United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 11

SEQ ID NO: 157033 - DNA, 20 bp, Artificial Sequence
  Description of Artificial Sequence: Synthetic oligonucleotide
  Target: ATXN1; (-) strand; PAM type: YTN; PAM sequence: TTG
actttcctcgaatttcatta

SEQ ID NO: 157034 - DNA, 20 bp, Artificial Sequence
  Description of Artificial Sequence: Synthetic oligonucleotide
  Target: ATXN1; (-) strand; PAM type: YTN; PAM sequence: CTT
gactttcctcgaatttcatt

SEQ ID NO: 157035 - DNA, 20 bp, Artificial Sequence
  Description of Artificial Sequence: Synthetic oligonucleotide
  Target: ATXN1; (-) strand; PAM type: YTN; PAM sequence: TTC
cttgactttcctcgaatttc

SEQ ID NO: 157036 - DNA, 20 bp, Artificial Sequence
  Description of Artificial Sequence: Synthetic oligonucleotide
  Target: ATXN1; (-) strand; PAM type: YTN; PAM sequence: CTA
gaatagttccttgactttcc

SEQ ID NO: 157037 - DNA, 20 bp, Artificial Sequence
  Description of Artificial Sequence: Synthetic oligonucleotide
  Target: ATXN1; (-) strand; PAM type: YTN; PAM sequence: TTA
gaatagctagaatagttcct

SEQ ID NO: 157038 - DNA, 20 bp, Artificial Sequence
  Description of Artificial Sequence: Synthetic oligonucleotide
  Target: ATXN1; (-) strand; PAM type: YTN; PAM sequence: TTT
agaatagctagaatagttcc

SEQ ID NO: 157039 - DNA, 20 bp, Artificial Sequence
  Description of Artificial Sequence: Synthetic oligonucleotide
  Target: ATXN1; (-) strand; PAM type: YTN; PAM sequence: TTG
aataggtttagaatagctag

SEQ ID NO: 157040 - DNA, 20 bp, Artificial Sequence
  Description of Artificial Sequence: Synthetic oligonucleotide
  Target: ATXN1; (-) strand; PAM type: YTN; PAM sequence: TTT
gaataggtttagaatagcta

SEQ ID NO: 157041 - DNA, 20 bp, Artificial Sequence
  Description of Artificial Sequence: Synthetic oligonucleotide
  Target: ATXN1; (-) strand; PAM type: YTN; PAM sequence: CTG
gggtgtaccaaaaacatttg

SEQ ID NO: 157042 - DNA, 20 bp, Artificial Sequence
  Description of Artificial Sequence: Synthetic oligonucleotide
  Target: ATXN1; (-) strand; PAM type: YTN; PAM sequence: TTC
tggggtgtaccaaaaacatt

SEQ ID NO: 157043 - DNA, 20 bp, Artificial Sequence
  Description of Artificial Sequence: Synthetic oligonucleotide
  Target: ATXN1; (-) strand; PAM type: YTN; PAM sequence: TTT
ctggggtgtaccaaaaacat

SEQ ID NO: 157044 - DNA, 20 bp, Artificial Sequence
  Description of Artificial Sequence: Synthetic oligonucleotide
  Target: ATXN1; (-) strand; PAM type: YTN; PAM sequence: TTT
tctggggtgtaccaaaaaca

SEQ ID NO: 157045 - DNA, 20 bp, Artificial Sequence
  Description of Artificial Sequence: Synthetic oligonucleotide
  Target: ATXN1; (-) strand; PAM type: YTN; PAM sequence: TTA
taaaccgttttctggggtgt

SEQ ID NO: 157046 - DNA, 20 bp, Artificial Sequence
  Description of Artificial Sequence: Synthetic oligonucleotide
  Target: ATXN1; (-) strand; PAM type: YTN; PAM sequence: TTT
ataaaccgttttctggggtg

SEQ ID NO: 157047 - DNA, 20 bp, Artificial Sequence
  Description of Artificial Sequence: Synthetic oligonucleotide
  Target: ATXN1; (-) strand; PAM type: YTN; PAM sequence: TTT
tataaaccgttttctggggt

SEQ ID NO: 157048 - DNA, 20 bp, Artificial Sequence
  Description of Artificial Sequence: Synthetic oligonucleotide
  Target: ATXN1; (-) strand; PAM type: YTN; PAM sequence: TTT
ttataaaccgttttctgggg

SEQ ID NO: 157049 - DNA, 20 bp, Artificial Sequence
  Description of Artificial Sequence: Synthetic oligonucleotide
  Target: ATXN1; (-) strand; PAM type: YTN; PAM sequence: CTA
atgatttttataaaccgttt

SEQ ID NO: 157050 - DNA, 20 bp, Artificial Sequence
  Description of Artificial Sequence: Synthetic oligonucleotide
  Target: ATXN1; (-) strand; PAM type: YTN; PAM sequence: TTC
accaggactaatgattttta

SEQ ID NO: 157051 - DNA, 20 bp, Artificial Sequence
  Description of Artificial Sequence: Synthetic oligonucleotide
  Target: ATXN1; (-) strand; PAM type: YTN; PAM sequence: TTA
gggttcaccaggactaatga

SEQ ID NO: 157052 - DNA, 20 bp, Artificial Sequence
  Description of Artificial Sequence: Synthetic oligonucleotide
  Target: ATXN1; (-) strand; PAM type: YTN; PAM sequence: TTT
agggttcaccaggactaatg

SEQ ID NO: 157053 - DNA, 20 bp, Artificial Sequence
  Description of Artificial Sequence: Synthetic oligonucleotide
  Target: ATXN1; (-) strand; PAM type: YTN; PAM sequence: TTA
catttagggttcaccaggac

SEQ ID NO: 157054 - DNA, 20 bp, Artificial Sequence
  Description of Artificial Sequence: Synthetic oligonucleotide
  Target: ATXN1; (-) strand; PAM type: YTN; PAM sequence: TTT
acatttagggttcaccagga

SEQ ID NO: 157055 - DNA, 20 bp, Artificial Sequence
  Description of Artificial Sequence: Synthetic oligonucleotide
  Target: ATXN1; (-) strand; PAM type: YTN; PAM sequence: TTC
atttacatttagggttcacc

SEQ ID NO: 157056 - DNA, 20 bp, Artificial Sequence
  Description of Artificial Sequence: Synthetic oligonucleotide
  Target: ATXN1; (-) strand; PAM type: YTN; PAM sequence: CTA
gtattcatttacatttaggg

SEQ ID NO: 157057 - DNA, 20 bp, Artificial Sequence
  Description of Artificial Sequence: Synthetic oligonucleotide
  Target: ATXN1; (-) strand; PAM type: YTN; PAM sequence: CTG
tctagtattcatttacattt

SEQ ID NO: 157058 - DNA, 20 bp, Artificial Sequence
  Description of Artificial Sequence: Synthetic oligonucleotide
  Target: ATXN1; (-) strand; PAM type: YTN; PAM sequence: TTG
gctgtctagtattcatttac

SEQ ID NO: 157059 - DNA, 20 bp, Artificial Sequence
  Description of Artificial Sequence: Synthetic oligonucleotide
  Target: ATXN1; (-) strand; PAM type: YTN; PAM sequence: TTT
ggctgtctagtattcattta

SEQ ID NO: 157060 - DNA, 20 bp, Artificial Sequence
  Description of Artificial Sequence: Synthetic oligonucleotide
  Target: ATXN1; (-) strand; PAM type: YTN; PAM sequence: TTT
tggctgtctagtattcattt

SEQ ID NO: 157061 - DNA, 20 bp, Artificial Sequence
  Description of Artificial Sequence: Synthetic oligonucleotide
  Target: ATXN1; (-) strand; PAM type: YTN; PAM sequence: CTG
gtatcaacccacattttggc

SEQ ID NO: 157062 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaatctggtatcaa

SEQ ID NO: 157063 - DNA, 20 bp, Artificial Sequence
  Description of Artificial Sequence: Synthetic oligonucleotide
  Target: ATXN1; (-) strand; PAM type: YTN; PAM sequence: TTC
acaaattaaaaaaaaaatct

SEQ ID NO: 157064 - DNA, 20 bp, Artificial Sequence
  Description of Artificial Sequence: Synthetic oligonucleotide
  Target: ATXN1; (-) strand; PAM type: YTN; PAM sequence: TTT
cacaaattaaaaaaaaaatc

SEQ ID NO: 157065 - DNA, 20 bp, Artificial Sequence
  Description of Artificial Sequence: Synthetic oligonucleotide
  Target: ATXN1; (-) strand; PAM type: YTN; PAM sequence: TTC
gtttcacaaattaaaaaaaa

SEQ ID NO: 157066 - DNA, 20 bp, Artificial Sequence
  Description of Artificial Sequence: Synthetic oligonucleotide
  Target: ATXN1; (-) strand; PAM type: YTN; PAM sequence: CTT
cgtttcacaaattaaaaaaa

SEQ ID NO: 157067 - DNA, 20 bp, Artificial Sequence
  Description of Artificial Sequence: Synthetic oligonucleotide
  Target: ATXN1; (-) strand; PAM type: YTN; PAM sequence: TTC
ttcgtttcacaaattaaaaa

SEQ ID NO: 157068 - DNA, 20 bp, Artificial Sequence
  Description of Artificial Sequence: Synthetic oligonucleotide
  Target: ATXN1; (-) strand; PAM type: YTN; PAM sequence: TTT
cttcgtttcacaaattaaaa

SEQ ID NO: 157069 - DNA, 20 bp, Artificial Sequence
  Description of Artificial Sequence: Synthetic oligonucleotide
  Target: ATXN1; (-) strand; PAM type: YTN; PAM sequence: CTT
tcttcgtttcacaaattaaa

SEQ ID NO: 157070 - DNA, 20 bp, Artificial Sequence
  Description of Artificial Sequence: Synthetic oligonucleotide
  Target: ATXN1; (-) strand; PAM type: YTN; PAM sequence: TTG
aaaatagtactttcttcgtt

SEQ ID NO: 157071 - DNA, 20 bp, Artificial Sequence
  Description of Artificial Sequence: Synthetic oligonucleotide
  Target: ATXN1; (-) strand; PAM type: YTN; PAM sequence: TTA
ccccattgaaaatagtactt

SEQ ID NO: 157072 - DNA, 20 bp, Artificial Sequence
  Description of Artificial Sequence: Synthetic oligonucleotide
  Target: ATXN1; (-) strand; PAM type: YTN; PAM sequence: TTT
accccattgaaaatagtact

SEQ ID NO: 157073 - DNA, 20 bp, Artificial Sequence
  Description of Artificial Sequence: Synthetic oligonucleotide
  Target: ATXN1; (-) strand; PAM type: YTN; PAM sequence: TTT
taccccattgaaaatagtac

SEQ ID NO: 157074 - DNA, 20 bp, Artificial Sequence
  Description of Artificial Sequence: Synthetic oligonucleotide
  Target: ATXN1; (-) strand; PAM type: YTN; PAM sequence: CTT
ttaccccattgaaaatagta

SEQ ID NO: 157075 - DNA, 20 bp, Artificial Sequence
  Description of Artificial Sequence: Synthetic oligonucleotide
  Target: ATXN1; (-) strand; PAM type: YTN; PAM sequence: TTC
ttttaccccattgaaaatag

SEQ ID NO: 157076 - DNA, 20 bp, Artificial Sequence
  Description of Artificial Sequence: Synthetic oligonucleotide
  Target: ATXN1; (-) strand; PAM type: YTN; PAM sequence: TTT
cttttaccccattgaaaata

SEQ ID NO: 157077 - DNA, 20 bp, Artificial Sequence
  Description of Artificial Sequence: Synthetic oligonucleotide
  Target: ATXN1; (-) strand; PAM type: YTN; PAM sequence: TTT
tcttttaccccattgaaaat

SEQ ID NO: 157078 - DNA, 20 bp, Artificial Sequence
  Description of Artificial Sequence: Synthetic oligonucleotide
  Target: ATXN1; (-) strand; PAM type: YTN; PAM sequence: CTT
ttcttttaccccattgaaaa

SEQ ID NO: 157079 - DNA, 20 bp, Artificial Sequence
  Description of Artificial Sequence: Synthetic oligonucleotide
  Target: ATXN1; (-) strand; PAM type: YTN; PAM sequence: CTG
acttttcttttaccccattg

SEQ ID NO: 157080 - DNA, 20 bp, Artificial Sequence
  Description of Artificial Sequence: Synthetic oligonucleotide
  Target: ATXN1; (-) strand; PAM type: YTN; PAM sequence: CTG
aacaaatacctgacttttct

SEQ ID NO: 157081 - DNA, 20 bp, Artificial Sequence
  Description of Artificial Sequence: Synthetic oligonucleotide
  Target: ATXN1; (-) strand; PAM type: YTN; PAM sequence: CTA
aactgaacaaatacctgact

SEQ ID NO: 157082 - DNA, 20 bp, Artificial Sequence
  Description of Artificial Sequence: Synthetic oligonucleotide
  Target: ATXN1; (-) strand; PAM type: YTN; PAM sequence: CTG
caactaaactgaacaaatac

SEQ ID NO: 157083 - DNA, 20 bp, Artificial Sequence
  Description of Artificial Sequence: Synthetic oligonucleotide
  Target: ATXN1; (-) strand; PAM type: YTN; PAM sequence: TTG
gatggctgcaactaaactga

SEQ ID NO: 157084 - DNA, 20 bp, Artificial Sequence
  Description of Artificial Sequence: Synthetic oligonucleotide
  Target: ATXN1; (-) strand; PAM type: YTN; PAM sequence: CTT
ggatggctgcaactaaactg

SEQ ID NO: 157085 - DNA, 20 bp, Artificial Sequence
  Description of Artificial Sequence: Synthetic oligonucleotide
  Target: ATXN1; (-) strand; PAM type: YTN; PAM sequence: TTA
cttggatggctgcaactaaa

SEQ ID NO: 157086 - DNA, 20 bp, Artificial Sequence
  Description of Artificial Sequence: Synthetic oligonucleotide
  Target: ATXN1; (-) strand; PAM type: YTN; PAM sequence: CTT
acttggatggctgcaactaa

SEQ ID NO: 157087 - DNA, 20 bp, Artificial Sequence
  Description of Artificial Sequence: Synthetic oligonucleotide
  Target: ATXN1; (-) strand; PAM type: YTN; PAM sequence: TTC
ttacttggatggctgcaact

SEQ ID NO: 157088 - DNA, 20 bp, Artificial Sequence
  Description of Artificial Sequence: Synthetic oligonucleotide
  Target: ATXN1; (-) strand; PAM type: YTN; PAM sequence: TTA
aatattcttacttggatggc

SEQ ID NO: 157089 - DNA, 20 bp, Artificial Sequence
  Description of Artificial Sequence: Synthetic oligonucleotide
  Target: ATXN1; (-) strand; PAM type: YTN; PAM sequence: TTT
aaatattcttacttggatgg

SEQ ID NO: 157090 - DNA, 20 bp, Artificial Sequence
  Description of Artificial Sequence: Synthetic oligonucleotide
  Target: ATXN1; (-) strand; PAM type: YTN; PAM sequence: TTT
taaatattcttacttggatg

SEQ ID NO: 157091 - DNA, 20 bp, Artificial Sequence
  Description of Artificial Sequence: Synthetic oligonucleotide
  Target: ATXN1; (-) strand; PAM type: YTN; PAM sequence: TTT
ttaaatattcttacttggat

SEQ ID NO: 157092 - DNA, 20 bp, Artificial Sequence
  Description of Artificial Sequence: Synthetic oligonucleotide
  Target: ATXN1; (-) strand; PAM type: YTN; PAM sequence: TTA
taagtagggagaaattttta

SEQ ID NO: 157093 - DNA, 20 bp, Artificial Sequence
  Description of Artificial Sequence: Synthetic oligonucleotide
  Target: ATXN1; (-) strand; PAM type: YTN; PAM sequence: TTT
ataagtagggagaaattttt

SEQ ID NO: 157094 - DNA, 20 bp, Artificial Sequence
  Description of Artificial Sequence: Synthetic oligonucleotide
  Target: ATXN1; (-) strand; PAM type: YTN; PAM sequence: TTT
tataagtagggagaaatttt

SEQ ID NO: 157095 - DNA, 20 bp, Artificial Sequence
  Description of Artificial Sequence: Synthetic oligonucleotide
  Target: ATXN1; (-) strand; PAM type: YTN; PAM sequence: TTA
aaaaaaagttttataagtag

SEQ ID NO: 157096 - DNA, 20 bp, Artificial Sequence
  Description of Artificial Sequence: Synthetic oligonucleotide
  Target: ATXN1; (-) strand; PAM type: YTN; PAM sequence: TTT
aaaaaaaagttttataagta

SEQ ID NO: 157097 - DNA, 20 bp, Artificial Sequence
  Description of Artificial Sequence: Synthetic oligonucleotide
  Target: ATXN1; (-) strand; PAM type: YTN; PAM sequence: CTT
taaaaaaaagttttataagt

SEQ ID NO: 157098 - DNA, 20 bp, Artificial Sequence
  Description of Artificial Sequence: Synthetic oligonucleotide
  Target: ATXN1; (-) strand; PAM type: YTN; PAM sequence: TTA
aagtgctttaaaaaaaagtt

SEQ ID NO: 157099 - DNA, 20 bp, Artificial Sequence
  Description of Artificial Sequence: Synthetic oligonucleotide
  Target: ATXN1; (-) strand; PAM type: YTN; PAM sequence: TTT
aaagtgctttaaaaaaaagt

SEQ ID NO: 157100 - DNA, 20 bp, Artificial Sequence
  Description of Artificial Sequence: Synthetic oligonucleotide
  Target: ATXN1; (-) strand; PAM type: YTN; PAM sequence: CTT
taaagtgctttaaaaaaaag

SEQ ID NO: 157101 - DNA, 20 bp, Artificial Sequence
  Description of Artificial Sequence: Synthetic oligonucleotide
  Target: ATXN1; (-) strand; PAM type: YTN; PAM sequence: TTG
aatgcatctttaaagtgctt

SEQ ID NO: 157102 - DNA, 20 bp, Artificial Sequence
  Description of Artificial Sequence: Synthetic oligonucleotide
  Target: ATXN1; (-) strand; PAM type: YTN; PAM sequence: TTT
gaatgcatctttaaagtgct

SEQ ID NO: 157103 - DNA, 20 bp, Artificial Sequence
  Description of Artificial Sequence: Synthetic oligonucleotide
  Target: ATXN1; (-) strand; PAM type: YTN; PAM sequence: TTT
tgaatgcatctttaaagtgc

SEQ ID NO: 157104 - DNA, 20 bp, Artificial Sequence
  Description of Artificial Sequence: Synthetic oligonucleotide
  Target: ATXN1; (-) strand; PAM type: YTN; PAM sequence: TTG
tgggttttgaatgcatcttt

SEQ ID NO: 157105 - DNA, 20 bp, Artificial Sequence
  Description of Artificial Sequence: Synthetic oligonucleotide
  Target: ATXN1; (-) strand; PAM type: YTN; PAM sequence: TTT
gtgggttttgaatgcatctt

SEQ ID NO: 157106 - DNA, 20 bp, Artificial Sequence
  Description of Artificial Sequence: Synthetic oligonucleotide
  Target: ATXN1; (-) strand; PAM type: YTN; PAM sequence: TTC
ccagagatccgaaatatcat

SEQ ID NO: 157107 - DNA, 20 bp, Artificial Sequence
  Description of Artificial Sequence: Synthetic oligonucleotide
  Target: ATXN1; (-) strand; PAM type: YTN; PAM sequence: TTC
attcccagagatccgaaata

SEQ ID NO: 157108 - DNA, 20 bp, Artificial Sequence
  Description of Artificial Sequence: Synthetic oligonucleotide
  Target: ATXN1; (-) strand; PAM type: YTN; PAM sequence: TTT
cattcccagagatccgaaat

SEQ ID NO: 157109 - DNA, 20 bp, Artificial Sequence
  Description of Artificial Sequence: Synthetic oligonucleotide
  Target: ATXN1; (-) strand; PAM type: YTN; PAM sequence: CTT
tcattcccagagatccgaaa

SEQ ID NO: 157110 - DNA, 20 bp, Artificial Sequence
  Description of Artificial Sequence: Synthetic oligonucleotide
  Target: ATXN1; (-) strand; PAM type: YTN; PAM sequence: TTA
aacctttcattcccagagat

SEQ ID NO: 157111 - DNA, 20 bp, Artificial Sequence
  Description of Artificial Sequence: Synthetic oligonucleotide
  Target: ATXN1; (-) strand; PAM type: YTN; PAM sequence: TTT
aaacctttcattcccagaga

SEQ ID NO: 157112 - DNA, 20 bp, Artificial Sequence
  Description of Artificial Sequence: Synthetic oligonucleotide
  Target: ATXN1; (-) strand; PAM type: YTN; PAM sequence: TTT
taaacctttcattcccagag

SEQ ID NO: 157113 - DNA, 20 bp, Artificial Sequence
  Description of Artificial Sequence: Synthetic oligonucleotide
  Target: ATXN1; (-) strand; PAM type: YTN; PAM sequence: TTT
ttaaacctttcattcccaga

SEQ ID NO: 157114 - DNA, 20 bp, Artificial Sequence
  Description of Artificial Sequence: Synthetic oligonucleotide
  Target: ATXN1; (-) strand; PAM type: YTN; PAM sequence: TTC
atagtttttaaacctttcat

SEQ ID NO: 157115 - DNA, 20 bp, Artificial Sequence
  Description of Artificial Sequence: Synthetic oligonucleotide
  Target: ATXN1; (-) strand; PAM type: YTN; PAM sequence: TTT
catagtttttaaacctttca

SEQ ID NO: 157116 - DNA, 20 bp, Artificial Sequence
  Description of Artificial Sequence: Synthetic oligonucleotide
  Target: ATXN1; (-) strand; PAM type: YTN; PAM sequence: TTG
gtacaaacccagaaagggta

SEQ ID NO: 157117 - DNA, 20 bp, Artificial Sequence
  Description of Artificial Sequence: Synthetic oligonucleotide
  Target: ATXN1; (-) strand; PAM type: YTN; PAM sequence: TTT
ggtacaaacccagaaagggt

SEQ ID NO: 157118 - DNA, 20 bp, Artificial Sequence
  Description of Artificial Sequence: Synthetic oligonucleotide
  Target: ATXN1; (-) strand; PAM type: YTN; PAM sequence: TTA
atgtttggtacaaacccaga

SEQ ID NO: 157119 - DNA, 20 bp, Artificial Sequence
  Description of Artificial Sequence: Synthetic oligonucleotide
  Target: ATXN1; (-) strand; PAM type: YTN; PAM sequence: TTT
aatgtttggtacaaacccag

SEQ ID NO: 157120 - DNA, 20 bp, Artificial Sequence
  Description of Artificial Sequence: Synthetic oligonucleotide
  Target: ATXN1; (-) strand; PAM type: YTN; PAM sequence: TTC
aaaatcaaatcgagatttaa

SEQ ID NO: 157121 - DNA, 20 bp, Artificial Sequence
  Description of Artificial Sequence: Synthetic oligonucleotide
  Target: ATXN1; (-) strand; PAM type: YTN; PAM sequence: CTA
ttcaaaatcaaatcgagatt

SEQ ID NO: 157122 - DNA, 20 bp, Artificial Sequence
  Description of Artificial Sequence: Synthetic oligonucleotide
  Target: ATXN1; (-) strand; PAM type: YTN; PAM sequence: TTC
tattcaaaatcaaatcgaga

SEQ ID NO: 157123 - DNA, 20 bp, Artificial Sequence
  Description of Artificial Sequence: Synthetic oligonucleotide
  Target: ATXN1; (-) strand; PAM type: YTN; PAM sequence: TTT
ctattcaaaatcaaatcgag

SEQ ID NO: 157124 - DNA, 20 bp, Artificial Sequence
  Description of Artificial Sequence: Synthetic oligonucleotide
  Target: ATXN1; (-) strand; PAM type: YTN; PAM sequence: TTT
tctattcaaaatcaaatcga

SEQ ID NO: 157125 - DNA, 20 bp, Artificial Sequence
  Description of Artificial Sequence: Synthetic oligonucleotide
  Target: ATXN1; (-) strand; PAM type: YTN; PAM sequence: TTT
ttctattcaaaatcaaatcg

SEQ ID NO: 157126 - DNA, 20 bp, Artificial Sequence
  Description of Artificial Sequence: Synthetic oligonucleotide
  Target: ATXN1; (-) strand; PAM type: YTN; PAM sequence: TTT
tttctattcaaaatcaaatc

SEQ ID NO: 157127 - DNA, 20 bp, Artificial Sequence
  Description of Artificial Sequence: Synthetic oligonucleotide
  Target: ATXN1; (-) strand; PAM type: YTN; PAM sequence: TTT
ttttctattcaaaatcaaat

SEQ ID NO: 157128 - DNA, 20 bp, Artificial Sequence
  Description of Artificial Sequence: Synthetic oligonucleotide
  Target: ATXN1; (-) strand; PAM type: YTN; PAM sequence: TTT
tttttctattcaaaatcaaa

SEQ ID NO: 157129 - DNA, 20 bp, Artificial Sequence
  Description of Artificial Sequence: Synthetic oligonucleotide
  Target: ATXN1; (-) strand; PAM type: YTN; PAM sequence: TTT
ttttttctattcaaaatcaa

SEQ ID NO: 157130 - DNA, 20 bp, Artificial Sequence
  Description of Artificial Sequence: Synthetic oligonucleotide
  Target: ATXN1; (-) strand; PAM type: YTN; PAM sequence: TTT
tttttttctattcaaaatca

SEQ ID NO: 157131 - DNA, 20 bp, Artificial Sequence
  Description of Artificial Sequence: Synthetic oligonucleotide
  Target: ATXN1; (-) strand; PAM type: YTN; PAM sequence: CTT
ttttttttctattcaaaatc

SEQ ID NO: 157132 - DNA, 20 bp, Artificial Sequence
  Description of Artificial Sequence: Synthetic oligonucleotide
  Target: ATXN1; (-) strand; PAM type: YTN; PAM sequence: TTC
agaatggcttttttttttct

SEQ ID NO: 157133 - DNA, 20 bp, Artificial Sequence
  Description of Artificial Sequence: Synthetic oligonucleotide
  Target: ATXN1; (-) strand; PAM type: YTN; PAM sequence: TTT
cagaatggcttttttttttc

SEQ ID NO: 157134 - DNA, 20 bp, Artificial Sequence
  Description of Artificial Sequence: Synthetic oligonucleotide
  Target: ATXN1; (-) strand; PAM type: YTN; PAM sequence: TTT
tcagaatggctttttttttt

SEQ ID NO: 157135 - DNA, 20 bp, Artificial Sequence
  Description of Artificial Sequence: Synthetic oligonucleotide
  Target: ATXN1; (-) strand; PAM type: YTN; PAM sequence: TTA
ttttcagaatggcttttttt

SEQ ID NO: 157136 - DNA, 20 bp, Artificial Sequence
  Description of Artificial Sequence: Synthetic oligonucleotide
  Target: ATXN1; (-) strand; PAM type: YTN; PAM sequence: TTA
atgttattttcagaatggct

SEQ ID NO: 157137 - DNA, 20 bp, Artificial Sequence
  Description of Artificial Sequence: Synthetic oligonucleotide
  Target: ATXN1; (-) strand; PAM type: YTN; PAM sequence: TTA
ttaatgttattttcagaatg

SEQ ID NO: 157138 - DNA, 20 bp, Artificial Sequence
  Description of Artificial Sequence: Synthetic oligonucleotide
  Target: ATXN1; (-) strand; PAM type: YTN; PAM sequence: TTG
ttattaatgttattttcaga

SEQ ID NO: 157139 - DNA, 20 bp, Artificial Sequence
  Description of Artificial Sequence: Synthetic oligonucleotide
  Target: ATXN1; (-) strand; PAM type: YTN; PAM sequence: TTG
ttgttattaatgttattttc

SEQ ID NO: 157140 - DNA, 20 bp, Artificial Sequence
  Description of Artificial Sequence: Synthetic oligonucleotide
  Target: ATXN1; (-) strand; PAM type: YTN; PAM sequence: TTA
ttgttgttattaatgttatt

SEQ ID NO: 157141 - DNA, 20 bp, Artificial Sequence
  Description of Artificial Sequence: Synthetic oligonucleotide
  Target: ATXN1; (-) strand; PAM type: YTN; PAM sequence: TTA
ttattgttgttattaatgtt

SEQ ID NO: 157142 - DNA, 20 bp, Artificial Sequence
  Description of Artificial Sequence: Synthetic oligonucleotide
  Target: ATXN1; (-) strand; PAM type: YTN; PAM sequence: TTT
attattgttgttattaatgt

SEQ ID NO: 157143 - DNA, 20 bp, Artificial Sequence
  Description of Artificial Sequence: Synthetic oligonucleotide
  Target: ATXN1; (-) strand; PAM type: YTN; PAM sequence: CTT
tattattgttgttattaatg

SEQ ID NO: 157144 - DNA, 20 bp, Artificial Sequence
  Description of Artificial Sequence: Synthetic oligonucleotide
  Target: ATXN1; (-) strand; PAM type: YTN; PAM sequence: TTA
ctttattattgttgttatta

SEQ ID NO: 157145 - DNA, 20 bp, Artificial Sequence
  Description of Artificial Sequence: Synthetic oligonucleotide
  Target: ATXN1; (-) strand; PAM type: YTN; PAM sequence: TTA
aacaattactttattattgt

SEQ ID NO: 157146 - DNA, 20 bp, Artificial Sequence
  Description of Artificial Sequence: Synthetic oligonucleotide
  Target: ATXN1; (-) strand; PAM type: YTN; PAM sequence: TTT
aaacaattactttattattg

SEQ ID NO: 157147 - DNA, 20 bp, Artificial Sequence
  Description of Artificial Sequence: Synthetic oligonucleotide
  Target: ATXN1; (-) strand; PAM type: YTN; PAM sequence: TTT
taaacaattactttattatt

SEQ ID NO: 157148 - DNA, 20 bp, Artificial Sequence
  Description of Artificial Sequence: Synthetic oligonucleotide
  Target: ATXN1; (-) strand; PAM type: YTN; PAM sequence: TTT
ttaaacaattactttattat

SEQ ID NO: 157149 - DNA, 20 bp, Artificial Sequence
  Description of Artificial Sequence: Synthetic oligonucleotide
  Target: ATXN1; (-) strand; PAM type: YTN; PAM sequence: TTT
tttaaacaattactttatta

SEQ ID NO: 157150 - DNA, 20 bp, Artificial Sequence
  Description of Artificial Sequence: Synthetic oligonucleotide
  Target: ATXN1; (-) strand; PAM type: YTN; PAM sequence: TTT
ttttaaacaattactttatt

SEQ ID NO: 157151 - DNA, 20 bp, Artificial Sequence
  Description of Artificial Sequence: Synthetic oligonucleotide
  Target: ATXN1; (-) strand; PAM type: YTN; PAM sequence: TTT
tttttaaacaattactttat

SEQ ID NO: 157152 - DNA, 20 bp, Artificial Sequence
  Description of Artificial Sequence: Synthetic oligonucleotide
  Target: ATXN1; (-) strand; PAM type: YTN; PAM sequence: TTA
tatatgtgagcaagattttt

SEQ ID NO: 157153 - DNA, 20 bp, Artificial Sequence
  Description of Artificial Sequence: Synthetic oligonucleotide
  Target: ATXN1; (-) strand; PAM type: YTN; PAM sequence: TTT
atatatgtgagcaagatttt

SEQ ID NO: 157154 - DNA, 20 bp, Artificial Sequence
  Description of Artificial Sequence: Synthetic oligonucleotide
  Target: ATXN1; (-) strand; PAM type: YTN; PAM sequence: TTC
cataaagacatttatatatg

SEQ ID NO: 157155 - DNA, 20 bp, Artificial Sequence
  Description of Artificial Sequence: Synthetic oligonucleotide
  Target: ATXN1; (-) strand; PAM type: YTN; PAM sequence: TTT
ccataaagacatttatatat

SEQ ID NO: 157156 - DNA, 20 bp, Artificial Sequence
  Description of Artificial Sequence: Synthetic oligonucleotide
  Target: ATXN1; (-) strand; PAM type: YTN; PAM sequence: TTT
tccataaagacatttatata

SEQ ID NO: 157157 - DNA, 20 bp, Artificial Sequence
  Description of Artificial Sequence: Synthetic oligonucleotide
  Target: ATXN1; (-) strand; PAM type: YTN; PAM sequence: TTG
agagagttttccataaagac

SEQ ID NO: 157158 - DNA, 20 bp, Artificial Sequence
  Description of Artificial Sequence: Synthetic oligonucleotide
  Target: ATXN1; (-) strand; PAM type: YTN; PAM sequence: TTC
attgagagagttttccataa

SEQ ID NO: 157159 - DNA, 20 bp, Artificial Sequence
  Description of Artificial Sequence: Synthetic oligonucleotide
  Target: ATXN1; (-) strand; PAM type: YTN; PAM sequence: TTC
agattcattgagagagtttt

SEQ ID NO: 157160 - DNA, 20 bp, Artificial Sequence
  Description of Artificial Sequence: Synthetic oligonucleotide
  Target: ATXN1; (-) strand; PAM type: YTN; PAM sequence: CTT
cagattcattgagagagttt

SEQ ID NO: 157161 - DNA, 20 bp, Artificial Sequence
  Description of Artificial Sequence: Synthetic oligonucleotide
  Target: ATXN1; (-) strand; PAM type: YTN; PAM sequence: TTC
ttcagattcattgagagagt

SEQ ID NO: 157162 - DNA, 20 bp, Artificial Sequence
  Description of Artificial Sequence: Synthetic oligonucleotide
  Target: ATXN1; (-) strand; PAM type: YTN; PAM sequence: TTT
cttcagattcattgagagag

SEQ ID NO: 157163 - DNA, 20 bp, Artificial Sequence
  Description of Artificial Sequence: Synthetic oligonucleotide
  Target: ATXN1; (-) strand; PAM type: YTN; PAM sequence: TTT
tcttcagattcattgagaga

SEQ ID NO: 157164 - DNA, 20 bp, Artificial Sequence
  Description of Artificial Sequence: Synthetic oligonucleotide
  Target: ATXN1; (-) strand; PAM type: YTN; PAM sequence: CTG
agaattttcttcagattcat

SEQ ID NO: 157165 - DNA, 20 bp, Artificial Sequence
  Description of Artificial Sequence: Synthetic oligonucleotide
  Target: ATXN1; (-) strand; PAM type: YTN; PAM sequence: CTC
tgagaattttcttcagattc

SEQ ID NO: 157166 - DNA, 20 bp, Artificial Sequence
  Description of Artificial Sequence: Synthetic oligonucleotide
  Target: ATXN1; (-) strand; PAM type: YTN; PAM sequence: TTA
gaaactctgagaattttctt

SEQ ID NO: 157167 - DNA, 20 bp, Artificial Sequence
  Description of Artificial Sequence: Synthetic oligonucleotide
  Target: ATXN1; (-) strand; PAM type: YTN; PAM sequence: CTT
agaaactctgagaattttct

SEQ ID NO: 157168 - DNA, 20 bp, Artificial Sequence
  Description of Artificial Sequence: Synthetic oligonucleotide
  Target: ATXN1; (-) strand; PAM type: YTN; PAM sequence: CTC
ttagaaactctgagaatttt

SEQ ID NO: 157169 - DNA, 20 bp, Artificial Sequence
  Description of Artificial Sequence: Synthetic oligonucleotide
  Target: ATXN1; (-) strand; PAM type: YTN; PAM sequence: TTA
gcgggctcttagaaactctg

SEQ ID NO: 157170 - DNA, 20 bp, Artificial Sequence
  Description of Artificial Sequence: Synthetic oligonucleotide
  Target: ATXN1; (-) strand; PAM type: YTN; PAM sequence: CTT
agcgggctcttagaaactct

SEQ ID NO: 157171 - DNA, 20 bp, Artificial Sequence
  Description of Artificial Sequence: Synthetic oligonucleotide
  Target: ATXN1; (-) strand; PAM type: YTN; PAM sequence: CTG
tcacaaaaagccaggtctta

SEQ ID NO: 157172 - DNA, 20 bp, Artificial Sequence
  Description of Artificial Sequence: Synthetic oligonucleotide
  Target: ATXN1; (-) strand; PAM type: YTN; PAM sequence: TTA
ccacatctgtcacaaaaagc

SEQ ID NO: 157173 - DNA, 20 bp, Artificial Sequence
  Description of Artificial Sequence: Synthetic oligonucleotide
  Target: ATXN1; (-) strand; PAM type: YTN; PAM sequence: TTT
accacatctgtcacaaaaag

SEQ ID NO: 157174 - DNA, 20 bp, Artificial Sequence
  Description of Artificial Sequence: Synthetic oligonucleotide
  Target: ATXN1; (-) strand; PAM type: YTN; PAM sequence: TTT
taccacatctgtcacaaaaa

SEQ ID NO: 157175 - DNA, 20 bp, Artificial Sequence
  Description of Artificial Sequence: Synthetic oligonucleotide
  Target: ATXN1; (-) strand; PAM type: YTN; PAM sequence: TTT
ttaccacatctgtcacaaaa

SEQ ID NO: 157176 - DNA, 20 bp, Artificial Sequence
  Description of Artificial Sequence: Synthetic oligonucleotide
  Target: ATXN1; (-) strand; PAM type: YTN; PAM sequence: CTT
tttaccacatctgtcacaaa

SEQ ID NO: 157177 - DNA, 20 bp, Artificial Sequence
  Description of Artificial Sequence: Synthetic oligonucleotide
  Target: ATXN1; (-) strand; PAM type: YTN; PAM sequence: TTG
gtctttttaccacatctgtc

SEQ ID NO: 157178 - DNA, 20 bp, Artificial Sequence
  Description of Artificial Sequence: Synthetic oligonucleotide
  Target: ATXN1; (-) strand; PAM type: YTN; PAM sequence: TTT
ggtctttttaccacatctgt

SEQ ID NO: 157179 - DNA, 20 bp, Artificial Sequence
  Description of Artificial Sequence: Synthetic oligonucleotide
  Target: ATXN1; (-) strand; PAM type: YTN; PAM sequence: TTT
tggtctttttaccacatctg

SEQ ID NO: 157180 - DNA, 20 bp, Artificial Sequence
  Description of Artificial Sequence: Synthetic oligonucleotide
  Target: ATXN1; (-) strand; PAM type: YTN; PAM sequence: TTC
attttggtctttttaccaca

SEQ ID NO: 157181 - DNA, 20 bp, Artificial Sequence
  Description of Artificial Sequence: Synthetic oligonucleotide
  Target: ATXN1; (-) strand; PAM type: YTN; PAM sequence: TTG
aaaattcattttggtctttt

SEQ ID NO: 157182 - DNA, 20 bp, Artificial Sequence
  Description of Artificial Sequence: Synthetic oligonucleotide
  Target: ATXN1; (-) strand; PAM type: YTN; PAM sequence: TTT
gaaaattcattttggtcttt

SEQ ID NO: 157183 - DNA, 20 bp, Artificial Sequence
  Description of Artificial Sequence: Synthetic oligonucleotide
  Target: ATXN1; (-) strand; PAM type: YTN; PAM sequence: CTT
tgaaaattcattttggtctt

SEQ ID NO: 157184 - DNA, 20 bp, Artificial Sequence
  Description of Artificial Sequence: Synthetic oligonucleotide
  Target: ATXN1; (-) strand; PAM type: YTN; PAM sequence: TTC
ctttgaaaattcattttggt

SEQ ID NO: 157185 - DNA, 20 bp, Artificial Sequence
  Description of Artificial Sequence: Synthetic oligonucleotide
  Target: ATXN1; (-) strand; PAM type: YTN; PAM sequence: TTA
tgttcctttgaaaattcatt

SEQ ID NO: 157186 - DNA, 20 bp, Artificial Sequence
  Description of Artificial Sequence: Synthetic oligonucleotide
  Target: ATXN1; (-) strand; PAM type: YTN; PAM sequence: TTA
taaggttatgttcctttgaa

SEQ ID NO: 157187 - DNA, 20 bp, Artificial Sequence
  Description of Artificial Sequence: Synthetic oligonucleotide
  Target: ATXN1; (-) strand; PAM type: YTN; PAM sequence: TTT
ataaggttatgttcctttga

SEQ ID NO: 157188 - DNA, 20 bp, Artificial Sequence
  Description of Artificial Sequence: Synthetic oligonucleotide
  Target: ATXN1; (-) strand; PAM type: YTN; PAM sequence: TTT
tataaggttatgttcctttg

SEQ ID NO: 157189 - DNA, 20 bp, Artificial Sequence
  Description of Artificial Sequence: Synthetic oligonucleotide
  Target: ATXN1; (-) strand; PAM type: YTN; PAM sequence: CTA
ggccattttataaggttatg

SEQ ID NO: 157190 - DNA, 20 bp, Artificial Sequence
  Description of Artificial Sequence: Synthetic oligonucleotide
  Target: ATXN1; (-) strand; PAM type: YTN; PAM sequence: CTC
taggccattttataaggtta

SEQ ID NO: 157191 - DNA, 20 bp, Artificial Sequence
  Description of Artificial Sequence: Synthetic oligonucleotide
  Target: ATXN1; (-) strand; PAM type: YTN; PAM sequence: CTA
aactctaggccattttataa

SEQ ID NO: 157192 - DNA, 20 bp, Artificial Sequence
  Description of Artificial Sequence: Synthetic oligonucleotide
  Target: ATXN1; (-) strand; PAM type: YTN; PAM sequence: CTG
cctaaactctaggccatttt

SEQ ID NO: 157193 - DNA, 20 bp, Artificial Sequence
  Description of Artificial Sequence: Synthetic oligonucleotide
  Target: ATXN1; (-) strand; PAM type: YTN; PAM sequence: CTA
acctgcctaaactctaggcc

SEQ ID NO: 157194 - DNA, 20 bp, Artificial Sequence
  Description of Artificial Sequence: Synthetic oligonucleotide
  Target: ATXN1; (-) strand; PAM type: YTN; PAM sequence: TTC
taacctgcctaaactctagg

SEQ ID NO: 157195 - DNA, 20 bp, Artificial Sequence
  Description of Artificial Sequence: Synthetic oligonucleotide
  Target: ATXN1; (-) strand; PAM type: YTN; PAM sequence: TTT
ctaacctgcctaaactctag

SEQ ID NO: 157196 - DNA, 20 bp, Artificial Sequence
  Description of Artificial Sequence: Synthetic oligonucleotide
  Target: ATXN1; (-) strand; PAM type: YTN; PAM sequence: CTT
tctaacctgcctaaactcta

SEQ ID NO: 157197 - DNA, 20 bp, Artificial Sequence
  Description of Artificial Sequence: Synthetic oligonucleotide
  Target: ATXN1; (-) strand; PAM type: YTN; PAM sequence: TTC
tttctaacctgcctaaactc

SEQ ID NO: 157198 - DNA, 20 bp, Artificial Sequence
  Description of Artificial Sequence: Synthetic oligonucleotide
  Target: ATXN1; (-) strand; PAM type: YTN; PAM sequence: TTT
ctttctaacctgcctaaact

SEQ ID NO: 157199 - DNA, 20 bp, Artificial Sequence
  Description of Artificial Sequence: Synthetic oligonucleotide
  Target: ATXN1; (-) strand; PAM type: YTN; PAM sequence: CTG
aacgagcataaataaatgta

SEQ ID NO: 157200 - DNA, 20 bp, Artificial Sequence
  Description of Artificial Sequence: Synthetic oligonucleotide
  Target: ATXN1; (-) strand; PAM type: YTN; PAM sequence: TTG
ggggactgaacgagcataaa

SEQ ID NO: 157201 - DNA, 20 bp, Artificial Sequence
  Description of Artificial Sequence: Synthetic oligonucleotide
  Target: ATXN1; (-) strand; PAM type: YTN; PAM sequence: TTT
gggggactgaacgagcataa

SEQ ID NO: 157202 - DNA, 20 bp, Artificial Sequence
  Description of Artificial Sequence: Synthetic oligonucleotide
  Target: ATXN1; (-) strand; PAM type: YTN; PAM sequence: TTG
tgggaaaggtttgggggact

SEQ ID NO: 157203 - DNA, 20 bp, Artificial Sequence
  Description of Artificial Sequence: Synthetic oligonucleotide
  Target: ATXN1; (-) strand; PAM type: YTN; PAM sequence: TTA
tccaataacattgtgggaaa

SEQ ID NO: 157204 - DNA, 20 bp, Artificial Sequence
  Description of Artificial Sequence: Synthetic oligonucleotide
  Target: ATXN1; (-) strand; PAM type: YTN; PAM sequence: TTT
atccaataacattgtgggaa

SEQ ID NO: 157205 - DNA, 20 bp, Artificial Sequence
  Description of Artificial Sequence: Synthetic oligonucleotide
  Target: ATXN1; (-) strand; PAM type: YTN; PAM sequence: TTT
tatccaataacattgtggga

SEQ ID NO: 157206 - DNA, 20 bp, Artificial Sequence
  Description of Artificial Sequence: Synthetic oligonucleotide
  Target: ATXN1; (-) strand; PAM type: YTN; PAM sequence: TTT
ttatccaataacattgtggg

SEQ ID NO: 157207 - DNA, 20 bp, Artificial Sequence
  Description of Artificial Sequence: Synthetic oligonucleotide
  Target: ATXN1; (-) strand; PAM type: YTN; PAM sequence: CTG
cagtttttatccaataacat

SEQ ID NO: 157208 - DNA, 20 bp, Artificial Sequence
  Description of Artificial Sequence: Synthetic oligonucleotide
  Target: ATXN1; (-) strand; PAM type: YTN; PAM sequence: TTC
ctgcagtttttatccaataa

SEQ ID NO: 157209 - DNA, 20 bp, Artificial Sequence
  Description of Artificial Sequence: Synthetic oligonucleotide
  Target: ATXN1; (-) strand; PAM type: YTN; PAM sequence: TTG
tgtgatattcctgcagtttt

SEQ ID NO: 157210 - DNA, 20 bp, Artificial Sequence
  Description of Artificial Sequence: Synthetic oligonucleotide
  Target: ATXN1; (-) strand; PAM type: YTN; PAM sequence: CTT
gtgtgatattcctgcagttt

SEQ ID NO: 157211 - DNA, 20 bp, Artificial Sequence
  Description of Artificial Sequence: Synthetic oligonucleotide
  Target: ATXN1; (-) strand; PAM type: YTN; PAM sequence: TTA
taacttgtgtgatattcctg

SEQ ID NO: 157212 - DNA, 20 bp, Artificial Sequence
  Description of Artificial Sequence: Synthetic oligonucleotide
  Target: ATXN1; (-) strand; PAM type: YTN; PAM sequence: TTT
ataacttgtgtgatattcct

SEQ ID NO: 157213 - DNA, 20 bp, Artificial Sequence
  Description of Artificial Sequence: Synthetic oligonucleotide
  Target: ATXN1; (-) strand; PAM type: YTN; PAM sequence: TTG
agtttataacttgtgtgata

SEQ ID NO: 157214 - DNA, 20 bp, Artificial Sequence
  Description of Artificial Sequence: Synthetic oligonucleotide
  Target: ATXN1; (-) strand; PAM type: YTN; PAM sequence: TTG
cacatattgagtttataact

SEQ ID NO: 157215 - DNA, 20 bp, Artificial Sequence
  Description of Artificial Sequence: Synthetic oligonucleotide
  Target: ATXN1; (-) strand; PAM type: YTN; PAM sequence: TTT
gcacatattgagtttataac

SEQ ID NO: 157216 - DNA, 20 bp, Artificial Sequence
  Description of Artificial Sequence: Synthetic oligonucleotide
  Target: ATXN1; (-) strand; PAM type: YTN; PAM sequence: TTG
cgatttgcacatattgagtt

SEQ ID NO: 157217 - DNA, 20 bp, Artificial Sequence
  Description of Artificial Sequence: Synthetic oligonucleotide
  Target: ATXN1; (-) strand; PAM type: YTN; PAM sequence: CTT
gcgatttgcacatattgagt

SEQ ID NO: 157218 - DNA, 20 bp, Artificial Sequence
  Description of Artificial Sequence: Synthetic oligonucleotide
  Target: ATXN1; (-) strand; PAM type: YTN; PAM sequence: TTA
aagaaccttgcgatttgcac

SEQ ID NO: 157219 - DNA, 20 bp, Artificial Sequence
  Description of Artificial Sequence: Synthetic oligonucleotide
  Target: ATXN1; (-) strand; PAM type: YTN; PAM sequence: TTT
aaagaaccttgcgatttgca

SEQ ID NO: 157220 - DNA, 20 bp, Artificial Sequence
  Description of Artificial Sequence: Synthetic oligonucleotide
  Target: ATXN1; (-) strand; PAM type: YTN; PAM sequence: TTT
taaagaaccttgcgatttgc

SEQ ID NO: 157221 - DNA, 20 bp, Artificial Sequence
  Description of Artificial Sequence: Synthetic oligonucleotide
  Target: ATXN1; (-) strand; PAM type: YTN; PAM sequence: CTT
ttaaagaaccttgcgatttg

SEQ ID NO: 157222 - DNA, 20 bp, Artificial Sequence
  Description of Artificial Sequence: Synthetic oligonucleotide
  Target: ATXN1; (-) strand; PAM type: YTN; PAM sequence: TTA
agatgaacttttaaagaacc

SEQ ID NO: 157223 - DNA, 20 bp, Artificial Sequence
  Description of Artificial Sequence: Synthetic oligonucleotide
  Target: ATXN1; (-) strand; PAM type: YTN; PAM sequence: TTT
aagatgaacttttaaagaac

SEQ ID NO: 157224 - DNA, 20 bp, Artificial Sequence
  Description of Artificial Sequence: Synthetic oligonucleotide
  Target: ATXN1; (-) strand; PAM type: YTN; PAM sequence: TTT
taagatgaacttttaaagaa

SEQ ID NO: 157225 - DNA, 20 bp, Artificial Sequence
  Description of Artificial Sequence: Synthetic oligonucleotide
  Target: ATXN1; (-) strand; PAM type: YTN; PAM sequence: TTT
ttaagatgaacttttaaaga

SEQ ID NO: 157226 - DNA, 20 bp, Artificial Sequence
  Description of Artificial Sequence: Synthetic oligonucleotide
  Target: ATXN1; (-) strand; PAM type: YTN; PAM sequence: CTT
tttaagatgaacttttaaag

SEQ ID NO: 157227 - DNA, 20 bp, Artificial Sequence
  Description of Artificial Sequence: Synthetic oligonucleotide
  Target: ATXN1; (-) strand; PAM type: YTN; PAM sequence: TTC
tttttaagatgaacttttaa

SEQ ID NO: 157228 - DNA, 20 bp, Artificial Sequence
  Description of Artificial Sequence: Synthetic oligonucleotide
  Target: ATXN1; (-) strand; PAM type: YTN; PAM sequence: TTT
ctttttaagatgaactttta

SEQ ID NO: 157229 - DNA, 20 bp, Artificial Sequence
  Description of Artificial Sequence: Synthetic oligonucleotide
  Target: ATXN1; (-) strand; PAM type: YTN; PAM sequence: TTT
tctttttaagatgaactttt

SEQ ID NO: 157230 - DNA, 20 bp, Artificial Sequence
  Description of Artificial Sequence: Synthetic oligonucleotide
  Target: ATXN1; (-) strand; PAM type: YTN; PAM sequence: TTT
ttctttttaagatgaacttt

SEQ ID NO: 157231 - DNA, 20 bp, Artificial Sequence
  Description of Artificial Sequence: Synthetic oligonucleotide
  Target: ATXN1; (-) strand; PAM type: YTN; PAM sequence: TTG
tccagtgtttttctttttaa

SEQ ID NO: 157232 - DNA, 20 bp, Artificial Sequence
  Description of Artificial Sequence: Synthetic oligonucleotide
  Target: ATXN1; (-) strand; PAM type: YTN; PAM sequence: TTT
gtccagtgtttttcttttta

SEQ ID NO: 157233 - DNA, 20 bp, Artificial Sequence
  Description of Artificial Sequence: Synthetic oligonucleotide
  Target: ATXN1; (-) strand; PAM type: YTN; PAM sequence: TTT
tgtccagtgtttttcttttt

SEQ ID NO: 157234 - DNA, 20 bp, Artificial Sequence
  Description of Artificial Sequence: Synthetic oligonucleotide
  Target: ATXN1; (-) strand; PAM type: YTN; PAM sequence: TTT
ttgtccagtgtttttctttt

SEQ ID NO: 157235 - DNA, 20 bp, Artificial Sequence
  Description of Artificial Sequence: Synthetic oligonucleotide
  Target: ATXN1; (-) strand; PAM type: YTN; PAM sequence: CTC
atttttgtccagtgtttttc

SEQ ID NO: 157236 - DNA, 20 bp, Artificial Sequence
  Description of Artificial Sequence: Synthetic oligonucleotide
  Target: ATXN1; (-) strand; PAM type: YTN; PAM sequence: CTG
agagaaaagggatggagaag

SEQ ID NO: 157237 - DNA, 20 bp, Artificial Sequence
  Description of Artificial Sequence: Synthetic oligonucleotide
  Target: ATXN1; (-) strand; PAM type: YTN; PAM sequence: TTG
gcagagaaactgagagaaaa

SEQ ID NO: 157238 - DNA, 20 bp, Artificial Sequence
  Description of Artificial Sequence: Synthetic oligonucleotide
  Target: ATXN1; (-) strand; PAM type: YTN; PAM sequence: TTC
aaggcatatgcagagttggc

SEQ ID NO: 157239 - DNA, 20 bp, Artificial Sequence
  Description of Artificial Sequence: Synthetic oligonucleotide
  Target: ATXN1; (-) strand; PAM type: YTN; PAM sequence: CTG
agaatcagttcaaggcatat

SEQ ID NO: 157240 - DNA, 20 bp, Artificial Sequence
  Description of Artificial Sequence: Synthetic oligonucleotide
  Target: ATXN1; (-) strand; PAM type: YTN; PAM sequence: TTG
atgtctgagaatcagttcaa

SEQ ID NO: 157241 - DNA, 20 bp, Artificial Sequence
  Description of Artificial Sequence: Synthetic oligonucleotide
  Target: ATXN1; (-) strand; PAM type: YTN; PAM sequence: TTT
gatgtctgagaatcagttca

SEQ ID NO: 157242 - DNA, 20 bp, Artificial Sequence
  Description of Artificial Sequence: Synthetic oligonucleotide
  Target: ATXN1; (-) strand; PAM type: YTN; PAM sequence: CTT
tgatgtctgagaatcagttc

SEQ ID NO: 157243 - DNA, 20 bp, Artificial Sequence
  Description of Artificial Sequence: Synthetic oligonucleotide
  Target: ATXN1; (-) strand; PAM type: YTN; PAM sequence: TTC
actttgatgtctgagaatca

SEQ ID NO: 157244 - DNA, 20 bp, Artificial Sequence
  Description of Artificial Sequence: Synthetic oligonucleotide
  Target: ATXN1; (-) strand; PAM type: YTN; PAM sequence: TTT
cactttgatgtctgagaatc

SEQ ID NO: 157245 - DNA, 20 bp, Artificial Sequence
  Description of Artificial Sequence: Synthetic oligonucleotide
  Target: ATXN1; (-) strand; PAM type: YTN; PAM sequence: TTT
tcactttgatgtctgagaat

SEQ ID NO: 157246 - DNA, 20 bp, Artificial Sequence
  Description of Artificial Sequence: Synthetic oligonucleotide
  Target: ATXN1; (-) strand; PAM type: YTN; PAM sequence: CTT
ttcactttgatgtctgagaa

SEQ ID NO: 157247 - DNA, 20 bp, Artificial Sequence
  Description of Artificial Sequence: Synthetic oligonucleotide
  Target: ATXN1; (-) strand; PAM type: YTN; PAM sequence: CTG
acgggaggcacttttcactt

SEQ ID NO: 157248 - DNA, 20 bp, Artificial Sequence
  Description of Artificial Sequence: Synthetic oligonucleotide
  Target: ATXN1; (-) strand; PAM type: YTN; PAM sequence: CTA
cctgacgggaggcacttttc

SEQ ID NO: 157249 - DNA, 20 bp, Artificial Sequence
  Description of Artificial Sequence: Synthetic oligonucleotide
  Target: ATXN1; (-) strand; PAM type: YTN; PAM sequence: CTA
gtatgtgacaataaatgacc

SEQ ID NO: 157250 - DNA, 20 bp, Artificial Sequence
  Description of Artificial Sequence: Synthetic oligonucleotide
  Target: ATXN1; (-) strand; PAM type: YTN; PAM sequence: TTA
tgaactagtatgtgacaata

SEQ ID NO: 157251 - DNA, 20 bp, Artificial Sequence
  Description of Artificial Sequence: Synthetic oligonucleotide
  Target: ATXN1; (-) strand; PAM type: YTN; PAM sequence: TTA
aagggatgaatgtgaattat

SEQ ID NO: 157252 - DNA, 20 bp, Artificial Sequence
  Description of Artificial Sequence: Synthetic oligonucleotide
  Target: ATXN1; (-) strand; PAM type: YTN; PAM sequence: TTT
aaagggatgaatgtgaatta

SEQ ID NO: 157253 - DNA, 20 bp, Artificial Sequence
  Description of Artificial Sequence: Synthetic oligonucleotide
  Target: ATXN1; (-) strand; PAM type: YTN; PAM sequence: TTC
aatgtggtttaaagggatga

SEQ ID NO: 157254 - DNA, 20 bp, Artificial Sequence
  Description of Artificial Sequence: Synthetic oligonucleotide
  Target: ATXN1; (-) strand; PAM type: YTN; PAM sequence: TTT
caatgtggtttaaagggatg

SEQ ID NO: 157255 - DNA, 20 bp, Artificial Sequence
  Description of Artificial Sequence: Synthetic oligonucleotide
  Target: ATXN1; (-) strand; PAM type: YTN; PAM sequence: TTG
aaagtttcaatgtggtttaa

SEQ ID NO: 157256 - DNA, 20 bp, Artificial Sequence
  Description of Artificial Sequence: Synthetic oligonucleotide
  Target: ATXN1; (-) strand; PAM type: YTN; PAM sequence: CTG
aagagcaagatattgaaagt

SEQ ID NO: 157257 - DNA, 20 bp, Artificial Sequence
  Description of Artificial Sequence: Synthetic oligonucleotide
  Target: ATXN1; (-) strand; PAM type: YTN; PAM sequence: TTG
ctgaagagcaagatattgaa

SEQ ID NO: 157258 - DNA, 20 bp, Artificial Sequence
  Description of Artificial Sequence: Synthetic oligonucleotide
  Target: ATXN1; (-) strand; PAM type: YTN; PAM sequence: CTG
cagaattgctgaagagcaag

SEQ ID NO: 157259 - DNA, 20 bp, Artificial Sequence
  Description of Artificial Sequence: Synthetic oligonucleotide
  Target: ATXN1; (-) strand; PAM type: YTN; PAM sequence: CTC
tgcagaattgctgaagagca

SEQ ID NO: 157260 - DNA, 20 bp, Artificial Sequence
  Description of Artificial Sequence: Synthetic oligonucleotide
  Target: ATXN1; (-) strand; PAM type: YTN; PAM sequence: TTC
agctctgcagaattgctgaa

SEQ ID NO: 157261 - DNA, 20 bp, Artificial Sequence
  Description of Artificial Sequence: Synthetic oligonucleotide
  Target: ATXN1; (-) strand; PAM type: YTN; PAM sequence: TTT
cagctctgcagaattgctga

SEQ ID NO: 157262 - DNA, 20 bp, Artificial Sequence
  Description of Artificial Sequence: Synthetic oligonucleotide
  Target: ATXN1; (-) strand; PAM type: YTN; PAM sequence: CTA
catttcagctctgcagaatt

SEQ ID NO: 157263 - DNA, 20 bp, Artificial Sequence
  Description of Artificial Sequence: Synthetic oligonucleotide
  Target: ATXN1; (-) strand; PAM type: YTN; PAM sequence: CTG
taactacatttcagctctgc

SEQ ID NO: 157264 - DNA, 20 bp, Artificial Sequence
  Description of Artificial Sequence: Synthetic oligonucleotide
  Target: ATXN1; (-) strand; PAM type: YTN; PAM sequence: TTC
aacactgtaactacatttca

SEQ ID NO: 157265 - DNA, 20 bp, Artificial Sequence
  Description of Artificial Sequence: Synthetic oligonucleotide
  Target: ATXN1; (-) strand; PAM type: YTN; PAM sequence: TTT
caacactgtaactacatttc

SEQ ID NO: 157266 - DNA, 20 bp, Artificial Sequence
  Description of Artificial Sequence: Synthetic oligonucleotide
  Target: ATXN1; (-) strand; PAM type: YTN; PAM sequence: TTT
tcaacactgtaactacattt

SEQ ID NO: 157267 - DNA, 20 bp, Artificial Sequence
  Description of Artificial Sequence: Synthetic oligonucleotide
  Target: ATXN1; (-) strand; PAM type: YTN; PAM sequence: TTT
ttcaacactgtaactacatt

SEQ ID NO: 157268 - DNA, 20 bp, Artificial Sequence
  Description of Artificial Sequence: Synthetic oligonucleotide
  Target: ATXN1; (-) strand; PAM type: YTN; PAM sequence: TTT
tttcaacactgtaactacat

SEQ ID NO: 157269 - DNA, 20 bp, Artificial Sequence
  Description of Artificial Sequence: Synthetic oligonucleotide
  Target: ATXN1; (-) strand; PAM type: YTN; PAM sequence: TTT
ttttcaacactgtaactaca

SEQ ID NO: 157270 - DNA, 20 bp, Artificial Sequence
  Description of Artificial Sequence: Synthetic oligonucleotide
  Target: ATXN1; (-) strand; PAM type: YTN; PAM sequence: CTT
tttttcaacactgtaactac

SEQ ID NO: 157271 - DNA, 20 bp, Artificial Sequence
  Description of Artificial Sequence: Synthetic oligonucleotide
  Target: ATXN1; (-) strand; PAM type: YTN; PAM sequence: TTC
tttttttcaacactgtaact

SEQ ID NO: 157272 - DNA, 20 bp, Artificial Sequence
  Description of Artificial Sequence: Synthetic oligonucleotide
  Target: ATXN1; (-) strand; PAM type: YTN; PAM sequence: TTT
ctttttttcaacactgtaac

SEQ ID NO: 157273 - DNA, 20 bp, Artificial Sequence
  Description of Artificial Sequence: Synthetic oligonucleotide
  Target: ATXN1; (-) strand; PAM type: YTN; PAM sequence: CTT
tctttttttcaacactgtaa

SEQ ID NO: 157274 - DNA, 20 bp, Artificial Sequence
  Description of Artificial Sequence: Synthetic oligonucleotide
  Target: ATXN1; (-) strand; PAM type: YTN; PAM sequence: TTG
ctttctttttttcaacactg

SEQ ID NO: 157275 - DNA, 20 bp, Artificial Sequence
  Description of Artificial Sequence: Synthetic oligonucleotide
  Target: ATXN1; (-) strand; PAM type: YTN; PAM sequence: CTA
agttgctttctttttttcaa

SEQ ID NO: 157276 - DNA, 20 bp, Artificial Sequence
  Description of Artificial Sequence: Synthetic oligonucleotide
  Target: ATXN1; (-) strand; PAM type: YTN; PAM sequence: TTG
gggaaaaaacaaaaacaaaa

SEQ ID NO: 157277 - DNA, 20 bp, Artificial Sequence
  Description of Artificial Sequence: Synthetic oligonucleotide
  Target: ATXN1; (-) strand; PAM type: YTN; PAM sequence: TTT
ggggaaaaaacaaaaacaaa

SEQ ID NO: 157278 - DNA, 20 bp, Artificial Sequence
  Description of Artificial Sequence: Synthetic oligonucleotide
  Target: ATXN1; (-) strand; PAM type: YTN; PAM sequence: CTT
tggggaaaaaacaaaaacaa

SEQ ID NO: 157279 - DNA, 20 bp, Artificial Sequence
  Description of Artificial Sequence: Synthetic oligonucleotide
  Target: ATXN1; (-) strand; PAM type: YTN; PAM sequence: CTC
tttggggaaaaaacaaaaac

SEQ ID NO: 157280 - DNA, 20 bp, Artificial Sequence
  Description of Artificial Sequence: Synthetic oligonucleotide
  Target: ATXN1; (-) strand; PAM type: YTN; PAM sequence: TTA
aactctttggggaaaaaaca

SEQ ID NO: 157281 - DNA, 20 bp, Artificial Sequence
  Description of Artificial Sequence: Synthetic oligonucleotide
  Target: ATXN1; (-) strand; PAM type: YTN; PAM sequence: TTT
aaactctttggggaaaaaac

SEQ ID NO: 157282 - DNA, 20 bp, Artificial Sequence
  Description of Artificial Sequence: Synthetic oligonucleotide
  Target: ATXN1; (-) strand; PAM type: YTN; PAM sequence: CTT
taaactctttggggaaaaaa

SEQ ID NO: 157283 - DNA, 20 bp, Artificial Sequence
  Description of Artificial Sequence: Synthetic oligonucleotide
  Target: ATXN1; (-) strand; PAM type: YTN; PAM sequence: CTC
actttaaactctttggggaa

SEQ ID NO: 157284 - DNA, 20 bp, Artificial Sequence
  Description of Artificial Sequence: Synthetic oligonucleotide
  Target: ATXN1; (-) strand; PAM type: YTN; PAM sequence: CTG
tatctcactttaaactcttt

SEQ ID NO: 157285 - DNA, 20 bp, Artificial Sequence
  Description of Artificial Sequence: Synthetic oligonucleotide
  Target: ATXN1; (-) strand; PAM type: YTN; PAM sequence: TTC
aacaagtactgtatctcact

SEQ ID NO: 157286 - DNA, 20 bp, Artificial Sequence
  Description of Artificial Sequence: Synthetic oligonucleotide
  Target: ATXN1; (-) strand; PAM type: YTN; PAM sequence: CTC
attcaacaagtactgtatct

SEQ ID NO: 157287 - DNA, 20 bp, Artificial Sequence
  Description of Artificial Sequence: Synthetic oligonucleotide
  Target: ATXN1; (-) strand; PAM type: YTN; PAM sequence: CTC
tcattcaacaagtactgtat

SEQ ID NO: 157288 - DNA, 20 bp, Artificial Sequence
  Description of Artificial Sequence: Synthetic oligonucleotide
  Target: ATXN1; (-) strand; PAM type: YTN; PAM sequence: TTG
gtctctcattcaacaagtac

SEQ ID NO: 157289 - DNA, 20 bp, Artificial Sequence
  Description of Artificial Sequence: Synthetic oligonucleotide
  Target: ATXN1; (-) strand; PAM type: YTN; PAM sequence: CTT
ggtctctcattcaacaagta

SEQ ID NO: 157290 - DNA, 20 bp, Artificial Sequence
  Description of Artificial Sequence: Synthetic oligonucleotide
  Target: ATXN1; (-) strand; PAM type: YTN; PAM sequence: TTA
ccaagcatcttggtctctca

SEQ ID NO: 157291 - DNA, 20 bp, Artificial Sequence
  Description of Artificial Sequence: Synthetic oligonucleotide
  Target: ATXN1; (-) strand; PAM type: YTN; PAM sequence: TTA
ttaccaagcatcttggtctc

SEQ ID NO: 157292 - DNA, 20 bp, Artificial Sequence
  Description of Artificial Sequence: Synthetic oligonucleotide
  Target: ATXN1; (-) strand; PAM type: YTN; PAM sequence: TTT
attaccaagcatcttggtct

SEQ ID NO: 157293 - DNA, 20 bp, Artificial Sequence
  Description of Artificial Sequence: Synthetic oligonucleotide
  Target: ATXN1; (-) strand; PAM type: YTN; PAM sequence: CTT
tattaccaagcatcttggtc

SEQ ID NO: 157294 - DNA, 20 bp, Artificial Sequence
  Description of Artificial Sequence: Synthetic oligonucleotide
  Target: ATXN1; (-) strand; PAM type: YTN; PAM sequence: TTC
acactttattaccaagcatc

SEQ ID NO: 157295 - DNA, 20 bp, Artificial Sequence
  Description of Artificial Sequence: Synthetic oligonucleotide
  Target: ATXN1; (-) strand; PAM type: YTN; PAM sequence: CTG
ttcacactttattaccaagc

SEQ ID NO: 157296 - DNA, 20 bp, Artificial Sequence
  Description of Artificial Sequence: Synthetic oligonucleotide
  Target: ATXN1; (-) strand; PAM type: YTN; PAM sequence: TTA
aaaatactgttcacacttta

SEQ ID NO: 157297 - DNA, 20 bp, Artificial Sequence
  Description of Artificial Sequence: Synthetic oligonucleotide
  Target: ATXN1; (-) strand; PAM type: YTN; PAM sequence: TTT
aaaaatactgttcacacttt

SEQ ID NO: 157298 - DNA, 20 bp, Artificial Sequence
  Description of Artificial Sequence: Synthetic oligonucleotide
  Target: ATXN1; (-) strand; PAM type: YTN; PAM sequence: TTA
agcatttaaaaatactgttc

SEQ ID NO: 157299 - DNA, 20 bp, Artificial Sequence
  Description of Artificial Sequence: Synthetic oligonucleotide
  Target: ATXN1; (-) strand; PAM type: YTN; PAM sequence: TTT
aagcatttaaaaatactgtt

SEQ ID NO: 157300 - DNA, 20 bp, Artificial Sequence
  Description of Artificial Sequence: Synthetic oligonucleotide
  Target: ATXN1; (-) strand; PAM type: YTN; PAM sequence: CTT
taagcatttaaaaatactgt

SEQ ID NO: 157301 - DNA, 20 bp, Artificial Sequence
  Description of Artificial Sequence: Synthetic oligonucleotide
  Target: ATXN1; (-) strand; PAM type: YTN; PAM sequence: CTA
tctttaagcatttaaaaata

SEQ ID NO: 157302 - DNA, 20 bp, Artificial Sequence
  Description of Artificial Sequence: Synthetic oligonucleotide
  Target: ATXN1; (-) strand; PAM type: YTN; PAM sequence: TTA
ctatctttaagcatttaaaa

SEQ ID NO: 157303 - DNA, 20 bp, Artificial Sequence
  Description of Artificial Sequence: Synthetic oligonucleotide
  Target: ATXN1; (-) strand; PAM type: YTN; PAM sequence: TTG
aagatgagcatatattacta

SEQ ID NO: 157304 - DNA, 20 bp, Artificial Sequence
  Description of Artificial Sequence: Synthetic oligonucleotide
  Target: ATXN1; (-) strand; PAM type: YTN; PAM sequence: TTT
gaagatgagcatatattact

SEQ ID NO: 157305 - DNA, 20 bp, Artificial Sequence
  Description of Artificial Sequence: Synthetic oligonucleotide
  Target: ATXN1; (-) strand; PAM type: YTN; PAM sequence: TTT
tgaagatgagcatatattac

SEQ ID NO: 157306 - DNA, 20 bp, Artificial Sequence
  Description of Artificial Sequence: Synthetic oligonucleotide
  Target: ATXN1; (-) strand; PAM type: YTN; PAM sequence: TTA
gattttgaagatgagcatat

SEQ ID NO: 157307 - DNA, 20 bp, Artificial Sequence
  Description of Artificial Sequence: Synthetic oligonucleotide
  Target: ATXN1; (-) strand; PAM type: YTN; PAM sequence: TTC
cagtgtgacatgaggaatta

SEQ ID NO: 157308 - DNA, 20 bp, Artificial Sequence
  Description of Artificial Sequence: Synthetic oligonucleotide
  Target: ATXN1; (-) strand; PAM type: YTN; PAM sequence: TTC
agattccagtgtgacatgag

SEQ ID NO: 157309 - DNA, 20 bp, Artificial Sequence
  Description of Artificial Sequence: Synthetic oligonucleotide
  Target: ATXN1; (-) strand; PAM type: YTN; PAM sequence: TTT
cagattccagtgtgacatga

SEQ ID NO: 157310 - DNA, 20 bp, Artificial Sequence
  Description of Artificial Sequence: Synthetic oligonucleotide
  Target: ATXN1; (-) strand; PAM type: YTN; PAM sequence: TTT
tcagattccagtgtgacatg

SEQ ID NO: 157311 - DNA, 20 bp, Artificial Sequence
  Description of Artificial Sequence: Synthetic oligonucleotide
  Target: ATXN1; (-) strand; PAM type: YTN; PAM sequence: TTT
ttcagattccagtgtgacat

SEQ ID NO: 157312 - DNA, 20 bp, Artificial Sequence
  Description of Artificial Sequence: Synthetic oligonucleotide
  Target: ATXN1; (-) strand; PAM type: YTN; PAM sequence: TTT
tttcagattccagtgtgaca

SEQ ID NO: 157313 - DNA, 20 bp, Artificial Sequence
  Description of Artificial Sequence: Synthetic oligonucleotide
  Target: ATXN1; (-) strand; PAM type: YTN; PAM sequence: TTT
ttttcagattccagtgtgac

SEQ ID NO: 157314 - DNA, 20 bp, Artificial Sequence
  Description of Artificial Sequence: Synthetic oligonucleotide
  Target: ATXN1; (-) strand; PAM type: YTN; PAM sequence: TTT
tttttcagattccagtgtga

SEQ ID NO: 157315 - DNA, 20 bp, Artificial Sequence
  Description of Artificial Sequence: Synthetic oligonucleotide
  Target: ATXN1; (-) strand; PAM type: YTN; PAM sequence: TTT
ttttttcagattccagtgtg

SEQ ID NO: 157316 - DNA, 20 bp, Artificial Sequence
  Description of Artificial Sequence: Synthetic oligonucleotide
  Target: ATXN1; (-) strand; PAM type: YTN; PAM sequence: TTT
tttttttcagattccagtgt

SEQ ID NO: 157317 - DNA, 20 bp, Artificial Sequence
  Description of Artificial Sequence: Synthetic oligonucleotide
  Target: ATXN1; (-) strand; PAM type: YTN; PAM sequence: TTT
ttttttttcagattccagtg

SEQ ID NO: 157318 - DNA, 20 bp, Artificial Sequence
  Description of Artificial Sequence: Synthetic oligonucleotide
  Target: ATXN1; (-) strand; PAM type: YTN; PAM sequence: TTT
tttttttttcagattccagt

SEQ ID NO: 157319 - DNA, 20 bp, Artificial Sequence
  Description of Artificial Sequence: Synthetic oligonucleotide
  Target: ATXN1; (-) strand; PAM type: YTN; PAM sequence: TTT
ttttttttttcagattccag

SEQ ID NO: 157320 - DNA, 20 bp, Artificial Sequence
  Description of Artificial Sequence: Synthetic oligonucleotide
  Target: ATXN1; (-) strand; PAM type: YTN; PAM sequence: CTT
tttttttttttcagattcca

SEQ ID NO: 157321 - DNA, 20 bp, Artificial Sequence
  Description of Artificial Sequence: Synthetic oligonucleotide
  Target: ATXN1; (-) strand; PAM type: YTN; PAM sequence: CTC
gggtgccacttttttttttt

SEQ ID NO: 157322 - DNA, 20 bp, Artificial Sequence
  Description of Artificial Sequence: Synthetic oligonucleotide
  Target: ATXN1; (-) strand; PAM type: YTN; PAM sequence: CTA
tggacaactcgggtgccact

SEQ ID NO: 157323 - DNA, 20 bp, Artificial Sequence
  Description of Artificial Sequence: Synthetic oligonucleotide
  Target: ATXN1; (-) strand; PAM type: YTN; PAM sequence: TTC
atgactatggacaactcggg

SEQ ID NO: 157324 - DNA, 20 bp, Artificial Sequence
  Description of Artificial Sequence: Synthetic oligonucleotide
  Target: ATXN1; (-) strand; PAM type: YTN; PAM sequence: TTA
tagttcatgactatggacaa

SEQ ID NO: 157325 - DNA, 20 bp, Artificial Sequence
  Description of Artificial Sequence: Synthetic oligonucleotide
  Target: ATXN1; (-) strand; PAM type: YTN; PAM sequence: TTT
atagttcatgactatggaca

SEQ ID NO: 157326 - DNA, 20 bp, Artificial Sequence
  Description of Artificial Sequence: Synthetic oligonucleotide
  Target: ATXN1; (-) strand; PAM type: YTN; PAM sequence: CTG
tttatagttcatgactatgg

SEQ ID NO: 157327 - DNA, 20 bp, Artificial Sequence
  Description of Artificial Sequence: Synthetic oligonucleotide
  Target: ATXN1; (-) strand; PAM type: YTN; PAM sequence: CTA
gtactgtttatagttcatga

SEQ ID NO: 157328 - DNA, 20 bp, Artificial Sequence
  Description of Artificial Sequence: Synthetic oligonucleotide
  Target: ATXN1; (-) strand; PAM type: YTN; PAM sequence: CTC
tagtactgtttatagttcat

SEQ ID NO: 157329 - DNA, 20 bp, Artificial Sequence
  Description of Artificial Sequence: Synthetic oligonucleotide
  Target: ATXN1; (-) strand; PAM type: YTN; PAM sequence: TTG
aactctagtactgtttatag

SEQ ID NO: 157330 - DNA, 20 bp, Artificial Sequence
  Description of Artificial Sequence: Synthetic oligonucleotide
  Target: ATXN1; (-) strand; PAM type: YTN; PAM sequence: TTT
gaactctagtactgtttata

SEQ ID NO: 157331 - DNA, 20 bp, Artificial Sequence
  Description of Artificial Sequence: Synthetic oligonucleotide
  Target: ATXN1; (-) strand; PAM type: YTN; PAM sequence: CTT
tgaactctagtactgtttat

SEQ ID NO: 157332 - DNA, 20 bp, Artificial Sequence
  Description of Artificial Sequence: Synthetic oligonucleotide
  Target: ATXN1; (-) strand; PAM type: YTN; PAM sequence: TTG
tctttgaactctagtactgt

SEQ ID NO: 157333 - DNA, 20 bp, Artificial Sequence
  Description of Artificial Sequence: Synthetic oligonucleotide
  Target: ATXN1; (-) strand; PAM type: YTN; PAM sequence: TTT
gtctttgaactctagtactg

SEQ ID NO: 157334 - DNA, 20 bp, Artificial Sequence
  Description of Artificial Sequence: Synthetic oligonucleotide
  Target: ATXN1; (-) strand; PAM type: YTN; PAM sequence: TTT
tgtctttgaactctagtact

SEQ ID NO: 157335 - DNA, 20 bp, Artificial Sequence
  Description of Artificial Sequence: Synthetic oligonucleotide
  Target: ATXN1; (-) strand; PAM type: YTN; PAM sequence: TTT
ttgtctttgaactctagtac

SEQ ID NO: 157336 - DNA, 20 bp, Artificial Sequence
  Description of Artificial Sequence: Synthetic oligonucleotide
  Target: ATXN1; (-) strand; PAM type: YTN; PAM sequence: CTT
tttgtctttgaactctagta

SEQ ID NO: 157337 - DNA, 20 bp, Artificial Sequence
  Description of Artificial Sequence: Synthetic oligonucleotide
  Target: ATXN1; (-) strand; PAM type: YTN; PAM sequence: TTG
cgaaatctttttgtctttga

SEQ ID NO: 157338 - DNA, 20 bp, Artificial Sequence
  Description of Artificial Sequence: Synthetic oligonucleotide
  Target: ATXN1; (-) strand; PAM type: YTN; PAM sequence: TTT
gcgaaatctttttgtctttg

SEQ ID NO: 157339 - DNA, 20 bp, Artificial Sequence
  Description of Artificial Sequence: Synthetic oligonucleotide
  Target: ATXN1; (-) strand; PAM type: YTN; PAM sequence: TTG
agtttgcgaaatctttttgt

SEQ ID NO: 157340 - DNA, 20 bp, Artificial Sequence
  Description of Artificial Sequence: Synthetic oligonucleotide
  Target: ATXN1; (-) strand; PAM type: YTN; PAM sequence: TTC
acgttgagtttgcgaaatct

SEQ ID NO: 157341 - DNA, 20 bp, Artificial Sequence
  Description of Artificial Sequence: Synthetic oligonucleotide
  Target: ATXN1; (-) strand; PAM type: YTN; PAM sequence: CTT
cacgttgagtttgcgaaatc

SEQ ID NO: 157342 - DNA, 20 bp, Artificial Sequence
  Description of Artificial Sequence: Synthetic oligonucleotide
  Target: ATXN1; (-) strand; PAM type: YTN; PAM sequence: CTC
ttcacgttgagtttgcgaaa

SEQ ID NO: 157343 - DNA, 20 bp, Artificial Sequence
  Description of Artificial Sequence: Synthetic oligonucleotide
  Target: ATXN1; (-) strand; PAM type: YTN; PAM sequence: TTC
agtgagagcaacagaagctc

SEQ ID NO: 157344 - DNA, 20 bp, Artificial Sequence
  Description of Artificial Sequence: Synthetic oligonucleotide
  Target: ATXN1; (-) strand; PAM type: YTN; PAM sequence: CTT
cagtgagagcaacagaagct

SEQ ID NO: 157345 - DNA, 20 bp, Artificial Sequence
  Description of Artificial Sequence: Synthetic oligonucleotide
  Target: ATXN1; (-) strand; PAM type: YTN; PAM sequence: CTG
cccttcagtgagagcaacag

SEQ ID NO: 157346 - DNA, 20 bp, Artificial Sequence
  Description of Artificial Sequence: Synthetic oligonucleotide
  Target: ATXN1; (-) strand; PAM type: YTN; PAM sequence: CTC
ccaagaggtagatgcaaact

SEQ ID NO: 157347 - DNA, 20 bp, Artificial Sequence
  Description of Artificial Sequence: Synthetic oligonucleotide
  Target: ATXN1; (-) strand; PAM type: YTN; PAM sequence: TTC
actcccaagaggtagatgca

SEQ ID NO: 157348 - DNA, 20 bp, Artificial Sequence
  Description of Artificial Sequence: Synthetic oligonucleotide
  Target: ATXN1; (-) strand; PAM type: YTN; PAM sequence: CTT
cactcccaagaggtagatgc

SEQ ID NO: 157349 - DNA, 20 bp, Artificial Sequence
  Description of Artificial Sequence: Synthetic oligonucleotide
  Target: ATXN1; (-) strand; PAM type: YTN; PAM sequence: TTG
acttcactcccaagaggtag

SEQ ID NO: 157350 - DNA, 20 bp, Artificial Sequence
  Description of Artificial Sequence: Synthetic oligonucleotide
  Target: ATXN1; (-) strand; PAM type: YTN; PAM sequence: TTG
cattgacttcactcccaaga

SEQ ID NO: 157351 - DNA, 20 bp, Artificial Sequence
  Description of Artificial Sequence: Synthetic oligonucleotide
  Target: ATXN1; (-) strand; PAM type: YTN; PAM sequence: TTA
ttgcattgacttcactccca

SEQ ID NO: 157352 - DNA, 20 bp, Artificial Sequence
  Description of Artificial Sequence: Synthetic oligonucleotide
  Target: ATXN1; (-) strand; PAM type: YTN; PAM sequence: TTA
ggaaaaccaatcaggttatt

SEQ ID NO: 157353 - DNA, 20 bp, Artificial Sequence
  Description of Artificial Sequence: Synthetic oligonucleotide
  Target: ATXN1; (-) strand; PAM type: YTN; PAM sequence: CTG
tgcagtgttaggaaaaccaa

SEQ ID NO: 157354 - DNA, 20 bp, Artificial Sequence
  Description of Artificial Sequence: Synthetic oligonucleotide
  Target: ATXN1; (-) strand; PAM type: YTN; PAM sequence: TTC
tgtgcagtgttaggaaaacc

SEQ ID NO: 157355 - DNA, 20 bp, Artificial Sequence
  Description of Artificial Sequence: Synthetic oligonucleotide
  Target: ATXN1; (-) strand; PAM type: YTN; PAM sequence: TTT
ctgtgcagtgttaggaaaac

SEQ ID NO: 157356 - DNA, 20 bp, Artificial Sequence
  Description of Artificial Sequence: Synthetic oligonucleotide
  Target: ATXN1; (-) strand; PAM type: YTN; PAM sequence: CTG
gtttctgtgcagtgttagga

SEQ ID NO: 157357 - DNA, 20 bp, Artificial Sequence
  Description of Artificial Sequence: Synthetic oligonucleotide
  Target: ATXN1; (-) strand; PAM type: YTN; PAM sequence: TTG
ggggtgggggagagggagag

SEQ ID NO: 157358 - DNA, 20 bp, Artificial Sequence
  Description of Artificial Sequence: Synthetic oligonucleotide
  Target: ATXN1; (-) strand; PAM type: YTN; PAM sequence: CTG
tcatggccccacatggggta

SEQ ID NO: 157359 - DNA, 20 bp, Artificial Sequence
  Description of Artificial Sequence: Synthetic oligonucleotide
  Target: ATXN1; (-) strand; PAM type: YTN; PAM sequence: CTG
ctgtcatggccccacatggg

SEQ ID NO: 157360 - DNA, 20 bp, Artificial Sequence
  Description of Artificial Sequence: Synthetic oligonucleotide
  Target: ATXN1; (-) strand; PAM type: YTN; PAM sequence: TTG
tggtggacagggaagcccct

SEQ ID NO: 157361 - DNA, 20 bp, Artificial Sequence
  Description of Artificial Sequence: Synthetic oligonucleotide
  Target: ATXN1; (-) strand; PAM type: YTN; PAM sequence: CTA
gtgcagcgatgtcaccaggg

SEQ ID NO: 157362 - DNA, 20 bp, Artificial Sequence
  Description of Artificial Sequence: Synthetic oligonucleotide
  Target: ATXN1; (-) strand; PAM type: YTN; PAM sequence: TTA
ctagtgcagcgatgtcacca

SEQ ID NO: 157363 - DNA, 20 bp, Artificial Sequence
  Description of Artificial Sequence: Synthetic oligonucleotide
  Target: ATXN1; (-) strand; PAM type: YTN; PAM sequence: TTT
actagtgcagcgatgtcacc

SEQ ID NO: 157364 - DNA, 20 bp, Artificial Sequence
  Description of Artificial Sequence: Synthetic oligonucleotide
  Target: ATXN1; (-) strand; PAM type: YTN; PAM sequence: TTT
tactagtgcagcgatgtcac

SEQ ID NO: 157365 - DNA, 20 bp, Artificial Sequence
  Description of Artificial Sequence: Synthetic oligonucleotide
  Target: ATXN1; (-) strand; PAM type: YTN; PAM sequence: TTT
ttactagtgcagcgatgtca

SEQ ID NO: 157366 - DNA, 20 bp, Artificial Sequence
  Description of Artificial Sequence: Synthetic oligonucleotide
  Target: ATXN1; (-) strand; PAM type: YTN; PAM sequence: CTT
tttactagtgcagcgatgtc

SEQ ID NO: 157367 - DNA, 20 bp, Artificial Sequence
  Description of Artificial Sequence: Synthetic oligonucleotide
  Target: ATXN1; (-) strand; PAM type: YTN; PAM sequence: CTG
ctttttactagtgcagcgat

SEQ ID NO: 157368 - DNA, 20 bp, Artificial Sequence
  Description of Artificial Sequence: Synthetic oligonucleotide
  Target: ATXN1; (-) strand; PAM type: YTN; PAM sequence: TTC
tgctttttactagtgcagcg

SEQ ID NO: 157369 - DNA, 20 bp, Artificial Sequence
  Description of Artificial Sequence: Synthetic oligonucleotide
  Target: ATXN1; (-) strand; PAM type: YTN; PAM sequence: TTT
ctgctttttactagtgcagc

SEQ ID NO: 157370 - DNA, 20 bp, Artificial Sequence
  Description of Artificial Sequence: Synthetic oligonucleotide
  Target: ATXN1; (-) strand; PAM type: YTN; PAM sequence: TTC
atttctgctttttactagtg

SEQ ID NO: 157371 - DNA, 20 bp, Artificial Sequence
  Description of Artificial Sequence: Synthetic oligonucleotide
  Target: ATXN1; (-) strand; PAM type: YTN; PAM sequence: TTT
catttctgctttttactagt

SEQ ID NO: 157372 - DNA, 20 bp, Artificial Sequence
  Description of Artificial Sequence: Synthetic oligonucleotide
  Target: ATXN1; (-) strand; PAM type: YTN; PAM sequence: CTG
ccacatgcgggatttcattt

SEQ ID NO: 157373 - DNA, 20 bp, Artificial Sequence
  Description of Artificial Sequence: Synthetic oligonucleotide
  Target: ATXN1; (-) strand; PAM type: YTN; PAM sequence: TTA
aagagcaactgccacatgcg

SEQ ID NO: 157374 - DNA, 20 bp, Artificial Sequence
  Description of Artificial Sequence: Synthetic oligonucleotide
  Target: ATXN1; (-) strand; PAM type: YTN; PAM sequence: TTT
aaagagcaactgccacatgc

SEQ ID NO: 157375 - DNA, 20 bp, Artificial Sequence
  Description of Artificial Sequence: Synthetic oligonucleotide
  Target: ATXN1; (-) strand; PAM type: YTN; PAM sequence: TTT
taaagagcaactgccacatg

SEQ ID NO: 157376 - DNA, 20 bp, Artificial Sequence
  Description of Artificial Sequence: Synthetic oligonucleotide
  Target: ATXN1; (-) strand; PAM type: YTN; PAM sequence: TTT
ttaaagagcaactgccacat

SEQ ID NO: 157377 - DNA, 20 bp, Artificial Sequence
  Description of Artificial Sequence: Synthetic oligonucleotide
  Target: ATXN1; (-) strand; PAM type: YTN; PAM sequence: TTT
tttaaagagcaactgccaca

SEQ ID NO: 157378 - DNA, 20 bp, Artificial Sequence
  Description of Artificial Sequence: Synthetic oligonucleotide
  Target: ATXN1; (-) strand; PAM type: YTN; PAM sequence: TTT
ttttaaagagcaactgccac

SEQ ID NO: 157379 - DNA, 20 bp, Artificial Sequence
  Description of Artificial Sequence: Synthetic oligonucleotide
  Target: ATXN1; (-) strand; PAM type: YTN; PAM sequence: TTT
tttttaaagagcaactgcca

SEQ ID NO: 157380 - DNA, 20 bp, Artificial Sequence
  Description of Artificial Sequence: Synthetic oligonucleotide
  Target: ATXN1; (-) strand; PAM type: YTN; PAM sequence: CTG
atatatattttttttaaaga

SEQ ID NO: 157381 - DNA, 20 bp, Artificial Sequence
  Description of Artificial Sequence: Synthetic oligonucleotide
  Target: ATXN1; (-) strand; PAM type: YTN; PAM sequence: CTG
cactgatatatatttttttt

SEQ ID NO: 157382 - DNA, 20 bp, Artificial Sequence
  Description of Artificial Sequence: Synthetic oligonucleotide
  Target: ATXN1; (-) strand; PAM type: YTN; PAM sequence: CTG
actgcactgatatatatttt

SEQ ID NO: 157383 - DNA, 20 bp, Artificial Sequence
  Description of Artificial Sequence: Synthetic oligonucleotide
  Target: ATXN1; (-) strand; PAM type: YTN; PAM sequence: CTA
tggggcctgactgcactgat

SEQ ID NO: 157384 - DNA, 20 bp, Artificial Sequence
  Description of Artificial Sequence: Synthetic oligonucleotide
  Target: ATXN1; (-) strand; PAM type: YTN; PAM sequence: TTC
cccctatggggcctgactgc

SEQ ID NO: 157385 - DNA, 20 bp, Artificial Sequence
  Description of Artificial Sequence: Synthetic oligonucleotide
  Target: ATXN1; (-) strand; PAM type: YTN; PAM sequence: TTT
ccccctatggggcctgactg

SEQ ID NO: 157386 - DNA, 20 bp, Artificial Sequence
  Description of Artificial Sequence: Synthetic oligonucleotide
  Target: ATXN1; (-) strand; PAM type: YTN; PAM sequence: TTG
tatagatatatatttccccc

SEQ ID NO: 157387 - DNA, 20 bp, Artificial Sequence
  Description of Artificial Sequence: Synthetic oligonucleotide
  Target: ATXN1; (-) strand; PAM type: YTN; PAM sequence: TTA
attgtatagatatatatttc

SEQ ID NO: 157388 - DNA, 20 bp, Artificial Sequence
  Description of Artificial Sequence: Synthetic oligonucleotide
  Target: ATXN1; (-) strand; PAM type: YTN; PAM sequence: TTT
aattgtatagatatatattt

SEQ ID NO: 157389 - DNA, 20 bp, Artificial Sequence
  Description of Artificial Sequence: Synthetic oligonucleotide
  Target: ATXN1; (-) strand; PAM type: YTN; PAM sequence: TTT
taattgtatagatatatatt

SEQ ID NO: 157390 - DNA, 20 bp, Artificial Sequence
  Description of Artificial Sequence: Synthetic oligonucleotide
  Target: ATXN1; (-) strand; PAM type: YTN; PAM sequence: CTT
ttaattgtatagatatatat

SEQ ID NO: 157391 - DNA, 20 bp, Artificial Sequence
  Description of Artificial Sequence: Synthetic oligonucleotide
  Target: ATXN1; (-) strand; PAM type: YTN; PAM sequence: TTA
caataaaagcaacttttaat

SEQ ID NO: 157392 - DNA, 20 bp, Artificial Sequence
  Description of Artificial Sequence: Synthetic oligonucleotide
  Target: ATXN1; (-) strand; PAM type: YTN; PAM sequence: TTT
acaataaaagcaacttttaa

SEQ ID NO: 157393 - DNA, 20 bp, Artificial Sequence
  Description of Artificial Sequence: Synthetic oligonucleotide
  Target: ATXN1; (-) strand; PAM type: YTN; PAM sequence: TTT
tacaataaaagcaactttta

SEQ ID NO: 157394 - DNA, 20 bp, Artificial Sequence
  Description of Artificial Sequence: Synthetic oligonucleotide
  Target: ATXN1; (-) strand; PAM type: YTN; PAM sequence: CTC
caacatattttacaataaaa

SEQ ID NO: 157395 - DNA, 20 bp, Artificial Sequence
  Description of Artificial Sequence: Synthetic oligonucleotide
  Target: ATXN1; (-) strand; PAM type: YTN; PAM sequence: CTC
tccaacatattttacaataa

SEQ ID NO: 157396 - DNA, 20 bp, Artificial Sequence
  Description of Artificial Sequence: Synthetic oligonucleotide
  Target: ATXN1; (-) strand; PAM type: YTN; PAM sequence: TTC
tctccaacatattttacaat

SEQ ID NO: 157397 - DNA, 20 bp, Artificial Sequence
  Description of Artificial Sequence: Synthetic oligonucleotide
  Target: ATXN1; (-) strand; PAM type: YTN; PAM sequence: TTT
ctctccaacatattttacaa

SEQ ID NO: 157398 - DNA, 20 bp, Artificial Sequence
  Description of Artificial Sequence: Synthetic oligonucleotide
  Target: ATXN1; (-) strand; PAM type: YTN; PAM sequence: TTT
tctctccaacatattttaca

SEQ ID NO: 157399 - DNA, 20 bp, Artificial Sequence
  Description of Artificial Sequence: Synthetic oligonucleotide
  Target: ATXN1; (-) strand; PAM type: YTN; PAM sequence: TTT
ttctctccaacatattttac

SEQ ID NO: 157400 - DNA, 20 bp, Artificial Sequence
  Description of Artificial Sequence: Synthetic oligonucleotide
  Target: ATXN1; (-) strand; PAM type: YTN; PAM sequence: TTA
aaagaacatttttctctcca

SEQ ID NO: 157401 - DNA, 20 bp, Artificial Sequence
  Description of Artificial Sequence: Synthetic oligonucleotide
  Target: ATXN1; (-) strand; PAM type: YTN; PAM sequence: TTT
aaaagaacatttttctctcc

SEQ ID NO: 157402 - DNA, 20 bp, Artificial Sequence
  Description of Artificial Sequence: Synthetic oligonucleotide
  Target: ATXN1; (-) strand; PAM type: YTN; PAM sequence: TTA
accatttaaaagaacatttt

SEQ ID NO: 157403 - DNA, 20 bp, Artificial Sequence
  Description of Artificial Sequence: Synthetic oligonucleotide
  Target: ATXN1; (-) strand; PAM type: YTN; PAM sequence: TTG
gaaagttaaccatttaaaag

SEQ ID NO: 157404 - DNA, 20 bp, Artificial Sequence
  Description of Artificial Sequence: Synthetic oligonucleotide
  Target: ATXN1; (-) strand; PAM type: YTN; PAM sequence: TTT
ggaaagttaaccatttaaaa

SEQ ID NO: 157405 - DNA, 20 bp, Artificial Sequence
  Description of Artificial Sequence: Synthetic oligonucleotide
  Target: ATXN1; (-) strand; PAM type: YTN; PAM sequence: TTC
agggcatcgcggagacgcgt

SEQ ID NO: 157406 - DNA, 20 bp, Artificial Sequence
  Description of Artificial Sequence: Synthetic oligonucleotide
  Target: ATXN1; (-) strand; PAM type: YTN; PAM sequence: CTT
cagggcatcgcggagacgcg

SEQ ID NO: 157407 - DNA, 20 bp, Artificial Sequence
  Description of Artificial Sequence: Synthetic oligonucleotide
  Target: ATXN1; (-) strand; PAM type: YTN; PAM sequence: TTC
ccacgtgcaaaatcaacatc

SEQ ID NO: 157408 - DNA, 20 bp, Artificial Sequence
  Description of Artificial Sequence: Synthetic oligonucleotide
  Target: ATXN1; (-) strand; PAM type: YTN; PAM sequence: CTG
gggttcccacgtgcaaaatc

SEQ ID NO: 157409 - DNA, 20 bp, Artificial Sequence
  Description of Artificial Sequence: Synthetic oligonucleotide
  Target: ATXN1; (-) strand; PAM type: YTN; PAM sequence: CTC
ctggggttcccacgtgcaaa

SEQ ID NO: 157410 - DNA, 20 bp, Artificial Sequence
  Description of Artificial Sequence: Synthetic oligonucleotide
  Target: ATXN1; (-) strand; PAM type: YTN; PAM sequence: TTC
agagcagtgtcctcctgggg

SEQ ID NO: 157411 - DNA, 20 bp, Artificial Sequence
  Description of Artificial Sequence: Synthetic oligonucleotide
  Target: ATXN1; (-) strand; PAM type: YTN; PAM sequence: CTA
tcggcatgggccgggggggt

SEQ ID NO: 157412 - DNA, 20 bp, Artificial Sequence
  Description of Artificial Sequence: Synthetic oligonucleotide
  Target: ATXN1; (-) strand; PAM type: YTN; PAM sequence: TTG
ctatcggcatgggccggggg

SEQ ID NO: 157413 - DNA, 20 bp, Artificial Sequence
  Description of Artificial Sequence: Synthetic oligonucleotide
  Target: ATXN1; (-) strand; PAM type: YTN; PAM sequence: CTT
gctatcggcatgggccgggg

SEQ ID NO: 157414 - DNA, 20 bp, Artificial Sequence
  Description of Artificial Sequence: Synthetic oligonucleotide
  Target: ATXN1; (-) strand; PAM type: YTN; PAM sequence: CTC
ttgctatcggcatgggccgg

SEQ ID NO: 157415 - DNA, 20 bp, Artificial Sequence
  Description of Artificial Sequence: Synthetic oligonucleotide
  Target: ATXN1; (-) strand; PAM type: YTN; PAM sequence: CTC
tcttgctatcggcatgggcc

SEQ ID NO: 157416 - DNA, 20 bp, Artificial Sequence
  Description of Artificial Sequence: Synthetic oligonucleotide
  Target: ATXN1; (-) strand; PAM type: YTN; PAM sequence: CTC
actctcttgctatcggcatg

SEQ ID NO: 157417 - DNA, 20 bp, Artificial Sequence
  Description of Artificial Sequence: Synthetic oligonucleotide
  Target: ATXN1; (-) strand; PAM type: YTN; PAM sequence: CTG
cctcactctcttgctatcgg

SEQ ID NO: 157418 - DNA, 20 bp, Artificial Sequence
  Description of Artificial Sequence: Synthetic oligonucleotide
  Target: ATXN1; (-) strand; PAM type: YTN; PAM sequence: CTC
tgcctcactctcttgctatc

SEQ ID NO: 157419 - DNA, 20 bp, Artificial Sequence
  Description of Artificial Sequence: Synthetic oligonucleotide
  Target: ATXN1; (-) strand; PAM type: YTN; PAM sequence: CTC
cctctgcctcactctcttgc

SEQ ID NO: 157420 - DNA, 20 bp, Artificial Sequence
  Description of Artificial Sequence: Synthetic oligonucleotide
  Target: ATXN1; (-) strand; PAM type: YTN; PAM sequence: CTG
cctccctctgcctcactctc

SEQ ID NO: 157421 - DNA, 20 bp, Artificial Sequence
  Description of Artificial Sequence: Synthetic oligonucleotide
  Target: ATXN1; (-) strand; PAM type: YTN; PAM sequence: CTC
tgcctccctctgcctcactc

SEQ ID NO: 157422 - DNA, 20 bp, Artificial Sequence
  Description of Artificial Sequence: Synthetic oligonucleotide
  Target: ATXN1; (-) strand; PAM type: YTN; PAM sequence: TTC
tctgcctccctctgcctcac

SEQ ID NO: 157423 - DNA, 20 bp, Artificial Sequence
  Description of Artificial Sequence: Synthetic oligonucleotide
  Target: ATXN1; (-) strand; PAM type: YTN; PAM sequence: TTT
ctctgcctccctctgcctca

SEQ ID NO: 157424 - DNA, 20 bp, Artificial Sequence
  Description of Artificial Sequence: Synthetic oligonucleotide
  Target: ATXN1; (-) strand; PAM type: YTN; PAM sequence: TTT
tctctgcctccctctgcctc

SEQ ID NO: 157425 - DNA, 20 bp, Artificial Sequence
  Description of Artificial Sequence: Synthetic oligonucleotide
  Target: ATXN1; (-) strand; PAM type: YTN; PAM sequence: TTT
ttctctgcctccctctgcct

SEQ ID NO: 157426 - DNA, 20 bp, Artificial Sequence
  Description of Artificial Sequence: Synthetic oligonucleotide
  Target: ATXN1; (-) strand; PAM type: YTN; PAM sequence: CTT
tttctctgcctccctctgcc

SEQ ID NO: 157427 - DNA, 20 bp, Artificial Sequence
  Description of Artificial Sequence: Synthetic oligonucleotide
  Target: ATXN1; (-) strand; PAM type: YTN; PAM sequence: CTC
tttttctctgcctccctctg

SEQ ID NO: 157428 - DNA, 20 bp, Artificial Sequence
  Description of Artificial Sequence: Synthetic oligonucleotide
  Target: ATXN1; (-) strand; PAM type: YTN; PAM sequence: CTG
tggcggcgagtgagggtctc

SEQ ID NO: 157429 - DNA, 20 bp, Artificial Sequence
  Description of Artificial Sequence: Synthetic oligonucleotide
  Target: ATXN1; (-) strand; PAM type: YTN; PAM sequence: TTG
cacgcatgtgggggtgcaca

SEQ ID NO: 157430 - DNA, 20 bp, Artificial Sequence
  Description of Artificial Sequence: Synthetic oligonucleotide
  Target: ATXN1; (-) strand; PAM type: YTN; PAM sequence: CTG
caggggtgcagggttgcacg

SEQ ID NO: 157431 - DNA, 20 bp, Artificial Sequence
  Description of Artificial Sequence: Synthetic oligonucleotide
  Target: ATXN1; (-) strand; PAM type: YTN; PAM sequence: CTA
gtgtcaggagaaaagtcccg

SEQ ID NO: 157432 - DNA, 20 bp, Artificial Sequence
  Description of Artificial Sequence: Synthetic oligonucleotide
  Target: ATXN1; (-) strand; PAM type: YTN; PAM sequence: CTC
ccgctagtgtcaggagaaaa

SEQ ID NO: 157433 - DNA, 20 bp, Artificial Sequence
  Description of Artificial Sequence: Synthetic oligonucleotide
  Target: ATXN1; (-) strand; PAM type: YTN; PAM sequence: CTG
actcccgctagtgtcaggag

SEQ ID NO: 157434 - DNA, 20 bp, Artificial Sequence
  Description of Artificial Sequence: Synthetic oligonucleotide
  Target: ATXN1; (-) strand; PAM type: YTN; PAM sequence: CTA
gcggcacagaagcagccggg

SEQ ID NO: 157435 - DNA, 20 bp, Artificial Sequence
  Description of Artificial Sequence: Synthetic oligonucleotide
  Target: ATXN1; (-) strand; PAM type: YTN; PAM sequence: CTC
tagcggcacagaagcagccg

SEQ ID NO: 157436 - DNA, 20 bp, Artificial Sequence
  Description of Artificial Sequence: Synthetic oligonucleotide
  Target: ATXN1; (-) strand; PAM type: YTN; PAM sequence: TTC
tctagcggcacagaagcagc

SEQ ID NO: 157437 - DNA, 20 bp, Artificial Sequence
  Description of Artificial Sequence: Synthetic oligonucleotide
  Target: ATXN1; (-) strand; PAM type: YTN; PAM sequence: CTT
ctctagcggcacagaagcag

SEQ ID NO: 157438 - DNA, 20 bp, Artificial Sequence
  Description of Artificial Sequence: Synthetic oligonucleotide
  Target: ATXN1; (-) strand; PAM type: YTN; PAM sequence: CTG
ccttctctagcggcacagaa

SEQ ID NO: 157439 - DNA, 20 bp, Artificial Sequence
  Description of Artificial Sequence: Synthetic oligonucleotide
  Target: ATXN1; (-) strand; PAM type: YTN; PAM sequence: TTC
acagtgcctgccttctctag

SEQ ID NO: 157440 - DNA, 20 bp, Artificial Sequence
  Description of Artificial Sequence: Synthetic oligonucleotide
  Target: ATXN1; (-) strand; PAM type: YTN; PAM sequence: CTT
cacagtgcctgccttctcta

SEQ ID NO: 157441 - DNA, 20 bp, Artificial Sequence
  Description of Artificial Sequence: Synthetic oligonucleotide
  Target: ATXN1; (-) strand; PAM type: YTN; PAM sequence: CTC
caggcatccccggggaagaa

SEQ ID NO: 157442 - DNA, 20 bp, Artificial Sequence
  Description of Artificial Sequence: Synthetic oligonucleotide
  Target: ATXN1; (-) strand; PAM type: YTN; PAM sequence: CTG
tcagtgagcgggcgggagga

SEQ ID NO: 157443 - DNA, 20 bp, Artificial Sequence
  Description of Artificial Sequence: Synthetic oligonucleotide
  Target: ATXN1; (-) strand; PAM type: YTN; PAM sequence: TTC
cacgagtgtctgtcagtgag

SEQ ID NO: 157444 - DNA, 20 bp, Artificial Sequence
  Description of Artificial Sequence: Synthetic oligonucleotide
  Target: ATXN1; (-) strand; PAM type: YTN; PAM sequence: TTT
ccacgagtgtctgtcagtga

SEQ ID NO: 157445 - DNA, 20 bp, Artificial Sequence
  Description of Artificial Sequence: Synthetic oligonucleotide
  Target: ATXN1; (-) strand; PAM type: YTN; PAM sequence: TTT
tccacgagtgtctgtcagtg

SEQ ID NO: 157446 - DNA, 20 bp, Artificial Sequence
  Description of Artificial Sequence: Synthetic oligonucleotide
  Target: ATXN1; (-) strand; PAM type: YTN; PAM sequence: TTT
ttccacgagtgtctgtcagt

SEQ ID NO: 157447 - DNA, 20 bp, Artificial Sequence
  Description of Artificial Sequence: Synthetic oligonucleotide
  Target: ATXN1; (-) strand; PAM type: YTN; PAM sequence: CTT
tttccacgagtgtctgtcag

SEQ ID NO: 157448 - DNA, 20 bp, Artificial Sequence
  Description of Artificial Sequence: Synthetic oligonucleotide
  Target: ATXN1; (-) strand; PAM type: YTN; PAM sequence: CTG
gtgcatatgctttttccacg

SEQ ID NO: 157449 - DNA, 20 bp, Artificial Sequence
  Description of Artificial Sequence: Synthetic oligonucleotide
  Target: ATXN1; (-) strand; PAM type: YTN; PAM sequence: TTA
cagcaggtgtgtcgcaggag

SEQ ID NO: 157450 - DNA, 20 bp, Artificial Sequence
  Description of Artificial Sequence: Synthetic oligonucleotide
  Target: ATXN1; (-) strand; PAM type: YTN; PAM sequence: TTA
gagttacagcaggtgtgtcg

SEQ ID NO: 157451 - DNA, 20 bp, Artificial Sequence
  Description of Artificial Sequence: Synthetic oligonucleotide
  Target: ATXN1; (-) strand; PAM type: YTN; PAM sequence: TTG
tcattagagttacagcaggt

SEQ ID NO: 157452 - DNA, 20 bp, Artificial Sequence
  Description of Artificial Sequence: Synthetic oligonucleotide
  Target: ATXN1; (-) strand; PAM type: YTN; PAM sequence: CTT
gtcattagagttacagcagg

SEQ ID NO: 157453 - DNA, 20 bp, Artificial Sequence
  Description of Artificial Sequence: Synthetic oligonucleotide
  Target: ATXN1; (-) strand; PAM type: YTN; PAM sequence: CTA
accttgtcattagagttaca

SEQ ID NO: 157454 - DNA, 20 bp, Artificial Sequence
  Description of Artificial Sequence: Synthetic oligonucleotide
  Target: ATXN1; (-) strand; PAM type: YTN; PAM sequence: TTC
taaccttgtcattagagtta

SEQ ID NO: 157455 - DNA, 20 bp, Artificial Sequence
  Description of Artificial Sequence: Synthetic oligonucleotide
  Target: ATXN1; (-) strand; PAM type: YTN; PAM sequence: CTG
ttctaaccttgtcattagag

SEQ ID NO: 157456 - DNA, 20 bp, Artificial Sequence
  Description of Artificial Sequence: Synthetic oligonucleotide
  Target: ATXN1; (-) strand; PAM type: YTN; PAM sequence: TTC
tgttctaaccttgtcattag

SEQ ID NO: 157457 - DNA, 20 bp, Artificial Sequence
  Description of Artificial Sequence: Synthetic oligonucleotide
  Target: ATXN1; (-) strand; PAM type: YTN; PAM sequence: TTT
ctgttctaaccttgtcatta

SEQ ID NO: 157458 - DNA, 20 bp, Artificial Sequence
  Description of Artificial Sequence: Synthetic oligonucleotide
  Target: ATXN1; (-) strand; PAM type: YTN; PAM sequence: TTA
ggtttctgttctaaccttgt

SEQ ID NO: 157459 - DNA, 20 bp, Artificial Sequence
  Description of Artificial Sequence: Synthetic oligonucleotide
  Target: ATXN1; (-) strand; PAM type: YTN; PAM sequence: TTT
aggtttctgttctaaccttg

SEQ ID NO: 157460 - DNA, 20 bp, Artificial Sequence
  Description of Artificial Sequence: Synthetic oligonucleotide
  Target: ATXN1; (-) strand; PAM type: YTN; PAM sequence: TTT
taggtttctgttctaacctt

SEQ ID NO: 157461 - DNA, 20 bp, Artificial Sequence
  Description of Artificial Sequence: Synthetic oligonucleotide
  Target: ATXN1; (-) strand; PAM type: YTN; PAM sequence: TTA
attttaggtttctgttctaa

SEQ ID NO: 157462 - DNA, 20 bp, Artificial Sequence
  Description of Artificial Sequence: Synthetic oligonucleotide
  Target: ATXN1; (-) strand; PAM type: YTN; PAM sequence: CTT
aattttaggtttctgttcta

SEQ ID NO: 157463 - DNA, 20 bp, Artificial Sequence
  Description of Artificial Sequence: Synthetic oligonucleotide
  Target: ATXN1; (-) strand; PAM type: YTN; PAM sequence: TTC
ttaattttaggtttctgttc

SEQ ID NO: 157464 - DNA, 20 bp, Artificial Sequence
  Description of Artificial Sequence: Synthetic oligonucleotide
  Target: ATXN1; (-) strand; PAM type: YTN; PAM sequence: CTT
cttaattttaggtttctgtt

SEQ ID NO: 157465 - DNA, 20 bp, Artificial Sequence
  Description of Artificial Sequence: Synthetic oligonucleotide
  Target: ATXN1; (-) strand; PAM type: YTN; PAM sequence: TTA
tcttcttaattttaggtttc

SEQ ID NO: 157466 - DNA, 20 bp, Artificial Sequence
  Description of Artificial Sequence: Synthetic oligonucleotide
  Target: ATXN1; (-) strand; PAM type: YTN; PAM sequence: TTA
catgttatcttcttaatttt

SEQ ID NO: 157467 - DNA, 20 bp, Artificial Sequence
  Description of Artificial Sequence: Synthetic oligonucleotide
  Target: ATXN1; (-) strand; PAM type: YTN; PAM sequence: TTT
acatgttatcttcttaattt

SEQ ID NO: 157468 - DNA, 20 bp, Artificial Sequence
  Description of Artificial Sequence: Synthetic oligonucleotide
  Target: ATXN1; (-) strand; PAM type: YTN; PAM sequence: CTA
aaataacacagtatttacat

SEQ ID NO: 157469 - DNA, 20 bp, Artificial Sequence
  Description of Artificial Sequence: Synthetic oligonucleotide
  Target: ATXN1; (-) strand; PAM type: YTN; PAM sequence: CTG
taggctaaaataacacagta

SEQ ID NO: 157470 - DNA, 20 bp, Artificial Sequence
  Description of Artificial Sequence: Synthetic oligonucleotide
  Target: ATXN1; (-) strand; PAM type: YTN; PAM sequence: CTG
tactgtaggctaaaataaca

SEQ ID NO: 157471 - DNA, 20 bp, Artificial Sequence
  Description of Artificial Sequence: Synthetic oligonucleotide
  Target: ATXN1; (-) strand; PAM type: YTN; PAM sequence: TTA
ctgtactgtaggctaaaata

SEQ ID NO: 157472 - DNA, 20 bp, Artificial Sequence
  Description of Artificial Sequence: Synthetic oligonucleotide
  Target: ATXN1; (-) strand; PAM type: YTN; PAM sequence: TTG
tatccagattactgtactgt

SEQ ID NO: 157473 - DNA, 20 bp, Artificial Sequence
  Description of Artificial Sequence: Synthetic oligonucleotide
  Target: ATXN1; (-) strand; PAM type: YTN; PAM sequence: TTT
gtatccagattactgtactg

SEQ ID NO: 157474 - DNA, 20 bp, Artificial Sequence
  Description of Artificial Sequence: Synthetic oligonucleotide
  Target: ATXN1; (-) strand; PAM type: YTN; PAM sequence: TTA
tcatttgtatccagattact

SEQ ID NO: 157475 - DNA, 20 bp, Artificial Sequence
  Description of Artificial Sequence: Synthetic oligonucleotide
  Target: ATXN1; (-) strand; PAM type: YTN; PAM sequence: CTT
atcatttgtatccagattac

SEQ ID NO: 157476 - DNA, 20 bp, Artificial Sequence
  Description of Artificial Sequence: Synthetic oligonucleotide
  Target: ATXN1; (-) strand; PAM type: YTN; PAM sequence: CTC
ccttatcatttgtatccaga

SEQ ID NO: 157477 - DNA, 20 bp, Artificial Sequence
  Description of Artificial Sequence: Synthetic oligonucleotide
  Target: ATXN1; (-) strand; PAM type: YTN; PAM sequence: CTC
tcccttatcatttgtatcca

SEQ ID NO: 157478 - DNA, 20 bp, Artificial Sequence
  Description of Artificial Sequence: Synthetic oligonucleotide
  Target: ATXN1; (-) strand; PAM type: YTN; PAM sequence: CTA
atgtaggcaagtagaggcag

SEQ ID NO: 157479 - DNA, 20 bp, Artificial Sequence
  Description of Artificial Sequence: Synthetic oligonucleotide
  Target: ATXN1; (-) strand; PAM type: YTN; PAM sequence: TTG
aaggccggtctaatgtaggc

SEQ ID NO: 157480 - DNA, 20 bp, Artificial Sequence
  Description of Artificial Sequence: Synthetic oligonucleotide
  Target: ATXN1; (-) strand; PAM type: YTN; PAM sequence: TTG
cattgaaggccggtctaatg

SEQ ID NO: 157481 - DNA, 20 bp, Artificial Sequence
  Description of Artificial Sequence: Synthetic oligonucleotide
  Target: ATXN1; (-) strand; PAM type: YTN; PAM sequence: TTT
gcattgaaggccggtctaat

SEQ ID NO: 157482 - DNA, 20 bp, Artificial Sequence
  Description of Artificial Sequence: Synthetic oligonucleotide
  Target: ATXN1; (-) strand; PAM type: YTN; PAM sequence: TTA
agatttgcattgaaggccgg

SEQ ID NO: 157483 - DNA, 20 bp, Artificial Sequence
  Description of Artificial Sequence: Synthetic oligonucleotide
  Target: ATXN1; (-) strand; PAM type: YTN; PAM sequence: CTC
aggaggttaagatttgcatt

SEQ ID NO: 157484 - DNA, 20 bp, Artificial Sequence
  Description of Artificial Sequence: Synthetic oligonucleotide
  Target: ATXN1; (-) strand; PAM type: YTN; PAM sequence: TTC
ctcaggaggttaagatttgc

SEQ ID NO: 157485 - DNA, 20 bp, Artificial Sequence
  Description of Artificial Sequence: Synthetic oligonucleotide
  Target: ATXN1; (-) strand; PAM type: YTN; PAM sequence: CTA
attcctcaggaggttaagat

SEQ ID NO: 157486 - DNA, 20 bp, Artificial Sequence
  Description of Artificial Sequence: Synthetic oligonucleotide
  Target: ATXN1; (-) strand; PAM type: YTN; PAM sequence: CTC
taattcctcaggaggttaag

SEQ ID NO: 157487 - DNA, 20 bp, Artificial Sequence
  Description of Artificial Sequence: Synthetic oligonucleotide
  Target: ATXN1; (-) strand; PAM type: YTN; PAM sequence: TTC
tctaattcctcaggaggtta

SEQ ID NO: 157488 - DNA, 20 bp, Artificial Sequence
  Description of Artificial Sequence: Synthetic oligonucleotide
  Target: ATXN1; (-) strand; PAM type: YTN; PAM sequence: CTT
ctctaattcctcaggaggtt

SEQ ID NO: 157489 - DNA, 20 bp, Artificial Sequence
  Description of Artificial Sequence: Synthetic oligonucleotide
  Target: ATXN1; (-) strand; PAM type: YTN; PAM sequence: CTA
agccttctctaattcctcag

SEQ ID NO: 157490 - DNA, 20 bp, Artificial Sequence
  Description of Artificial Sequence: Synthetic oligonucleotide
  Target: ATXN1; (-) strand; PAM type: YTN; PAM sequence: TTC
ctaagccttctctaattcct

SEQ ID NO: 157491 - DNA, 20 bp, Artificial Sequence
  Description of Artificial Sequence: Synthetic oligonucleotide
  Target: ATXN1; (-) strand; PAM type: YTN; PAM sequence: CTT
cctaagccttctctaattcc

SEQ ID NO: 157492 - DNA, 20 bp, Artificial Sequence
  Description of Artificial Sequence: Synthetic oligonucleotide
  Target: ATXN1; (-) strand; PAM type: YTN; PAM sequence: CTC
ttcctaagccttctctaatt

SEQ ID NO: 157493 - DNA, 20 bp, Artificial Sequence
  Description of Artificial Sequence: Synthetic oligonucleotide
  Target: ATXN1; (-) strand; PAM type: YTN; PAM sequence: TTG
actcttcctaagccttctct

SEQ ID NO: 157494 - DNA, 20 bp, Artificial Sequence
  Description of Artificial Sequence: Synthetic oligonucleotide
  Target: ATXN1; (-) strand; PAM type: YTN; PAM sequence: TTT
gactcttcctaagccttctc

SEQ ID NO: 157495 - DNA, 20 bp, Artificial Sequence
  Description of Artificial Sequence: Synthetic oligonucleotide
  Target: ATXN1; (-) strand; PAM type: YTN; PAM sequence: CTT
tgactcttcctaagccttct

SEQ ID NO: 157496 - DNA, 20 bp, Artificial Sequence
  Description of Artificial Sequence: Synthetic oligonucleotide
  Target: ATXN1; (-) strand; PAM type: YTN; PAM sequence: CTG
gagaagtcagaagacgaacc

SEQ ID NO: 157497 - DNA, 20 bp, Artificial Sequence
  Description of Artificial Sequence: Synthetic oligonucleotide
  Target: ATXN1; (-) strand; PAM type: YTN; PAM sequence: CTC
accaaaatagaacccagcaa

SEQ ID NO: 157498 - DNA, 20 bp, Artificial Sequence
  Description of Artificial Sequence: Synthetic oligonucleotide
  Target: ATXN1; (-) strand; PAM type: YTN; PAM sequence: TTC
ctcaccaaaatagaacccag

SEQ ID NO: 157499 - DNA, 20 bp, Artificial Sequence
  Description of Artificial Sequence: Synthetic oligonucleotide
  Target: ATXN1; (-) strand; PAM type: YTN; PAM sequence: CTT
cctcaccaaaatagaaccca

SEQ ID NO: 157500 - DNA, 20 bp, Artificial Sequence
  Description of Artificial Sequence: Synthetic oligonucleotide
  Target: ATXN1; (-) strand; PAM type: YTN; PAM sequence: CTG
cagcgcccttcctcaccaaa

SEQ ID NO: 157501 - DNA, 20 bp, Artificial Sequence
  Description of Artificial Sequence: Synthetic oligonucleotide
  Target: ATXN1; (-) strand; PAM type: YTN; PAM sequence: TTG
cctgcagcgcccttcctcac

SEQ ID NO: 157502 - DNA, 20 bp, Artificial Sequence
  Description of Artificial Sequence: Synthetic oligonucleotide
  Target: ATXN1; (-) strand; PAM type: YTN; PAM sequence: TTC
cagagaaaatgggattgcct

SEQ ID NO: 157503 - DNA, 20 bp, Artificial Sequence
  Description of Artificial Sequence: Synthetic oligonucleotide
  Target: ATXN1; (-) strand; PAM type: YTN; PAM sequence: TTT
ccagagaaaatgggattgcc

SEQ ID NO: 157504 - DNA, 20 bp, Artificial Sequence
  Description of Artificial Sequence: Synthetic oligonucleotide
  Target: ATXN1; (-) strand; PAM type: YTN; PAM sequence: CTG
aagtttccagagaaaatggg

SEQ ID NO: 157505 - DNA, 20 bp, Artificial Sequence
  Description of Artificial Sequence: Synthetic oligonucleotide
  Target: ATXN1; (-) strand; PAM type: YTN; PAM sequence: CTG
agaatggcgaactgaagttt

SEQ ID NO: 157506 - DNA, 20 bp, Artificial Sequence
  Description of Artificial Sequence: Synthetic oligonucleotide
  Target: ATXN1; (-) strand; PAM type: YTN; PAM sequence: CTC
tgagaatggcgaactgaagt

SEQ ID NO: 157507 - DNA, 20 bp, Artificial Sequence
  Description of Artificial Sequence: Synthetic oligonucleotide
  Target: ATXN1; (-) strand; PAM type: YTN; PAM sequence: CTC
tctgagaatggcgaactgaa

SEQ ID NO: 157508 - DNA, 20 bp, Artificial Sequence
  Description of Artificial Sequence: Synthetic oligonucleotide
  Target: ATXN1; (-) strand; PAM type: YTN; PAM sequence: CTG
gcgggcagcagacacaggta

SEQ ID NO: 157509 - DNA, 20 bp, Artificial Sequence
  Description of Artificial Sequence: Synthetic oligonucleotide
  Target: ATXN1; (-) strand; PAM type: YTN; PAM sequence: CTC
aaaggccgacggcctggcgg

SEQ ID NO: 157510 - DNA, 20 bp, Artificial Sequence
  Description of Artificial Sequence: Synthetic oligonucleotide
  Target: ATXN1; (-) strand; PAM type: YTN; PAM sequence: CTG
aagcactcaaaggccgacgg

SEQ ID NO: 157511 - DNA, 20 bp, Artificial Sequence
  Description of Artificial Sequence: Synthetic oligonucleotide
  Target: ATXN1; (-) strand; PAM type: YTN; PAM sequence: CTG
ctgaagcactcaaaggccga

SEQ ID NO: 157512 - DNA, 20 bp, Artificial Sequence
  Description of Artificial Sequence: Synthetic oligonucleotide
  Target: ATXN1; (-) strand; PAM type: YTN; PAM sequence: TTA
aaaagggccagcccgtggat

SEQ ID NO: 157513 - DNA, 20 bp, Artificial Sequence
  Description of Artificial Sequence: Synthetic oligonucleotide
  Target: ATXN1; (-) strand; PAM type: YTN; PAM sequence: CTG
ttaaaaagggccagcccgtg

SEQ ID NO: 157514 - DNA, 20 bp, Artificial Sequence
  Description of Artificial Sequence: Synthetic oligonucleotide
  Target: ATXN1; (-) strand; PAM type: YTN; PAM sequence: CTC
tgttaaaaagggccagcccg

SEQ ID NO: 157515 - DNA, 20 bp, Artificial Sequence
  Description of Artificial Sequence: Synthetic oligonucleotide
  Target: ATXN1; (-) strand; PAM type: YTN; PAM sequence: CTG
aagaacggctctgttaaaaa

SEQ ID NO: 157516 - DNA, 20 bp, Artificial Sequence
  Description of Artificial Sequence: Synthetic oligonucleotide
  Target: ATXN1; (-) strand; PAM type: YTN; PAM sequence: CTC
aagaacctgaagaacggctc

SEQ ID NO: 157517 - DNA, 20 bp, Artificial Sequence
  Description of Artificial Sequence: Synthetic oligonucleotide
  Target: ATXN1; (-) strand; PAM type: YTN; PAM sequence: TTA
ccctcaagaacctgaagaac

SEQ ID NO: 157518 - DNA, 20 bp, Artificial Sequence
  Description of Artificial Sequence: Synthetic oligonucleotide
  Target: ATXN1; (-) strand; PAM type: YTN; PAM sequence: CTT
accctcaagaacctgaagaa

SEQ ID NO: 157519 - DNA, 20 bp, Artificial Sequence
  Description of Artificial Sequence: Synthetic oligonucleotide
  Target: ATXN1; (-) strand; PAM type: YTN; PAM sequence: CTC
gcttaccctcaagaacctga

SEQ ID NO: 157520 - DNA, 20 bp, Artificial Sequence
  Description of Artificial Sequence: Synthetic oligonucleotide
  Target: ATXN1; (-) strand; PAM type: YTN; PAM sequence: CTG
catctcgcttaccctcaaga

SEQ ID NO: 157521 - DNA, 20 bp, Artificial Sequence
  Description of Artificial Sequence: Synthetic oligonucleotide
  Target: ATXN1; (-) strand; PAM type: YTN; PAM sequence: TTG
gggatgtctgcatctcgctt

SEQ ID NO: 157522 - DNA, 20 bp, Artificial Sequence
  Description of Artificial Sequence: Synthetic oligonucleotide
  Target: ATXN1; (-) strand; PAM type: YTN; PAM sequence: CTC
agttggggatgtctgcatct

SEQ ID NO: 157523 - DNA, 20 bp, Artificial Sequence
  Description of Artificial Sequence: Synthetic oligonucleotide
  Target: ATXN1; (-) strand; PAM type: YTN; PAM sequence: CTC
tcagttggggatgtctgcat

SEQ ID NO: 157524 - DNA, 20 bp, Artificial Sequence
  Description of Artificial Sequence: Synthetic oligonucleotide
  Target: ATXN1; (-) strand; PAM type: YTN; PAM sequence: TTC
caaactctcagttggggatg

SEQ ID NO: 157525 - DNA, 20 bp, Artificial Sequence
  Description of Artificial Sequence: Synthetic oligonucleotide
  Target: ATXN1; (-) strand; PAM type: YTN; PAM sequence: TTG
ccgtgttccaaactctcagt

SEQ ID NO: 157526 - DNA, 20 bp, Artificial Sequence
  Description of Artificial Sequence: Synthetic oligonucleotide
  Target: ATXN1; (-) strand; PAM type: YTN; PAM sequence: TTT
gccgtgttccaaactctcag

SEQ ID NO: 157527 - DNA, 20 bp, Artificial Sequence
  Description of Artificial Sequence: Synthetic oligonucleotide
  Target: ATXN1; (-) strand; PAM type: YTN; PAM sequence: TTG
atttgccgtgttccaaactc

SEQ ID NO: 157528 - DNA, 20 bp, Artificial Sequence
  Description of Artificial Sequence: Synthetic oligonucleotide
  Target: ATXN1; (-) strand; PAM type: YTN; PAM sequence: TTT
gatttgccgtgttccaaact

SEQ ID NO: 157529 - DNA, 20 bp, Artificial Sequence
  Description of Artificial Sequence: Synthetic oligonucleotide
  Target: ATXN1; (-) strand; PAM type: YTN; PAM sequence: CTT
tgatttgccgtgttccaaac

SEQ ID NO: 157530 - DNA, 20 bp, Artificial Sequence
  Description of Artificial Sequence: Synthetic oligonucleotide
  Target: ATXN1; (-) strand; PAM type: YTN; PAM sequence: CTC
tttgatttgccgtgttccaa

SEQ ID NO: 157531 - DNA, 20 bp, Artificial Sequence
  Description of Artificial Sequence: Synthetic oligonucleotide
  Target: ATXN1; (-) strand; PAM type: YTN; PAM sequence: CTG
tccggagagaaccagccagc

SEQ ID NO: 157532 - DNA, 20 bp, Artificial Sequence
  Description of Artificial Sequence: Synthetic oligonucleotide
  Target: ATXN1; (-) strand; PAM type: YTN; PAM sequence: CTG
ctgtccggagagaaccagcc

SEQ ID NO: 157533 - DNA, 20 bp, Artificial Sequence
  Description of Artificial Sequence: Synthetic oligonucleotide
  Target: ATXN1; (-) strand; PAM type: YTN; PAM sequence: CTG
gtcatcctgctgtccggaga

SEQ ID NO: 157534 - DNA, 20 bp, Artificial Sequence
  Description of Artificial Sequence: Synthetic oligonucleotide
  Target: ATXN1; (-) strand; PAM type: YTN; PAM sequence: TTG
gacagggctggtcatcctgc

SEQ ID NO: 157535 - DNA, 20 bp, Artificial Sequence
  Description of Artificial Sequence: Synthetic oligonucleotide
  Target: ATXN1; (-) strand; PAM type: YTN; PAM sequence: TTT
ggacagggctggtcatcctg

SEQ ID NO: 157536 - DNA, 20 bp, Artificial Sequence
  Description of Artificial Sequence: Synthetic oligonucleotide
  Target: ATXN1; (-) strand; PAM type: YTN; PAM sequence: TTG
tgtttggacagggctggtca

SEQ ID NO: 157537 - DNA, 20 bp, Artificial Sequence
  Description of Artificial Sequence: Synthetic oligonucleotide
  Target: ATXN1; (-) strand; PAM type: YTN; PAM sequence: TTT
gtgtttggacagggctggtc

SEQ ID NO: 157538 - DNA, 20 bp, Artificial Sequence
  Description of Artificial Sequence: Synthetic oligonucleotide
  Target: ATXN1; (-) strand; PAM type: YTN; PAM sequence: TTT
tgtgtttggacagggctggt

SEQ ID NO: 157539 - DNA, 20 bp, Artificial Sequence
  Description of Artificial Sequence: Synthetic oligonucleotide
  Target: ATXN1; (-) strand; PAM type: YTN; PAM sequence: TTT
ttgtgtttggacagggctgg

SEQ ID NO: 157540 - DNA, 20 bp, Artificial Sequence
  Description of Artificial Sequence: Synthetic oligonucleotide
  Target: ATXN1; (-) strand; PAM type: YTN; PAM sequence: TTT
tttgtgtttggacagggctg

SEQ ID NO: 157541 - DNA, 20 bp, Artificial Sequence
  Description of Artificial Sequence: Synthetic oligonucleotide
  Target: ATXN1; (-) strand; PAM type: YTN; PAM sequence: TTT
ttttgtgtttggacagggct

SEQ ID NO: 157542 - DNA, 20 bp, Artificial Sequence
  Description of Artificial Sequence: Synthetic oligonucleotide
  Target: ATXN1; (-) strand; PAM type: YTN; PAM sequence: CTT
tttttgtgtttggacagggc

SEQ ID NO: 157543 - DNA, 20 bp, Artificial Sequence
  Description of Artificial Sequence: Synthetic oligonucleotide
  Target: ATXN1; (-) strand; PAM type: YTN; PAM sequence: TTG
gtagagtatcctttttttgt

SEQ ID NO: 157544 - DNA, 20 bp, Artificial Sequence
  Description of Artificial Sequence: Synthetic oligonucleotide
  Target: ATXN1; (-) strand; PAM type: YTN; PAM sequence: TTT
ggtagagtatcctttttttg

SEQ ID NO: 157545 - DNA, 20 bp, Artificial Sequence
  Description of Artificial Sequence: Synthetic oligonucleotide
  Target: ATXN1; (-) strand; PAM type: YTN; PAM sequence: TTT
tggtagagtatccttttttt

SEQ ID NO: 157546 - DNA, 20 bp, Artificial Sequence
  Description of Artificial Sequence: Synthetic oligonucleotide
  Target: ATXN1; (-) strand; PAM type: YTN; PAM sequence: TTG
aagttttggtagagtatcct

SEQ ID NO: 157547 - DNA, 20 bp, Artificial Sequence
  Description of Artificial Sequence: Synthetic oligonucleotide
  Target: ATXN1; (-) strand; PAM type: YTN; PAM sequence: TTC
cacaggtcagcgttgaagtt

SEQ ID NO: 157548 - DNA, 20 bp, Artificial Sequence
  Description of Artificial Sequence: Synthetic oligonucleotide
  Target: ATXN1; (-) strand; PAM type: YTN; PAM sequence: TTT
ccacaggtcagcgttgaagt

SEQ ID NO: 157549 - DNA, 20 bp, Artificial Sequence
  Description of Artificial Sequence: Synthetic oligonucleotide
  Target: ATXN1; (-) strand; PAM type: YTN; PAM sequence: CTG
tttccacaggtcagcgttga

SEQ ID NO: 157550 - DNA, 20 bp, Artificial Sequence
  Description of Artificial Sequence: Synthetic oligonucleotide
  Target: ATXN1; (-) strand; PAM type: YTN; PAM sequence: CTC
cctgtttccacaggtcagcg

SEQ ID NO: 157551 - DNA, 20 bp, Artificial Sequence
  Description of Artificial Sequence: Synthetic oligonucleotide
  Target: ATXN1; (-) strand; PAM type: YTN; PAM sequence: CTC
tccctgtttccacaggtcag

SEQ ID NO: 157552 - DNA, 20 bp, Artificial Sequence
  Description of Artificial Sequence: Synthetic oligonucleotide
  Target: ATXN1; (-) strand; PAM type: YTN; PAM sequence: CTG
tctctccctgtttccacagg

SEQ ID NO: 157553 - DNA, 20 bp, Artificial Sequence
  Description of Artificial Sequence: Synthetic oligonucleotide
  Target: ATXN1; (-) strand; PAM type: YTN; PAM sequence: CTC
tgtctctccctgtttccaca

SEQ ID NO: 157554 - DNA, 20 bp, Artificial Sequence
  Description of Artificial Sequence: Synthetic oligonucleotide
  Target: ATXN1; (-) strand; PAM type: YTN; PAM sequence: CTC
tctgtctctccctgtttcca

SEQ ID NO: 157555 - DNA, 20 bp, Artificial Sequence
  Description of Artificial Sequence: Synthetic oligonucleotide
  Target: ATXN1; (-) strand; PAM type: YTN; PAM sequence: CTC
tctctgtctctccctgtttc

SEQ ID NO: 157556 - DNA, 20 bp, Artificial Sequence
  Description of Artificial Sequence: Synthetic oligonucleotide
  Target: ATXN1; (-) strand; PAM type: YTN; PAM sequence: TTC
ctctctctgtctctccctgt

SEQ ID NO: 157557 - DNA, 20 bp, Artificial Sequence
  Description of Artificial Sequence: Synthetic oligonucleotide
  Target: ATXN1; (-) strand; PAM type: YTN; PAM sequence: CTT
cctctctctgtctctccctg

SEQ ID NO: 157558 - DNA, 20 bp, Artificial Sequence
  Description of Artificial Sequence: Synthetic oligonucleotide
  Target: ATXN1; (-) strand; PAM type: YTN; PAM sequence: TTC
ttcctctctctgtctctccc

SEQ ID NO: 157559 - DNA, 20 bp, Artificial Sequence
  Description of Artificial Sequence: Synthetic oligonucleotide
  Target: ATXN1; (-) strand; PAM type: YTN; PAM sequence: CTT
cttcctctctctgtctctcc

SEQ ID NO: 157560 - DNA, 20 bp, Artificial Sequence
  Description of Artificial Sequence: Synthetic oligonucleotide
  Target: ATXN1; (-) strand; PAM type: YTN; PAM sequence: TTC
cttcttcctctctctgtctc

SEQ ID NO: 157561 - DNA, 20 bp, Artificial Sequence
  Description of Artificial Sequence: Synthetic oligonucleotide
  Target: ATXN1; (-) strand; PAM type: YTN; PAM sequence: CTT
ccttcttcctctctctgtct

SEQ ID NO: 157562 - DNA, 20 bp, Artificial Sequence
  Description of Artificial Sequence: Synthetic oligonucleotide
  Target: ATXN1; (-) strand; PAM type: YTN; PAM sequence: TTC
ccttccttcttcctctctct

SEQ ID NO: 157563 - DNA, 20 bp, Artificial Sequence
  Description of Artificial Sequence: Synthetic oligonucleotide
  Target: ATXN1; (-) strand; PAM type: YTN; PAM sequence: TTG
ttcccttccttcttcctctc

SEQ ID NO: 157564 - DNA, 20 bp, Artificial Sequence
  Description of Artificial Sequence: Synthetic oligonucleotide
  Target: ATXN1; (-) strand; PAM type: YTN; PAM sequence: TTT
gttcccttccttcttcctct

SEQ ID NO: 157565 - DNA, 20 bp, Artificial Sequence
  Description of Artificial Sequence: Synthetic oligonucleotide
  Target: ATXN1; (-) strand; PAM type: YTN; PAM sequence: TTC
atttgttcccttccttcttc

SEQ ID NO: 157566 - DNA, 20 bp, Artificial Sequence
  Description of Artificial Sequence: Synthetic oligonucleotide
  Target: ATXN1; (-) strand; PAM type: YTN; PAM sequence: TTT
catttgttcccttccttctt

SEQ ID NO: 157567 - DNA, 20 bp, Artificial Sequence
  Description of Artificial Sequence: Synthetic oligonucleotide
  Target: ATXN1; (-) strand; PAM type: YTN; PAM sequence: TTT
tcatttgttcccttccttct

SEQ ID NO: 157568 - DNA, 20 bp, Artificial Sequence
  Description of Artificial Sequence: Synthetic oligonucleotide
  Target: ATXN1; (-) strand; PAM type: YTN; PAM sequence: CTG
tgtgtgtgcataaaatcaaa

SEQ ID NO: 157569 - DNA, 20 bp, Artificial Sequence
  Description of Artificial Sequence: Synthetic oligonucleotide
  Target: ATXN1; (-) strand; PAM type: YTN; PAM sequence: TTC
atacctgtgtgtgtgcataa

SEQ ID NO: 157570 - DNA, 20 bp, Artificial Sequence
  Description of Artificial Sequence: Synthetic oligonucleotide
  Target: ATXN1; (-) strand; PAM type: YTN; PAM sequence: CTG
tgtgagttcatacctgtgtg

SEQ ID NO: 157571 - DNA, 20 bp, Artificial Sequence
  Description of Artificial Sequence: Synthetic oligonucleotide
  Target: ATXN1; (-) strand; PAM type: YTN; PAM sequence: CTG
tgtgtgtctgtgtgagttca

SEQ ID NO: 157572 - DNA, 20 bp, Artificial Sequence
  Description of Artificial Sequence: Synthetic oligonucleotide
  Target: ATXN1; (-) strand; PAM type: YTN; PAM sequence: TTC
agcctgtgtgtgtctgtgtg

SEQ ID NO: 157573 - DNA, 20 bp, Artificial Sequence
  Description of Artificial Sequence: Synthetic oligonucleotide
  Target: ATXN1; (-) strand; PAM type: YTN; PAM sequence: TTC
ccccattcagcctgtgtgtg

SEQ ID NO: 157574 - DNA, 20 bp, Artificial Sequence
  Description of Artificial Sequence: Synthetic oligonucleotide
  Target: ATXN1; (-) strand; PAM type: YTN; PAM sequence: TTT
cccccattcagcctgtgtgt

SEQ ID NO: 157575 - DNA, 20 bp, Artificial Sequence
  Description of Artificial Sequence: Synthetic oligonucleotide
  Target: ATXN1; (-) strand; PAM type: YTN; PAM sequence: TTT
tcccccattcagcctgtgtg

SEQ ID NO: 157576 - DNA, 20 bp, Artificial Sequence
  Description of Artificial Sequence: Synthetic oligonucleotide
  Target: ATXN1; (-) strand; PAM type: YTN; PAM sequence: CTG
agtcattttcccccattcag

SEQ ID NO: 157577 - DNA, 20 bp, Artificial Sequence
  Description of Artificial Sequence: Synthetic oligonucleotide
  Target: ATXN1; (-) strand; PAM type: YTN; PAM sequence: TTG
caaactgagtcattttcccc

SEQ ID NO: 157578 - DNA, 20 bp, Artificial Sequence
  Description of Artificial Sequence: Synthetic oligonucleotide
  Target: ATXN1; (-) strand; PAM type: YTN; PAM sequence: TTT
gcaaactgagtcattttccc

SEQ ID NO: 157579 - DNA, 20 bp, Artificial Sequence
  Description of Artificial Sequence: Synthetic oligonucleotide
  Target: ATXN1; (-) strand; PAM type: YTN; PAM sequence: CTG
ggggagagggaggtttgcaa

SEQ ID NO: 157580 - DNA, 20 bp, Artificial Sequence
  Description of Artificial Sequence: Synthetic oligonucleotide
  Target: ATXN1; (-) strand; PAM type: YTN; PAM sequence: TTA
tagtgtgtggctgggggaga

SEQ ID NO: 157581 - DNA, 20 bp, Artificial Sequence
  Description of Artificial Sequence: Synthetic oligonucleotide
  Target: ATXN1; (-) strand; PAM type: YTN; PAM sequence: TTT
atagtgtgtggctgggggag

SEQ ID NO: 157582 - DNA, 20 bp, Artificial Sequence
  Description of Artificial Sequence: Synthetic oligonucleotide
  Target: ATXN1; (-) strand; PAM type: YTN; PAM sequence: CTC
atttatagtgtgtggctggg

SEQ ID NO: 157583 - DNA, 20 bp, Artificial Sequence
  Description of Artificial Sequence: Synthetic oligonucleotide
  Target: ATXN1; (-) strand; PAM type: YTN; PAM sequence: CTA
tggcaagtagaggtacaacc

SEQ ID NO: 157584 - DNA, 20 bp, Artificial Sequence
  Description of Artificial Sequence: Synthetic oligonucleotide
  Target: ATXN1; (-) strand; PAM type: YTN; PAM sequence: CTG
cctatggcaagtagaggtac

SEQ ID NO: 157585 - DNA, 20 bp, Artificial Sequence
  Description of Artificial Sequence: Synthetic oligonucleotide
  Target: ATXN1; (-) strand; PAM type: YTN; PAM sequence: TTC
tgcctatggcaagtagaggt

SEQ ID NO: 157586 - DNA, 20 bp, Artificial Sequence
  Description of Artificial Sequence: Synthetic oligonucleotide
  Target: ATXN1; (-) strand; PAM type: YTN; PAM sequence: CTT
ctgcctatggcaagtagagg

SEQ ID NO: 157587 - DNA, 20 bp, Artificial Sequence
  Description of Artificial Sequence: Synthetic oligonucleotide
  Target: ATXN1; (-) strand; PAM type: YTN; PAM sequence: CTG
gcttctgcctatggcaagta

SEQ ID NO: 157588 - DNA, 20 bp, Artificial Sequence
  Description of Artificial Sequence: Synthetic oligonucleotide
  Target: ATXN1; (-) strand; PAM type: YTN; PAM sequence: TTC
actggcttctgcctatggca

SEQ ID NO: 157589 - DNA, 20 bp, Artificial Sequence
  Description of Artificial Sequence: Synthetic oligonucleotide
  Target: ATXN1; (-) strand; PAM type: YTN; PAM sequence: TTT
cactggcttctgcctatggc

SEQ ID NO: 157590 - DNA, 20 bp, Artificial Sequence
  Description of Artificial Sequence: Synthetic oligonucleotide
  Target: ATXN1; (-) strand; PAM type: YTN; PAM sequence: TTT
tcactggcttctgcctatgg

SEQ ID NO: 157591 - DNA, 20 bp, Artificial Sequence
  Description of Artificial Sequence: Synthetic oligonucleotide
  Target: ATXN1; (-) strand; PAM type: YTN; PAM sequence: CTT
ttcactggcttctgcctatg

SEQ ID NO: 157592 - DNA, 20 bp, Artificial Sequence
  Description of Artificial Sequence: Synthetic oligonucleotide
  Target: ATXN1; (-) strand; PAM type: YTN; PAM sequence: TTG
atgaccttttcactggcttc

SEQ ID NO: 157593 - DNA, 20 bp, Artificial Sequence
  Description of Artificial Sequence: Synthetic oligonucleotide
  Target: ATXN1; (-) strand; PAM type: YTN; PAM sequence: TTG
aatattgatgaccttttcac

SEQ ID NO: 157594 - DNA, 20 bp, Artificial Sequence
  Description of Artificial Sequence: Synthetic oligonucleotide
  Target: ATXN1; (-) strand; PAM type: YTN; PAM sequence: TTT
gaatattgatgaccttttca

SEQ ID NO: 157595 - DNA, 20 bp, Artificial Sequence
  Description of Artificial Sequence: Synthetic oligonucleotide
  Target: ATXN1; (-) strand; PAM type: YTN; PAM sequence: TTT
tgaatattgatgaccttttc

SEQ ID NO: 157596 - DNA, 20 bp, Artificial Sequence
  Description of Artificial Sequence: Synthetic oligonucleotide
  Target: ATXN1; (-) strand; PAM type: YTN; PAM sequence: TTG
atggaatattttgaatattg

SEQ ID NO: 157597 - DNA, 20 bp, Artificial Sequence
  Description of Artificial Sequence: Synthetic oligonucleotide
  Target: ATXN1; (-) strand; PAM type: YTN; PAM sequence: CTT
gatggaatattttgaatatt

SEQ ID NO: 157598 - DNA, 20 bp, Artificial Sequence
  Description of Artificial Sequence: Synthetic oligonucleotide
  Target: ATXN1; (-) strand; PAM type: YTN; PAM sequence: CTA
acacttgatggaatattttg

SEQ ID NO: 157599 - DNA, 20 bp, Artificial Sequence
  Description of Artificial Sequence: Synthetic oligonucleotide
  Target: ATXN1; (-) strand; PAM type: YTN; PAM sequence: CTA
tagagctaacacttgatgga

SEQ ID NO: 157600 - DNA, 20 bp, Artificial Sequence
  Description of Artificial Sequence: Synthetic oligonucleotide
  Target: ATXN1; (-) strand; PAM type: YTN; PAM sequence: CTA
acagagaccagctatagagc

SEQ ID NO: 157601 - DNA, 20 bp, Artificial Sequence
  Description of Artificial Sequence: Synthetic oligonucleotide
  Target: ATXN1; (-) strand; PAM type: YTN; PAM sequence: TTC
taacagagaccagctataga

SEQ ID NO: 157602 - DNA, 20 bp, Artificial Sequence
  Description of Artificial Sequence: Synthetic oligonucleotide
  Target: ATXN1; (-) strand; PAM type: YTN; PAM sequence: CTG
gttctaacagagaccagcta

SEQ ID NO: 157603 - DNA, 20 bp, Artificial Sequence
  Description of Artificial Sequence: Synthetic oligonucleotide
  Target: ATXN1; (-) strand; PAM type: YTN; PAM sequence: TTG
actggttctaacagagacca

SEQ ID NO: 157604 - DNA, 20 bp, Artificial Sequence
  Description of Artificial Sequence: Synthetic oligonucleotide
  Target: ATXN1; (-) strand; PAM type: YTN; PAM sequence: TTC
gattgactggttctaacaga

SEQ ID NO: 157605 - DNA, 20 bp, Artificial Sequence
  Description of Artificial Sequence: Synthetic oligonucleotide
  Target: ATXN1; (-) strand; PAM type: YTN; PAM sequence: CTG
gggttcgattgactggttct

SEQ ID NO: 157606 - DNA, 20 bp, Artificial Sequence
  Description of Artificial Sequence: Synthetic oligonucleotide
  Target: ATXN1; (-) strand; PAM type: YTN; PAM sequence: TTA
ctggggttcgattgactggt

SEQ ID NO: 157607 - DNA, 20 bp, Artificial Sequence
  Description of Artificial Sequence: Synthetic oligonucleotide
  Target: ATXN1; (-) strand; PAM type: YTN; PAM sequence: CTG
tcattactggggttcgattg

SEQ ID NO: 157608 - DNA, 20 bp, Artificial Sequence
  Description of Artificial Sequence: Synthetic oligonucleotide
  Target: ATXN1; (-) strand; PAM type: YTN; PAM sequence: CTC
tgtcattactggggttcgat

SEQ ID NO: 157609 - DNA, 20 bp, Artificial Sequence
  Description of Artificial Sequence: Synthetic oligonucleotide
  Target: ATXN1; (-) strand; PAM type: YTN; PAM sequence: CTA
agtgggtgctctgtcattac

SEQ ID NO: 157610 - DNA, 20 bp, Artificial Sequence
  Description of Artificial Sequence: Synthetic oligonucleotide
  Target: ATXN1; (-) strand; PAM type: YTN; PAM sequence: CTG
aaagctaagtgggtgctctg

SEQ ID NO: 157611 - DNA, 20 bp, Artificial Sequence
  Description of Artificial Sequence: Synthetic oligonucleotide
  Target: ATXN1; (-) strand; PAM type: YTN; PAM sequence: TTG
gtgctgaaagctaagtgggt

SEQ ID NO: 157612 - DNA, 20 bp, Artificial Sequence
  Description of Artificial Sequence: Synthetic oligonucleotide
  Target: ATXN1; (-) strand; PAM type: YTN; PAM sequence: CTT
ggtgctgaaagctaagtggg

SEQ ID NO: 157613 - DNA, 20 bp, Artificial Sequence
  Description of Artificial Sequence: Synthetic oligonucleotide
  Target: ATXN1; (-) strand; PAM type: YTN; PAM sequence: CTA
gcttggtgctgaaagctaag

SEQ ID NO: 157614 - DNA, 20 bp, Artificial Sequence
  Description of Artificial Sequence: Synthetic oligonucleotide
  Target: ATXN1; (-) strand; PAM type: YTN; PAM sequence: CTG
cagagcctagcttggtgctg

SEQ ID NO: 157615 - DNA, 20 bp, Artificial Sequence
  Description of Artificial Sequence: Synthetic oligonucleotide
  Target: ATXN1; (-) strand; PAM type: YTN; PAM sequence: TTG
tgagccacctgcagagccta

SEQ ID NO: 157616 - DNA, 20 bp, Artificial Sequence
  Description of Artificial Sequence: Synthetic oligonucleotide
  Target: ATXN1; (-) strand; PAM type: YTN; PAM sequence: CTT
gtgagccacctgcagagcct

SEQ ID NO: 157617 - DNA, 20 bp, Artificial Sequence
  Description of Artificial Sequence: Synthetic oligonucleotide
  Target: ATXN1; (-) strand; PAM type: YTN; PAM sequence: CTG
ggcttgtgagccacctgcag

SEQ ID NO: 157618 - DNA, 20 bp, Artificial Sequence
  Description of Artificial Sequence: Synthetic oligonucleotide
  Target: ATXN1; (-) strand; PAM type: YTN; PAM sequence: CTA
agaccgcgctgggcttgtga

SEQ ID NO: 157619 - DNA, 20 bp, Artificial Sequence
  Description of Artificial Sequence: Synthetic oligonucleotide
  Target: ATXN1; (-) strand; PAM type: YTN; PAM sequence: CTC
ataaaatctaagaccgcgct

SEQ ID NO: 157620 - DNA, 20 bp, Artificial Sequence
  Description of Artificial Sequence: Synthetic oligonucleotide
  Target: ATXN1; (-) strand; PAM type: YTN; PAM sequence: TTG
agctcataaaatctaagacc

SEQ ID NO: 157621 - DNA, 20 bp, Artificial Sequence
  Description of Artificial Sequence: Synthetic oligonucleotide
  Target: ATXN1; (-) strand; PAM type: YTN; PAM sequence: TTG
tccattgagctcataaaatc

SEQ ID NO: 157622 - DNA, 20 bp, Artificial Sequence
  Description of Artificial Sequence: Synthetic oligonucleotide
  Target: ATXN1; (-) strand; PAM type: YTN; PAM sequence: CTG
tatgataatagcagttgtcc

SEQ ID NO: 157623 - DNA, 20 bp, Artificial Sequence
  Description of Artificial Sequence: Synthetic oligonucleotide
  Target: ATXN1; (-) strand; PAM type: YTN; PAM sequence: CTG
tcctgtatgataatagcagt

SEQ ID NO: 157624 - DNA, 20 bp, Artificial Sequence
  Description of Artificial Sequence: Synthetic oligonucleotide
  Target: ATXN1; (-) strand; PAM type: YTN; PAM sequence: TTA
gtcctgtcctgtatgataat

SEQ ID NO: 157625 - DNA, 20 bp, Artificial Sequence
  Description of Artificial Sequence: Synthetic oligonucleotide
  Target: ATXN1; (-) strand; PAM type: YTN; PAM sequence: TTT
agtcctgtcctgtatgataa

SEQ ID NO: 157626 - DNA, 20 bp, Artificial Sequence
  Description of Artificial Sequence: Synthetic oligonucleotide
  Target: ATXN1; (-) strand; PAM type: YTN; PAM sequence: CTG
atccatgtttagtcctgtcc

SEQ ID NO: 157627 - DNA, 20 bp, Artificial Sequence
  Description of Artificial Sequence: Synthetic oligonucleotide
  Target: ATXN1; (-) strand; PAM type: YTN; PAM sequence: CTC
tgatccatgtttagtcctgt

SEQ ID NO: 157628 - DNA, 20 bp, Artificial Sequence
  Description of Artificial Sequence: Synthetic oligonucleotide
  Target: ATXN1; (-) strand; PAM type: YTN; PAM sequence: CTC
actctgatccatgtttagtc

SEQ ID NO: 157629 - DNA, 20 bp, Artificial Sequence
  Description of Artificial Sequence: Synthetic oligonucleotide
  Target: ATXN1; (-) strand; PAM type: YTN; PAM sequence: CTC
acagtctcactctgatccat

SEQ ID NO: 157630 - DNA, 20 bp, Artificial Sequence
  Description of Artificial Sequence: Synthetic oligonucleotide
  Target: ATXN1; (-) strand; PAM type: YTN; PAM sequence: TTG
gaactcacagtctcactctg

SEQ ID NO: 157631 - DNA, 20 bp, Artificial Sequence
  Description of Artificial Sequence: Synthetic oligonucleotide
  Target: ATXN1; (-) strand; PAM type: YTN; PAM sequence: CTT
ggaactcacagtctcactct

SEQ ID NO: 157632 - DNA, 20 bp, Artificial Sequence
  Description of Artificial Sequence: Synthetic oligonucleotide
  Target: ATXN1; (-) strand; PAM type: YTN; PAM sequence: TTC
ttggaactcacagtctcact

SEQ ID NO: 157633 - DNA, 20 bp, Artificial Sequence
  Description of Artificial Sequence: Synthetic oligonucleotide
  Target: ATXN1; (-) strand; PAM type: YTN; PAM sequence: CTT
cttggaactcacagtctcac

SEQ ID NO: 157634 - DNA, 20 bp, Artificial Sequence
  Description of Artificial Sequence: Synthetic oligonucleotide
  Target: ATXN1; (-) strand; PAM type: YTN; PAM sequence: CTG
cttcttggaactcacagtct

SEQ ID NO: 157635 - DNA, 20 bp, Artificial Sequence
  Description of Artificial Sequence: Synthetic oligonucleotide
  Target: ATXN1; (-) strand; PAM type: YTN; PAM sequence: CTG
tgcctgcttcttggaactca

SEQ ID NO: 157636 - DNA, 20 bp, Artificial Sequence
  Description of Artificial Sequence: Synthetic oligonucleotide
  Target: ATXN1; (-) strand; PAM type: YTN; PAM sequence: CTC
agtgataaacacactgtgcc

SEQ ID NO: 157637 - DNA, 20 bp, Artificial Sequence
  Description of Artificial Sequence: Synthetic oligonucleotide
  Target: ATXN1; (-) strand; PAM type: YTN; PAM sequence: CTG
gggactcagtgataaacaca

SEQ ID NO: 157638 - DNA, 20 bp, Artificial Sequence
  Description of Artificial Sequence: Synthetic oligonucleotide
  Target: ATXN1; (-) strand; PAM type: YTN; PAM sequence: TTA
ggggctggggactcagtgat

SEQ ID NO: 157639 - DNA, 20 bp, Artificial Sequence
  Description of Artificial Sequence: Synthetic oligonucleotide
  Target: ATXN1; (-) strand; PAM type: YTN; PAM sequence: TTT
aggggctggggactcagtga

SEQ ID NO: 157640 - DNA, 20 bp, Artificial Sequence
  Description of Artificial Sequence: Synthetic oligonucleotide
  Target: ATXN1; (-) strand; PAM type: YTN; PAM sequence: TTT
taggggctggggactcagtg

SEQ ID NO: 157641 - DNA, 20 bp, Artificial Sequence
  Description of Artificial Sequence: Synthetic oligonucleotide
  Target: ATXN1; (-) strand; PAM type: YTN; PAM sequence: CTT
ttaggggctggggactcagt

SEQ ID NO: 157642 - DNA, 20 bp, Artificial Sequence
  Description of Artificial Sequence: Synthetic oligonucleotide
  Target: ATXN1; (-) strand; PAM type: YTN; PAM sequence: CTG
tgcccagccaccaagcatcc

SEQ ID NO: 157643 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccactgtgcc

SEQ ID NO: 157644 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccac

SEQ ID NO: 157645 - DNA, 20 bp, Artificial Sequence
  Description of Artificial Sequence: Synthetic oligonucleotide
  Target: ATXN1; (-) strand; PAM type: YTN; PAM sequence: TTG
gtgtcccaaagtgctgggat

SEQ ID NO: 157646 - DNA, 20 bp, Artificial Sequence
  Description of Artificial Sequence: Synthetic oligonucleotide
  Target: ATXN1; (-) strand; PAM type: YTN; PAM sequence: CTT
ggtgtcccaaagtgctggga

SEQ ID NO: 157647 - DNA, 20 bp, Artificial Sequence
  Description of Artificial Sequence: Synthetic oligonucleotide
  Target: ATXN1; (-) strand; PAM type: YTN; PAM sequence: CTC
aaatgatccacccaccttgg

SEQ ID NO: 157648 - DNA, 20 bp, Artificial Sequence
  Description of Artificial Sequence: Synthetic oligonucleotide
  Target: ATXN1; (-) strand; PAM type: YTN; PAM sequence: CTG
acctcaaatgatccacccac

SEQ ID NO: 157649 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaaatgatccacc

SEQ ID NO: 157650 - DNA, 20 bp, Artificial Sequence
  Description of Artificial Sequence: Synthetic oligonucleotide
  Target: ATXN1; (-) strand; PAM type: YTN; PAM sequence: TTG
aactcctgacctcaaatgat

SEQ ID NO: 157651 - DNA, 20 bp, Artificial Sequence
  Description of Artificial Sequence: Synthetic oligonucleotide
  Target: ATXN1; (-) strand; PAM type: YTN; PAM sequence: CTT
gaactcctgacctcaaatga

SEQ ID NO: 157652 - DNA, 20 bp, Artificial Sequence
  Description of Artificial Sequence: Synthetic oligonucleotide
  Target: ATXN1; (-) strand; PAM type: YTN; PAM sequence: CTG
gtcttgaactcctgacctca

SEQ ID NO: 157653 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtcttgaactc

SEQ ID NO: 157654 - DNA, 20 bp, Artificial Sequence
  Description of Artificial Sequence: Synthetic oligonucleotide
  Target: ATXN1; (-) strand; PAM type: YTN; PAM sequence: TTC
cccatgttggccaggctggt

SEQ ID NO: 157655 - DNA, 20 bp, Artificial Sequence
  Description of Artificial Sequence: Synthetic oligonucleotide
  Target: ATXN1; (-) strand; PAM type: YTN; PAM sequence: TTT
ccccatgttggccaggctgg

SEQ ID NO: 157656 - DNA, 20 bp, Artificial Sequence
  Description of Artificial Sequence: Synthetic oligonucleotide
  Target: ATXN1; (-) strand; PAM type: YTN; PAM sequence: TTA
gtggagacggggtttcccca

SEQ ID NO: 157657 - DNA, 20 bp, Artificial Sequence
  Description of Artificial Sequence: Synthetic oligonucleotide
  Target: ATXN1; (-) strand; PAM type: YTN; PAM sequence: TTT
agtggagacggggtttcccc

SEQ ID NO: 157658 - DNA, 20 bp, Artificial Sequence
  Description of Artificial Sequence: Synthetic oligonucleotide
  Target: ATXN1; (-) strand; PAM type: YTN; PAM sequence: TTT
tagtggagacggggtttccc

SEQ ID NO: 157659 - DNA, 20 bp, Artificial Sequence
  Description of Artificial Sequence: Synthetic oligonucleotide
  Target: ATXN1; (-) strand; PAM type: YTN; PAM sequence: TTT
ttagtggagacggggtttcc

SEQ ID NO: 157660 - DNA, 20 bp, Artificial Sequence
  Description of Artificial Sequence: Synthetic oligonucleotide
  Target: ATXN1; (-) strand; PAM type: YTN; PAM sequence: TTA
tttttagtggagacggggtt

SEQ ID NO: 157661 - DNA, 20 bp, Artificial Sequence
  Description of Artificial Sequence: Synthetic oligonucleotide
  Target: ATXN1; (-) strand; PAM type: YTN; PAM sequence: TTT
atttttagtggagacggggt

SEQ ID NO: 157662 - DNA, 20 bp, Artificial Sequence
  Description of Artificial Sequence: Synthetic oligonucleotide
  Target: ATXN1; (-) strand; PAM type: YTN; PAM sequence: TTT
tatttttagtggagacgggg

SEQ ID NO: 157663 - DNA, 20 bp, Artificial Sequence
  Description of Artificial Sequence: Synthetic oligonucleotide
  Target: ATXN1; (-) strand; PAM type: YTN; PAM sequence: TTT
ttatttttagtggagacggg

SEQ ID NO: 157664 - DNA, 20 bp, Artificial Sequence
  Description of Artificial Sequence: Synthetic oligonucleotide
  Target: ATXN1; (-) strand; PAM type: YTN; PAM sequence: TTT
tttatttttagtggagacgg

SEQ ID NO: 157665 - DNA, 20 bp, Artificial Sequence
  Description of Artificial Sequence: Synthetic oligonucleotide
  Target: ATXN1; (-) strand; PAM type: YTN; PAM sequence: TTT
ttttatttttagtggagacg

SEQ ID NO: 157666 - DNA, 20 bp, Artificial Sequence
  Description of Artificial Sequence: Synthetic oligonucleotide
  Target: ATXN1; (-) strand; PAM type: YTN; PAM sequence: TTT
tttttatttttagtggagac

SEQ ID NO: 157667 - DNA, 20 bp, Artificial Sequence
  Description of Artificial Sequence: Synthetic oligonucleotide
  Target: ATXN1; (-) strand; PAM type: YTN; PAM sequence: TTT
ttttttatttttagtggaga

SEQ ID NO: 157668 - DNA, 20 bp, Artificial Sequence
  Description of Artificial Sequence: Synthetic oligonucleotide
  Target: ATXN1; (-) strand; PAM type: YTN; PAM sequence: TTT
tttttttatttttagtggag

SEQ ID NO: 157669 - DNA, 20 bp, Artificial Sequence
  Description of Artificial Sequence: Synthetic oligonucleotide
  Target: ATXN1; (-) strand; PAM type: YTN; PAM sequence: TTT
ttttttttatttttagtgga

SEQ ID NO: 157670 - DNA, 20 bp, Artificial Sequence
  Description of Artificial Sequence: Synthetic oligonucleotide
  Target: ATXN1; (-) strand; PAM type: YTN; PAM sequence: TTT
tttttttttatttttagtgg

SEQ ID NO: 157671 - DNA, 20 bp, Artificial Sequence
  Description of Artificial Sequence: Synthetic oligonucleotide
  Target: ATXN1; (-) strand; PAM type: YTN; PAM sequence: CTA
attttttttttttattttta

SEQ ID NO: 157672 - DNA, 20 bp, Artificial Sequence
  Description of Artificial Sequence: Synthetic oligonucleotide
  Target: ATXN1; (-) strand; PAM type: YTN; PAM sequence: TTA
caggtgcccgccaccacgca

SEQ ID NO: 157673 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgcccgccac

SEQ ID NO: 157674 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggattacag

SEQ ID NO: 157675 - DNA, 20 bp, Artificial Sequence
  Description of Artificial Sequence: Synthetic oligonucleotide
  Target: ATXN1; (-) strand; PAM type: YTN; PAM sequence: TTC
agcctcccaagtagctggga

SEQ ID NO: 157676 - DNA, 20 bp, Artificial Sequence
  Description of Artificial Sequence: Synthetic oligonucleotide
  Target: ATXN1; (-) strand; PAM type: YTN; PAM sequence: TTT
cagcctcccaagtagctggg

SEQ ID NO: 157677 - DNA, 20 bp, Artificial Sequence
  Description of Artificial Sequence: Synthetic oligonucleotide
  Target: ATXN1; (-) strand; PAM type: YTN; PAM sequence: CTA
gtgtttcagcctcccaagta

SEQ ID NO: 157678 - DNA, 20 bp, Artificial Sequence
  Description of Artificial Sequence: Synthetic oligonucleotide
  Target: ATXN1; (-) strand; PAM type: YTN; PAM sequence: TTC
tagtgtttcagcctcccaag

SEQ ID NO: 157679 - DNA, 20 bp, Artificial Sequence
  Description of Artificial Sequence: Synthetic oligonucleotide
  Target: ATXN1; (-) strand; PAM type: YTN; PAM sequence: TTC
aagtgattctagtgtttcag

SEQ ID NO: 157680 - DNA, 20 bp, Artificial Sequence
  Description of Artificial Sequence: Synthetic oligonucleotide
  Target: ATXN1; (-) strand; PAM type: YTN; PAM sequence: CTG
ggttcaagtgattctagtgt

SEQ ID NO: 157681 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagtgattctag

SEQ ID NO: 157682 - DNA, 20 bp, Artificial Sequence
  Description of Artificial Sequence: Synthetic oligonucleotide
  Target: ATXN1; (-) strand; PAM type: YTN; PAM sequence: CTG
cctcctgggttcaagtgatt

SEQ ID NO: 157683 - DNA, 20 bp, Artificial Sequence
  Description of Artificial Sequence: Synthetic oligonucleotide
  Target: ATXN1; (-) strand; PAM type: YTN; PAM sequence: CTG
caacatctgcctcctgggtt

SEQ ID NO: 157684 - DNA, 20 bp, Artificial Sequence
  Description of Artificial Sequence: Synthetic oligonucleotide
  Target: ATXN1; (-) strand; PAM type: YTN; PAM sequence: CTC
gctgcaacatctgcctcctg

SEQ ID NO: 157685 - DNA, 20 bp, Artificial Sequence
  Description of Artificial Sequence: Synthetic oligonucleotide
  Target: ATXN1; (-) strand; PAM type: YTN; PAM sequence: CTC
ggctcgctgcaacatctgcc

SEQ ID NO: 157686 - DNA, 20 bp, Artificial Sequence
  Description of Artificial Sequence: Synthetic oligonucleotide
  Target: ATXN1; (-) strand; PAM type: YTN; PAM sequence: CTG
gatcgcccagtggcacgatc

SEQ ID NO: 157687 - DNA, 20 bp, Artificial Sequence
  Description of Artificial Sequence: Synthetic oligonucleotide
  Target: ATXN1; (-) strand; PAM type: YTN; PAM sequence: CTG
tggcccaggctggatcgccc

SEQ ID NO: 157688 - DNA, 20 bp, Artificial Sequence
  Description of Artificial Sequence: Synthetic oligonucleotide
  Target: ATXN1; (-) strand; PAM type: YTN; PAM sequence: CTC
tgtggcccaggctggatcgc

SEQ ID NO: 157689 - DNA, 20 bp, Artificial Sequence
  Description of Artificial Sequence: Synthetic oligonucleotide
  Target: ATXN1; (-) strand; PAM type: YTN; PAM sequence: CTC
actctgtggcccaggctgga

SEQ ID NO: 157690 - DNA, 20 bp, Artificial Sequence
  Description of Artificial Sequence: Synthetic oligonucleotide
  Target: ATXN1; (-) strand; PAM type: YTN; PAM sequence: TTG
agacggagtctcactctgtg

SEQ ID NO: 157691 - DNA, 20 bp, Artificial Sequence
  Description of Artificial Sequence: Synthetic oligonucleotide
  Target: ATXN1; (-) strand; PAM type: YTN; PAM sequence: TTT
gagacggagtctcactctgt

SEQ ID NO: 157692 - DNA, 20 bp, Artificial Sequence
  Description of Artificial Sequence: Synthetic oligonucleotide
  Target: ATXN1; (-) strand; PAM type: YTN; PAM sequence: TTT
tgagacggagtctcactctg

SEQ ID NO: 157693 - DNA, 20 bp, Artificial Sequence
  Description of Artificial Sequence: Synthetic oligonucleotide
  Target: ATXN1; (-) strand; PAM type: YTN; PAM sequence: TTT
ttgagacggagtctcactct

SEQ ID NO: 157694 - DNA, 20 bp, Artificial Sequence
  Description of Artificial Sequence: Synthetic oligonucleotide
  Target: ATXN1; (-) strand; PAM type: YTN; PAM sequence: TTT
tttgagacggagtctcactc

SEQ ID NO: 157695 - DNA, 20 bp, Artificial Sequence
  Description of Artificial Sequence: Synthetic oligonucleotide
  Target: ATXN1; (-) strand; PAM type: YTN; PAM sequence: TTT
ttttgagacggagtctcact

SEQ ID NO: 157696 - DNA, 20 bp, Artificial Sequence
  Description of Artificial Sequence: Synthetic oligonucleotide
  Target: ATXN1; (-) strand; PAM type: YTN; PAM sequence: TTT
tttttgagacggagtctcac

SEQ ID NO: 157697 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacggagtctca

SEQ ID NO: 157698 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacggagtctc

SEQ ID NO: 157699 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacggagtct

SEQ ID NO: 157700 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacggagtc

SEQ ID NO: 157701 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacggagt

SEQ ID NO: 157702 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacggag

SEQ ID NO: 157703 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacgga

SEQ ID NO: 157704 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacgg

SEQ ID NO: 157705 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagacg

SEQ ID NO: 157706 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttgagac

SEQ ID NO: 157707 - DNA, 20 bp, Artificial Sequence
  Description of Artificial Sequence: Synthetic oligonucleotide
  Target: ATXN1; (-) strand; PAM type: YTN; PAM sequence: TTG
actttttttttttttttttg

SEQ ID NO: 157708 - DNA, 20 bp, Artificial Sequence
  Description of Artificial Sequence: Synthetic oligonucleotide
  Target: ATXN1; (-) strand; PAM type: YTN; PAM sequence: TTG
gaaattgacttttttttttt

SEQ ID NO: 157709 - DNA, 20 bp, Artificial Sequence
  Description of Artificial Sequence: Synthetic oligonucleotide
  Target: ATXN1; (-) strand; PAM type: YTN; PAM sequence: CTA
gaaaggacattggaaattga

SEQ ID NO: 157710 - DNA, 20 bp, Artificial Sequence
  Description of Artificial Sequence: Synthetic oligonucleotide
  Target: ATXN1; (-) strand; PAM type: YTN; PAM sequence: CTA
catctagaaaggacattgga

SEQ ID NO: 157711 - DNA, 20 bp, Artificial Sequence
  Description of Artificial Sequence: Synthetic oligonucleotide
  Target: ATXN1; (-) strand; PAM type: YTN; PAM sequence: CTA
ctacatctagaaaggacatt

SEQ ID NO: 157712 - DNA, 20 bp, Artificial Sequence
  Description of Artificial Sequence: Synthetic oligonucleotide
  Target: ATXN1; (-) strand; PAM type: YTN; PAM sequence: CTA
gtctactacatctagaaagg

SEQ ID NO: 157713 - DNA, 20 bp, Artificial Sequence
  Description of Artificial Sequence: Synthetic oligonucleotide
  Target: ATXN1; (-) strand; PAM type: YTN; PAM sequence: TTA
cctagtctactacatctaga

SEQ ID NO: 157714 - DNA, 20 bp, Artificial Sequence
  Description of Artificial Sequence: Synthetic oligonucleotide
  Target: ATXN1; (-) strand; PAM type: YTN; PAM sequence: TTG
gtccaaattacctagtctac

SEQ ID NO: 157715 - DNA, 20 bp, Artificial Sequence
  Description of Artificial Sequence: Synthetic oligonucleotide
  Target: ATXN1; (-) strand; PAM type: YTN; PAM sequence: CTC
agaaggagggttggtccaaa

SEQ ID NO: 157716 - DNA, 20 bp, Artificial Sequence
  Description of Artificial Sequence: Synthetic oligonucleotide
  Target: ATXN1; (-) strand; PAM type: YTN; PAM sequence: TTG
tcctcagaaggagggttggt

SEQ ID NO: 157717 - DNA, 20 bp, Artificial Sequence
  Description of Artificial Sequence: Synthetic oligonucleotide
  Target: ATXN1; (-) strand; PAM type: YTN; PAM sequence: TTA
gttgtcctcagaaggagggt

SEQ ID NO: 157718 - DNA, 20 bp, Artificial Sequence
  Description of Artificial Sequence: Synthetic oligonucleotide
  Target: ATXN1; (-) strand; PAM type: YTN; PAM sequence: TTT
agttgtcctcagaaggaggg

SEQ ID NO: 157719 - DNA, 20 bp, Artificial Sequence
  Description of Artificial Sequence: Synthetic oligonucleotide
  Target: ATXN1; (-) strand; PAM type: YTN; PAM sequence: TTT
tagttgtcctcagaaggagg

SEQ ID NO: 157720 - DNA, 20 bp, Artificial Sequence
  Description of Artificial Sequence: Synthetic oligonucleotide
  Target: ATXN1; (-) strand; PAM type: YTN; PAM sequence: TTT
ttagttgtcctcagaaggag

SEQ ID NO: 157721 - DNA, 20 bp, Artificial Sequence
  Description of Artificial Sequence: Synthetic oligonucleotide
  Target: ATXN1; (-) strand; PAM type: YTN; PAM sequence: TTC
agagtttttagttgtcctca

SEQ ID NO: 157722 - DNA, 20 bp, Artificial Sequence
  Description of Artificial Sequence: Synthetic oligonucleotide
  Target: ATXN1; (-) strand; PAM type: YTN; PAM sequence: TTG
ttcagagtttttagttgtcc

SEQ ID NO: 157723 - DNA, 20 bp, Artificial Sequence
  Description of Artificial Sequence: Synthetic oligonucleotide
  Target: ATXN1; (-) strand; PAM type: YTN; PAM sequence: TTT
gttcagagtttttagttgtc

SEQ ID NO: 157724 - DNA, 20 bp, Artificial Sequence
  Description of Artificial Sequence: Synthetic oligonucleotide
  Target: ATXN1; (-) strand; PAM type: YTN; PAM sequence: TTT
tgttcagagtttttagttgt

SEQ ID NO: 157725 - DNA, 20 bp, Artificial Sequence
  Description of Artificial Sequence: Synthetic oligonucleotide
  Target: ATXN1; (-) strand; PAM type: YTN; PAM sequence: TTT
ttgttcagagtttttagttg

SEQ ID NO: 157726 - DNA, 20 bp, Artificial Sequence
  Description of Artificial Sequence: Synthetic oligonucleotide
  Target: ATXN1; (-) strand; PAM type: YTN; PAM sequence: TTA
tatttttgttcagagttttt

SEQ ID NO: 157727 - DNA, 20 bp, Artificial Sequence
  Description of Artificial Sequence: Synthetic oligonucleotide
  Target: ATXN1; (-) strand; PAM type: YTN; PAM sequence: CTT
atatttttgttcagagtttt

SEQ ID NO: 157728 - DNA, 20 bp, Artificial Sequence
  Description of Artificial Sequence: Synthetic oligonucleotide
  Target: ATXN1; (-) strand; PAM type: YTN; PAM sequence: TTG
cttatatttttgttcagagt

SEQ ID NO: 157729 - DNA, 20 bp, Artificial Sequence
  Description of Artificial Sequence: Synthetic oligonucleotide
  Target: ATXN1; (-) strand; PAM type: YTN; PAM sequence: TTT
gcttatatttttgttcagag

SEQ ID NO: 157730 - DNA, 20 bp, Artificial Sequence
  Description of Artificial Sequence: Synthetic oligonucleotide
  Target: ATXN1; (-) strand; PAM type: YTN; PAM sequence: TTG
tttgcttatatttttgttca

SEQ ID NO: 157731 - DNA, 20 bp, Artificial Sequence
  Description of Artificial Sequence: Synthetic oligonucleotide
  Target: ATXN1; (-) strand; PAM type: YTN; PAM sequence: TTT
gtttgcttatatttttgttc

SEQ ID NO: 157732 - DNA, 20 bp, Artificial Sequence
  Description of Artificial Sequence: Synthetic oligonucleotide
  Target: ATXN1; (-) strand; PAM type: YTN; PAM sequence: TTA
tttgtttgcttatatttttg

SEQ ID NO: 157733 - DNA, 20 bp, Artificial Sequence
  Description of Artificial Sequence: Synthetic oligonucleotide
  Target: ATXN1; (-) strand; PAM type: YTN; PAM sequence: TTT
atttgtttgcttatattttt

SEQ ID NO: 157734 - DNA, 20 bp, Artificial Sequence
  Description of Artificial Sequence: Synthetic oligonucleotide
  Target: ATXN1; (-) strand; PAM type: YTN; PAM sequence: TTA
aatttatttgtttgcttata

SEQ ID NO: 157735 - DNA, 20 bp, Artificial Sequence
  Description of Artificial Sequence: Synthetic oligonucleotide
  Target: ATXN1; (-) strand; PAM type: YTN; PAM sequence: TTT
aaatttatttgtttgcttat

SEQ ID NO: 157736 - DNA, 20 bp, Artificial Sequence
  Description of Artificial Sequence: Synthetic oligonucleotide
  Target: ATXN1; (-) strand; PAM type: YTN; PAM sequence: TTT
taaatttatttgtttgctta

SEQ ID NO: 157737 - DNA, 20 bp, Artificial Sequence
  Description of Artificial Sequence: Synthetic oligonucleotide
  Target: ATXN1; (-) strand; PAM type: YTN; PAM sequence: TTT
ttaaatttatttgtttgctt

SEQ ID NO: 157738 - DNA, 20 bp, Artificial Sequence
  Description of Artificial Sequence: Synthetic oligonucleotide
  Target: ATXN1; (-) strand; PAM type: YTN; PAM sequence: TTG
tccagagtttttaaatttat

SEQ ID NO: 157739 - DNA, 20 bp, Artificial Sequence
  Description of Artificial Sequence: Synthetic oligonucleotide
  Target: ATXN1; (-) strand; PAM type: YTN; PAM sequence: TTT
gtccagagtttttaaattta

SEQ ID NO: 157740 - DNA, 20 bp, Artificial Sequence
  Description of Artificial Sequence: Synthetic oligonucleotide
  Target: ATXN1; (-) strand; PAM type: YTN; PAM sequence: TTT
tgtccagagtttttaaattt

SEQ ID NO: 157741 - DNA, 20 bp, Artificial Sequence
  Description of Artificial Sequence: Synthetic oligonucleotide
  Target: ATXN1; (-) strand; PAM type: YTN; PAM sequence: TTA
aacattttgtccagagtttt

SEQ ID NO: 157742 - DNA, 20 bp, Artificial Sequence
  Description of Artificial Sequence: Synthetic oligonucleotide
  Target: ATXN1; (-) strand; PAM type: YTN; PAM sequence: TTT
aaacattttgtccagagttt

SEQ ID NO: 157743 - DNA, 20 bp, Artificial Sequence
  Description of Artificial Sequence: Synthetic oligonucleotide
  Target: ATXN1; (-) strand; PAM type: YTN; PAM sequence: CTA
taagaaaaaaagtttaaaca

SEQ ID NO: 157744 - DNA, 20 bp, Artificial Sequence
  Description of Artificial Sequence: Synthetic oligonucleotide
  Target: ATXN1; (-) strand; PAM type: YTN; PAM sequence: CTG
tccagtactataagaaaaaa

SEQ ID NO: 157745 - DNA, 20 bp, Artificial Sequence
  Description of Artificial Sequence: Synthetic oligonucleotide
  Target: ATXN1; (-) strand; PAM type: YTN; PAM sequence: TTG
ctgtccagtactataagaaa

SEQ ID NO: 157746 - DNA, 20 bp, Artificial Sequence
  Description of Artificial Sequence: Synthetic oligonucleotide
  Target: ATXN1; (-) strand; PAM type: YTN; PAM sequence: TTT
gctgtccagtactataagaa

SEQ ID NO: 157747 - DNA, 20 bp, Artificial Sequence
  Description of Artificial Sequence: Synthetic oligonucleotide
  Target: ATXN1; (-) strand; PAM type: YTN; PAM sequence: TTA
tttgctgtccagtactataa

SEQ ID NO: 157748 - DNA, 20 bp, Artificial Sequence
  Description of Artificial Sequence: Synthetic oligonucleotide
  Target: ATXN1; (-) strand; PAM type: YTN; PAM sequence: CTT
atttgctgtccagtactata

SEQ ID NO: 157749 - DNA, 20 bp, Artificial Sequence
  Description of Artificial Sequence: Synthetic oligonucleotide
  Target: ATXN1; (-) strand; PAM type: YTN; PAM sequence: CTA
tcttatttgctgtccagtac

SEQ ID NO: 157750 - DNA, 20 bp, Artificial Sequence
  Description of Artificial Sequence: Synthetic oligonucleotide
  Target: ATXN1; (-) strand; PAM type: YTN; PAM sequence: TTA
ctatcttatttgctgtccag

SEQ ID NO: 157751 - DNA, 20 bp, Artificial Sequence
  Description of Artificial Sequence: Synthetic oligonucleotide
  Target: ATXN1; (-) strand; PAM type: YTN; PAM sequence: TTT
actatcttatttgctgtcca

SEQ ID NO: 157752 - DNA, 20 bp, Artificial Sequence
  Description of Artificial Sequence: Synthetic oligonucleotide
  Target: ATXN1; (-) strand; PAM type: YTN; PAM sequence: TTT
tactatcttatttgctgtcc

SEQ ID NO: 157753 - DNA, 20 bp, Artificial Sequence
  Description of Artificial Sequence: Synthetic oligonucleotide
  Target: ATXN1; (-) strand; PAM type: YTN; PAM sequence: TTT
ttactatcttatttgctgtc

SEQ ID NO: 157754 - DNA, 20 bp, Artificial Sequence
  Description of Artificial Sequence: Synthetic oligonucleotide
  Target: ATXN1; (-) strand; PAM type: YTN; PAM sequence: CTT
tttactatcttatttgctgt

SEQ ID NO: 157755 - DNA, 20 bp, Artificial Sequence
  Description of Artificial Sequence: Synthetic oligonucleotide
  Target: ATXN1; (-) strand; PAM type: YTN; PAM sequence: CTG
gcctttttactatcttattt

SEQ ID NO: 157756 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccgcgcc

SEQ ID NO: 157757 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccac

SEQ ID NO: 157758 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 157759 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 157760 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 157761 - DNA, 20 bp, Artificial Sequence
  Description of Artificial Sequence: Synthetic oligonucleotide
  Target: ATXN1; (-) strand; PAM type: YTN; PAM sequence: CTC
aggtgatccacgcgccttgg

SEQ ID NO: 157762 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatccacgcgc

SEQ ID NO: 157763 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgatccacg

SEQ ID NO: 157764 - DNA, 20 bp, Artificial Sequence
  Description of Artificial Sequence: Synthetic oligonucleotide
  Target: ATXN1; (-) strand; PAM type: YTN; PAM sequence: CTC
aaactcctgacctcaggtga

SEQ ID NO: 157765 - DNA, 20 bp, Artificial Sequence
  Description of Artificial Sequence: Synthetic oligonucleotide
  Target: ATXN1; (-) strand; PAM type: YTN; PAM sequence: CTG
gtctcaaactcctgacctca

SEQ ID NO: 157766 - DNA, 20 bp, Artificial Sequence
  Description of Artificial Sequence: Synthetic oligonucleotide
  Target: ATXN1; (-) strand; PAM type: YTN; PAM sequence: TTG
ccatggtagccaggctggtc

SEQ ID NO: 157767 - DNA, 20 bp, Artificial Sequence
  Description of Artificial Sequence: Synthetic oligonucleotide
  Target: ATXN1; (-) strand; PAM type: YTN; PAM sequence: TTT
gccatggtagccaggctggt

SEQ ID NO: 157768 - DNA, 20 bp, Artificial Sequence
  Description of Artificial Sequence: Synthetic oligonucleotide
  Target: ATXN1; (-) strand; PAM type: YTN; PAM sequence: TTT
tgccatggtagccaggctgg

SEQ ID NO: 157769 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggttttgcca

SEQ ID NO: 157770 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggttttgcc

SEQ ID NO: 157771 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggttttgc

SEQ ID NO: 157772 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggttttg

SEQ ID NO: 157773 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggg

SEQ ID NO: 157774 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 157775 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 157776 - DNA, 20 bp, Artificial Sequence
  Description of Artificial Sequence: Synthetic oligonucleotide
  Target: ATXN1; (-) strand; PAM type: YTN; PAM sequence: CTA
agttttgtatttttagtaga

SEQ ID NO: 157777 - DNA, 20 bp, Artificial Sequence
  Description of Artificial Sequence: Synthetic oligonucleotide
  Target: ATXN1; (-) strand; PAM type: YTN; PAM sequence: CTG
gctaagttttgtatttttag

SEQ ID NO: 157778 - DNA, 20 bp, Artificial Sequence
  Description of Artificial Sequence: Synthetic oligonucleotide
  Target: ATXN1; (-) strand; PAM type: YTN; PAM sequence: TTA
taggggcccaccaccacacc

SEQ ID NO: 157779 - DNA, 20 bp, Artificial Sequence
  Description of Artificial Sequence: Synthetic oligonucleotide
  Target: ATXN1; (-) strand; PAM type: YTN; PAM sequence: CTG
ggattataggggcccaccac

SEQ ID NO: 157780 - DNA, 20 bp, Artificial Sequence
  Description of Artificial Sequence: Synthetic oligonucleotide
  Target: ATXN1; (-) strand; PAM type: YTN; PAM sequence: CTG
agtagctgggattatagggg

SEQ ID NO: 157781 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctgggattatag

SEQ ID NO: 157782 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagctggga

SEQ ID NO: 157783 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcctgagtagct

SEQ ID NO: 157784 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcctgagta

SEQ ID NO: 157785 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcctgag

SEQ ID NO: 157786 - DNA, 20 bp, Artificial Sequence
  Description of Artificial Sequence: Synthetic oligonucleotide
  Target: ATXN1; (-) strand; PAM type: YTN; PAM sequence: CTC
aaacgattctcctgcctcag

SEQ ID NO: 157787 - DNA, 20 bp, Artificial Sequence
  Description of Artificial Sequence: Synthetic oligonucleotide
  Target: ATXN1; (-) strand; PAM type: YTN; PAM sequence: TTC
gtcccccggactcaaacgat

SEQ ID NO: 157788 - DNA, 20 bp, Artificial Sequence
  Description of Artificial Sequence: Synthetic oligonucleotide
  Target: ATXN1; (-) strand; PAM type: YTN; PAM sequence: CTT
cgtcccccggactcaaacga

SEQ ID NO: 157789 - DNA, 20 bp, Artificial Sequence
  Description of Artificial Sequence: Synthetic oligonucleotide
  Target: ATXN1; (-) strand; PAM type: YTN; PAM sequence: CTG
caaccttcgtcccccggact

SEQ ID NO: 157790 - DNA, 20 bp, Artificial Sequence
  Description of Artificial Sequence: Synthetic oligonucleotide
  Target: ATXN1; (-) strand; PAM type: YTN; PAM sequence: CTC
actgcaaccttcgtcccccg

SEQ ID NO: 157791 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaaccttcgtcc

SEQ ID NO: 157792 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaaccttcgtc

SEQ ID NO: 157793 - DNA, 20 bp, Artificial Sequence
  Description of Artificial Sequence: Synthetic oligonucleotide
  Target: ATXN1; (-) strand; PAM type: YTN; PAM sequence: CTC
agagtaaagtggcacgatct

SEQ ID NO: 157794 - DNA, 20 bp, Artificial Sequence
  Description of Artificial Sequence: Synthetic oligonucleotide
  Target: ATXN1; (-) strand; PAM type: YTN; PAM sequence: CTG
gtctcagagtaaagtggcac

SEQ ID NO: 157795 - DNA, 20 bp, Artificial Sequence
  Description of Artificial Sequence: Synthetic oligonucleotide
  Target: ATXN1; (-) strand; PAM type: YTN; PAM sequence: CTG
gccaggctggtctcagagta

SEQ ID NO: 157796 - DNA, 20 bp, Artificial Sequence
  Description of Artificial Sequence: Synthetic oligonucleotide
  Target: ATXN1; (-) strand; PAM type: YTN; PAM sequence: TTC
accatgctggccaggctggt

SEQ ID NO: 157797 - DNA, 20 bp, Artificial Sequence
  Description of Artificial Sequence: Synthetic oligonucleotide
  Target: ATXN1; (-) strand; PAM type: YTN; PAM sequence: TTT
caccatgctggccaggctgg

SEQ ID NO: 157798 - DNA, 20 bp, Artificial Sequence
  Description of Artificial Sequence: Synthetic oligonucleotide
  Target: ATXN1; (-) strand; PAM type: YTN; PAM sequence: TTA
gtagggacagggtttcacca

SEQ ID NO: 157799 - DNA, 20 bp, Artificial Sequence
  Description of Artificial Sequence: Synthetic oligonucleotide
  Target: ATXN1; (-) strand; PAM type: YTN; PAM sequence: TTT
agtagggacagggtttcacc

SEQ ID NO: 157800 - DNA, 20 bp, Artificial Sequence
  Description of Artificial Sequence: Synthetic oligonucleotide
  Target: ATXN1; (-) strand; PAM type: YTN; PAM sequence: TTT
tagtagggacagggtttcac

SEQ ID NO: 157801 - DNA, 20 bp, Artificial Sequence
  Description of Artificial Sequence: Synthetic oligonucleotide
  Target: ATXN1; (-) strand; PAM type: YTN; PAM sequence: TTT
ttagtagggacagggtttca

SEQ ID NO: 157802 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagggacaggg

SEQ ID NO: 157803 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagggacagg

SEQ ID NO: 157804 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagggacag

SEQ ID NO: 157805 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagggaca

SEQ ID NO: 157806 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtagg

SEQ ID NO: 157807 - DNA, 20 bp, Artificial Sequence
  Description of Artificial Sequence: Synthetic oligonucleotide
  Target: ATXN1; (-) strand; PAM type: YTN; PAM sequence: CTG
gctaatttttgtatttttag

SEQ ID NO: 157808 - DNA, 20 bp, Artificial Sequence
  Description of Artificial Sequence: Synthetic oligonucleotide
  Target: ATXN1; (-) strand; PAM type: YTN; PAM sequence: CTG
ccaccacacctggctaattt

SEQ ID NO: 157809 - DNA, 20 bp, Artificial Sequence
  Description of Artificial Sequence: Synthetic oligonucleotide
  Target: ATXN1; (-) strand; PAM type: YTN; PAM sequence: TTA
taggcgcctgccaccacacc

SEQ ID NO: 157810 - DNA, 20 bp, Artificial Sequence
  Description of Artificial Sequence: Synthetic oligonucleotide
  Target: ATXN1; (-) strand; PAM type: YTN; PAM sequence: CTG
ggattataggcgcctgccac

SEQ ID NO: 157811 - DNA, 20 bp, Artificial Sequence
  Description of Artificial Sequence: Synthetic oligonucleotide
  Target: ATXN1; (-) strand; PAM type: YTN; PAM sequence: CTG
agtagctgggattataggcg

SEQ ID NO: 157812 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctgggattatag

SEQ ID NO: 157813 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagctggga

SEQ ID NO: 157814 - DNA, 20 bp, Artificial Sequence
  Description of Artificial Sequence: Synthetic oligonucleotide
  Target: ATXN1; (-) strand; PAM type: YTN; PAM sequence: TTG
cctcagcctcctgagtagct

SEQ ID NO: 157815 - DNA, 20 bp, Artificial Sequence
  Description of Artificial Sequence: Synthetic oligonucleotide
  Target: ATXN1; (-) strand; PAM type: YTN; PAM sequence: CTT
gcctcagcctcctgagtagc

SEQ ID NO: 157816 - DNA, 20 bp, Artificial Sequence
  Description of Artificial Sequence: Synthetic oligonucleotide
  Target: ATXN1; (-) strand; PAM type: YTN; PAM sequence: CTC
ttgcctcagcctcctgagta

SEQ ID NO: 157817 - DNA, 20 bp, Artificial Sequence
  Description of Artificial Sequence: Synthetic oligonucleotide
  Target: ATXN1; (-) strand; PAM type: YTN; PAM sequence: TTC
tcttgcctcagcctcctgag

SEQ ID NO: 157818 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcttgcctcag

SEQ ID NO: 157819 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagcgattctct

SEQ ID NO: 157820 - DNA, 20 bp, Artificial Sequence
  Description of Artificial Sequence: Synthetic oligonucleotide
  Target: ATXN1; (-) strand; PAM type: YTN; PAM sequence: CTC
cgcctcccgggttcaagcga

SEQ ID NO: 157821 - DNA, 20 bp, Artificial Sequence
  Description of Artificial Sequence: Synthetic oligonucleotide
  Target: ATXN1; (-) strand; PAM type: YTN; PAM sequence: CTG
cagcctccgcctcccgggtt

SEQ ID NO: 157822 - DNA, 20 bp, Artificial Sequence
  Description of Artificial Sequence: Synthetic oligonucleotide
  Target: ATXN1; (-) strand; PAM type: YTN; PAM sequence: TTC
actgcagcctccgcctcccg

SEQ ID NO: 157823 - DNA, 20 bp, Artificial Sequence
  Description of Artificial Sequence: Synthetic oligonucleotide
  Target: ATXN1; (-) strand; PAM type: YTN; PAM sequence: CTC
ggttcactgcagcctccgcc

SEQ ID NO: 157824 - DNA, 20 bp, Artificial Sequence
  Description of Artificial Sequence: Synthetic oligonucleotide
  Target: ATXN1; (-) strand; PAM type: YTN; PAM sequence: CTG
gagtgaagtggcatgatctc

SEQ ID NO: 157825 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggctggagtgaag

SEQ ID NO: 157826 - DNA, 20 bp, Artificial Sequence
  Description of Artificial Sequence: Synthetic oligonucleotide
  Target: ATXN1; (-) strand; PAM type: YTN; PAM sequence: CTC
tgtcgcccaggctggagtga

SEQ ID NO: 157827 - DNA, 20 bp, Artificial Sequence
  Description of Artificial Sequence: Synthetic oligonucleotide
  Target: ATXN1; (-) strand; PAM type: YTN; PAM sequence: TTC
actctgtcgcccaggctgga

SEQ ID NO: 157828 - DNA, 20 bp, Artificial Sequence
  Description of Artificial Sequence: Synthetic oligonucleotide
  Target: ATXN1; (-) strand; PAM type: YTN; PAM sequence: TTT
cactctgtcgcccaggctgg

SEQ ID NO: 157829 - DNA, 20 bp, Artificial Sequence
  Description of Artificial Sequence: Synthetic oligonucleotide
  Target: ATXN1; (-) strand; PAM type: YTN; PAM sequence: CTG
atccaacccaggaagtgtgt

SEQ ID NO: 157830 - DNA, 20 bp, Artificial Sequence
  Description of Artificial Sequence: Synthetic oligonucleotide
  Target: ATXN1; (-) strand; PAM type: YTN; PAM sequence: TTC
ctgatccaacccaggaagtg

SEQ ID NO: 157831 - DNA, 20 bp, Artificial Sequence
  Description of Artificial Sequence: Synthetic oligonucleotide
  Target: ATXN1; (-) strand; PAM type: YTN; PAM sequence: TTT
cctgatccaacccaggaagt

SEQ ID NO: 157832 - DNA, 20 bp, Artificial Sequence
  Description of Artificial Sequence: Synthetic oligonucleotide
  Target: ATXN1; (-) strand; PAM type: YTN; PAM sequence: TTT
tcctgatccaacccaggaag

SEQ ID NO: 157833 - DNA, 20 bp, Artificial Sequence
  Description of Artificial Sequence: Synthetic oligonucleotide
  Target: ATXN1; (-) strand; PAM type: YTN; PAM sequence: CTT
ttcctgatccaacccaggaa

SEQ ID NO: 157834 - DNA, 20 bp, Artificial Sequence
  Description of Artificial Sequence: Synthetic oligonucleotide
  Target: ATXN1; (-) strand; PAM type: YTN; PAM sequence: CTG
ggccatcatcttttcctgat

SEQ ID NO: 157835 - DNA, 20 bp, Artificial Sequence
  Description of Artificial Sequence: Synthetic oligonucleotide
  Target: ATXN1; (-) strand; PAM type: YTN; PAM sequence: CTC
tgggccatcatcttttcctg

SEQ ID NO: 157836 - DNA, 20 bp, Artificial Sequence
  Description of Artificial Sequence: Synthetic oligonucleotide
  Target: ATXN1; (-) strand; PAM type: YTN; PAM sequence: CTC
tctgggccatcatcttttcc

SEQ ID NO: 157837 - DNA, 20 bp, Artificial Sequence
  Description of Artificial Sequence: Synthetic oligonucleotide
  Target: ATXN1; (-) strand; PAM type: YTN; PAM sequence: TTC
acctctctgggccatcatct

SEQ ID NO: 157838 - DNA, 20 bp, Artificial Sequence
  Description of Artificial Sequence: Synthetic oligonucleotide
  Target: ATXN1; (-) strand; PAM type: YTN; PAM sequence: CTT
cacctctctgggccatcatc

SEQ ID NO: 157839 - DNA, 20 bp, Artificial Sequence
  Description of Artificial Sequence: Synthetic oligonucleotide
  Target: ATXN1; (-) strand; PAM type: YTN; PAM sequence: TTC
aggagaaaacaggcccccaa

SEQ ID NO: 157840 - DNA, 20 bp, Artificial Sequence
  Description of Artificial Sequence: Synthetic oligonucleotide
  Target: ATXN1; (-) strand; PAM type: YTN; PAM sequence: CTT
caggagaaaacaggccccca

SEQ ID NO: 157841 - DNA, 20 bp, Artificial Sequence
  Description of Artificial Sequence: Synthetic oligonucleotide
  Target: ATXN1; (-) strand; PAM type: YTN; PAM sequence: TTC
aagtgccttcaggagaaaac

SEQ ID NO: 157842 - DNA, 20 bp, Artificial Sequence
  Description of Artificial Sequence: Synthetic oligonucleotide
  Target: ATXN1; (-) strand; PAM type: YTN; PAM sequence: TTG
gaatgttcaagtgccttcag

SEQ ID NO: 157843 - DNA, 20 bp, Artificial Sequence
  Description of Artificial Sequence: Synthetic oligonucleotide
  Target: ATXN1; (-) strand; PAM type: YTN; PAM sequence: TTT
ggaatgttcaagtgccttca

SEQ ID NO: 157844 - DNA, 20 bp, Artificial Sequence
  Description of Artificial Sequence: Synthetic oligonucleotide
  Target: ATXN1; (-) strand; PAM type: YTN; PAM sequence: CTT
tggaatgttcaagtgccttc

SEQ ID NO: 157845 - DNA, 20 bp, Artificial Sequence
  Description of Artificial Sequence: Synthetic oligonucleotide
  Target: ATXN1; (-) strand; PAM type: YTN; PAM sequence: CTC
cactttggaatgttcaagtg

SEQ ID NO: 157846 - DNA, 20 bp, Artificial Sequence
  Description of Artificial Sequence: Synthetic oligonucleotide
  Target: ATXN1; (-) strand; PAM type: YTN; PAM sequence: CTG
ctccactttggaatgttcaa

SEQ ID NO: 157847 - DNA, 20 bp, Artificial Sequence
  Description of Artificial Sequence: Synthetic oligonucleotide
  Target: ATXN1; (-) strand; PAM type: YTN; PAM sequence: TTC
ccaactgctccactttggaa

SEQ ID NO: 157848 - DNA, 20 bp, Artificial Sequence
  Description of Artificial Sequence: Synthetic oligonucleotide
  Target: ATXN1; (-) strand; PAM type: YTN; PAM sequence: TTT
cccaactgctccactttgga

SEQ ID NO: 157849 - DNA, 20 bp, Artificial Sequence
  Description of Artificial Sequence: Synthetic oligonucleotide
  Target: ATXN1; (-) strand; PAM type: YTN; PAM sequence: TTG
gtttcccaactgctccactt

SEQ ID NO: 157850 - DNA, 20 bp, Artificial Sequence
  Description of Artificial Sequence: Synthetic oligonucleotide
  Target: ATXN1; (-) strand; PAM type: YTN; PAM sequence: CTT
ggtttcccaactgctccact

SEQ ID NO: 157851 - DNA, 20 bp, Artificial Sequence
  Description of Artificial Sequence: Synthetic oligonucleotide
  Target: ATXN1; (-) strand; PAM type: YTN; PAM sequence: CTA
tcaaaagcccacttggtttc

SEQ ID NO: 157852 - DNA, 20 bp, Artificial Sequence
  Description of Artificial Sequence: Synthetic oligonucleotide
  Target: ATXN1; (-) strand; PAM type: YTN; PAM sequence: TTA
acactatcaaaagcccactt

SEQ ID NO: 157853 - DNA, 20 bp, Artificial Sequence
  Description of Artificial Sequence: Synthetic oligonucleotide
  Target: ATXN1; (-) strand; PAM type: YTN; PAM sequence: CTT
aacactatcaaaagcccact

SEQ ID NO: 157854 - DNA, 20 bp, Artificial Sequence
  Description of Artificial Sequence: Synthetic oligonucleotide
  Target: ATXN1; (-) strand; PAM type: YTN; PAM sequence: CTC
ttaacactatcaaaagccca

SEQ ID NO: 157855 - DNA, 20 bp, Artificial Sequence
  Description of Artificial Sequence: Synthetic oligonucleotide
  Target: ATXN1; (-) strand; PAM type: YTN; PAM sequence: CTA
tgctcttaacactatcaaaa

SEQ ID NO: 157856 - DNA, 20 bp, Artificial Sequence
  Description of Artificial Sequence: Synthetic oligonucleotide
  Target: ATXN1; (-) strand; PAM type: YTN; PAM sequence: TTC
cctatgctcttaacactatc

SEQ ID NO: 157857 - DNA, 20 bp, Artificial Sequence
  Description of Artificial Sequence: Synthetic oligonucleotide
  Target: ATXN1; (-) strand; PAM type: YTN; PAM sequence: CTG
ttccctatgctcttaacact

SEQ ID NO: 157858 - DNA, 20 bp, Artificial Sequence
  Description of Artificial Sequence: Synthetic oligonucleotide
  Target: ATXN1; (-) strand; PAM type: YTN; PAM sequence: TTA
cctgttccctatgctcttaa

SEQ ID NO: 157859 - DNA, 20 bp, Artificial Sequence
  Description of Artificial Sequence: Synthetic oligonucleotide
  Target: ATXN1; (-) strand; PAM type: YTN; PAM sequence: CTC
cattacctgttccctatgct

SEQ ID NO: 157860 - DNA, 20 bp, Artificial Sequence
  Description of Artificial Sequence: Synthetic oligonucleotide
  Target: ATXN1; (-) strand; PAM type: YTN; PAM sequence: CTG
aactccattacctgttccct

SEQ ID NO: 157861 - DNA, 20 bp, Artificial Sequence
  Description of Artificial Sequence: Synthetic oligonucleotide
  Target: ATXN1; (-) strand; PAM type: YTN; PAM sequence: TTG
gtgtatcctgaactccatta

SEQ ID NO: 157862 - DNA, 20 bp, Artificial Sequence
  Description of Artificial Sequence: Synthetic oligonucleotide
  Target: ATXN1; (-) strand; PAM type: YTN; PAM sequence: CTT
ggtgtatcctgaactccatt

SEQ ID NO: 157863 - DNA, 20 bp, Artificial Sequence
  Description of Artificial Sequence: Synthetic oligonucleotide
  Target: ATXN1; (-) strand; PAM type: YTN; PAM sequence: CTC
ccttggtgtatcctgaactc

SEQ ID NO: 157864 - DNA, 20 bp, Artificial Sequence
  Description of Artificial Sequence: Synthetic oligonucleotide
  Target: ATXN1; (-) strand; PAM type: YTN; PAM sequence: CTC
accagagaacaccctccctt

SEQ ID NO: 157865 - DNA, 20 bp, Artificial Sequence
  Description of Artificial Sequence: Synthetic oligonucleotide
  Target: ATXN1; (-) strand; PAM type: YTN; PAM sequence: CTC
aaaagaatggggctcaccag

SEQ ID NO: 157866 - DNA, 20 bp, Artificial Sequence
  Description of Artificial Sequence: Synthetic oligonucleotide
  Target: ATXN1; (-) strand; PAM type: YTN; PAM sequence: TTG
gggtcacaactcaaaagaat

SEQ ID NO: 157867 - DNA, 20 bp, Artificial Sequence
  Description of Artificial Sequence: Synthetic oligonucleotide
  Target: ATXN1; (-) strand; PAM type: YTN; PAM sequence: TTT
ggggtcacaactcaaaagaa

SEQ ID NO: 157868 - DNA, 20 bp, Artificial Sequence
  Description of Artificial Sequence: Synthetic oligonucleotide
  Target: ATXN1; (-) strand; PAM type: YTN; PAM sequence: CTT
tggggtcacaactcaaaaga

SEQ ID NO: 157869 - DNA, 20 bp, Artificial Sequence
  Description of Artificial Sequence: Synthetic oligonucleotide
  Target: ATXN1; (-) strand; PAM type: YTN; PAM sequence: CTA
agggacagtgctttggggtc

SEQ ID NO: 157870 - DNA, 20 bp, Artificial Sequence
  Description of Artificial Sequence: Synthetic oligonucleotide
  Target: ATXN1; (-) strand; PAM type: YTN; PAM sequence: CTC
taagggacagtgctttgggg

SEQ ID NO: 157871 - DNA, 20 bp, Artificial Sequence
  Description of Artificial Sequence: Synthetic oligonucleotide
  Target: ATXN1; (-) strand; PAM type: YTN; PAM sequence: CTC
ctctaagggacagtgctttg

SEQ ID NO: 157872 - DNA, 20 bp, Artificial Sequence
  Description of Artificial Sequence: Synthetic oligonucleotide
  Target: ATXN1; (-) strand; PAM type: YTN; PAM sequence: CTG
tctcctctaagggacagtgc

SEQ ID NO: 157873 - DNA, 20 bp, Artificial Sequence
  Description of Artificial Sequence: Synthetic oligonucleotide
  Target: ATXN1; (-) strand; PAM type: YTN; PAM sequence: TTC
actgtctcctctaagggaca

SEQ ID NO: 157874 - DNA, 20 bp, Artificial Sequence
  Description of Artificial Sequence: Synthetic oligonucleotide
  Target: ATXN1; (-) strand; PAM type: YTN; PAM sequence: TTG
tggttcactgtctcctctaa

SEQ ID NO: 157875 - DNA, 20 bp, Artificial Sequence
  Description of Artificial Sequence: Synthetic oligonucleotide
  Target: ATXN1; (-) strand; PAM type: YTN; PAM sequence: CTT
gtggttcactgtctcctcta

SEQ ID NO: 157876 - DNA, 20 bp, Artificial Sequence
  Description of Artificial Sequence: Synthetic oligonucleotide
  Target: ATXN1; (-) strand; PAM type: YTN; PAM sequence: TTG
gcttgtggttcactgtctcc

SEQ ID NO: 157877 - DNA, 20 bp, Artificial Sequence
  Description of Artificial Sequence: Synthetic oligonucleotide
  Target: ATXN1; (-) strand; PAM type: YTN; PAM sequence: CTG
ttggcttgtggttcactgtc

SEQ ID NO: 157878 - DNA, 20 bp, Artificial Sequence
  Description of Artificial Sequence: Synthetic oligonucleotide
  Target: ATXN1; (-) strand; PAM type: YTN; PAM sequence: TTG
aaaggcctgttggcttgtgg

SEQ ID NO: 157879 - DNA, 20 bp, Artificial Sequence
  Description of Artificial Sequence: Synthetic oligonucleotide
  Target: ATXN1; (-) strand; PAM type: YTN; PAM sequence: CTT
gaaaggcctgttggcttgtg

SEQ ID NO: 157880 - DNA, 20 bp, Artificial Sequence
  Description of Artificial Sequence: Synthetic oligonucleotide
  Target: ATXN1; (-) strand; PAM type: YTN; PAM sequence: TTC
agaccttgaaaggcctgttg

SEQ ID NO: 157881 - DNA, 20 bp, Artificial Sequence
  Description of Artificial Sequence: Synthetic oligonucleotide
  Target: ATXN1; (-) strand; PAM type: YTN; PAM sequence: CTT
cagaccttgaaaggcctgtt

SEQ ID NO: 157882 - DNA, 20 bp, Artificial Sequence
  Description of Artificial Sequence: Synthetic oligonucleotide
  Target: ATXN1; (-) strand; PAM type: YTN; PAM sequence: CTG
agcttcagaccttgaaaggc

SEQ ID NO: 157883 - DNA, 20 bp, Artificial Sequence
  Description of Artificial Sequence: Synthetic oligonucleotide
  Target: ATXN1; (-) strand; PAM type: YTN; PAM sequence: CTC
agatgagtcaatctgagctt

SEQ ID NO: 157884 - DNA, 20 bp, Artificial Sequence
  Description of Artificial Sequence: Synthetic oligonucleotide
  Target: ATXN1; (-) strand; PAM type: YTN; PAM sequence: TTA
gggactcagatgagtcaatc

SEQ ID NO: 157885 - DNA, 20 bp, Artificial Sequence
  Description of Artificial Sequence: Synthetic oligonucleotide
  Target: ATXN1; (-) strand; PAM type: YTN; PAM sequence: TTT
agggactcagatgagtcaat

SEQ ID NO: 157886 - DNA, 20 bp, Artificial Sequence
  Description of Artificial Sequence: Synthetic oligonucleotide
  Target: ATXN1; (-) strand; PAM type: YTN; PAM sequence: TTT
tagggactcagatgagtcaa

SEQ ID NO: 157887 - DNA, 20 bp, Artificial Sequence
  Description of Artificial Sequence: Synthetic oligonucleotide
  Target: ATXN1; (-) strand; PAM type: YTN; PAM sequence: TTA
atccagttttagggactcag

SEQ ID NO: 157888 - DNA, 20 bp, Artificial Sequence
  Description of Artificial Sequence: Synthetic oligonucleotide
  Target: ATXN1; (-) strand; PAM type: YTN; PAM sequence: CTT
aatccagttttagggactca

SEQ ID NO: 157889 - DNA, 20 bp, Artificial Sequence
  Description of Artificial Sequence: Synthetic oligonucleotide
  Target: ATXN1; (-) strand; PAM type: YTN; PAM sequence: TTC
aagaccttaatccagtttta

SEQ ID NO: 157890 - DNA, 20 bp, Artificial Sequence
  Description of Artificial Sequence: Synthetic oligonucleotide
  Target: ATXN1; (-) strand; PAM type: YTN; PAM sequence: TTG
tgaaagtaattcaagacctt

SEQ ID NO: 157891 - DNA, 20 bp, Artificial Sequence
  Description of Artificial Sequence: Synthetic oligonucleotide
  Target: ATXN1; (-) strand; PAM type: YTN; PAM sequence: TTG
caaaattgtgaaagtaattc

SEQ ID NO: 157892 - DNA, 20 bp, Artificial Sequence
  Description of Artificial Sequence: Synthetic oligonucleotide
  Target: ATXN1; (-) strand; PAM type: YTN; PAM sequence: TTT
gcaaaattgtgaaagtaatt

SEQ ID NO: 157893 - DNA, 20 bp, Artificial Sequence
  Description of Artificial Sequence: Synthetic oligonucleotide
  Target: ATXN1; (-) strand; PAM type: YTN; PAM sequence: TTA
tttgcaaaattgtgaaagta

SEQ ID NO: 157894 - DNA, 20 bp, Artificial Sequence
  Description of Artificial Sequence: Synthetic oligonucleotide
  Target: ATXN1; (-) strand; PAM type: YTN; PAM sequence: TTT
atttgcaaaattgtgaaagt

SEQ ID NO: 157895 - DNA, 20 bp, Artificial Sequence
  Description of Artificial Sequence: Synthetic oligonucleotide
  Target: ATXN1; (-) strand; PAM type: YTN; PAM sequence: TTT
tatttgcaaaattgtgaaag

SEQ ID NO: 157896 - DNA, 20 bp, Artificial Sequence
  Description of Artificial Sequence: Synthetic oligonucleotide
  Target: ATXN1; (-) strand; PAM type: YTN; PAM sequence: CTT
ttatttgcaaaattgtgaaa

SEQ ID NO: 157897 - DNA, 20 bp, Artificial Sequence
  Description of Artificial Sequence: Synthetic oligonucleotide
  Target: ATXN1; (-) strand; PAM type: YTN; PAM sequence: TTG
aatgcttttatttgcaaaat

SEQ ID NO: 157898 - DNA, 20 bp, Artificial Sequence
  Description of Artificial Sequence: Synthetic oligonucleotide
  Target: ATXN1; (-) strand; PAM type: YTN; PAM sequence: TTA
aattgaatgcttttatttgc

SEQ ID NO: 157899 - DNA, 20 bp, Artificial Sequence
  Description of Artificial Sequence: Synthetic oligonucleotide
  Target: ATXN1; (-) strand; PAM type: YTN; PAM sequence: TTT
aaattgaatgcttttatttg

SEQ ID NO: 157900 - DNA, 20 bp, Artificial Sequence
  Description of Artificial Sequence: Synthetic oligonucleotide
  Target: ATXN1; (-) strand; PAM type: YTN; PAM sequence: TTT
taaattgaatgcttttattt

SEQ ID NO: 157901 - DNA, 20 bp, Artificial Sequence
  Description of Artificial Sequence: Synthetic oligonucleotide
  Target: ATXN1; (-) strand; PAM type: YTN; PAM sequence: TTT
ttaaattgaatgcttttatt

SEQ ID NO: 157902 - DNA, 20 bp, Artificial Sequence
  Description of Artificial Sequence: Synthetic oligonucleotide
  Target: ATXN1; (-) strand; PAM type: YTN; PAM sequence: TTT
tttaaattgaatgcttttat

SEQ ID NO: 157903 - DNA, 20 bp, Artificial Sequence
  Description of Artificial Sequence: Synthetic oligonucleotide
  Target: ATXN1; (-) strand; PAM type: YTN; PAM sequence: CTT
ttttaaattgaatgctttta

SEQ ID NO: 157904 - DNA, 20 bp, Artificial Sequence
  Description of Artificial Sequence: Synthetic oligonucleotide
  Target: ATXN1; (-) strand; PAM type: YTN; PAM sequence: CTC
atgaccaccacccccctttt

SEQ ID NO: 157905 - DNA, 20 bp, Artificial Sequence
  Description of Artificial Sequence: Synthetic oligonucleotide
  Target: ATXN1; (-) strand; PAM type: YTN; PAM sequence: CTC
ctcatgaccaccacccccct

SEQ ID NO: 157906 - DNA, 20 bp, Artificial Sequence
  Description of Artificial Sequence: Synthetic oligonucleotide
  Target: ATXN1; (-) strand; PAM type: YTN; PAM sequence: CTG
gtctcctcatgaccaccacc

SEQ ID NO: 157907 - DNA, 20 bp, Artificial Sequence
  Description of Artificial Sequence: Synthetic oligonucleotide
  Target: ATXN1; (-) strand; PAM type: YTN; PAM sequence: CTA
tctggtctcctcatgaccac

SEQ ID NO: 157908 - DNA, 20 bp, Artificial Sequence
  Description of Artificial Sequence: Synthetic oligonucleotide
  Target: ATXN1; (-) strand; PAM type: YTN; PAM sequence: TTA
tacaagctatctggtctcct

SEQ ID NO: 157909 - DNA, 20 bp, Artificial Sequence
  Description of Artificial Sequence: Synthetic oligonucleotide
  Target: ATXN1; (-) strand; PAM type: YTN; PAM sequence: CTT
atacaagctatctggtctcc

SEQ ID NO: 157910 - DNA, 20 bp, Artificial Sequence
  Description of Artificial Sequence: Synthetic oligonucleotide
  Target: ATXN1; (-) strand; PAM type: YTN; PAM sequence: CTA
gtgcttatacaagctatctg

SEQ ID NO: 157911 - DNA, 20 bp, Artificial Sequence
  Description of Artificial Sequence: Synthetic oligonucleotide
  Target: ATXN1; (-) strand; PAM type: YTN; PAM sequence: TTG
ctagtgcttatacaagctat

SEQ ID NO: 157912 - DNA, 20 bp, Artificial Sequence
  Description of Artificial Sequence: Synthetic oligonucleotide
  Target: ATXN1; (-) strand; PAM type: YTN; PAM sequence: TTT
gctagtgcttatacaagcta

SEQ ID NO: 157913 - DNA, 20 bp, Artificial Sequence
  Description of Artificial Sequence: Synthetic oligonucleotide
  Target: ATXN1; (-) strand; PAM type: YTN; PAM sequence: TTT
tgctagtgcttatacaagct

SEQ ID NO: 157914 - DNA, 20 bp, Artificial Sequence
  Description of Artificial Sequence: Synthetic oligonucleotide
  Target: ATXN1; (-) strand; PAM type: YTN; PAM sequence: CTG
atattttgctagtgcttata

SEQ ID NO: 157915 - DNA, 20 bp, Artificial Sequence
  Description of Artificial Sequence: Synthetic oligonucleotide
  Target: ATXN1; (-) strand; PAM type: YTN; PAM sequence: TTA
agatctgatattttgctagt

SEQ ID NO: 157916 - DNA, 20 bp, Artificial Sequence
  Description of Artificial Sequence: Synthetic oligonucleotide
  Target: ATXN1; (-) strand; PAM type: YTN; PAM sequence: TTT
aagatctgatattttgctag

SEQ ID NO: 157917 - DNA, 20 bp, Artificial Sequence
  Description of Artificial Sequence: Synthetic oligonucleotide
  Target: ATXN1; (-) strand; PAM type: YTN; PAM sequence: TTT
taagatctgatattttgcta

SEQ ID NO: 157918 - DNA, 20 bp, Artificial Sequence
  Description of Artificial Sequence: Synthetic oligonucleotide
  Target: ATXN1; (-) strand; PAM type: YTN; PAM sequence: TTT
ttaagatctgatattttgct

SEQ ID NO: 157919 - DNA, 20 bp, Artificial Sequence
  Description of Artificial Sequence: Synthetic oligonucleotide
  Target: ATXN1; (-) strand; PAM type: YTN; PAM sequence: TTT
tttaagatctgatattttgc

SEQ ID NO: 157920 - DNA, 20 bp, Artificial Sequence
  Description of Artificial Sequence: Synthetic oligonucleotide
  Target: ATXN1; (-) strand; PAM type: YTN; PAM sequence: CTT
ttttaagatctgatattttg

SEQ ID NO: 157921 - DNA, 20 bp, Artificial Sequence
  Description of Artificial Sequence: Synthetic oligonucleotide
  Target: ATXN1; (-) strand; PAM type: YTN; PAM sequence: CTG
gtgcatccttttttaagatc

SEQ ID NO: 157922 - DNA, 20 bp, Artificial Sequence
  Description of Artificial Sequence: Synthetic oligonucleotide
  Target: ATXN1; (-) strand; PAM type: YTN; PAM sequence: CTA
tatgagaagccctggtgcat

SEQ ID NO: 157923 - DNA, 20 bp, Artificial Sequence
  Description of Artificial Sequence: Synthetic oligonucleotide
  Target: ATXN1; (-) strand; PAM type: YTN; PAM sequence: CTC
tatatgagaagccctggtgc

SEQ ID NO: 157924 - DNA, 20 bp, Artificial Sequence
  Description of Artificial Sequence: Synthetic oligonucleotide
  Target: ATXN1; (-) strand; PAM type: YTN; PAM sequence: CTA
tatgtatgactctatatgag

SEQ ID NO: 157925 - DNA, 20 bp, Artificial Sequence
  Description of Artificial Sequence: Synthetic oligonucleotide
  Target: ATXN1; (-) strand; PAM type: YTN; PAM sequence: TTG
taaagtctatatgtatgact

SEQ ID NO: 157926 - DNA, 20 bp, Artificial Sequence
  Description of Artificial Sequence: Synthetic oligonucleotide
  Target: ATXN1; (-) strand; PAM type: YTN; PAM sequence: TTT
gtaaagtctatatgtatgac

SEQ ID NO: 157927 - DNA, 20 bp, Artificial Sequence
  Description of Artificial Sequence: Synthetic oligonucleotide
  Target: ATXN1; (-) strand; PAM type: YTN; PAM sequence: CTT
tgtaaagtctatatgtatga

SEQ ID NO: 157928 - DNA, 20 bp, Artificial Sequence
  Description of Artificial Sequence: Synthetic oligonucleotide
  Target: ATXN1; (-) strand; PAM type: YTN; PAM sequence: TTG
taagcatagtctttgtaaag

SEQ ID NO: 157929 - DNA, 20 bp, Artificial Sequence
  Description of Artificial Sequence: Synthetic oligonucleotide
  Target: ATXN1; (-) strand; PAM type: YTN; PAM sequence: TTA
ttgtaagcatagtctttgta

SEQ ID NO: 157930 - DNA, 20 bp, Artificial Sequence
  Description of Artificial Sequence: Synthetic oligonucleotide
  Target: ATXN1; (-) strand; PAM type: YTN; PAM sequence: TTA
attattgtaagcatagtctt

SEQ ID NO: 157931 - DNA, 20 bp, Artificial Sequence
  Description of Artificial Sequence: Synthetic oligonucleotide
  Target: ATXN1; (-) strand; PAM type: YTN; PAM sequence: CTT
aattattgtaagcatagtct

SEQ ID NO: 157932 - DNA, 20 bp, Artificial Sequence
  Description of Artificial Sequence: Synthetic oligonucleotide
  Target: ATXN1; (-) strand; PAM type: YTN; PAM sequence: TTC
ttaattattgtaagcatagt

SEQ ID NO: 157933 - DNA, 20 bp, Artificial Sequence
  Description of Artificial Sequence: Synthetic oligonucleotide
  Target: ATXN1; (-) strand; PAM type: YTN; PAM sequence: CTT
cttaattattgtaagcatag

SEQ ID NO: 157934 - DNA, 20 bp, Artificial Sequence
  Description of Artificial Sequence: Synthetic oligonucleotide
  Target: ATXN1; (-) strand; PAM type: YTN; PAM sequence: TTA
atcttcttaattattgtaag

SEQ ID NO: 157935 - DNA, 20 bp, Artificial Sequence
  Description of Artificial Sequence: Synthetic oligonucleotide
  Target: ATXN1; (-) strand; PAM type: YTN; PAM sequence: TTT
aatcttcttaattattgtaa

SEQ ID NO: 157936 - DNA, 20 bp, Artificial Sequence
  Description of Artificial Sequence: Synthetic oligonucleotide
  Target: ATXN1; (-) strand; PAM type: YTN; PAM sequence: CTT
taatcttcttaattattgta

SEQ ID NO: 157937 - DNA, 20 bp, Artificial Sequence
  Description of Artificial Sequence: Synthetic oligonucleotide
  Target: ATXN1; (-) strand; PAM type: YTN; PAM sequence: CTG
tctttaatcttcttaattat

SEQ ID NO: 157938 - DNA, 20 bp, Artificial Sequence
  Description of Artificial Sequence: Synthetic oligonucleotide
  Target: ATXN1; (-) strand; PAM type: YTN; PAM sequence: CTC
aagctgtctttaatcttctt

SEQ ID NO: 157939 - DNA, 20 bp, Artificial Sequence
  Description of Artificial Sequence: Synthetic oligonucleotide
  Target: ATXN1; (-) strand; PAM type: YTN; PAM sequence: TTC
tcaagctgtctttaatcttc

SEQ ID NO: 157940 - DNA, 20 bp, Artificial Sequence
  Description of Artificial Sequence: Synthetic oligonucleotide
  Target: ATXN1; (-) strand; PAM type: YTN; PAM sequence: CTA
tcaaaattctcaagctgtct

SEQ ID NO: 157941 - DNA, 20 bp, Artificial Sequence
  Description of Artificial Sequence: Synthetic oligonucleotide
  Target: ATXN1; (-) strand; PAM type: YTN; PAM sequence: TTC
ctatcaaaattctcaagctg

SEQ ID NO: 157942 - DNA, 20 bp, Artificial Sequence
  Description of Artificial Sequence: Synthetic oligonucleotide
  Target: ATXN1; (-) strand; PAM type: YTN; PAM sequence: TTT
cctatcaaaattctcaagct

SEQ ID NO: 157943 - DNA, 20 bp, Artificial Sequence
  Description of Artificial Sequence: Synthetic oligonucleotide
  Target: ATXN1; (-) strand; PAM type: YTN; PAM sequence: CTA
gtttcctatcaaaattctca

SEQ ID NO: 157944 - DNA, 20 bp, Artificial Sequence
  Description of Artificial Sequence: Synthetic oligonucleotide
  Target: ATXN1; (-) strand; PAM type: YTN; PAM sequence: TTC
tagtttcctatcaaaattct

SEQ ID NO: 157945 - DNA, 20 bp, Artificial Sequence
  Description of Artificial Sequence: Synthetic oligonucleotide
  Target: ATXN1; (-) strand; PAM type: YTN; PAM sequence: TTA
aaaacagattctagtttcct

SEQ ID NO: 157946 - DNA, 20 bp, Artificial Sequence
  Description of Artificial Sequence: Synthetic oligonucleotide
  Target: ATXN1; (-) strand; PAM type: YTN; PAM sequence: TTT
aaaaacagattctagtttcc

SEQ ID NO: 157947 - DNA, 20 bp, Artificial Sequence
  Description of Artificial Sequence: Synthetic oligonucleotide
  Target: ATXN1; (-) strand; PAM type: YTN; PAM sequence: TTT
taaaaacagattctagtttc

SEQ ID NO: 157948 - DNA, 20 bp, Artificial Sequence
  Description of Artificial Sequence: Synthetic oligonucleotide
  Target: ATXN1; (-) strand; PAM type: YTN; PAM sequence: CTT
ttaaaaacagattctagttt

SEQ ID NO: 157949 - DNA, 20 bp, Artificial Sequence
  Description of Artificial Sequence: Synthetic oligonucleotide
  Target: ATXN1; (-) strand; PAM type: YTN; PAM sequence: TTC
atggatcttttaaaaacaga

SEQ ID NO: 157950 - DNA, 20 bp, Artificial Sequence
  Description of Artificial Sequence: Synthetic oligonucleotide
  Target: ATXN1; (-) strand; PAM type: YTN; PAM sequence: CTT
catggatcttttaaaaacag

SEQ ID NO: 157951 - DNA, 20 bp, Artificial Sequence
  Description of Artificial Sequence: Synthetic oligonucleotide
  Target: ATXN1; (-) strand; PAM type: YTN; PAM sequence: CTG
gcttcatggatcttttaaaa

SEQ ID NO: 157952 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccatgcc

SEQ ID NO: 157953 - DNA, 20 bp, Artificial Sequence
  Description of Artificial Sequence: Synthetic oligonucleotide
  Target: ATXN1; (-) strand; PAM type: YTN; PAM sequence: CTG
agattacaggcatgagccac

SEQ ID NO: 157954 - DNA, 20 bp, Artificial Sequence
  Description of Artificial Sequence: Synthetic oligonucleotide
  Target: ATXN1; (-) strand; PAM type: YTN; PAM sequence: CTC
ccaaagtactgagattacag

SEQ ID NO: 157955 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtactgaga

SEQ ID NO: 157956 - DNA, 20 bp, Artificial Sequence
  Description of Artificial Sequence: Synthetic oligonucleotide
  Target: ATXN1; (-) strand; PAM type: YTN; PAM sequence: CTG
tctcagcctcccaaagtact

SEQ ID NO: 157957 - DNA, 20 bp, Artificial Sequence
  Description of Artificial Sequence: Synthetic oligonucleotide
  Target: ATXN1; (-) strand; PAM type: YTN; PAM sequence: CTC
cctgtctcagcctcccaaag

SEQ ID NO: 157958 - DNA, 20 bp, Artificial Sequence
  Description of Artificial Sequence: Synthetic oligonucleotide
  Target: ATXN1; (-) strand; PAM type: YTN; PAM sequence: CTC
aagtgatcctccctgtctca

SEQ ID NO: 157959 - DNA, 20 bp, Artificial Sequence
  Description of Artificial Sequence: Synthetic oligonucleotide
  Target: ATXN1; (-) strand; PAM type: YTN; PAM sequence: CTG
gcctcaagtgatcctccctg

SEQ ID NO: 157960 - DNA, 20 bp, Artificial Sequence
  Description of Artificial Sequence: Synthetic oligonucleotide
  Target: ATXN1; (-) strand; PAM type: YTN; PAM sequence: CTC
ctggcctcaagtgatcctcc

SEQ ID NO: 157961 - DNA, 20 bp, Artificial Sequence
  Description of Artificial Sequence: Synthetic oligonucleotide
  Target: ATXN1; (-) strand; PAM type: YTN; PAM sequence: CTG
aaactcctggcctcaagtga

SEQ ID NO: 157962 - DNA, 20 bp, Artificial Sequence
  Description of Artificial Sequence: Synthetic oligonucleotide
  Target: ATXN1; (-) strand; PAM type: YTN; PAM sequence: CTG
gtctgaaactcctggcctca

SEQ ID NO: 157963 - DNA, 20 bp, Artificial Sequence
  Description of Artificial Sequence: Synthetic oligonucleotide
  Target: ATXN1; (-) strand; PAM type: YTN; PAM sequence: TTG
cccagactggtctgaaactc

SEQ ID NO: 157964 - DNA, 20 bp, Artificial Sequence
  Description of Artificial Sequence: Synthetic oligonucleotide
  Target: ATXN1; (-) strand; PAM type: YTN; PAM sequence: TTG
ttgcccagactggtctgaaa

SEQ ID NO: 157965 - DNA, 20 bp, Artificial Sequence
  Description of Artificial Sequence: Synthetic oligonucleotide
  Target: ATXN1; (-) strand; PAM type: YTN; PAM sequence: TTT
gttgcccagactggtctgaa

SEQ ID NO: 157966 - DNA, 20 bp, Artificial Sequence
  Description of Artificial Sequence: Synthetic oligonucleotide
  Target: ATXN1; (-) strand; PAM type: YTN; PAM sequence: TTT
tgttgcccagactggtctga

SEQ ID NO: 157967 - DNA, 20 bp, Artificial Sequence
  Description of Artificial Sequence: Synthetic oligonucleotide
  Target: ATXN1; (-) strand; PAM type: YTN; PAM sequence: CTC
attttgttgcccagactggt

SEQ ID NO: 157968 - DNA, 20 bp, Artificial Sequence
  Description of Artificial Sequence: Synthetic oligonucleotide
  Target: ATXN1; (-) strand; PAM type: YTN; PAM sequence: CTG
tagaaacggggtctcatttt

SEQ ID NO: 157969 - DNA, 20 bp, Artificial Sequence
  Description of Artificial Sequence: Synthetic oligonucleotide
  Target: ATXN1; (-) strand; PAM type: YTN; PAM sequence: TTC
tgtagaaacggggtctcatt

SEQ ID NO: 157970 - DNA, 20 bp, Artificial Sequence
  Description of Artificial Sequence: Synthetic oligonucleotide
  Target: ATXN1; (-) strand; PAM type: YTN; PAM sequence: TTT
ctgtagaaacggggtctcat

SEQ ID NO: 157971 - DNA, 20 bp, Artificial Sequence
  Description of Artificial Sequence: Synthetic oligonucleotide
  Target: ATXN1; (-) strand; PAM type: YTN; PAM sequence: TTA
aatttctgtagaaacggggt

SEQ ID NO: 157972 - DNA, 20 bp, Artificial Sequence
  Description of Artificial Sequence: Synthetic oligonucleotide
  Target: ATXN1; (-) strand; PAM type: YTN; PAM sequence: TTT
aaatttctgtagaaacgggg

SEQ ID NO: 157973 - DNA, 20 bp, Artificial Sequence
  Description of Artificial Sequence: Synthetic oligonucleotide
  Target: ATXN1; (-) strand; PAM type: YTN; PAM sequence: TTT
taaatttctgtagaaacggg

SEQ ID NO: 157974 - DNA, 20 bp, Artificial Sequence
  Description of Artificial Sequence: Synthetic oligonucleotide
  Target: ATXN1; (-) strand; PAM type: YTN; PAM sequence: TTT
ttaaatttctgtagaaacgg

SEQ ID NO: 157975 - DNA, 20 bp, Artificial Sequence
  Description of Artificial Sequence: Synthetic oligonucleotide
  Target: ATXN1; (-) strand; PAM type: YTN; PAM sequence: TTT
tttaaatttctgtagaaacg

SEQ ID NO: 157976 - DNA, 20 bp, Artificial Sequence
  Description of Artificial Sequence: Synthetic oligonucleotide
  Target: ATXN1; (-) strand; PAM type: YTN; PAM sequence: TTT
ttttaaatttctgtagaaac

SEQ ID NO: 157977 - DNA, 20 bp, Artificial Sequence
  Description of Artificial Sequence: Synthetic oligonucleotide
  Target: ATXN1; (-) strand; PAM type: YTN; PAM sequence: TTT
tttttaaatttctgtagaaa

SEQ ID NO: 157978 - DNA, 20 bp, Artificial Sequence
  Description of Artificial Sequence: Synthetic oligonucleotide
  Target: ATXN1; (-) strand; PAM type: YTN; PAM sequence: TTT
ttttttaaatttctgtagaa

SEQ ID NO: 157979 - DNA, 20 bp, Artificial Sequence
  Description of Artificial Sequence: Synthetic oligonucleotide
  Target: ATXN1; (-) strand; PAM type: YTN; PAM sequence: CTA
tttttttttaaatttctgta

SEQ ID NO: 157980 - DNA, 20 bp, Artificial Sequence
  Description of Artificial Sequence: Synthetic oligonucleotide
  Target: ATXN1; (-) strand; PAM type: YTN; PAM sequence: CTA
ggctatttttttttaaattt

SEQ ID NO: 157981 - DNA, 20 bp, Artificial Sequence
  Description of Artificial Sequence: Synthetic oligonucleotide
  Target: ATXN1; (-) strand; PAM type: YTN; PAM sequence: CTA
caggcacgcatcaccacact

SEQ ID NO: 157982 - DNA, 20 bp, Artificial Sequence
  Description of Artificial Sequence: Synthetic oligonucleotide
  Target: ATXN1; (-) strand; PAM type: YTN; PAM sequence: TTG
ggactacaggcacgcatcac

SEQ ID NO: 157983 - DNA, 20 bp, Artificial Sequence
  Description of Artificial Sequence: Synthetic oligonucleotide
  Target: ATXN1; (-) strand; PAM type: YTN; PAM sequence: CTG
agtagttgggactacaggca

SEQ ID NO: 157984 - DNA, 20 bp, Artificial Sequence
  Description of Artificial Sequence: Synthetic oligonucleotide
  Target: ATXN1; (-) strand; PAM type: YTN; PAM sequence: CTC
ctgagtagttgggactacag

SEQ ID NO: 157985 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagttggga

SEQ ID NO: 157986 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcctgagtagtt

SEQ ID NO: 157987 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcctgagta

SEQ ID NO: 157988 - DNA, 20 bp, Artificial Sequence
  Description of Artificial Sequence: Synthetic oligonucleotide
  Target: ATXN1; (-) strand; PAM type: YTN; PAM sequence: CTC
aagatcctcctgcctcagcc

SEQ ID NO: 157989 - DNA, 20 bp, Artificial Sequence
  Description of Artificial Sequence: Synthetic oligonucleotide
  Target: ATXN1; (-) strand; PAM type: YTN; PAM sequence: CTG
ggctcaagatcctcctgcct

SEQ ID NO: 157990 - DNA, 20 bp, Artificial Sequence
  Description of Artificial Sequence: Synthetic oligonucleotide
  Target: ATXN1; (-) strand; PAM type: YTN; PAM sequence: CTC
ctgggctcaagatcctcctg

SEQ ID NO: 157991 - DNA, 20 bp, Artificial Sequence
  Description of Artificial Sequence: Synthetic oligonucleotide
  Target: ATXN1; (-) strand; PAM type: YTN; PAM sequence: CTA
actcctgggctcaagatcct

SEQ ID NO: 157992 - DNA, 20 bp, Artificial Sequence
  Description of Artificial Sequence: Synthetic oligonucleotide
  Target: ATXN1; (-) strand; PAM type: YTN; PAM sequence: CTC
taactcctgggctcaagatc

SEQ ID NO: 157993 - DNA, 20 bp, Artificial Sequence
  Description of Artificial Sequence: Synthetic oligonucleotide
  Target: ATXN1; (-) strand; PAM type: YTN; PAM sequence: CTG
caacctctaactcctgggct

SEQ ID NO: 157994 - DNA, 20 bp, Artificial Sequence
  Description of Artificial Sequence: Synthetic oligonucleotide
  Target: ATXN1; (-) strand; PAM type: YTN; PAM sequence: CTC
actgcaacctctaactcctg

SEQ ID NO: 157995 - DNA, 20 bp, Artificial Sequence
  Description of Artificial Sequence: Synthetic oligonucleotide
  Target: ATXN1; (-) strand; PAM type: YTN; PAM sequence: TTG
tgatcatagctcactgcaac

SEQ ID NO: 157996 - DNA, 20 bp, Artificial Sequence
  Description of Artificial Sequence: Synthetic oligonucleotide
  Target: ATXN1; (-) strand; PAM type: YTN; PAM sequence: CTT
gtgatcatagctcactgcaa

SEQ ID NO: 157997 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtcttgtgatcat

SEQ ID NO: 157998 - DNA, 20 bp, Artificial Sequence
  Description of Artificial Sequence: Synthetic oligonucleotide
  Target: ATXN1; (-) strand; PAM type: YTN; PAM sequence: TTG
tccaggctggagtgcagtct

SEQ ID NO: 157999 - DNA, 20 bp, Artificial Sequence
  Description of Artificial Sequence: Synthetic oligonucleotide
  Target: ATXN1; (-) strand; PAM type: YTN; PAM sequence: CTG
ttgtccaggctggagtgcag

SEQ ID NO: 158000 - DNA, 20 bp, Artificial Sequence
  Description of Artificial Sequence: Synthetic oligonucleotide
  Target: ATXN1; (-) strand; PAM type: YTN; PAM sequence: CTC
tgttgtccaggctggagtgc

SEQ ID NO: 158001 - DNA, 20 bp, Artificial Sequence
  Description of Artificial Sequence: Synthetic oligonucleotide
  Target: ATXN1; (-) strand; PAM type: YTN; PAM sequence: CTC
actctgttgtccaggctgga

SEQ ID NO: 158002 - DNA, 20 bp, Artificial Sequence
  Description of Artificial Sequence: Synthetic oligonucleotide
  Target: ATXN1; (-) strand; PAM type: YTN; PAM sequence: TTA
gagacagagtctcactctgt

SEQ ID NO: 158003 - DNA, 20 bp, Artificial Sequence
  Description of Artificial Sequence: Synthetic oligonucleotide
  Target: ATXN1; (-) strand; PAM type: YTN; PAM sequence: TTT
agagacagagtctcactctg

SEQ ID NO: 158004 - DNA, 20 bp, Artificial Sequence
  Description of Artificial Sequence: Synthetic oligonucleotide
  Target: ATXN1; (-) strand; PAM type: YTN; PAM sequence: TTT
tagagacagagtctcactct

SEQ ID NO: 158005 - DNA, 20 bp, Artificial Sequence
  Description of Artificial Sequence: Synthetic oligonucleotide
  Target: ATXN1; (-) strand; PAM type: YTN; PAM sequence: TTT
ttagagacagagtctcactc

SEQ ID NO: 158006 - DNA, 20 bp, Artificial Sequence
  Description of Artificial Sequence: Synthetic oligonucleotide
  Target: ATXN1; (-) strand; PAM type: YTN; PAM sequence: TTT
tttagagacagagtctcact

SEQ ID NO: 158007 - DNA, 20 bp, Artificial Sequence
  Description of Artificial Sequence: Synthetic oligonucleotide
  Target: ATXN1; (-) strand; PAM type: YTN; PAM sequence: TTT
ttttagagacagagtctcac

SEQ ID NO: 158008 - DNA, 20 bp, Artificial Sequence
  Description of Artificial Sequence: Synthetic oligonucleotide
  Target: ATXN1; (-) strand; PAM type: YTN; PAM sequence: TTT
tttttagagacagagtctca

SEQ ID NO: 158009 - DNA, 20 bp, Artificial Sequence
  Description of Artificial Sequence: Synthetic oligonucleotide
  Target: ATXN1; (-) strand; PAM type: YTN; PAM sequence: TTT
ttttttagagacagagtctc

SEQ ID NO: 158010 - DNA, 20 bp, Artificial Sequence
  Description of Artificial Sequence: Synthetic oligonucleotide
  Target: ATXN1; (-) strand; PAM type: YTN; PAM sequence: TTT
tttttttagagacagagtct

SEQ ID NO: 158011 - DNA, 20 bp, Artificial Sequence
  Description of Artificial Sequence: Synthetic oligonucleotide
  Target: ATXN1; (-) strand; PAM type: YTN; PAM sequence: TTT
ttttttttagagacagagtc

SEQ ID NO: 158012 - DNA, 20 bp, Artificial Sequence
  Description of Artificial Sequence: Synthetic oligonucleotide
  Target: ATXN1; (-) strand; PAM type: YTN; PAM sequence: TTT
tttttttttagagacagagt

SEQ ID NO: 158013 - DNA, 20 bp, Artificial Sequence
  Description of Artificial Sequence: Synthetic oligonucleotide
  Target: ATXN1; (-) strand; PAM type: YTN; PAM sequence: TTT
ttttttttttagagacagag

SEQ ID NO: 158014 - DNA, 20 bp, Artificial Sequence
  Description of Artificial Sequence: Synthetic oligonucleotide
  Target: ATXN1; (-) strand; PAM type: YTN; PAM sequence: TTT
tttttttttttagagacaga

SEQ ID NO: 158015 - DNA, 20 bp, Artificial Sequence
  Description of Artificial Sequence: Synthetic oligonucleotide
  Target: ATXN1; (-) strand; PAM type: YTN; PAM sequence: TTA
ttttttttttttttagagac

SEQ ID NO: 158016 - DNA, 20 bp, Artificial Sequence
  Description of Artificial Sequence: Synthetic oligonucleotide
  Target: ATXN1; (-) strand; PAM type: YTN; PAM sequence: TTT
attttttttttttttagaga

SEQ ID NO: 158017 - DNA, 20 bp, Artificial Sequence
  Description of Artificial Sequence: Synthetic oligonucleotide
  Target: ATXN1; (-) strand; PAM type: YTN; PAM sequence: TTA
tttattttttttttttttag

SEQ ID NO: 158018 - DNA, 20 bp, Artificial Sequence
  Description of Artificial Sequence: Synthetic oligonucleotide
  Target: ATXN1; (-) strand; PAM type: YTN; PAM sequence: TTA
ttatttattttttttttttt

SEQ ID NO: 158019 - DNA, 20 bp, Artificial Sequence
  Description of Artificial Sequence: Synthetic oligonucleotide
  Target: ATXN1; (-) strand; PAM type: YTN; PAM sequence: TTA
ttattatttatttttttttt

SEQ ID NO: 158020 - DNA, 20 bp, Artificial Sequence
  Description of Artificial Sequence: Synthetic oligonucleotide
  Target: ATXN1; (-) strand; PAM type: YTN; PAM sequence: TTA
ttattattatttattttttt

SEQ ID NO: 158021 - DNA, 20 bp, Artificial Sequence
  Description of Artificial Sequence: Synthetic oligonucleotide
  Target: ATXN1; (-) strand; PAM type: YTN; PAM sequence: TTA
ttattattattatttatttt

SEQ ID NO: 158022 - DNA, 20 bp, Artificial Sequence
  Description of Artificial Sequence: Synthetic oligonucleotide
  Target: ATXN1; (-) strand; PAM type: YTN; PAM sequence: TTA
ttattattattattatttat

SEQ ID NO: 158023 - DNA, 20 bp, Artificial Sequence
  Description of Artificial Sequence: Synthetic oligonucleotide
  Target: ATXN1; (-) strand; PAM type: YTN; PAM sequence: TTA
attattattattattattat

SEQ ID NO: 158024 - DNA, 20 bp, Artificial Sequence
  Description of Artificial Sequence: Synthetic oligonucleotide
  Target: ATXN1; (-) strand; PAM type: YTN; PAM sequence: TTA
attaattattattattatta

SEQ ID NO: 158025 - DNA, 20 bp, Artificial Sequence
  Description of Artificial Sequence: Synthetic oligonucleotide
  Target: ATXN1; (-) strand; PAM type: YTN; PAM sequence: TTA
attaattaattattattatt

SEQ ID NO: 158026 - DNA, 20 bp, Artificial Sequence
  Description of Artificial Sequence: Synthetic oligonucleotide
  Target: ATXN1; (-) strand; PAM type: YTN; PAM sequence: TTT
aattaattaattattattat

SEQ ID NO: 158027 - DNA, 20 bp, Artificial Sequence
  Description of Artificial Sequence: Synthetic oligonucleotide
  Target: ATXN1; (-) strand; PAM type: YTN; PAM sequence: TTT
taattaattaattattatta

SEQ ID NO: 158028 - DNA, 20 bp, Artificial Sequence
  Description of Artificial Sequence: Synthetic oligonucleotide
  Target: ATXN1; (-) strand; PAM type: YTN; PAM sequence: TTT
ttaattaattaattattatt

SEQ ID NO: 158029 - DNA, 20 bp, Artificial Sequence
  Description of Artificial Sequence: Synthetic oligonucleotide
  Target: ATXN1; (-) strand; PAM type: YTN; PAM sequence: TTT
tttaattaattaattattat

SEQ ID NO: 158030 - DNA, 20 bp, Artificial Sequence
  Description of Artificial Sequence: Synthetic oligonucleotide
  Target: ATXN1; (-) strand; PAM type: YTN; PAM sequence: CTT
ttttaattaattaattatta

SEQ ID NO: 158031 - DNA, 20 bp, Artificial Sequence
  Description of Artificial Sequence: Synthetic oligonucleotide
  Target: ATXN1; (-) strand; PAM type: YTN; PAM sequence: CTC
atagaccttttttaattaat

SEQ ID NO: 158032 - DNA, 20 bp, Artificial Sequence
  Description of Artificial Sequence: Synthetic oligonucleotide
  Target: ATXN1; (-) strand; PAM type: YTN; PAM sequence: TTC
tcatagaccttttttaatta

SEQ ID NO: 158033 - DNA, 20 bp, Artificial Sequence
  Description of Artificial Sequence: Synthetic oligonucleotide
  Target: ATXN1; (-) strand; PAM type: YTN; PAM sequence: CTA
caattctcatagaccttttt

SEQ ID NO: 158034 - DNA, 20 bp, Artificial Sequence
  Description of Artificial Sequence: Synthetic oligonucleotide
  Target: ATXN1; (-) strand; PAM type: YTN; PAM sequence: TTC
tacaattctcatagaccttt

SEQ ID NO: 158035 - DNA, 20 bp, Artificial Sequence
  Description of Artificial Sequence: Synthetic oligonucleotide
  Target: ATXN1; (-) strand; PAM type: YTN; PAM sequence: TTA
attctacaattctcatagac

SEQ ID NO: 158036 - DNA, 20 bp, Artificial Sequence
  Description of Artificial Sequence: Synthetic oligonucleotide
  Target: ATXN1; (-) strand; PAM type: YTN; PAM sequence: TTT
aattctacaattctcataga

SEQ ID NO: 158037 - DNA, 20 bp, Artificial Sequence
  Description of Artificial Sequence: Synthetic oligonucleotide
  Target: ATXN1; (-) strand; PAM type: YTN; PAM sequence: TTT
taattctacaattctcatag

SEQ ID NO: 158038 - DNA, 20 bp, Artificial Sequence
  Description of Artificial Sequence: Synthetic oligonucleotide
  Target: ATXN1; (-) strand; PAM type: YTN; PAM sequence: TTC
agtggtgtatattttaattc

SEQ ID NO: 158039 - DNA, 20 bp, Artificial Sequence
  Description of Artificial Sequence: Synthetic oligonucleotide
  Target: ATXN1; (-) strand; PAM type: YTN; PAM sequence: TTT
cagtggtgtatattttaatt

SEQ ID NO: 158040 - DNA, 20 bp, Artificial Sequence
  Description of Artificial Sequence: Synthetic oligonucleotide
  Target: ATXN1; (-) strand; PAM type: YTN; PAM sequence: TTG
atttcagtggtgtatatttt

SEQ ID NO: 158041 - DNA, 20 bp, Artificial Sequence
  Description of Artificial Sequence: Synthetic oligonucleotide
  Target: ATXN1; (-) strand; PAM type: YTN; PAM sequence: CTT
gatttcagtggtgtatattt

SEQ ID NO: 158042 - DNA, 20 bp, Artificial Sequence
  Description of Artificial Sequence: Synthetic oligonucleotide
  Target: ATXN1; (-) strand; PAM type: YTN; PAM sequence: TTC
ttgatttcagtggtgtatat

SEQ ID NO: 158043 - DNA, 20 bp, Artificial Sequence
  Description of Artificial Sequence: Synthetic oligonucleotide
  Target: ATXN1; (-) strand; PAM type: YTN; PAM sequence: TTG
cattcttgatttcagtggtg

SEQ ID NO: 158044 - DNA, 20 bp, Artificial Sequence
  Description of Artificial Sequence: Synthetic oligonucleotide
  Target: ATXN1; (-) strand; PAM type: YTN; PAM sequence: CTC
attgcattcttgatttcagt

SEQ ID NO: 158045 - DNA, 20 bp, Artificial Sequence
  Description of Artificial Sequence: Synthetic oligonucleotide
  Target: ATXN1; (-) strand; PAM type: YTN; PAM sequence: CTG
gaaagctcattgcattcttg

SEQ ID NO: 158046 - DNA, 20 bp, Artificial Sequence
  Description of Artificial Sequence: Synthetic oligonucleotide
  Target: ATXN1; (-) strand; PAM type: YTN; PAM sequence: TTC
aactggaaagctcattgcat

SEQ ID NO: 158047 - DNA, 20 bp, Artificial Sequence
  Description of Artificial Sequence: Synthetic oligonucleotide
  Target: ATXN1; (-) strand; PAM type: YTN; PAM sequence: CTA
ttcaactggaaagctcattg

SEQ ID NO: 158048 - DNA, 20 bp, Artificial Sequence
  Description of Artificial Sequence: Synthetic oligonucleotide
  Target: ATXN1; (-) strand; PAM type: YTN; PAM sequence: TTA
atccatgtctattcaactgg

SEQ ID NO: 158049 - DNA, 20 bp, Artificial Sequence
  Description of Artificial Sequence: Synthetic oligonucleotide
  Target: ATXN1; (-) strand; PAM type: YTN; PAM sequence: CTT
aatccatgtctattcaactg

SEQ ID NO: 158050 - DNA, 20 bp, Artificial Sequence
  Description of Artificial Sequence: Synthetic oligonucleotide
  Target: ATXN1; (-) strand; PAM type: YTN; PAM sequence: TTC
ttaatccatgtctattcaac

SEQ ID NO: 158051 - DNA, 20 bp, Artificial Sequence
  Description of Artificial Sequence: Synthetic oligonucleotide
  Target: ATXN1; (-) strand; PAM type: YTN; PAM sequence: TTT
cttaatccatgtctattcaa

SEQ ID NO: 158052 - DNA, 20 bp, Artificial Sequence
  Description of Artificial Sequence: Synthetic oligonucleotide
  Target: ATXN1; (-) strand; PAM type: YTN; PAM sequence: CTT
tcttaatccatgtctattca

SEQ ID NO: 158053 - DNA, 20 bp, Artificial Sequence
  Description of Artificial Sequence: Synthetic oligonucleotide
  Target: ATXN1; (-) strand; PAM type: YTN; PAM sequence: TTC
tttcttaatccatgtctatt

SEQ ID NO: 158054 - DNA, 20 bp, Artificial Sequence
  Description of Artificial Sequence: Synthetic oligonucleotide
  Target: ATXN1; (-) strand; PAM type: YTN; PAM sequence: CTG
aattctttcttaatccatgt

SEQ ID NO: 158055 - DNA, 20 bp, Artificial Sequence
  Description of Artificial Sequence: Synthetic oligonucleotide
  Target: ATXN1; (-) strand; PAM type: YTN; PAM sequence: TTC
ctgaattctttcttaatcca

SEQ ID NO: 158056 - DNA, 20 bp, Artificial Sequence
  Description of Artificial Sequence: Synthetic oligonucleotide
  Target: ATXN1; (-) strand; PAM type: YTN; PAM sequence: TTA
gagaatccagttcctgaatt

SEQ ID NO: 158057 - DNA, 20 bp, Artificial Sequence
  Description of Artificial Sequence: Synthetic oligonucleotide
  Target: ATXN1; (-) strand; PAM type: YTN; PAM sequence: CTA
attagagaatccagttcctg

SEQ ID NO: 158058 - DNA, 20 bp, Artificial Sequence
  Description of Artificial Sequence: Synthetic oligonucleotide
  Target: ATXN1; (-) strand; PAM type: YTN; PAM sequence: CTC
taattagagaatccagttcc

SEQ ID NO: 158059 - DNA, 20 bp, Artificial Sequence
  Description of Artificial Sequence: Synthetic oligonucleotide
  Target: ATXN1; (-) strand; PAM type: YTN; PAM sequence: CTA
aagctctaattagagaatcc

SEQ ID NO: 158060 - DNA, 20 bp, Artificial Sequence
  Description of Artificial Sequence: Synthetic oligonucleotide
  Target: ATXN1; (-) strand; PAM type: YTN; PAM sequence: TTC
taaagctctaattagagaat

SEQ ID NO: 158061 - DNA, 20 bp, Artificial Sequence
  Description of Artificial Sequence: Synthetic oligonucleotide
  Target: ATXN1; (-) strand; PAM type: YTN; PAM sequence: CTT
ctaaagctctaattagagaa

SEQ ID NO: 158062 - DNA, 20 bp, Artificial Sequence
  Description of Artificial Sequence: Synthetic oligonucleotide
  Target: ATXN1; (-) strand; PAM type: YTN; PAM sequence: CTC
ttctaaagctctaattagag

SEQ ID NO: 158063 - DNA, 20 bp, Artificial Sequence
  Description of Artificial Sequence: Synthetic oligonucleotide
  Target: ATXN1; (-) strand; PAM type: YTN; PAM sequence: CTG
tggagtctcttctaaagctc

SEQ ID NO: 158064 - DNA, 20 bp, Artificial Sequence
  Description of Artificial Sequence: Synthetic oligonucleotide
  Target: ATXN1; (-) strand; PAM type: YTN; PAM sequence: CTC
tgtggagtctcttctaaagc

SEQ ID NO: 158065 - DNA, 20 bp, Artificial Sequence
  Description of Artificial Sequence: Synthetic oligonucleotide
  Target: ATXN1; (-) strand; PAM type: YTN; PAM sequence: TTC
actctgtggagtctcttcta

SEQ ID NO: 158066 - DNA, 20 bp, Artificial Sequence
  Description of Artificial Sequence: Synthetic oligonucleotide
  Target: ATXN1; (-) strand; PAM type: YTN; PAM sequence: CTA
tgttcactctgtggagtctc

SEQ ID NO: 158067 - DNA, 20 bp, Artificial Sequence
  Description of Artificial Sequence: Synthetic oligonucleotide
  Target: ATXN1; (-) strand; PAM type: YTN; PAM sequence: CTC
tatgttcactctgtggagtc

SEQ ID NO: 158068 - DNA, 20 bp, Artificial Sequence
  Description of Artificial Sequence: Synthetic oligonucleotide
  Target: ATXN1; (-) strand; PAM type: YTN; PAM sequence: TTG
tctctatgttcactctgtgg

SEQ ID NO: 158069 - DNA, 20 bp, Artificial Sequence
  Description of Artificial Sequence: Synthetic oligonucleotide
  Target: ATXN1; (-) strand; PAM type: YTN; PAM sequence: TTT
gtctctatgttcactctgtg

SEQ ID NO: 158070 - DNA, 20 bp, Artificial Sequence
  Description of Artificial Sequence: Synthetic oligonucleotide
  Target: ATXN1; (-) strand; PAM type: YTN; PAM sequence: TTT
tgtctctatgttcactctgt

SEQ ID NO: 158071 - DNA, 20 bp, Artificial Sequence
  Description of Artificial Sequence: Synthetic oligonucleotide
  Target: ATXN1; (-) strand; PAM type: YTN; PAM sequence: TTT
ttgtctctatgttcactctg

SEQ ID NO: 158072 - DNA, 20 bp, Artificial Sequence
  Description of Artificial Sequence: Synthetic oligonucleotide
  Target: ATXN1; (-) strand; PAM type: YTN; PAM sequence: CTT
tttgtctctatgttcactct

SEQ ID NO: 158073 - DNA, 20 bp, Artificial Sequence
  Description of Artificial Sequence: Synthetic oligonucleotide
  Target: ATXN1; (-) strand; PAM type: YTN; PAM sequence: TTG
accatctttttgtctctatg

SEQ ID NO: 158074 - DNA, 20 bp, Artificial Sequence
  Description of Artificial Sequence: Synthetic oligonucleotide
  Target: ATXN1; (-) strand; PAM type: YTN; PAM sequence: CTC
catattgaccatctttttgt

SEQ ID NO: 158075 - DNA, 20 bp, Artificial Sequence
  Description of Artificial Sequence: Synthetic oligonucleotide
  Target: ATXN1; (-) strand; PAM type: YTN; PAM sequence: CTC
ctccatattgaccatctttt

SEQ ID NO: 158076 - DNA, 20 bp, Artificial Sequence
  Description of Artificial Sequence: Synthetic oligonucleotide
  Target: ATXN1; (-) strand; PAM type: YTN; PAM sequence: CTC
tcctccatattgaccatctt

SEQ ID NO: 158077 - DNA, 20 bp, Artificial Sequence
  Description of Artificial Sequence: Synthetic oligonucleotide
  Target: ATXN1; (-) strand; PAM type: YTN; PAM sequence: TTA
ccctctcctccatattgacc

SEQ ID NO: 158078 - DNA, 20 bp, Artificial Sequence
  Description of Artificial Sequence: Synthetic oligonucleotide
  Target: ATXN1; (-) strand; PAM type: YTN; PAM sequence: CTT
accctctcctccatattgac

SEQ ID NO: 158079 - DNA, 20 bp, Artificial Sequence
  Description of Artificial Sequence: Synthetic oligonucleotide
  Target: ATXN1; (-) strand; PAM type: YTN; PAM sequence: CTC
ttaccctctcctccatattg

SEQ ID NO: 158080 - DNA, 20 bp, Artificial Sequence
  Description of Artificial Sequence: Synthetic oligonucleotide
  Target: ATXN1; (-) strand; PAM type: YTN; PAM sequence: CTA
tgtgtctcttaccctctcct

SEQ ID NO: 158081 - DNA, 20 bp, Artificial Sequence
  Description of Artificial Sequence: Synthetic oligonucleotide
  Target: ATXN1; (-) strand; PAM type: YTN; PAM sequence: CTC
aatgtatcctatgtgtctct

SEQ ID NO: 158082 - DNA, 20 bp, Artificial Sequence
  Description of Artificial Sequence: Synthetic oligonucleotide
  Target: ATXN1; (-) strand; PAM type: YTN; PAM sequence: CTC
tcaatgtatcctatgtgtct

SEQ ID NO: 158083 - DNA, 20 bp, Artificial Sequence
  Description of Artificial Sequence: Synthetic oligonucleotide
  Target: ATXN1; (-) strand; PAM type: YTN; PAM sequence: TTA
gcccctctcaatgtatccta

SEQ ID NO: 158084 - DNA, 20 bp, Artificial Sequence
  Description of Artificial Sequence: Synthetic oligonucleotide
  Target: ATXN1; (-) strand; PAM type: YTN; PAM sequence: CTG
ttagcccctctcaatgtatc

SEQ ID NO: 158085 - DNA, 20 bp, Artificial Sequence
  Description of Artificial Sequence: Synthetic oligonucleotide
  Target: ATXN1; (-) strand; PAM type: YTN; PAM sequence: TTA
tgtgtctgttagcccctctc

SEQ ID NO: 158086 - DNA, 20 bp, Artificial Sequence
  Description of Artificial Sequence: Synthetic oligonucleotide
  Target: ATXN1; (-) strand; PAM type: YTN; PAM sequence: TTC
aaattatgtgtctgttagcc

SEQ ID NO: 158087 - DNA, 20 bp, Artificial Sequence
  Description of Artificial Sequence: Synthetic oligonucleotide
  Target: ATXN1; (-) strand; PAM type: YTN; PAM sequence: CTA
ggattcaaattatgtgtctg

SEQ ID NO: 158088 - DNA, 20 bp, Artificial Sequence
  Description of Artificial Sequence: Synthetic oligonucleotide
  Target: ATXN1; (-) strand; PAM type: YTN; PAM sequence: CTC
ctaggattcaaattatgtgt

SEQ ID NO: 158089 - DNA, 20 bp, Artificial Sequence
  Description of Artificial Sequence: Synthetic oligonucleotide
  Target: ATXN1; (-) strand; PAM type: YTN; PAM sequence: CTC
ctcctaggattcaaattatg

SEQ ID NO: 158090 - DNA, 20 bp, Artificial Sequence
  Description of Artificial Sequence: Synthetic oligonucleotide
  Target: ATXN1; (-) strand; PAM type: YTN; PAM sequence: TTC
ctcctcctaggattcaaatt

SEQ ID NO: 158091 - DNA, 20 bp, Artificial Sequence
  Description of Artificial Sequence: Synthetic oligonucleotide
  Target: ATXN1; (-) strand; PAM type: YTN; PAM sequence: CTT
cctcctcctaggattcaaat

SEQ ID NO: 158092 - DNA, 20 bp, Artificial Sequence
  Description of Artificial Sequence: Synthetic oligonucleotide
  Target: ATXN1; (-) strand; PAM type: YTN; PAM sequence: CTC
ttcctcctcctaggattcaa

SEQ ID NO: 158093 - DNA, 20 bp, Artificial Sequence
  Description of Artificial Sequence: Synthetic oligonucleotide
  Target: ATXN1; (-) strand; PAM type: YTN; PAM sequence: CTC
tcttcctcctcctaggattc

SEQ ID NO: 158094 - DNA, 20 bp, Artificial Sequence
  Description of Artificial Sequence: Synthetic oligonucleotide
  Target: ATXN1; (-) strand; PAM type: YTN; PAM sequence: CTC
cctctcttcctcctcctagg

SEQ ID NO: 158095 - DNA, 20 bp, Artificial Sequence
  Description of Artificial Sequence: Synthetic oligonucleotide
  Target: ATXN1; (-) strand; PAM type: YTN; PAM sequence: TTA
tctccctctcttcctcctcc

SEQ ID NO: 158096 - DNA, 20 bp, Artificial Sequence
  Description of Artificial Sequence: Synthetic oligonucleotide
  Target: ATXN1; (-) strand; PAM type: YTN; PAM sequence: CTA
ttatctccctctcttcctcc

SEQ ID NO: 158097 - DNA, 20 bp, Artificial Sequence
  Description of Artificial Sequence: Synthetic oligonucleotide
  Target: ATXN1; (-) strand; PAM type: YTN; PAM sequence: CTG
ccctattatctccctctctt

SEQ ID NO: 158098 - DNA, 20 bp, Artificial Sequence
  Description of Artificial Sequence: Synthetic oligonucleotide
  Target: ATXN1; (-) strand; PAM type: YTN; PAM sequence: TTC
tgccctattatctccctctc

SEQ ID NO: 158099 - DNA, 20 bp, Artificial Sequence
  Description of Artificial Sequence: Synthetic oligonucleotide
  Target: ATXN1; (-) strand; PAM type: YTN; PAM sequence: CTT
ctgccctattatctccctct

SEQ ID NO: 158100 - DNA, 20 bp, Artificial Sequence
  Description of Artificial Sequence: Synthetic oligonucleotide
  Target: ATXN1; (-) strand; PAM type: YTN; PAM sequence: TTA
acttctgccctattatctcc

SEQ ID NO: 158101 - DNA, 20 bp, Artificial Sequence
  Description of Artificial Sequence: Synthetic oligonucleotide
  Target: ATXN1; (-) strand; PAM type: YTN; PAM sequence: CTC
aagtattaacttctgcccta

SEQ ID NO: 158102 - DNA, 20 bp, Artificial Sequence
  Description of Artificial Sequence: Synthetic oligonucleotide
  Target: ATXN1; (-) strand; PAM type: YTN; PAM sequence: CTC
ctcaagtattaacttctgcc

SEQ ID NO: 158103 - DNA, 20 bp, Artificial Sequence
  Description of Artificial Sequence: Synthetic oligonucleotide
  Target: ATXN1; (-) strand; PAM type: YTN; PAM sequence: TTA
cctcctcaagtattaacttc

SEQ ID NO: 158104 - DNA, 20 bp, Artificial Sequence
  Description of Artificial Sequence: Synthetic oligonucleotide
  Target: ATXN1; (-) strand; PAM type: YTN; PAM sequence: TTA
gccattacctcctcaagtat

SEQ ID NO: 158105 - DNA, 20 bp, Artificial Sequence
  Description of Artificial Sequence: Synthetic oligonucleotide
  Target: ATXN1; (-) strand; PAM type: YTN; PAM sequence: CTT
agccattacctcctcaagta

SEQ ID NO: 158106 - DNA, 20 bp, Artificial Sequence
  Description of Artificial Sequence: Synthetic oligonucleotide
  Target: ATXN1; (-) strand; PAM type: YTN; PAM sequence: TTC
ttagccattacctcctcaag

SEQ ID NO: 158107 - DNA, 20 bp, Artificial Sequence
  Description of Artificial Sequence: Synthetic oligonucleotide
  Target: ATXN1; (-) strand; PAM type: YTN; PAM sequence: TTG
ggaaaattcttagccattac

SEQ ID NO: 158108 - DNA, 20 bp, Artificial Sequence
  Description of Artificial Sequence: Synthetic oligonucleotide
  Target: ATXN1; (-) strand; PAM type: YTN; PAM sequence: TTT
gggaaaattcttagccatta

SEQ ID NO: 158109 - DNA, 20 bp, Artificial Sequence
  Description of Artificial Sequence: Synthetic oligonucleotide
  Target: ATXN1; (-) strand; PAM type: YTN; PAM sequence: TTC
agtttgggaaaattcttagc

SEQ ID NO: 158110 - DNA, 20 bp, Artificial Sequence
  Description of Artificial Sequence: Synthetic oligonucleotide
  Target: ATXN1; (-) strand; PAM type: YTN; PAM sequence: CTT
cagtttgggaaaattcttag

SEQ ID NO: 158111 - DNA, 20 bp, Artificial Sequence
  Description of Artificial Sequence: Synthetic oligonucleotide
  Target: ATXN1; (-) strand; PAM type: YTN; PAM sequence: TTC
ttcagtttgggaaaattctt

SEQ ID NO: 158112 - DNA, 20 bp, Artificial Sequence
  Description of Artificial Sequence: Synthetic oligonucleotide
  Target: ATXN1; (-) strand; PAM type: YTN; PAM sequence: CTT
cttcagtttgggaaaattct

SEQ ID NO: 158113 - DNA, 20 bp, Artificial Sequence
  Description of Artificial Sequence: Synthetic oligonucleotide
  Target: ATXN1; (-) strand; PAM type: YTN; PAM sequence: TTA
tccttcttcagtttgggaaa

SEQ ID NO: 158114 - DNA, 20 bp, Artificial Sequence
  Description of Artificial Sequence: Synthetic oligonucleotide
  Target: ATXN1; (-) strand; PAM type: YTN; PAM sequence: TTA
ttatccttcttcagtttggg

SEQ ID NO: 158115 - DNA, 20 bp, Artificial Sequence
  Description of Artificial Sequence: Synthetic oligonucleotide
  Target: ATXN1; (-) strand; PAM type: YTN; PAM sequence: CTT
attatccttcttcagtttgg

SEQ ID NO: 158116 - DNA, 20 bp, Artificial Sequence
  Description of Artificial Sequence: Synthetic oligonucleotide
  Target: ATXN1; (-) strand; PAM type: YTN; PAM sequence: CTG
tcttattatccttcttcagt

SEQ ID NO: 158117 - DNA, 20 bp, Artificial Sequence
  Description of Artificial Sequence: Synthetic oligonucleotide
  Target: ATXN1; (-) strand; PAM type: YTN; PAM sequence: TTG
aaactgtcttattatccttc

SEQ ID NO: 158118 - DNA, 20 bp, Artificial Sequence
  Description of Artificial Sequence: Synthetic oligonucleotide
  Target: ATXN1; (-) strand; PAM type: YTN; PAM sequence: CTT
gaaactgtcttattatcctt

SEQ ID NO: 158119 - DNA, 20 bp, Artificial Sequence
  Description of Artificial Sequence: Synthetic oligonucleotide
  Target: ATXN1; (-) strand; PAM type: YTN; PAM sequence: TTC
ttgaaactgtcttattatcc

SEQ ID NO: 158120 - DNA, 20 bp, Artificial Sequence
  Description of Artificial Sequence: Synthetic oligonucleotide
  Target: ATXN1; (-) strand; PAM type: YTN; PAM sequence: CTT
cttgaaactgtcttattatc

SEQ ID NO: 158121 - DNA, 20 bp, Artificial Sequence
  Description of Artificial Sequence: Synthetic oligonucleotide
  Target: ATXN1; (-) strand; PAM type: YTN; PAM sequence: CTA
ggccttcttgaaactgtctt

SEQ ID NO: 158122 - DNA, 20 bp, Artificial Sequence
  Description of Artificial Sequence: Synthetic oligonucleotide
  Target: ATXN1; (-) strand; PAM type: YTN; PAM sequence: TTG
gggctaggccttcttgaaac

SEQ ID NO: 158123 - DNA, 20 bp, Artificial Sequence
  Description of Artificial Sequence: Synthetic oligonucleotide
  Target: ATXN1; (-) strand; PAM type: YTN; PAM sequence: TTT
ggggctaggccttcttgaaa

SEQ ID NO: 158124 - DNA, 20 bp, Artificial Sequence
  Description of Artificial Sequence: Synthetic oligonucleotide
  Target: ATXN1; (-) strand; PAM type: YTN; PAM sequence: CTG
tttggggctaggccttcttg

SEQ ID NO: 158125 - DNA, 20 bp, Artificial Sequence
  Description of Artificial Sequence: Synthetic oligonucleotide
  Target: ATXN1; (-) strand; PAM type: YTN; PAM sequence: TTC
ctgtttggggctaggccttc

SEQ ID NO: 158126 - DNA, 20 bp, Artificial Sequence
  Description of Artificial Sequence: Synthetic oligonucleotide
  Target: ATXN1; (-) strand; PAM type: YTN; PAM sequence: TTT
cctgtttggggctaggcctt

SEQ ID NO: 158127 - DNA, 20 bp, Artificial Sequence
  Description of Artificial Sequence: Synthetic oligonucleotide
  Target: ATXN1; (-) strand; PAM type: YTN; PAM sequence: TTT
tcctgtttggggctaggcct

SEQ ID NO: 158128 - DNA, 20 bp, Artificial Sequence
  Description of Artificial Sequence: Synthetic oligonucleotide
  Target: ATXN1; (-) strand; PAM type: YTN; PAM sequence: TTT
ttcctgtttggggctaggcc

SEQ ID NO: 158129 - DNA, 20 bp, Artificial Sequence
  Description of Artificial Sequence: Synthetic oligonucleotide
  Target: ATXN1; (-) strand; PAM type: YTN; PAM sequence: TTA
tttttcctgtttggggctag

SEQ ID NO: 158130 - DNA, 20 bp, Artificial Sequence
  Description of Artificial Sequence: Synthetic oligonucleotide
  Target: ATXN1; (-) strand; PAM type: YTN; PAM sequence: TTT
atttttcctgtttggggcta

SEQ ID NO: 158131 - DNA, 20 bp, Artificial Sequence
  Description of Artificial Sequence: Synthetic oligonucleotide
  Target: ATXN1; (-) strand; PAM type: YTN; PAM sequence: TTG
tttatttttcctgtttgggg

SEQ ID NO: 158132 - DNA, 20 bp, Artificial Sequence
  Description of Artificial Sequence: Synthetic oligonucleotide
  Target: ATXN1; (-) strand; PAM type: YTN; PAM sequence: TTT
gtttatttttcctgtttggg

SEQ ID NO: 158133 - DNA, 20 bp, Artificial Sequence
  Description of Artificial Sequence: Synthetic oligonucleotide
  Target: ATXN1; (-) strand; PAM type: YTN; PAM sequence: TTT
tgtttatttttcctgtttgg

SEQ ID NO: 158134 - DNA, 20 bp, Artificial Sequence
  Description of Artificial Sequence: Synthetic oligonucleotide
  Target: ATXN1; (-) strand; PAM type: YTN; PAM sequence: TTT
ttgtttatttttcctgtttg

SEQ ID NO: 158135 - DNA, 20 bp, Artificial Sequence
  Description of Artificial Sequence: Synthetic oligonucleotide
  Target: ATXN1; (-) strand; PAM type: YTN; PAM sequence: CTT
tttgtttatttttcctgttt

SEQ ID NO: 158136 - DNA, 20 bp, Artificial Sequence
  Description of Artificial Sequence: Synthetic oligonucleotide
  Target: ATXN1; (-) strand; PAM type: YTN; PAM sequence: TTC
tttttgtttatttttcctgt

SEQ ID NO: 158137 - DNA, 20 bp, Artificial Sequence
  Description of Artificial Sequence: Synthetic oligonucleotide
  Target: ATXN1; (-) strand; PAM type: YTN; PAM sequence: TTT
ctttttgtttatttttcctg

SEQ ID NO: 158138 - DNA, 20 bp, Artificial Sequence
  Description of Artificial Sequence: Synthetic oligonucleotide
  Target: ATXN1; (-) strand; PAM type: YTN; PAM sequence: CTC
agtgaggatttctttttgtt

SEQ ID NO: 158139 - DNA, 20 bp, Artificial Sequence
  Description of Artificial Sequence: Synthetic oligonucleotide
  Target: ATXN1; (-) strand; PAM type: YTN; PAM sequence: CTG
cctcagtgaggatttctttt

SEQ ID NO: 158140 - DNA, 20 bp, Artificial Sequence
  Description of Artificial Sequence: Synthetic oligonucleotide
  Target: ATXN1; (-) strand; PAM type: YTN; PAM sequence: CTC
atctgcctcagtgaggattt

SEQ ID NO: 158141 - DNA, 20 bp, Artificial Sequence
  Description of Artificial Sequence: Synthetic oligonucleotide
  Target: ATXN1; (-) strand; PAM type: YTN; PAM sequence: TTC
tcatctgcctcagtgaggat

SEQ ID NO: 158142 - DNA, 20 bp, Artificial Sequence
  Description of Artificial Sequence: Synthetic oligonucleotide
  Target: ATXN1; (-) strand; PAM type: YTN; PAM sequence: TTA
attctcatctgcctcagtga

SEQ ID NO: 158143 - DNA, 20 bp, Artificial Sequence
  Description of Artificial Sequence: Synthetic oligonucleotide
  Target: ATXN1; (-) strand; PAM type: YTN; PAM sequence: TTT
aattctcatctgcctcagtg

SEQ ID NO: 158144 - DNA, 20 bp, Artificial Sequence
  Description of Artificial Sequence: Synthetic oligonucleotide
  Target: ATXN1; (-) strand; PAM type: YTN; PAM sequence: TTA
tagcagtttaattctcatct

SEQ ID NO: 158145 - DNA, 20 bp, Artificial Sequence
  Description of Artificial Sequence: Synthetic oligonucleotide
  Target: ATXN1; (-) strand; PAM type: YTN; PAM sequence: TTT
atagcagtttaattctcatc

SEQ ID NO: 158146 - DNA, 20 bp, Artificial Sequence
  Description of Artificial Sequence: Synthetic oligonucleotide
  Target: ATXN1; (-) strand; PAM type: YTN; PAM sequence: TTG
atttatagcagtttaattct

SEQ ID NO: 158147 - DNA, 20 bp, Artificial Sequence
  Description of Artificial Sequence: Synthetic oligonucleotide
  Target: ATXN1; (-) strand; PAM type: YTN; PAM sequence: TTT
gatttatagcagtttaattc

SEQ ID NO: 158148 - DNA, 20 bp, Artificial Sequence
  Description of Artificial Sequence: Synthetic oligonucleotide
  Target: ATXN1; (-) strand; PAM type: YTN; PAM sequence: CTT
tgatttatagcagtttaatt

SEQ ID NO: 158149 - DNA, 20 bp, Artificial Sequence
  Description of Artificial Sequence: Synthetic oligonucleotide
  Target: ATXN1; (-) strand; PAM type: YTN; PAM sequence: TTA
caagatgtctttgatttata

SEQ ID NO: 158150 - DNA, 20 bp, Artificial Sequence
  Description of Artificial Sequence: Synthetic oligonucleotide
  Target: ATXN1; (-) strand; PAM type: YTN; PAM sequence: TTT
acaagatgtctttgatttat

SEQ ID NO: 158151 - DNA, 20 bp, Artificial Sequence
  Description of Artificial Sequence: Synthetic oligonucleotide
  Target: ATXN1; (-) strand; PAM type: YTN; PAM sequence: TTA
gtttacaagatgtctttgat

SEQ ID NO: 158152 - DNA, 20 bp, Artificial Sequence
  Description of Artificial Sequence: Synthetic oligonucleotide
  Target: ATXN1; (-) strand; PAM type: YTN; PAM sequence: TTT
agtttacaagatgtctttga

SEQ ID NO: 158153 - DNA, 20 bp, Artificial Sequence
  Description of Artificial Sequence: Synthetic oligonucleotide
  Target: ATXN1; (-) strand; PAM type: YTN; PAM sequence: CTG
tttagtttacaagatgtctt

SEQ ID NO: 158154 - DNA, 20 bp, Artificial Sequence
  Description of Artificial Sequence: Synthetic oligonucleotide
  Target: ATXN1; (-) strand; PAM type: YTN; PAM sequence: TTC
ctgtttagtttacaagatgt

SEQ ID NO: 158155 - DNA, 20 bp, Artificial Sequence
  Description of Artificial Sequence: Synthetic oligonucleotide
  Target: ATXN1; (-) strand; PAM type: YTN; PAM sequence: TTT
cctgtttagtttacaagatg

SEQ ID NO: 158156 - DNA, 20 bp, Artificial Sequence
  Description of Artificial Sequence: Synthetic oligonucleotide
  Target: ATXN1; (-) strand; PAM type: YTN; PAM sequence: TTT
tcctgtttagtttacaagat

SEQ ID NO: 158157 - DNA, 20 bp, Artificial Sequence
  Description of Artificial Sequence: Synthetic oligonucleotide
  Target: ATXN1; (-) strand; PAM type: YTN; PAM sequence: TTT
ttcctgtttagtttacaaga

SEQ ID NO: 158158 - DNA, 20 bp, Artificial Sequence
  Description of Artificial Sequence: Synthetic oligonucleotide
  Target: ATXN1; (-) strand; PAM type: YTN; PAM sequence: TTT
tttcctgtttagtttacaag

SEQ ID NO: 158159 - DNA, 20 bp, Artificial Sequence
  Description of Artificial Sequence: Synthetic oligonucleotide
  Target: ATXN1; (-) strand; PAM type: YTN; PAM sequence: TTA
acgatattttttcctgttta

SEQ ID NO: 158160 - DNA, 20 bp, Artificial Sequence
  Description of Artificial Sequence: Synthetic oligonucleotide
  Target: ATXN1; (-) strand; PAM type: YTN; PAM sequence: TTT
aacgatattttttcctgttt

SEQ ID NO: 158161 - DNA, 20 bp, Artificial Sequence
  Description of Artificial Sequence: Synthetic oligonucleotide
  Target: ATXN1; (-) strand; PAM type: YTN; PAM sequence: TTT
taacgatattttttcctgtt

SEQ ID NO: 158162 - DNA, 20 bp, Artificial Sequence
  Description of Artificial Sequence: Synthetic oligonucleotide
  Target: ATXN1; (-) strand; PAM type: YTN; PAM sequence: CTT
ttaacgatattttttcctgt

SEQ ID NO: 158163 - DNA, 20 bp, Artificial Sequence
  Description of Artificial Sequence: Synthetic oligonucleotide
  Target: ATXN1; (-) strand; PAM type: YTN; PAM sequence: CTA
gaggcttttaacgatatttt

SEQ ID NO: 158164 - DNA, 20 bp, Artificial Sequence
  Description of Artificial Sequence: Synthetic oligonucleotide
  Target: ATXN1; (-) strand; PAM type: YTN; PAM sequence: TTC
tagaggcttttaacgatatt

SEQ ID NO: 158165 - DNA, 20 bp, Artificial Sequence
  Description of Artificial Sequence: Synthetic oligonucleotide
  Target: ATXN1; (-) strand; PAM type: YTN; PAM sequence: CTG
ttctagaggcttttaacgat

SEQ ID NO: 158166 - DNA, 20 bp, Artificial Sequence
  Description of Artificial Sequence: Synthetic oligonucleotide
  Target: ATXN1; (-) strand; PAM type: YTN; PAM sequence: TTA
caggcaggagccaccacacc

SEQ ID NO: 158167 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcaggagccac

SEQ ID NO: 158168 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 158169 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 158170 - DNA, 20 bp, Artificial Sequence
  Description of Artificial Sequence: Synthetic oligonucleotide
  Target: ATXN1; (-) strand; PAM type: YTN; PAM sequence: CTC
aggtaatccacccacctcgg

SEQ ID NO: 158171 - DNA, 20 bp, Artificial Sequence
  Description of Artificial Sequence: Synthetic oligonucleotide
  Target: ATXN1; (-) strand; PAM type: YTN; PAM sequence: CTG
acctcaggtaatccacccac

SEQ ID NO: 158172 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtaatccacc

SEQ ID NO: 158173 - DNA, 20 bp, Artificial Sequence
  Description of Artificial Sequence: Synthetic oligonucleotide
  Target: ATXN1; (-) strand; PAM type: YTN; PAM sequence: CTC
aaactcctgacctcaggtaa

SEQ ID NO: 158174 - DNA, 20 bp, Artificial Sequence
  Description of Artificial Sequence: Synthetic oligonucleotide
  Target: ATXN1; (-) strand; PAM type: YTN; PAM sequence: CTG
gtctcaaactcctgacctca

SEQ ID NO: 158175 - DNA, 20 bp, Artificial Sequence
  Description of Artificial Sequence: Synthetic oligonucleotide
  Target: ATXN1; (-) strand; PAM type: YTN; PAM sequence: TTG
gccagactggtctcaaactc

SEQ ID NO: 158176 - DNA, 20 bp, Artificial Sequence
  Description of Artificial Sequence: Synthetic oligonucleotide
  Target: ATXN1; (-) strand; PAM type: YTN; PAM sequence: TTC
accatgttggccagactggt

SEQ ID NO: 158177 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccagactgg

SEQ ID NO: 158178 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtttcacca

SEQ ID NO: 158179 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtttcacc

SEQ ID NO: 158180 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtttcac

SEQ ID NO: 158181 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtttca

SEQ ID NO: 158182 - DNA, 20 bp, Artificial Sequence
  Description of Artificial Sequence: Synthetic oligonucleotide
  Target: ATXN1; (-) strand; PAM type: YTN; PAM sequence: TTG
catttttagtagagatgggg

SEQ ID NO: 158183 - DNA, 20 bp, Artificial Sequence
  Description of Artificial Sequence: Synthetic oligonucleotide
  Target: ATXN1; (-) strand; PAM type: YTN; PAM sequence: TTT
gcatttttagtagagatggg

SEQ ID NO: 158184 - DNA, 20 bp, Artificial Sequence
  Description of Artificial Sequence: Synthetic oligonucleotide
  Target: ATXN1; (-) strand; PAM type: YTN; PAM sequence: TTT
tgcatttttagtagagatgg

SEQ ID NO: 158185 - DNA, 20 bp, Artificial Sequence
  Description of Artificial Sequence: Synthetic oligonucleotide
  Target: ATXN1; (-) strand; PAM type: YTN; PAM sequence: TTT
ttgcatttttagtagagatg

SEQ ID NO: 158186 - DNA, 20 bp, Artificial Sequence
  Description of Artificial Sequence: Synthetic oligonucleotide
  Target: ATXN1; (-) strand; PAM type: YTN; PAM sequence: CTA
atttttgcatttttagtaga

SEQ ID NO: 158187 - DNA, 20 bp, Artificial Sequence
  Description of Artificial Sequence: Synthetic oligonucleotide
  Target: ATXN1; (-) strand; PAM type: YTN; PAM sequence: CTG
ccaccatgcccagctaattt

SEQ ID NO: 158188 - DNA, 20 bp, Artificial Sequence
  Description of Artificial Sequence: Synthetic oligonucleotide
  Target: ATXN1; (-) strand; PAM type: YTN; PAM sequence: TTC
ctgccaccatgcccagctaa

SEQ ID NO: 158189 - DNA, 20 bp, Artificial Sequence
  Description of Artificial Sequence: Synthetic oligonucleotide
  Target: ATXN1; (-) strand; PAM type: YTN; PAM sequence: TTA
caggttcctgccaccatgcc

SEQ ID NO: 158190 - DNA, 20 bp, Artificial Sequence
  Description of Artificial Sequence: Synthetic oligonucleotide
  Target: ATXN1; (-) strand; PAM type: YTN; PAM sequence: CTG
ggattacaggttcctgccac

SEQ ID NO: 158191 - DNA, 20 bp, Artificial Sequence
  Description of Artificial Sequence: Synthetic oligonucleotide
  Target: ATXN1; (-) strand; PAM type: YTN; PAM sequence: CTC
agccccccgagtagctggga

SEQ ID NO: 158192 - DNA, 20 bp, Artificial Sequence
  Description of Artificial Sequence: Synthetic oligonucleotide
  Target: ATXN1; (-) strand; PAM type: YTN; PAM sequence: CTG
cctcagccccccgagtagct

SEQ ID NO: 158193 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagccccccgagta

SEQ ID NO: 158194 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagccccccgag

SEQ ID NO: 158195 - DNA, 20 bp, Artificial Sequence
  Description of Artificial Sequence: Synthetic oligonucleotide
  Target: ATXN1; (-) strand; PAM type: YTN; PAM sequence: TTC
aagtgattctcctgcctcag

SEQ ID NO: 158196 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagtgattctcc

SEQ ID NO: 158197 - DNA, 20 bp, Artificial Sequence
  Description of Artificial Sequence: Synthetic oligonucleotide
  Target: ATXN1; (-) strand; PAM type: YTN; PAM sequence: CTC
cgcctcccgggttcaagtga

SEQ ID NO: 158198 - DNA, 20 bp, Artificial Sequence
  Description of Artificial Sequence: Synthetic oligonucleotide
  Target: ATXN1; (-) strand; PAM type: YTN; PAM sequence: CTG
caacctccgcctcccgggtt

SEQ ID NO: 158199 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccgcctcccg

SEQ ID NO: 158200 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacctccgcct

SEQ ID NO: 158201 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaacctccgcc

SEQ ID NO: 158202 - DNA, 20 bp, Artificial Sequence
  Description of Artificial Sequence: Synthetic oligonucleotide
  Target: ATXN1; (-) strand; PAM type: YTN; PAM sequence: CTG
caacgatcttggctcactgc

SEQ ID NO: 158203 - DNA, 20 bp, Artificial Sequence
  Description of Artificial Sequence: Synthetic oligonucleotide
  Target: ATXN1; (-) strand; PAM type: YTN; PAM sequence: CTC
actgcaacgatcttggctca

SEQ ID NO: 158204 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacgatcttgg

SEQ ID NO: 158205 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaacgatcttg

SEQ ID NO: 158206 - DNA, 20 bp, Artificial Sequence
  Description of Artificial Sequence: Synthetic oligonucleotide
  Target: ATXN1; (-) strand; PAM type: YTN; PAM sequence: CTG
caacgatcttggctcactgc

SEQ ID NO: 158207 - DNA, 20 bp, Artificial Sequence
  Description of Artificial Sequence: Synthetic oligonucleotide
  Target: ATXN1; (-) strand; PAM type: YTN; PAM sequence: CTC
actgcaacgatcttggctca

SEQ ID NO: 158208 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacgatcttgg

SEQ ID NO: 158209 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaacgatcttg

SEQ ID NO: 158210 - DNA, 20 bp, Artificial Sequence
  Description of Artificial Sequence: Synthetic oligonucleotide
  Target: ATXN1; (-) strand; PAM type: YTN; PAM sequence: CTA
gagtgtgatggaatgatctt

SEQ ID NO: 158211 - DNA, 20 bp, Artificial Sequence
  Description of Artificial Sequence: Synthetic oligonucleotide
  Target: ATXN1; (-) strand; PAM type: YTN; PAM sequence: TTG
tcgcccagtctagagtgtga

SEQ ID NO: 158212 - DNA, 20 bp, Artificial Sequence
  Description of Artificial Sequence: Synthetic oligonucleotide
  Target: ATXN1; (-) strand; PAM type: YTN; PAM sequence: CTA
ttgtcgcccagtctagagtg

SEQ ID NO: 158213 - DNA, 20 bp, Artificial Sequence
  Description of Artificial Sequence: Synthetic oligonucleotide
  Target: ATXN1; (-) strand; PAM type: YTN; PAM sequence: CTC
tattgtcgcccagtctagag

SEQ ID NO: 158214 - DNA, 20 bp, Artificial Sequence
  Description of Artificial Sequence: Synthetic oligonucleotide
  Target: ATXN1; (-) strand; PAM type: YTN; PAM sequence: TTC
tctattgtcgcccagtctag

SEQ ID NO: 158215 - DNA, 20 bp, Artificial Sequence
  Description of Artificial Sequence: Synthetic oligonucleotide
  Target: ATXN1; (-) strand; PAM type: YTN; PAM sequence: TTT
ctctattgtcgcccagtcta

SEQ ID NO: 158216 - DNA, 20 bp, Artificial Sequence
  Description of Artificial Sequence: Synthetic oligonucleotide
  Target: ATXN1; (-) strand; PAM type: YTN; PAM sequence: TTA
atggagtttctctattgtcg

SEQ ID NO: 158217 - DNA, 20 bp, Artificial Sequence
  Description of Artificial Sequence: Synthetic oligonucleotide
  Target: ATXN1; (-) strand; PAM type: YTN; PAM sequence: TTT
aatggagtttctctattgtc

SEQ ID NO: 158218 - DNA, 20 bp, Artificial Sequence
  Description of Artificial Sequence: Synthetic oligonucleotide
  Target: ATXN1; (-) strand; PAM type: YTN; PAM sequence: TTT
taatggagtttctctattgt

SEQ ID NO: 158219 - DNA, 20 bp, Artificial Sequence
  Description of Artificial Sequence: Synthetic oligonucleotide
  Target: ATXN1; (-) strand; PAM type: YTN; PAM sequence: TTT
ttaatggagtttctctattg

SEQ ID NO: 158220 - DNA, 20 bp, Artificial Sequence
  Description of Artificial Sequence: Synthetic oligonucleotide
  Target: ATXN1; (-) strand; PAM type: YTN; PAM sequence: TTT
tttaatggagtttctctatt

SEQ ID NO: 158221 - DNA, 20 bp, Artificial Sequence
  Description of Artificial Sequence: Synthetic oligonucleotide
  Target: ATXN1; (-) strand; PAM type: YTN; PAM sequence: TTT
ttttaatggagtttctctat

SEQ ID NO: 158222 - DNA, 20 bp, Artificial Sequence
  Description of Artificial Sequence: Synthetic oligonucleotide
  Target: ATXN1; (-) strand; PAM type: YTN; PAM sequence: TTT
tttttaatggagtttctcta

SEQ ID NO: 158223 - DNA, 20 bp, Artificial Sequence
  Description of Artificial Sequence: Synthetic oligonucleotide
  Target: ATXN1; (-) strand; PAM type: YTN; PAM sequence: TTT
ttttttaatggagtttctct

SEQ ID NO: 158224 - DNA, 20 bp, Artificial Sequence
  Description of Artificial Sequence: Synthetic oligonucleotide
  Target: ATXN1; (-) strand; PAM type: YTN; PAM sequence: TTT
tttttttaatggagtttctc

SEQ ID NO: 158225 - DNA, 20 bp, Artificial Sequence
  Description of Artificial Sequence: Synthetic oligonucleotide
  Target: ATXN1; (-) strand; PAM type: YTN; PAM sequence: TTT
ttttttttaatggagtttct

SEQ ID NO: 158226 - DNA, 20 bp, Artificial Sequence
  Description of Artificial Sequence: Synthetic oligonucleotide
  Target: ATXN1; (-) strand; PAM type: YTN; PAM sequence: CTT
tttttttttaatggagtttc

SEQ ID NO: 158227 - DNA, 20 bp, Artificial Sequence
  Description of Artificial Sequence: Synthetic oligonucleotide
  Target: ATXN1; (-) strand; PAM type: YTN; PAM sequence: CTA
gaggctttttttttttaatg

SEQ ID NO: 158228 - DNA, 20 bp, Artificial Sequence
  Description of Artificial Sequence: Synthetic oligonucleotide
  Target: ATXN1; (-) strand; PAM type: YTN; PAM sequence: TTC
tagaggctttttttttttaa

SEQ ID NO: 158229 - DNA, 20 bp, Artificial Sequence
  Description of Artificial Sequence: Synthetic oligonucleotide
  Target: ATXN1; (-) strand; PAM type: YTN; PAM sequence: TTG
ttctagaggctttttttttt

SEQ ID NO: 158230 - DNA, 20 bp, Artificial Sequence
  Description of Artificial Sequence: Synthetic oligonucleotide
  Target: ATXN1; (-) strand; PAM type: YTN; PAM sequence: TTT
gttctagaggcttttttttt

SEQ ID NO: 158231 - DNA, 20 bp, Artificial Sequence
  Description of Artificial Sequence: Synthetic oligonucleotide
  Target: ATXN1; (-) strand; PAM type: YTN; PAM sequence: TTT
tgttctagaggctttttttt

SEQ ID NO: 158232 - DNA, 20 bp, Artificial Sequence
  Description of Artificial Sequence: Synthetic oligonucleotide
  Target: ATXN1; (-) strand; PAM type: YTN; PAM sequence: TTG
gagataatatgtattttgtt

SEQ ID NO: 158233 - DNA, 20 bp, Artificial Sequence
  Description of Artificial Sequence: Synthetic oligonucleotide
  Target: ATXN1; (-) strand; PAM type: YTN; PAM sequence: TTT
ggagataatatgtattttgt

SEQ ID NO: 158234 - DNA, 20 bp, Artificial Sequence
  Description of Artificial Sequence: Synthetic oligonucleotide
  Target: ATXN1; (-) strand; PAM type: YTN; PAM sequence: TTA
tttggagataatatgtattt

SEQ ID NO: 158235 - DNA, 20 bp, Artificial Sequence
  Description of Artificial Sequence: Synthetic oligonucleotide
  Target: ATXN1; (-) strand; PAM type: YTN; PAM sequence: CTT
atttggagataatatgtatt

SEQ ID NO: 158236 - DNA, 20 bp, Artificial Sequence
  Description of Artificial Sequence: Synthetic oligonucleotide
  Target: ATXN1; (-) strand; PAM type: YTN; PAM sequence: TTG
cttatttggagataatatgt

SEQ ID NO: 158237 - DNA, 20 bp, Artificial Sequence
  Description of Artificial Sequence: Synthetic oligonucleotide
  Target: ATXN1; (-) strand; PAM type: YTN; PAM sequence: TTG
ttgcttatttggagataata

SEQ ID NO: 158238 - DNA, 20 bp, Artificial Sequence
  Description of Artificial Sequence: Synthetic oligonucleotide
  Target: ATXN1; (-) strand; PAM type: YTN; PAM sequence: TTC
cattgttgcttatttggaga

SEQ ID NO: 158239 - DNA, 20 bp, Artificial Sequence
  Description of Artificial Sequence: Synthetic oligonucleotide
  Target: ATXN1; (-) strand; PAM type: YTN; PAM sequence: CTG
tgagttccattgttgcttat

SEQ ID NO: 158240 - DNA, 20 bp, Artificial Sequence
  Description of Artificial Sequence: Synthetic oligonucleotide
  Target: ATXN1; (-) strand; PAM type: YTN; PAM sequence: TTG
agatgtaaactgtgagttcc

SEQ ID NO: 158241 - DNA, 20 bp, Artificial Sequence
  Description of Artificial Sequence: Synthetic oligonucleotide
  Target: ATXN1; (-) strand; PAM type: YTN; PAM sequence: TTG
ttgagatgtaaactgtgagt

SEQ ID NO: 158242 - DNA, 20 bp, Artificial Sequence
  Description of Artificial Sequence: Synthetic oligonucleotide
  Target: ATXN1; (-) strand; PAM type: YTN; PAM sequence: TTT
gttgagatgtaaactgtgag

SEQ ID NO: 158243 - DNA, 20 bp, Artificial Sequence
  Description of Artificial Sequence: Synthetic oligonucleotide
  Target: ATXN1; (-) strand; PAM type: YTN; PAM sequence: TTT
tgttgagatgtaaactgtga

SEQ ID NO: 158244 - DNA, 20 bp, Artificial Sequence
  Description of Artificial Sequence: Synthetic oligonucleotide
  Target: ATXN1; (-) strand; PAM type: YTN; PAM sequence: TTT
ttgttgagatgtaaactgtg

SEQ ID NO: 158245 - DNA, 20 bp, Artificial Sequence
  Description of Artificial Sequence: Synthetic oligonucleotide
  Target: ATXN1; (-) strand; PAM type: YTN; PAM sequence: TTA
tttttgttgagatgtaaact

SEQ ID NO: 158246 - DNA, 20 bp, Artificial Sequence
  Description of Artificial Sequence: Synthetic oligonucleotide
  Target: ATXN1; (-) strand; PAM type: YTN; PAM sequence: TTC
cattatttttgttgagatgt

SEQ ID NO: 158247 - DNA, 20 bp, Artificial Sequence
  Description of Artificial Sequence: Synthetic oligonucleotide
  Target: ATXN1; (-) strand; PAM type: YTN; PAM sequence: CTT
ccattatttttgttgagatg

SEQ ID NO: 158248 - DNA, 20 bp, Artificial Sequence
  Description of Artificial Sequence: Synthetic oligonucleotide
  Target: ATXN1; (-) strand; PAM type: YTN; PAM sequence: CTG
gcttccattatttttgttga

SEQ ID NO: 158249 - DNA, 20 bp, Artificial Sequence
  Description of Artificial Sequence: Synthetic oligonucleotide
  Target: ATXN1; (-) strand; PAM type: YTN; PAM sequence: CTA
ctggcttccattatttttgt

SEQ ID NO: 158250 - DNA, 20 bp, Artificial Sequence
  Description of Artificial Sequence: Synthetic oligonucleotide
  Target: ATXN1; (-) strand; PAM type: YTN; PAM sequence: TTG
tctactggcttccattattt

SEQ ID NO: 158251 - DNA, 20 bp, Artificial Sequence
  Description of Artificial Sequence: Synthetic oligonucleotide
  Target: ATXN1; (-) strand; PAM type: YTN; PAM sequence: CTC
cattgtctactggcttccat

SEQ ID NO: 158252 - DNA, 20 bp, Artificial Sequence
  Description of Artificial Sequence: Synthetic oligonucleotide
  Target: ATXN1; (-) strand; PAM type: YTN; PAM sequence: TTG
tctccattgtctactggctt

SEQ ID NO: 158253 - DNA, 20 bp, Artificial Sequence
  Description of Artificial Sequence: Synthetic oligonucleotide
  Target: ATXN1; (-) strand; PAM type: YTN; PAM sequence: TTC
cattgtctccattgtctact

SEQ ID NO: 158254 - DNA, 20 bp, Artificial Sequence
  Description of Artificial Sequence: Synthetic oligonucleotide
  Target: ATXN1; (-) strand; PAM type: YTN; PAM sequence: CTG
taaagatattccattgtctc

SEQ ID NO: 158255 - DNA, 20 bp, Artificial Sequence
  Description of Artificial Sequence: Synthetic oligonucleotide
  Target: ATXN1; (-) strand; PAM type: YTN; PAM sequence: TTA
gcactgtaaagatattccat

SEQ ID NO: 158256 - DNA, 20 bp, Artificial Sequence
  Description of Artificial Sequence: Synthetic oligonucleotide
  Target: ATXN1; (-) strand; PAM type: YTN; PAM sequence: TTT
agcactgtaaagatattcca

SEQ ID NO: 158257 - DNA, 20 bp, Artificial Sequence
  Description of Artificial Sequence: Synthetic oligonucleotide
  Target: ATXN1; (-) strand; PAM type: YTN; PAM sequence: CTT
tagcactgtaaagatattcc

SEQ ID NO: 158258 - DNA, 20 bp, Artificial Sequence
  Description of Artificial Sequence: Synthetic oligonucleotide
  Target: ATXN1; (-) strand; PAM type: YTN; PAM sequence: TTC
tttagcactgtaaagatatt

SEQ ID NO: 158259 - DNA, 20 bp, Artificial Sequence
  Description of Artificial Sequence: Synthetic oligonucleotide
  Target: ATXN1; (-) strand; PAM type: YTN; PAM sequence: TTT
ctttagcactgtaaagatat

SEQ ID NO: 158260 - DNA, 20 bp, Artificial Sequence
  Description of Artificial Sequence: Synthetic oligonucleotide
  Target: ATXN1; (-) strand; PAM type: YTN; PAM sequence: TTT
tctttagcactgtaaagata

SEQ ID NO: 158261 - DNA, 20 bp, Artificial Sequence
  Description of Artificial Sequence: Synthetic oligonucleotide
  Target: ATXN1; (-) strand; PAM type: YTN; PAM sequence: TTT
ttctttagcactgtaaagat

SEQ ID NO: 158262 - DNA, 20 bp, Artificial Sequence
  Description of Artificial Sequence: Synthetic oligonucleotide
  Target: ATXN1; (-) strand; PAM type: YTN; PAM sequence: CTT
tttctttagcactgtaaaga

SEQ ID NO: 158263 - DNA, 20 bp, Artificial Sequence
  Description of Artificial Sequence: Synthetic oligonucleotide
  Target: ATXN1; (-) strand; PAM type: YTN; PAM sequence: TTC
tttttctttagcactgtaaa

SEQ ID NO: 158264 - DNA, 20 bp, Artificial Sequence
  Description of Artificial Sequence: Synthetic oligonucleotide
  Target: ATXN1; (-) strand; PAM type: YTN; PAM sequence: TTG
acaattctttttctttagca

SEQ ID NO: 158265 - DNA, 20 bp, Artificial Sequence
  Description of Artificial Sequence: Synthetic oligonucleotide
  Target: ATXN1; (-) strand; PAM type: YTN; PAM sequence: TTC
gccattgacaattctttttc

SEQ ID NO: 158266 - DNA, 20 bp, Artificial Sequence
  Description of Artificial Sequence: Synthetic oligonucleotide
  Target: ATXN1; (-) strand; PAM type: YTN; PAM sequence: CTC
catatagaattcgccattga

SEQ ID NO: 158267 - DNA, 20 bp, Artificial Sequence
  Description of Artificial Sequence: Synthetic oligonucleotide
  Target: ATXN1; (-) strand; PAM type: YTN; PAM sequence: TTG
ctccatatagaattcgccat

SEQ ID NO: 158268 - DNA, 20 bp, Artificial Sequence
  Description of Artificial Sequence: Synthetic oligonucleotide
  Target: ATXN1; (-) strand; PAM type: YTN; PAM sequence: TTT
gctccatatagaattcgcca

SEQ ID NO: 158269 - DNA, 20 bp, Artificial Sequence
  Description of Artificial Sequence: Synthetic oligonucleotide
  Target: ATXN1; (-) strand; PAM type: YTN; PAM sequence: TTT
tgctccatatagaattcgcc

SEQ ID NO: 158270 - DNA, 20 bp, Artificial Sequence
  Description of Artificial Sequence: Synthetic oligonucleotide
  Target: ATXN1; (-) strand; PAM type: YTN; PAM sequence: TTT
ttgctccatatagaattcgc

SEQ ID NO: 158271 - DNA, 20 bp, Artificial Sequence
  Description of Artificial Sequence: Synthetic oligonucleotide
  Target: ATXN1; (-) strand; PAM type: YTN; PAM sequence: CTT
tttgctccatatagaattcg

SEQ ID NO: 158272 - DNA, 20 bp, Artificial Sequence
  Description of Artificial Sequence: Synthetic oligonucleotide
  Target: ATXN1; (-) strand; PAM type: YTN; PAM sequence: CTG
gaaggatctttttgctccat

SEQ ID NO: 158273 - DNA, 20 bp, Artificial Sequence
  Description of Artificial Sequence: Synthetic oligonucleotide
  Target: ATXN1; (-) strand; PAM type: YTN; PAM sequence: TTC
tggaaggatctttttgctcc

SEQ ID NO: 158274 - DNA, 20 bp, Artificial Sequence
  Description of Artificial Sequence: Synthetic oligonucleotide
  Target: ATXN1; (-) strand; PAM type: YTN; PAM sequence: TTC
attctggaaggatctttttg

SEQ ID NO: 158275 - DNA, 20 bp, Artificial Sequence
  Description of Artificial Sequence: Synthetic oligonucleotide
  Target: ATXN1; (-) strand; PAM type: YTN; PAM sequence: CTT
cattctggaaggatcttttt

SEQ ID NO: 158276 - DNA, 20 bp, Artificial Sequence
  Description of Artificial Sequence: Synthetic oligonucleotide
  Target: ATXN1; (-) strand; PAM type: YTN; PAM sequence: TTG
ccttcattctggaaggatct

SEQ ID NO: 158277 - DNA, 20 bp, Artificial Sequence
  Description of Artificial Sequence: Synthetic oligonucleotide
  Target: ATXN1; (-) strand; PAM type: YTN; PAM sequence: TTT
gccttcattctggaaggatc

SEQ ID NO: 158278 - DNA, 20 bp, Artificial Sequence
  Description of Artificial Sequence: Synthetic oligonucleotide
  Target: ATXN1; (-) strand; PAM type: YTN; PAM sequence: TTT
tgccttcattctggaaggat

SEQ ID NO: 158279 - DNA, 20 bp, Artificial Sequence
  Description of Artificial Sequence: Synthetic oligonucleotide
  Target: ATXN1; (-) strand; PAM type: YTN; PAM sequence: CTA
ttttgccttcattctggaag

SEQ ID NO: 158280 - DNA, 20 bp, Artificial Sequence
  Description of Artificial Sequence: Synthetic oligonucleotide
  Target: ATXN1; (-) strand; PAM type: YTN; PAM sequence: CTC
tattttgccttcattctgga

SEQ ID NO: 158281 - DNA, 20 bp, Artificial Sequence
  Description of Artificial Sequence: Synthetic oligonucleotide
  Target: ATXN1; (-) strand; PAM type: YTN; PAM sequence: CTG
aacatgtctctattttgcct

SEQ ID NO: 158282 - DNA, 20 bp, Artificial Sequence
  Description of Artificial Sequence: Synthetic oligonucleotide
  Target: ATXN1; (-) strand; PAM type: YTN; PAM sequence: TTG
tctgaacatgtctctatttt

SEQ ID NO: 158283 - DNA, 20 bp, Artificial Sequence
  Description of Artificial Sequence: Synthetic oligonucleotide
  Target: ATXN1; (-) strand; PAM type: YTN; PAM sequence: TTT
gtctgaacatgtctctattt

SEQ ID NO: 158284 - DNA, 20 bp, Artificial Sequence
  Description of Artificial Sequence: Synthetic oligonucleotide
  Target: ATXN1; (-) strand; PAM type: YTN; PAM sequence: CTG
tttgtctgaacatgtctcta

SEQ ID NO: 158285 - DNA, 20 bp, Artificial Sequence
  Description of Artificial Sequence: Synthetic oligonucleotide
  Target: ATXN1; (-) strand; PAM type: YTN; PAM sequence: TTA
ctgtttgtctgaacatgtct

SEQ ID NO: 158286 - DNA, 20 bp, Artificial Sequence
  Description of Artificial Sequence: Synthetic oligonucleotide
  Target: ATXN1; (-) strand; PAM type: YTN; PAM sequence: TTA
attactgtttgtctgaacat

SEQ ID NO: 158287 - DNA, 20 bp, Artificial Sequence
  Description of Artificial Sequence: Synthetic oligonucleotide
  Target: ATXN1; (-) strand; PAM type: YTN; PAM sequence: TTT
aattactgtttgtctgaaca

SEQ ID NO: 158288 - DNA, 20 bp, Artificial Sequence
  Description of Artificial Sequence: Synthetic oligonucleotide
  Target: ATXN1; (-) strand; PAM type: YTN; PAM sequence: TTT
taattactgtttgtctgaac

SEQ ID NO: 158289 - DNA, 20 bp, Artificial Sequence
  Description of Artificial Sequence: Synthetic oligonucleotide
  Target: ATXN1; (-) strand; PAM type: YTN; PAM sequence: CTT
ttaattactgtttgtctgaa

SEQ ID NO: 158290 - DNA, 20 bp, Artificial Sequence
  Description of Artificial Sequence: Synthetic oligonucleotide
  Target: ATXN1; (-) strand; PAM type: YTN; PAM sequence: TTC
ttttaattactgtttgtctg

SEQ ID NO: 158291 - DNA, 20 bp, Artificial Sequence
  Description of Artificial Sequence: Synthetic oligonucleotide
  Target: ATXN1; (-) strand; PAM type: YTN; PAM sequence: TTG
atggtgaattcttttaatta

SEQ ID NO: 158292 - DNA, 20 bp, Artificial Sequence
  Description of Artificial Sequence: Synthetic oligonucleotide
  Target: ATXN1; (-) strand; PAM type: YTN; PAM sequence: CTG
ttgatggtgaattcttttaa

SEQ ID NO: 158293 - DNA, 20 bp, Artificial Sequence
  Description of Artificial Sequence: Synthetic oligonucleotide
  Target: ATXN1; (-) strand; PAM type: YTN; PAM sequence: CTA
taatgcagatctgttgatgg

SEQ ID NO: 158294 - DNA, 20 bp, Artificial Sequence
  Description of Artificial Sequence: Synthetic oligonucleotide
  Target: ATXN1; (-) strand; PAM type: YTN; PAM sequence: TTC
tataatgcagatctgttgat

SEQ ID NO: 158295 - DNA, 20 bp, Artificial Sequence
  Description of Artificial Sequence: Synthetic oligonucleotide
  Target: ATXN1; (-) strand; PAM type: YTN; PAM sequence: TTT
ctataatgcagatctgttga

SEQ ID NO: 158296 - DNA, 20 bp, Artificial Sequence
  Description of Artificial Sequence: Synthetic oligonucleotide
  Target: ATXN1; (-) strand; PAM type: YTN; PAM sequence: TTT
tctataatgcagatctgttg

SEQ ID NO: 158297 - DNA, 20 bp, Artificial Sequence
  Description of Artificial Sequence: Synthetic oligonucleotide
  Target: ATXN1; (-) strand; PAM type: YTN; PAM sequence: TTA
gtattttctataatgcagat

SEQ ID NO: 158298 - DNA, 20 bp, Artificial Sequence
  Description of Artificial Sequence: Synthetic oligonucleotide
  Target: ATXN1; (-) strand; PAM type: YTN; PAM sequence: TTT
agtattttctataatgcaga

SEQ ID NO: 158299 - DNA, 20 bp, Artificial Sequence
  Description of Artificial Sequence: Synthetic oligonucleotide
  Target: ATXN1; (-) strand; PAM type: YTN; PAM sequence: TTT
tagtattttctataatgcag

SEQ ID NO: 158300 - DNA, 20 bp, Artificial Sequence
  Description of Artificial Sequence: Synthetic oligonucleotide
  Target: ATXN1; (-) strand; PAM type: YTN; PAM sequence: CTT
ttagtattttctataatgca

SEQ ID NO: 158301 - DNA, 20 bp, Artificial Sequence
  Description of Artificial Sequence: Synthetic oligonucleotide
  Target: ATXN1; (-) strand; PAM type: YTN; PAM sequence: CTA
aagaataccttttagtattt

SEQ ID NO: 158302 - DNA, 20 bp, Artificial Sequence
  Description of Artificial Sequence: Synthetic oligonucleotide
  Target: ATXN1; (-) strand; PAM type: YTN; PAM sequence: CTA
cctaaagaataccttttagt

SEQ ID NO: 158303 - DNA, 20 bp, Artificial Sequence
  Description of Artificial Sequence: Synthetic oligonucleotide
  Target: ATXN1; (-) strand; PAM type: YTN; PAM sequence: CTC
tacctaaagaatacctttta

SEQ ID NO: 158304 - DNA, 20 bp, Artificial Sequence
  Description of Artificial Sequence: Synthetic oligonucleotide
  Target: ATXN1; (-) strand; PAM type: YTN; PAM sequence: TTC
tctacctaaagaataccttt

SEQ ID NO: 158305 - DNA, 20 bp, Artificial Sequence
  Description of Artificial Sequence: Synthetic oligonucleotide
  Target: ATXN1; (-) strand; PAM type: YTN; PAM sequence: TTT
ctctacctaaagaatacctt

SEQ ID NO: 158306 - DNA, 20 bp, Artificial Sequence
  Description of Artificial Sequence: Synthetic oligonucleotide
  Target: ATXN1; (-) strand; PAM type: YTN; PAM sequence: TTT
tctctacctaaagaatacct

SEQ ID NO: 158307 - DNA, 20 bp, Artificial Sequence
  Description of Artificial Sequence: Synthetic oligonucleotide
  Target: ATXN1; (-) strand; PAM type: YTN; PAM sequence: TTT
ttctctacctaaagaatacc

SEQ ID NO: 158308 - DNA, 20 bp, Artificial Sequence
  Description of Artificial Sequence: Synthetic oligonucleotide
  Target: ATXN1; (-) strand; PAM type: YTN; PAM sequence: TTT
tttctctacctaaagaatac

SEQ ID NO: 158309 - DNA, 20 bp, Artificial Sequence
  Description of Artificial Sequence: Synthetic oligonucleotide
  Target: ATXN1; (-) strand; PAM type: YTN; PAM sequence: TTG
ttttttctctacctaaagaa

SEQ ID NO: 158310 - DNA, 20 bp, Artificial Sequence
  Description of Artificial Sequence: Synthetic oligonucleotide
  Target: ATXN1; (-) strand; PAM type: YTN; PAM sequence: TTT
gttttttctctacctaaaga

SEQ ID NO: 158311 - DNA, 20 bp, Artificial Sequence
  Description of Artificial Sequence: Synthetic oligonucleotide
  Target: ATXN1; (-) strand; PAM type: YTN; PAM sequence: CTA
gatttgttttttctctacct

SEQ ID NO: 158312 - DNA, 20 bp, Artificial Sequence
  Description of Artificial Sequence: Synthetic oligonucleotide
  Target: ATXN1; (-) strand; PAM type: YTN; PAM sequence: TTC
aatctagatttgttttttct

SEQ ID NO: 158313 - DNA, 20 bp, Artificial Sequence
  Description of Artificial Sequence: Synthetic oligonucleotide
  Target: ATXN1; (-) strand; PAM type: YTN; PAM sequence: CTT
caatctagatttgttttttc

SEQ ID NO: 158314 - DNA, 20 bp, Artificial Sequence
  Description of Artificial Sequence: Synthetic oligonucleotide
  Target: ATXN1; (-) strand; PAM type: YTN; PAM sequence: CTG
tacaaacttcaatctagatt

SEQ ID NO: 158315 - DNA, 20 bp, Artificial Sequence
  Description of Artificial Sequence: Synthetic oligonucleotide
  Target: ATXN1; (-) strand; PAM type: YTN; PAM sequence: CTC
cctgtacaaacttcaatcta

SEQ ID NO: 158316 - DNA, 20 bp, Artificial Sequence
  Description of Artificial Sequence: Synthetic oligonucleotide
  Target: ATXN1; (-) strand; PAM type: YTN; PAM sequence: TTC
ctccctgtacaaacttcaat

SEQ ID NO: 158317 - DNA, 20 bp, Artificial Sequence
  Description of Artificial Sequence: Synthetic oligonucleotide
  Target: ATXN1; (-) strand; PAM type: YTN; PAM sequence: TTC
attcctccctgtacaaactt

SEQ ID NO: 158318 - DNA, 20 bp, Artificial Sequence
  Description of Artificial Sequence: Synthetic oligonucleotide
  Target: ATXN1; (-) strand; PAM type: YTN; PAM sequence: CTT
cattcctccctgtacaaact

SEQ ID NO: 158319 - DNA, 20 bp, Artificial Sequence
  Description of Artificial Sequence: Synthetic oligonucleotide
  Target: ATXN1; (-) strand; PAM type: YTN; PAM sequence: CTC
ttcattcctccctgtacaaa

SEQ ID NO: 158320 - DNA, 20 bp, Artificial Sequence
  Description of Artificial Sequence: Synthetic oligonucleotide
  Target: ATXN1; (-) strand; PAM type: YTN; PAM sequence: TTC
ctcttcattcctccctgtac

SEQ ID NO: 158321 - DNA, 20 bp, Artificial Sequence
  Description of Artificial Sequence: Synthetic oligonucleotide
  Target: ATXN1; (-) strand; PAM type: YTN; PAM sequence: TTC
attcctcttcattcctccct

SEQ ID NO: 158322 - DNA, 20 bp, Artificial Sequence
  Description of Artificial Sequence: Synthetic oligonucleotide
  Target: ATXN1; (-) strand; PAM type: YTN; PAM sequence: TTT
cattcctcttcattcctccc

SEQ ID NO: 158323 - DNA, 20 bp, Artificial Sequence
  Description of Artificial Sequence: Synthetic oligonucleotide
  Target: ATXN1; (-) strand; PAM type: YTN; PAM sequence: TTT
tcattcctcttcattcctcc

SEQ ID NO: 158324 - DNA, 20 bp, Artificial Sequence
  Description of Artificial Sequence: Synthetic oligonucleotide
  Target: ATXN1; (-) strand; PAM type: YTN; PAM sequence: CTA
ccattttcattcctcttcat

SEQ ID NO: 158325 - DNA, 20 bp, Artificial Sequence
  Description of Artificial Sequence: Synthetic oligonucleotide
  Target: ATXN1; (-) strand; PAM type: YTN; PAM sequence: TTC
accatgtatctaccattttc

SEQ ID NO: 158326 - DNA, 20 bp, Artificial Sequence
  Description of Artificial Sequence: Synthetic oligonucleotide
  Target: ATXN1; (-) strand; PAM type: YTN; PAM sequence: TTC
agattcaccatgtatctacc

SEQ ID NO: 158327 - DNA, 20 bp, Artificial Sequence
  Description of Artificial Sequence: Synthetic oligonucleotide
  Target: ATXN1; (-) strand; PAM type: YTN; PAM sequence: TTC
attcagattcaccatgtatc

SEQ ID NO: 158328 - DNA, 20 bp, Artificial Sequence
  Description of Artificial Sequence: Synthetic oligonucleotide
  Target: ATXN1; (-) strand; PAM type: YTN; PAM sequence: TTA
catatagccaatattcattc

SEQ ID NO: 158329 - DNA, 20 bp, Artificial Sequence
  Description of Artificial Sequence: Synthetic oligonucleotide
  Target: ATXN1; (-) strand; PAM type: YTN; PAM sequence: TTG
ttacatatagccaatattca

SEQ ID NO: 158330 - DNA, 20 bp, Artificial Sequence
  Description of Artificial Sequence: Synthetic oligonucleotide
  Target: ATXN1; (-) strand; PAM type: YTN; PAM sequence: TTA
aatattgttacatatagcca

SEQ ID NO: 158331 - DNA, 20 bp, Artificial Sequence
  Description of Artificial Sequence: Synthetic oligonucleotide
  Target: ATXN1; (-) strand; PAM type: YTN; PAM sequence: TTT
aaatattgttacatatagcc

SEQ ID NO: 158332 - DNA, 20 bp, Artificial Sequence
  Description of Artificial Sequence: Synthetic oligonucleotide
  Target: ATXN1; (-) strand; PAM type: YTN; PAM sequence: TTT
taaatattgttacatatagc

SEQ ID NO: 158333 - DNA, 20 bp, Artificial Sequence
  Description of Artificial Sequence: Synthetic oligonucleotide
  Target: ATXN1; (-) strand; PAM type: YTN; PAM sequence: CTC
acaaaaagaaaaaaagaatc

SEQ ID NO: 158334 - DNA, 20 bp, Artificial Sequence
  Description of Artificial Sequence: Synthetic oligonucleotide
  Target: ATXN1; (-) strand; PAM type: YTN; PAM sequence: CTC
tcacaaaaagaaaaaaagaa

SEQ ID NO: 158335 - DNA, 20 bp, Artificial Sequence
  Description of Artificial Sequence: Synthetic oligonucleotide
  Target: ATXN1; (-) strand; PAM type: YTN; PAM sequence: CTC
cctctcacaaaaagaaaaaa

SEQ ID NO: 158336 - DNA, 20 bp, Artificial Sequence
  Description of Artificial Sequence: Synthetic oligonucleotide
  Target: ATXN1; (-) strand; PAM type: YTN; PAM sequence: CTG
ggcgacagagcaagactccc

SEQ ID NO: 158337 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcgacagagcaa

SEQ ID NO: 158338 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggcgacag

SEQ ID NO: 158339 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatcgcgcc

SEQ ID NO: 158340 - DNA, 20 bp, Artificial Sequence
  Description of Artificial Sequence: Synthetic oligonucleotide
  Target: ATXN1; (-) strand; PAM type: YTN; PAM sequence: TTG
aacccgggaggcggagattg

SEQ ID NO: 158341 - DNA, 20 bp, Artificial Sequence
  Description of Artificial Sequence: Synthetic oligonucleotide
  Target: ATXN1; (-) strand; PAM type: YTN; PAM sequence: CTT
gaacccgggaggcggagatt

SEQ ID NO: 158342 - DNA, 20 bp, Artificial Sequence
  Description of Artificial Sequence: Synthetic oligonucleotide
  Target: ATXN1; (-) strand; PAM type: YTN; PAM sequence: CTC
gcttgaacccgggaggcgga

SEQ ID NO: 158343 - DNA, 20 bp, Artificial Sequence
  Description of Artificial Sequence: Synthetic oligonucleotide
  Target: ATXN1; (-) strand; PAM type: YTN; PAM sequence: CTG
aggcaggagactcgcttgaa

SEQ ID NO: 158344 - DNA, 20 bp, Artificial Sequence
  Description of Artificial Sequence: Synthetic oligonucleotide
  Target: ATXN1; (-) strand; PAM type: YTN; PAM sequence: TTG
ggagtctgaggcaggagact

SEQ ID NO: 158345 - DNA, 20 bp, Artificial Sequence
  Description of Artificial Sequence: Synthetic oligonucleotide
  Target: ATXN1; (-) strand; PAM type: YTN; PAM sequence: CTT
gggagtctgaggcaggagac

SEQ ID NO: 158346 - DNA, 20 bp, Artificial Sequence
  Description of Artificial Sequence: Synthetic oligonucleotide
  Target: ATXN1; (-) strand; PAM type: YTN; PAM sequence: CTA
cttgggagtctgaggcagga

SEQ ID NO: 158347 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctacttgggag

SEQ ID NO: 158348 - DNA, 20 bp, Artificial Sequence
  Description of Artificial Sequence: Synthetic oligonucleotide
  Target: ATXN1; (-) strand; PAM type: YTN; PAM sequence: CTG
ggcgtggtggtggtggtgca

SEQ ID NO: 158349 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaagtagctgg

SEQ ID NO: 158350 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaagtagc

SEQ ID NO: 158351 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaagta

SEQ ID NO: 158352 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaagccccc

SEQ ID NO: 158353 - DNA, 20 bp, Artificial Sequence
  Description of Artificial Sequence: Synthetic oligonucleotide
  Target: ATXN1; (-) strand; PAM type: YTN; PAM sequence: CTG
aggcgggtggatcatgaggt

SEQ ID NO: 158354 - DNA, 20 bp, Artificial Sequence
  Description of Artificial Sequence: Synthetic oligonucleotide
  Target: ATXN1; (-) strand; PAM type: YTN; PAM sequence: TTG
ggagactgaggcgggtggat

SEQ ID NO: 158355 - DNA, 20 bp, Artificial Sequence
  Description of Artificial Sequence: Synthetic oligonucleotide
  Target: ATXN1; (-) strand; PAM type: YTN; PAM sequence: TTT
gggagactgaggcgggtgga

SEQ ID NO: 158356 - DNA, 20 bp, Artificial Sequence
  Description of Artificial Sequence: Synthetic oligonucleotide
  Target: ATXN1; (-) strand; PAM type: YTN; PAM sequence: CTT
tgggagactgaggcgggtgg

SEQ ID NO: 158357 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 158358 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcccagcact

SEQ ID NO: 158359 - DNA, 20 bp, Artificial Sequence
  Description of Artificial Sequence: Synthetic oligonucleotide
  Target: ATXN1; (-) strand; PAM type: YTN; PAM sequence: CTG
acacggtggctcacgcctgt

SEQ ID NO: 158360 - DNA, 20 bp, Artificial Sequence
  Description of Artificial Sequence: Synthetic oligonucleotide
  Target: ATXN1; (-) strand; PAM type: YTN; PAM sequence: CTG
aatgtgtataaaatccaatg

SEQ ID NO: 158361 - DNA, 20 bp, Artificial Sequence
  Description of Artificial Sequence: Synthetic oligonucleotide
  Target: ATXN1; (-) strand; PAM type: YTN; PAM sequence: TTG
tgtgtctgaatgtgtataaa

SEQ ID NO: 158362 - DNA, 20 bp, Artificial Sequence
  Description of Artificial Sequence: Synthetic oligonucleotide
  Target: ATXN1; (-) strand; PAM type: YTN; PAM sequence: TTT
gtgtgtctgaatgtgtataa

SEQ ID NO: 158363 - DNA, 20 bp, Artificial Sequence
  Description of Artificial Sequence: Synthetic oligonucleotide
  Target: ATXN1; (-) strand; PAM type: YTN; PAM sequence: TTT
tgtgtgtctgaatgtgtata

SEQ ID NO: 158364 - DNA, 20 bp, Artificial Sequence
  Description of Artificial Sequence: Synthetic oligonucleotide
  Target: ATXN1; (-) strand; PAM type: YTN; PAM sequence: TTT
ttgtgtgtctgaatgtgtat

SEQ ID NO: 158365 - DNA, 20 bp, Artificial Sequence
  Description of Artificial Sequence: Synthetic oligonucleotide
  Target: ATXN1; (-) strand; PAM type: YTN; PAM sequence: TTA
tgcatgtgtgtttttgtgtg

SEQ ID NO: 158366 - DNA, 20 bp, Artificial Sequence
  Description of Artificial Sequence: Synthetic oligonucleotide
  Target: ATXN1; (-) strand; PAM type: YTN; PAM sequence: TTC
aattatgcatgtgtgttttt

SEQ ID NO: 158367 - DNA, 20 bp, Artificial Sequence
  Description of Artificial Sequence: Synthetic oligonucleotide
  Target: ATXN1; (-) strand; PAM type: YTN; PAM sequence: CTT
caattatgcatgtgtgtttt

SEQ ID NO: 158368 - DNA, 20 bp, Artificial Sequence
  Description of Artificial Sequence: Synthetic oligonucleotide
  Target: ATXN1; (-) strand; PAM type: YTN; PAM sequence: TTG
gtacttcaattatgcatgtg

SEQ ID NO: 158369 - DNA, 20 bp, Artificial Sequence
  Description of Artificial Sequence: Synthetic oligonucleotide
  Target: ATXN1; (-) strand; PAM type: YTN; PAM sequence: TTT
ggtacttcaattatgcatgt

SEQ ID NO: 158370 - DNA, 20 bp, Artificial Sequence
  Description of Artificial Sequence: Synthetic oligonucleotide
  Target: ATXN1; (-) strand; PAM type: YTN; PAM sequence: TTT
tggtacttcaattatgcatg

SEQ ID NO: 158371 - DNA, 20 bp, Artificial Sequence
  Description of Artificial Sequence: Synthetic oligonucleotide
  Target: ATXN1; (-) strand; PAM type: YTN; PAM sequence: TTT
ttggtacttcaattatgcat

SEQ ID NO: 158372 - DNA, 20 bp, Artificial Sequence
  Description of Artificial Sequence: Synthetic oligonucleotide
  Target: ATXN1; (-) strand; PAM type: YTN; PAM sequence: TTT
tttggtacttcaattatgca

SEQ ID NO: 158373 - DNA, 20 bp, Artificial Sequence
  Description of Artificial Sequence: Synthetic oligonucleotide
  Target: ATXN1; (-) strand; PAM type: YTN; PAM sequence: TTT
ttttggtacttcaattatgc

SEQ ID NO: 158374 - DNA, 20 bp, Artificial Sequence
  Description of Artificial Sequence: Synthetic oligonucleotide
  Target: ATXN1; (-) strand; PAM type: YTN; PAM sequence: TTA
aagtttttttggtacttcaa

SEQ ID NO: 158375 - DNA, 20 bp, Artificial Sequence
  Description of Artificial Sequence: Synthetic oligonucleotide
  Target: ATXN1; (-) strand; PAM type: YTN; PAM sequence: TTT
aaagtttttttggtacttca

SEQ ID NO: 158376 - DNA, 20 bp, Artificial Sequence
  Description of Artificial Sequence: Synthetic oligonucleotide
  Target: ATXN1; (-) strand; PAM type: YTN; PAM sequence: TTT
taaagtttttttggtacttc

SEQ ID NO: 158377 - DNA, 20 bp, Artificial Sequence
  Description of Artificial Sequence: Synthetic oligonucleotide
  Target: ATXN1; (-) strand; PAM type: YTN; PAM sequence: CTT
ttaaagtttttttggtactt

SEQ ID NO: 158378 - DNA, 20 bp, Artificial Sequence
  Description of Artificial Sequence: Synthetic oligonucleotide
  Target: ATXN1; (-) strand; PAM type: YTN; PAM sequence: CTA
cttttaaagtttttttggta

SEQ ID NO: 158379 - DNA, 20 bp, Artificial Sequence
  Description of Artificial Sequence: Synthetic oligonucleotide
  Target: ATXN1; (-) strand; PAM type: YTN; PAM sequence: CTA
ctacttttaaagtttttttg

SEQ ID NO: 158380 - DNA, 20 bp, Artificial Sequence
  Description of Artificial Sequence: Synthetic oligonucleotide
  Target: ATXN1; (-) strand; PAM type: YTN; PAM sequence: CTG
tggaaatctactacttttaa

SEQ ID NO: 158381 - DNA, 20 bp, Artificial Sequence
  Description of Artificial Sequence: Synthetic oligonucleotide
  Target: ATXN1; (-) strand; PAM type: YTN; PAM sequence: TTA
acaaaggaaacaaagaagat

SEQ ID NO: 158382 - DNA, 20 bp, Artificial Sequence
  Description of Artificial Sequence: Synthetic oligonucleotide
  Target: ATXN1; (-) strand; PAM type: YTN; PAM sequence: CTA
gatcaatcagagttaacaaa

SEQ ID NO: 158383 - DNA, 20 bp, Artificial Sequence
  Description of Artificial Sequence: Synthetic oligonucleotide
  Target: ATXN1; (-) strand; PAM type: YTN; PAM sequence: CTA
gaaatgtatcagaactagat

SEQ ID NO: 158384 - DNA, 20 bp, Artificial Sequence
  Description of Artificial Sequence: Synthetic oligonucleotide
  Target: ATXN1; (-) strand; PAM type: YTN; PAM sequence: TTC
tagaaatgtatcagaactag

SEQ ID NO: 158385 - DNA, 20 bp, Artificial Sequence
  Description of Artificial Sequence: Synthetic oligonucleotide
  Target: ATXN1; (-) strand; PAM type: YTN; PAM sequence: CTG
tcattctagaaatgtatcag

SEQ ID NO: 158386 - DNA, 20 bp, Artificial Sequence
  Description of Artificial Sequence: Synthetic oligonucleotide
  Target: ATXN1; (-) strand; PAM type: YTN; PAM sequence: TTG
tatggatccagtaaagtctg

SEQ ID NO: 158387 - DNA, 20 bp, Artificial Sequence
  Description of Artificial Sequence: Synthetic oligonucleotide
  Target: ATXN1; (-) strand; PAM type: YTN; PAM sequence: CTT
gtatggatccagtaaagtct

SEQ ID NO: 158388 - DNA, 20 bp, Artificial Sequence
  Description of Artificial Sequence: Synthetic oligonucleotide
  Target: ATXN1; (-) strand; PAM type: YTN; PAM sequence: CTA
aaaatatgccttgtatggat

SEQ ID NO: 158389 - DNA, 20 bp, Artificial Sequence
  Description of Artificial Sequence: Synthetic oligonucleotide
  Target: ATXN1; (-) strand; PAM type: YTN; PAM sequence: TTC
taaaaatatgccttgtatgg

SEQ ID NO: 158390 - DNA, 20 bp, Artificial Sequence
  Description of Artificial Sequence: Synthetic oligonucleotide
  Target: ATXN1; (-) strand; PAM type: YTN; PAM sequence: CTT
ctaaaaatatgccttgtatg

SEQ ID NO: 158391 - DNA, 20 bp, Artificial Sequence
  Description of Artificial Sequence: Synthetic oligonucleotide
  Target: ATXN1; (-) strand; PAM type: YTN; PAM sequence: CTC
ttctaaaaatatgccttgta

SEQ ID NO: 158392 - DNA, 20 bp, Artificial Sequence
  Description of Artificial Sequence: Synthetic oligonucleotide
  Target: ATXN1; (-) strand; PAM type: YTN; PAM sequence: TTG
tctcttctaaaaatatgcct

SEQ ID NO: 158393 - DNA, 20 bp, Artificial Sequence
  Description of Artificial Sequence: Synthetic oligonucleotide
  Target: ATXN1; (-) strand; PAM type: YTN; PAM sequence: CTC
aagttgtctcttctaaaaat

SEQ ID NO: 158394 - DNA, 20 bp, Artificial Sequence
  Description of Artificial Sequence: Synthetic oligonucleotide
  Target: ATXN1; (-) strand; PAM type: YTN; PAM sequence: CTG
ccatatgaatgtactcaagt

SEQ ID NO: 158395 - DNA, 20 bp, Artificial Sequence
  Description of Artificial Sequence: Synthetic oligonucleotide
  Target: ATXN1; (-) strand; PAM type: YTN; PAM sequence: TTA
caagctgccatatgaatgta

SEQ ID NO: 158396 - DNA, 20 bp, Artificial Sequence
  Description of Artificial Sequence: Synthetic oligonucleotide
  Target: ATXN1; (-) strand; PAM type: YTN; PAM sequence: CTT
acaagctgccatatgaatgt

SEQ ID NO: 158397 - DNA, 20 bp, Artificial Sequence
  Description of Artificial Sequence: Synthetic oligonucleotide
  Target: ATXN1; (-) strand; PAM type: YTN; PAM sequence: TTC
atgcttacaagctgccatat

SEQ ID NO: 158398 - DNA, 20 bp, Artificial Sequence
  Description of Artificial Sequence: Synthetic oligonucleotide
  Target: ATXN1; (-) strand; PAM type: YTN; PAM sequence: TTC
ccccagtaatacacacagga

SEQ ID NO: 158399 - DNA, 20 bp, Artificial Sequence
  Description of Artificial Sequence: Synthetic oligonucleotide
  Target: ATXN1; (-) strand; PAM type: YTN; PAM sequence: TTT
cccccagtaatacacacagg

SEQ ID NO: 158400 - DNA, 20 bp, Artificial Sequence
  Description of Artificial Sequence: Synthetic oligonucleotide
  Target: ATXN1; (-) strand; PAM type: YTN; PAM sequence: CTT
tcccccagtaatacacacag

SEQ ID NO: 158401 - DNA, 20 bp, Artificial Sequence
  Description of Artificial Sequence: Synthetic oligonucleotide
  Target: ATXN1; (-) strand; PAM type: YTN; PAM sequence: TTA
taaaaatagcccagaacaat

SEQ ID NO: 158402 - DNA, 20 bp, Artificial Sequence
  Description of Artificial Sequence: Synthetic oligonucleotide
  Target: ATXN1; (-) strand; PAM type: YTN; PAM sequence: TTC
acattataaaaatagcccag

SEQ ID NO: 158403 - DNA, 20 bp, Artificial Sequence
  Description of Artificial Sequence: Synthetic oligonucleotide
  Target: ATXN1; (-) strand; PAM type: YTN; PAM sequence: CTT
cacattataaaaatagccca

SEQ ID NO: 158404 - DNA, 20 bp, Artificial Sequence
  Description of Artificial Sequence: Synthetic oligonucleotide
  Target: ATXN1; (-) strand; PAM type: YTN; PAM sequence: TTG
cttcacattataaaaatagc

SEQ ID NO: 158405 - DNA, 20 bp, Artificial Sequence
  Description of Artificial Sequence: Synthetic oligonucleotide
  Target: ATXN1; (-) strand; PAM type: YTN; PAM sequence: CTT
gcttcacattataaaaatag

SEQ ID NO: 158406 - DNA, 20 bp, Artificial Sequence
  Description of Artificial Sequence: Synthetic oligonucleotide
  Target: ATXN1; (-) strand; PAM type: YTN; PAM sequence: TTA
gcttgcttcacattataaaa

SEQ ID NO: 158407 - DNA, 20 bp, Artificial Sequence
  Description of Artificial Sequence: Synthetic oligonucleotide
  Target: ATXN1; (-) strand; PAM type: YTN; PAM sequence: TTT
agcttgcttcacattataaa

SEQ ID NO: 158408 - DNA, 20 bp, Artificial Sequence
  Description of Artificial Sequence: Synthetic oligonucleotide
  Target: ATXN1; (-) strand; PAM type: YTN; PAM sequence: TTT
tagcttgcttcacattataa

SEQ ID NO: 158409 - DNA, 20 bp, Artificial Sequence
  Description of Artificial Sequence: Synthetic oligonucleotide
  Target: ATXN1; (-) strand; PAM type: YTN; PAM sequence: CTT
ttagcttgcttcacattata

SEQ ID NO: 158410 - DNA, 20 bp, Artificial Sequence
  Description of Artificial Sequence: Synthetic oligonucleotide
  Target: ATXN1; (-) strand; PAM type: YTN; PAM sequence: CTC
aaaaacttttagcttgcttc

SEQ ID NO: 158411 - DNA, 20 bp, Artificial Sequence
  Description of Artificial Sequence: Synthetic oligonucleotide
  Target: ATXN1; (-) strand; PAM type: YTN; PAM sequence: TTG
acagagagtaggcactcaaa

SEQ ID NO: 158412 - DNA, 20 bp, Artificial Sequence
  Description of Artificial Sequence: Synthetic oligonucleotide
  Target: ATXN1; (-) strand; PAM type: YTN; PAM sequence: CTT
gacagagagtaggcactcaa

SEQ ID NO: 158413 - DNA, 20 bp, Artificial Sequence
  Description of Artificial Sequence: Synthetic oligonucleotide
  Target: ATXN1; (-) strand; PAM type: YTN; PAM sequence: CTG
agagcttgacagagagtagg

SEQ ID NO: 158414 - DNA, 20 bp, Artificial Sequence
  Description of Artificial Sequence: Synthetic oligonucleotide
  Target: ATXN1; (-) strand; PAM type: YTN; PAM sequence: TTG
tacctgagagcttgacagag

SEQ ID NO: 158415 - DNA, 20 bp, Artificial Sequence
  Description of Artificial Sequence: Synthetic oligonucleotide
  Target: ATXN1; (-) strand; PAM type: YTN; PAM sequence: TTT
gtacctgagagcttgacaga

SEQ ID NO: 158416 - DNA, 20 bp, Artificial Sequence
  Description of Artificial Sequence: Synthetic oligonucleotide
  Target: ATXN1; (-) strand; PAM type: YTN; PAM sequence: TTG
taaagtttgtacctgagagc

SEQ ID NO: 158417 - DNA, 20 bp, Artificial Sequence
  Description of Artificial Sequence: Synthetic oligonucleotide
  Target: ATXN1; (-) strand; PAM type: YTN; PAM sequence: TTT
gtaaagtttgtacctgagag

SEQ ID NO: 158418 - DNA, 20 bp, Artificial Sequence
  Description of Artificial Sequence: Synthetic oligonucleotide
  Target: ATXN1; (-) strand; PAM type: YTN; PAM sequence: TTT
tgtaaagtttgtacctgaga

SEQ ID NO: 158419 - DNA, 20 bp, Artificial Sequence
  Description of Artificial Sequence: Synthetic oligonucleotide
  Target: ATXN1; (-) strand; PAM type: YTN; PAM sequence: TTT
ttgtaaagtttgtacctgag

SEQ ID NO: 158420 - DNA, 20 bp, Artificial Sequence
  Description of Artificial Sequence: Synthetic oligonucleotide
  Target: ATXN1; (-) strand; PAM type: YTN; PAM sequence: CTT
tttgtaaagtttgtacctga

SEQ ID NO: 158421 - DNA, 20 bp, Artificial Sequence
  Description of Artificial Sequence: Synthetic oligonucleotide
  Target: ATXN1; (-) strand; PAM type: YTN; PAM sequence: TTA
aacaaaatactttttgtaaa

SEQ ID NO: 158422 - DNA, 20 bp, Artificial Sequence
  Description of Artificial Sequence: Synthetic oligonucleotide
  Target: ATXN1; (-) strand; PAM type: YTN; PAM sequence: TTA
tgaacattaaacaaaatact

SEQ ID NO: 158423 - DNA, 20 bp, Artificial Sequence
  Description of Artificial Sequence: Synthetic oligonucleotide
  Target: ATXN1; (-) strand; PAM type: YTN; PAM sequence: CTA
ttatgaacattaaacaaaat

SEQ ID NO: 158424 - DNA, 20 bp, Artificial Sequence
  Description of Artificial Sequence: Synthetic oligonucleotide
  Target: ATXN1; (-) strand; PAM type: YTN; PAM sequence: CTA
atactattatgaacattaaa

SEQ ID NO: 158425 - DNA, 20 bp, Artificial Sequence
  Description of Artificial Sequence: Synthetic oligonucleotide
  Target: ATXN1; (-) strand; PAM type: YTN; PAM sequence: TTC
catactaatactattatgaa

SEQ ID NO: 158426 - DNA, 20 bp, Artificial Sequence
  Description of Artificial Sequence: Synthetic oligonucleotide
  Target: ATXN1; (-) strand; PAM type: YTN; PAM sequence: CTA
ttccatactaatactattat

SEQ ID NO: 158427 - DNA, 20 bp, Artificial Sequence
  Description of Artificial Sequence: Synthetic oligonucleotide
  Target: ATXN1; (-) strand; PAM type: YTN; PAM sequence: TTG
gaagagcaatactattccat

SEQ ID NO: 158428 - DNA, 20 bp, Artificial Sequence
  Description of Artificial Sequence: Synthetic oligonucleotide
  Target: ATXN1; (-) strand; PAM type: YTN; PAM sequence: TTA
caaaattggaagagcaatac

SEQ ID NO: 158429 - DNA, 20 bp, Artificial Sequence
  Description of Artificial Sequence: Synthetic oligonucleotide
  Target: ATXN1; (-) strand; PAM type: YTN; PAM sequence: TTT
acaaaattggaagagcaata

SEQ ID NO: 158430 - DNA, 20 bp, Artificial Sequence
  Description of Artificial Sequence: Synthetic oligonucleotide
  Target: ATXN1; (-) strand; PAM type: YTN; PAM sequence: TTC
gtaaaatttacaaaattgga

SEQ ID NO: 158431 - DNA, 20 bp, Artificial Sequence
  Description of Artificial Sequence: Synthetic oligonucleotide
  Target: ATXN1; (-) strand; PAM type: YTN; PAM sequence: CTA
ttcgtaaaatttacaaaatt

SEQ ID NO: 158432 - DNA, 20 bp, Artificial Sequence
  Description of Artificial Sequence: Synthetic oligonucleotide
  Target: ATXN1; (-) strand; PAM type: YTN; PAM sequence: CTG
tgactattcgtaaaatttac

SEQ ID NO: 158433 - DNA, 20 bp, Artificial Sequence
  Description of Artificial Sequence: Synthetic oligonucleotide
  Target: ATXN1; (-) strand; PAM type: YTN; PAM sequence: CTC
tgtgactattcgtaaaattt

SEQ ID NO: 158434 - DNA, 20 bp, Artificial Sequence
  Description of Artificial Sequence: Synthetic oligonucleotide
  Target: ATXN1; (-) strand; PAM type: YTN; PAM sequence: CTC
tctgtgactattcgtaaaat

SEQ ID NO: 158435 - DNA, 20 bp, Artificial Sequence
  Description of Artificial Sequence: Synthetic oligonucleotide
  Target: ATXN1; (-) strand; PAM type: YTN; PAM sequence: TTA
atctctctgtgactattcgt

SEQ ID NO: 158436 - DNA, 20 bp, Artificial Sequence
  Description of Artificial Sequence: Synthetic oligonucleotide
  Target: ATXN1; (-) strand; PAM type: YTN; PAM sequence: CTT
aatctctctgtgactattcg

SEQ ID NO: 158437 - DNA, 20 bp, Artificial Sequence
  Description of Artificial Sequence: Synthetic oligonucleotide
  Target: ATXN1; (-) strand; PAM type: YTN; PAM sequence: TTA
ggcaagtgacttaatctctc

SEQ ID NO: 158438 - DNA, 20 bp, Artificial Sequence
  Description of Artificial Sequence: Synthetic oligonucleotide
  Target: ATXN1; (-) strand; PAM type: YTN; PAM sequence: CTA
tgacattaggcaagtgactt

SEQ ID NO: 158439 - DNA, 20 bp, Artificial Sequence
  Description of Artificial Sequence: Synthetic oligonucleotide
  Target: ATXN1; (-) strand; PAM type: YTN; PAM sequence: CTA
atagctatgacattaggcaa

SEQ ID NO: 158440 - DNA, 20 bp, Artificial Sequence
  Description of Artificial Sequence: Synthetic oligonucleotide
  Target: ATXN1; (-) strand; PAM type: YTN; PAM sequence: TTA
gctaatagctatgacattag

SEQ ID NO: 158441 - DNA, 20 bp, Artificial Sequence
  Description of Artificial Sequence: Synthetic oligonucleotide
  Target: ATXN1; (-) strand; PAM type: YTN; PAM sequence: CTA
aacccattagctaatagcta

SEQ ID NO: 158442 - DNA, 20 bp, Artificial Sequence
  Description of Artificial Sequence: Synthetic oligonucleotide
  Target: ATXN1; (-) strand; PAM type: YTN; PAM sequence: CTG
ggataaaatcctaaacccat

SEQ ID NO: 158443 - DNA, 20 bp, Artificial Sequence
  Description of Artificial Sequence: Synthetic oligonucleotide
  Target: ATXN1; (-) strand; PAM type: YTN; PAM sequence: TTG
ggggccaatgactgggataa

SEQ ID NO: 158444 - DNA, 20 bp, Artificial Sequence
  Description of Artificial Sequence: Synthetic oligonucleotide
  Target: ATXN1; (-) strand; PAM type: YTN; PAM sequence: TTT
gggggccaatgactgggata

SEQ ID NO: 158445 - DNA, 20 bp, Artificial Sequence
  Description of Artificial Sequence: Synthetic oligonucleotide
  Target: ATXN1; (-) strand; PAM type: YTN; PAM sequence: CTC
acaagggtagaggtcaggag

SEQ ID NO: 158446 - DNA, 20 bp, Artificial Sequence
  Description of Artificial Sequence: Synthetic oligonucleotide
  Target: ATXN1; (-) strand; PAM type: YTN; PAM sequence: TTG
ctcacaagggtagaggtcag

SEQ ID NO: 158447 - DNA, 20 bp, Artificial Sequence
  Description of Artificial Sequence: Synthetic oligonucleotide
  Target: ATXN1; (-) strand; PAM type: YTN; PAM sequence: TTT
gctcacaagggtagaggtca

SEQ ID NO: 158448 - DNA, 20 bp, Artificial Sequence
  Description of Artificial Sequence: Synthetic oligonucleotide
  Target: ATXN1; (-) strand; PAM type: YTN; PAM sequence: CTT
tgctcacaagggtagaggtc

SEQ ID NO: 158449 - DNA, 20 bp, Artificial Sequence
  Description of Artificial Sequence: Synthetic oligonucleotide
  Target: ATXN1; (-) strand; PAM type: YTN; PAM sequence: TTG
taatgtctttgctcacaagg

SEQ ID NO: 158450 - DNA, 20 bp, Artificial Sequence
  Description of Artificial Sequence: Synthetic oligonucleotide
  Target: ATXN1; (-) strand; PAM type: YTN; PAM sequence: TTG
gtggcattgtaatgtctttg

SEQ ID NO: 158451 - DNA, 20 bp, Artificial Sequence
  Description of Artificial Sequence: Synthetic oligonucleotide
  Target: ATXN1; (-) strand; PAM type: YTN; PAM sequence: TTT
ggtggcattgtaatgtcttt

SEQ ID NO: 158452 - DNA, 20 bp, Artificial Sequence
  Description of Artificial Sequence: Synthetic oligonucleotide
  Target: ATXN1; (-) strand; PAM type: YTN; PAM sequence: TTT
tggtggcattgtaatgtctt

SEQ ID NO: 158453 - DNA, 20 bp, Artificial Sequence
  Description of Artificial Sequence: Synthetic oligonucleotide
  Target: ATXN1; (-) strand; PAM type: YTN; PAM sequence: CTT
ttggtggcattgtaatgtct

SEQ ID NO: 158454 - DNA, 20 bp, Artificial Sequence
  Description of Artificial Sequence: Synthetic oligonucleotide
  Target: ATXN1; (-) strand; PAM type: YTN; PAM sequence: CTC
ttttggtggcattgtaatgt

SEQ ID NO: 158455 - DNA, 20 bp, Artificial Sequence
  Description of Artificial Sequence: Synthetic oligonucleotide
  Target: ATXN1; (-) strand; PAM type: YTN; PAM sequence: TTC
atctcttttggtggcattgt

SEQ ID NO: 158456 - DNA, 20 bp, Artificial Sequence
  Description of Artificial Sequence: Synthetic oligonucleotide
  Target: ATXN1; (-) strand; PAM type: YTN; PAM sequence: TTA
gttcatctcttttggtggca

SEQ ID NO: 158457 - DNA, 20 bp, Artificial Sequence
  Description of Artificial Sequence: Synthetic oligonucleotide
  Target: ATXN1; (-) strand; PAM type: YTN; PAM sequence: CTT
agttcatctcttttggtggc

SEQ ID NO: 158458 - DNA, 20 bp, Artificial Sequence
  Description of Artificial Sequence: Synthetic oligonucleotide
  Target: ATXN1; (-) strand; PAM type: YTN; PAM sequence: TTG
gggggtagcaggaatgctta

SEQ ID NO: 158459 - DNA, 20 bp, Artificial Sequence
  Description of Artificial Sequence: Synthetic oligonucleotide
  Target: ATXN1; (-) strand; PAM type: YTN; PAM sequence: CTG
ttggggggtagcaggaatgc

SEQ ID NO: 158460 - DNA, 20 bp, Artificial Sequence
  Description of Artificial Sequence: Synthetic oligonucleotide
  Target: ATXN1; (-) strand; PAM type: YTN; PAM sequence: TTC
accactgttggggggtagca

SEQ ID NO: 158461 - DNA, 20 bp, Artificial Sequence
  Description of Artificial Sequence: Synthetic oligonucleotide
  Target: ATXN1; (-) strand; PAM type: YTN; PAM sequence: TTC
agtcaatattcaccactgtt

SEQ ID NO: 158462 - DNA, 20 bp, Artificial Sequence
  Description of Artificial Sequence: Synthetic oligonucleotide
  Target: ATXN1; (-) strand; PAM type: YTN; PAM sequence: TTT
cagtcaatattcaccactgt

SEQ ID NO: 158463 - DNA, 20 bp, Artificial Sequence
  Description of Artificial Sequence: Synthetic oligonucleotide
  Target: ATXN1; (-) strand; PAM type: YTN; PAM sequence: TTA
tttcagtcaatattcaccac

SEQ ID NO: 158464 - DNA, 20 bp, Artificial Sequence
  Description of Artificial Sequence: Synthetic oligonucleotide
  Target: ATXN1; (-) strand; PAM type: YTN; PAM sequence: CTT
atttcagtcaatattcacca

SEQ ID NO: 158465 - DNA, 20 bp, Artificial Sequence
  Description of Artificial Sequence: Synthetic oligonucleotide
  Target: ATXN1; (-) strand; PAM type: YTN; PAM sequence: CTA
cttatttcagtcaatattca

SEQ ID NO: 158466 - DNA, 20 bp, Artificial Sequence
  Description of Artificial Sequence: Synthetic oligonucleotide
  Target: ATXN1; (-) strand; PAM type: YTN; PAM sequence: TTG
gatcctacttatttcagtca

SEQ ID NO: 158467 - DNA, 20 bp, Artificial Sequence
  Description of Artificial Sequence: Synthetic oligonucleotide
  Target: ATXN1; (-) strand; PAM type: YTN; PAM sequence: TTT
ggatcctacttatttcagtc

SEQ ID NO: 158468 - DNA, 20 bp, Artificial Sequence
  Description of Artificial Sequence: Synthetic oligonucleotide
  Target: ATXN1; (-) strand; PAM type: YTN; PAM sequence: CTT
tggatcctacttatttcagt

SEQ ID NO: 158469 - DNA, 20 bp, Artificial Sequence
  Description of Artificial Sequence: Synthetic oligonucleotide
  Target: ATXN1; (-) strand; PAM type: YTN; PAM sequence: CTC
atgcctttggatcctactta

SEQ ID NO: 158470 - DNA, 20 bp, Artificial Sequence
  Description of Artificial Sequence: Synthetic oligonucleotide
  Target: ATXN1; (-) strand; PAM type: YTN; PAM sequence: CTG
taccatggaacaagcccatg

SEQ ID NO: 158471 - DNA, 20 bp, Artificial Sequence
  Description of Artificial Sequence: Synthetic oligonucleotide
  Target: ATXN1; (-) strand; PAM type: YTN; PAM sequence: TTA
tctgtaccatggaacaagcc

SEQ ID NO: 158472 - DNA, 20 bp, Artificial Sequence
  Description of Artificial Sequence: Synthetic oligonucleotide
  Target: ATXN1; (-) strand; PAM type: YTN; PAM sequence: CTG
catcacaattatctgtacca

SEQ ID NO: 158473 - DNA, 20 bp, Artificial Sequence
  Description of Artificial Sequence: Synthetic oligonucleotide
  Target: ATXN1; (-) strand; PAM type: YTN; PAM sequence: CTA
taaggcaaacactgcatcac

SEQ ID NO: 158474 - DNA, 20 bp, Artificial Sequence
  Description of Artificial Sequence: Synthetic oligonucleotide
  Target: ATXN1; (-) strand; PAM type: YTN; PAM sequence: TTG
tatgagtggctataaggcaa

SEQ ID NO: 158475 - DNA, 20 bp, Artificial Sequence
  Description of Artificial Sequence: Synthetic oligonucleotide
  Target: ATXN1; (-) strand; PAM type: YTN; PAM sequence: CTA
gaattgtatgagtggctata

SEQ ID NO: 158476 - DNA, 20 bp, Artificial Sequence
  Description of Artificial Sequence: Synthetic oligonucleotide
  Target: ATXN1; (-) strand; PAM type: YTN; PAM sequence: TTG
tacagggtaactagaattgt

SEQ ID NO: 158477 - DNA, 20 bp, Artificial Sequence
  Description of Artificial Sequence: Synthetic oligonucleotide
  Target: ATXN1; (-) strand; PAM type: YTN; PAM sequence: CTT
gtacagggtaactagaattg

SEQ ID NO: 158478 - DNA, 20 bp, Artificial Sequence
  Description of Artificial Sequence: Synthetic oligonucleotide
  Target: ATXN1; (-) strand; PAM type: YTN; PAM sequence: TTG
aaaccaaatagtgtcacaca

SEQ ID NO: 158479 - DNA, 20 bp, Artificial Sequence
  Description of Artificial Sequence: Synthetic oligonucleotide
  Target: ATXN1; (-) strand; PAM type: YTN; PAM sequence: TTT
gaaaccaaatagtgtcacac

SEQ ID NO: 158480 - DNA, 20 bp, Artificial Sequence
  Description of Artificial Sequence: Synthetic oligonucleotide
  Target: ATXN1; (-) strand; PAM type: YTN; PAM sequence: TTT
tgaaaccaaatagtgtcaca

SEQ ID NO: 158481 - DNA, 20 bp, Artificial Sequence
  Description of Artificial Sequence: Synthetic oligonucleotide
  Target: ATXN1; (-) strand; PAM type: YTN; PAM sequence: CTG
tgtgtgatgtaaatgtagtt

SEQ ID NO: 158482 - DNA, 20 bp, Artificial Sequence
  Description of Artificial Sequence: Synthetic oligonucleotide
  Target: ATXN1; (-) strand; PAM type: YTN; PAM sequence: TTC
tgtgtgtgatgtaaatgtag

SEQ ID NO: 158483 - DNA, 20 bp, Artificial Sequence
  Description of Artificial Sequence: Synthetic oligonucleotide
  Target: ATXN1; (-) strand; PAM type: YTN; PAM sequence: TTT
ctgtgtgtgatgtaaatgta

SEQ ID NO: 158484 - DNA, 20 bp, Artificial Sequence
  Description of Artificial Sequence: Synthetic oligonucleotide
  Target: ATXN1; (-) strand; PAM type: YTN; PAM sequence: CTA
tgtatatatgcacatatatg

SEQ ID NO: 158485 - DNA, 20 bp, Artificial Sequence
  Description of Artificial Sequence: Synthetic oligonucleotide
  Target: ATXN1; (-) strand; PAM type: YTN; PAM sequence: TTG
tctatgtatatatgcacata

SEQ ID NO: 158486 - DNA, 20 bp, Artificial Sequence
  Description of Artificial Sequence: Synthetic oligonucleotide
  Target: ATXN1; (-) strand; PAM type: YTN; PAM sequence: TTT
gtctatgtatatatgcacat

SEQ ID NO: 158487 - DNA, 20 bp, Artificial Sequence
  Description of Artificial Sequence: Synthetic oligonucleotide
  Target: ATXN1; (-) strand; PAM type: YTN; PAM sequence: TTG
taagtatatttgtctatgta

SEQ ID NO: 158488 - DNA, 20 bp, Artificial Sequence
  Description of Artificial Sequence: Synthetic oligonucleotide
  Target: ATXN1; (-) strand; PAM type: YTN; PAM sequence: CTT
gtaagtatatttgtctatgt

SEQ ID NO: 158489 - DNA, 20 bp, Artificial Sequence
  Description of Artificial Sequence: Synthetic oligonucleotide
  Target: ATXN1; (-) strand; PAM type: YTN; PAM sequence: CTG
atacagtcacttgtaagtat

SEQ ID NO: 158490 - DNA, 20 bp, Artificial Sequence
  Description of Artificial Sequence: Synthetic oligonucleotide
  Target: ATXN1; (-) strand; PAM type: YTN; PAM sequence: TTA
gaatacagtgggtatcccca

SEQ ID NO: 158491 - DNA, 20 bp, Artificial Sequence
  Description of Artificial Sequence: Synthetic oligonucleotide
  Target: ATXN1; (-) strand; PAM type: YTN; PAM sequence: CTT
agaatacagtgggtatcccc

SEQ ID NO: 158492 - DNA, 20 bp, Artificial Sequence
  Description of Artificial Sequence: Synthetic oligonucleotide
  Target: ATXN1; (-) strand; PAM type: YTN; PAM sequence: CTA
cttagaatacagtgggtatc

SEQ ID NO: 158493 - DNA, 20 bp, Artificial Sequence
  Description of Artificial Sequence: Synthetic oligonucleotide
  Target: ATXN1; (-) strand; PAM type: YTN; PAM sequence: CTC
ctacttagaatacagtgggt

SEQ ID NO: 158494 - DNA, 20 bp, Artificial Sequence
  Description of Artificial Sequence: Synthetic oligonucleotide
  Target: ATXN1; (-) strand; PAM type: YTN; PAM sequence: TTG
gtcctcctacttagaataca

SEQ ID NO: 158495 - DNA, 20 bp, Artificial Sequence
  Description of Artificial Sequence: Synthetic oligonucleotide
  Target: ATXN1; (-) strand; PAM type: YTN; PAM sequence: TTC
cagattggtcctcctactta

SEQ ID NO: 158496 - DNA, 20 bp, Artificial Sequence
  Description of Artificial Sequence: Synthetic oligonucleotide
  Target: ATXN1; (-) strand; PAM type: YTN; PAM sequence: CTA
tggagccagttccagattgg

SEQ ID NO: 158497 - DNA, 20 bp, Artificial Sequence
  Description of Artificial Sequence: Synthetic oligonucleotide
  Target: ATXN1; (-) strand; PAM type: YTN; PAM sequence: TTG
caagaggatctatggagcca

SEQ ID NO: 158498 - DNA, 20 bp, Artificial Sequence
  Description of Artificial Sequence: Synthetic oligonucleotide
  Target: ATXN1; (-) strand; PAM type: YTN; PAM sequence: TTT
gcaagaggatctatggagcc

SEQ ID NO: 158499 - DNA, 20 bp, Artificial Sequence
  Description of Artificial Sequence: Synthetic oligonucleotide
  Target: ATXN1; (-) strand; PAM type: YTN; PAM sequence: CTA
agaggtttgcaagaggatct

SEQ ID NO: 158500 - DNA, 20 bp, Artificial Sequence
  Description of Artificial Sequence: Synthetic oligonucleotide
  Target: ATXN1; (-) strand; PAM type: YTN; PAM sequence: CTC
taagaggtttgcaagaggat

SEQ ID NO: 158501 - DNA, 20 bp, Artificial Sequence
  Description of Artificial Sequence: Synthetic oligonucleotide
  Target: ATXN1; (-) strand; PAM type: YTN; PAM sequence: TTA
atgactctaagaggtttgca

SEQ ID NO: 158502 - DNA, 20 bp, Artificial Sequence
  Description of Artificial Sequence: Synthetic oligonucleotide
  Target: ATXN1; (-) strand; PAM type: YTN; PAM sequence: TTG
ttaatgactctaagaggttt

SEQ ID NO: 158503 - DNA, 20 bp, Artificial Sequence
  Description of Artificial Sequence: Synthetic oligonucleotide
  Target: ATXN1; (-) strand; PAM type: YTN; PAM sequence: TTA
tgttgttaatgactctaaga

SEQ ID NO: 158504 - DNA, 20 bp, Artificial Sequence
  Description of Artificial Sequence: Synthetic oligonucleotide
  Target: ATXN1; (-) strand; PAM type: YTN; PAM sequence: TTT
atgttgttaatgactctaag

SEQ ID NO: 158505 - DNA, 20 bp, Artificial Sequence
  Description of Artificial Sequence: Synthetic oligonucleotide
  Target: ATXN1; (-) strand; PAM type: YTN; PAM sequence: TTC
agtttatgttgttaatgact

SEQ ID NO: 158506 - DNA, 20 bp, Artificial Sequence
  Description of Artificial Sequence: Synthetic oligonucleotide
  Target: ATXN1; (-) strand; PAM type: YTN; PAM sequence: CTG
ttcagtttatgttgttaatg

SEQ ID NO: 158507 - DNA, 20 bp, Artificial Sequence
  Description of Artificial Sequence: Synthetic oligonucleotide
  Target: ATXN1; (-) strand; PAM type: YTN; PAM sequence: TTC
tgttcagtttatgttgttaa

SEQ ID NO: 158508 - DNA, 20 bp, Artificial Sequence
  Description of Artificial Sequence: Synthetic oligonucleotide
  Target: ATXN1; (-) strand; PAM type: YTN; PAM sequence: CTT
ctgttcagtttatgttgtta

SEQ ID NO: 158509 - DNA, 20 bp, Artificial Sequence
  Description of Artificial Sequence: Synthetic oligonucleotide
  Target: ATXN1; (-) strand; PAM type: YTN; PAM sequence: TTC
cttctgttcagtttatgttg

SEQ ID NO: 158510 - DNA, 20 bp, Artificial Sequence
  Description of Artificial Sequence: Synthetic oligonucleotide
  Target: ATXN1; (-) strand; PAM type: YTN; PAM sequence: TTT
ccttctgttcagtttatgtt

SEQ ID NO: 158511 - DNA, 20 bp, Artificial Sequence
  Description of Artificial Sequence: Synthetic oligonucleotide
  Target: ATXN1; (-) strand; PAM type: YTN; PAM sequence: TTG
gtttccttctgttcagttta

SEQ ID NO: 158512 - DNA, 20 bp, Artificial Sequence
  Description of Artificial Sequence: Synthetic oligonucleotide
  Target: ATXN1; (-) strand; PAM type: YTN; PAM sequence: TTG
atgtgggattggtttccttc

SEQ ID NO: 158513 - DNA, 20 bp, Artificial Sequence
  Description of Artificial Sequence: Synthetic oligonucleotide
  Target: ATXN1; (-) strand; PAM type: YTN; PAM sequence: CTT
gatgtgggattggtttcctt

SEQ ID NO: 158514 - DNA, 20 bp, Artificial Sequence
  Description of Artificial Sequence: Synthetic oligonucleotide
  Target: ATXN1; (-) strand; PAM type: YTN; PAM sequence: CTC
cacttgatgtgggattggtt

SEQ ID NO: 158515 - DNA, 20 bp, Artificial Sequence
  Description of Artificial Sequence: Synthetic oligonucleotide
  Target: ATXN1; (-) strand; PAM type: YTN; PAM sequence: TTG
cagcaaaacaatctccactt

SEQ ID NO: 158516 - DNA, 20 bp, Artificial Sequence
  Description of Artificial Sequence: Synthetic oligonucleotide
  Target: ATXN1; (-) strand; PAM type: YTN; PAM sequence: TTT
gcagcaaaacaatctccact

SEQ ID NO: 158517 - DNA, 20 bp, Artificial Sequence
  Description of Artificial Sequence: Synthetic oligonucleotide
  Target: ATXN1; (-) strand; PAM type: YTN; PAM sequence: TTG
gatttgcagcaaaacaatct

SEQ ID NO: 158518 - DNA, 20 bp, Artificial Sequence
  Description of Artificial Sequence: Synthetic oligonucleotide
  Target: ATXN1; (-) strand; PAM type: YTN; PAM sequence: CTT
ggatttgcagcaaaacaatc

SEQ ID NO: 158519 - DNA, 20 bp, Artificial Sequence
  Description of Artificial Sequence: Synthetic oligonucleotide
  Target: ATXN1; (-) strand; PAM type: YTN; PAM sequence: TTA
tgacttggatttgcagcaaa

SEQ ID NO: 158520 - DNA, 20 bp, Artificial Sequence
  Description of Artificial Sequence: Synthetic oligonucleotide
  Target: ATXN1; (-) strand; PAM type: YTN; PAM sequence: TTT
atgacttggatttgcagcaa

SEQ ID NO: 158521 - DNA, 20 bp, Artificial Sequence
  Description of Artificial Sequence: Synthetic oligonucleotide
  Target: ATXN1; (-) strand; PAM type: YTN; PAM sequence: TTT
tatgacttggatttgcagca

SEQ ID NO: 158522 - DNA, 20 bp, Artificial Sequence
  Description of Artificial Sequence: Synthetic oligonucleotide
  Target: ATXN1; (-) strand; PAM type: YTN; PAM sequence: TTT
ttatgacttggatttgcagc

SEQ ID NO: 158523 - DNA, 20 bp, Artificial Sequence
  Description of Artificial Sequence: Synthetic oligonucleotide
  Target: ATXN1; (-) strand; PAM type: YTN; PAM sequence: TTA
tttttatgacttggatttgc

SEQ ID NO: 158524 - DNA, 20 bp, Artificial Sequence
  Description of Artificial Sequence: Synthetic oligonucleotide
  Target: ATXN1; (-) strand; PAM type: YTN; PAM sequence: TTT
atttttatgacttggatttg

SEQ ID NO: 158525 - DNA, 20 bp, Artificial Sequence
  Description of Artificial Sequence: Synthetic oligonucleotide
  Target: ATXN1; (-) strand; PAM type: YTN; PAM sequence: TTT
tatttttatgacttggattt

SEQ ID NO: 158526 - DNA, 20 bp, Artificial Sequence
  Description of Artificial Sequence: Synthetic oligonucleotide
  Target: ATXN1; (-) strand; PAM type: YTN; PAM sequence: CTG
agagttttatttttatgact

SEQ ID NO: 158527 - DNA, 20 bp, Artificial Sequence
  Description of Artificial Sequence: Synthetic oligonucleotide
  Target: ATXN1; (-) strand; PAM type: YTN; PAM sequence: TTA
acacctgagagttttatttt

SEQ ID NO: 158528 - DNA, 20 bp, Artificial Sequence
  Description of Artificial Sequence: Synthetic oligonucleotide
  Target: ATXN1; (-) strand; PAM type: YTN; PAM sequence: TTA
cgagacagatgttaacacct

SEQ ID NO: 158529 - DNA, 20 bp, Artificial Sequence
  Description of Artificial Sequence: Synthetic oligonucleotide
  Target: ATXN1; (-) strand; PAM type: YTN; PAM sequence: CTT
acgagacagatgttaacacc

SEQ ID NO: 158530 - DNA, 20 bp, Artificial Sequence
  Description of Artificial Sequence: Synthetic oligonucleotide
  Target: ATXN1; (-) strand; PAM type: YTN; PAM sequence: CTG
gtagagagtcttacgagaca

SEQ ID NO: 158531 - DNA, 20 bp, Artificial Sequence
  Description of Artificial Sequence: Synthetic oligonucleotide
  Target: ATXN1; (-) strand; PAM type: YTN; PAM sequence: CTC
tggtagagagtcttacgaga

SEQ ID NO: 158532 - DNA, 20 bp, Artificial Sequence
  Description of Artificial Sequence: Synthetic oligonucleotide
  Target: ATXN1; (-) strand; PAM type: YTN; PAM sequence: TTG
ggcaagaataagcaaaccgc

SEQ ID NO: 158533 - DNA, 20 bp, Artificial Sequence
  Description of Artificial Sequence: Synthetic oligonucleotide
  Target: ATXN1; (-) strand; PAM type: YTN; PAM sequence: CTG
gtgttgggcaagaataagca

SEQ ID NO: 158534 - DNA, 20 bp, Artificial Sequence
  Description of Artificial Sequence: Synthetic oligonucleotide
  Target: ATXN1; (-) strand; PAM type: YTN; PAM sequence: CTG
cctggtgttgggcaagaata

SEQ ID NO: 158535 - DNA, 20 bp, Artificial Sequence
  Description of Artificial Sequence: Synthetic oligonucleotide
  Target: ATXN1; (-) strand; PAM type: YTN; PAM sequence: CTC
tgcctggtgttgggcaagaa

SEQ ID NO: 158536 - DNA, 20 bp, Artificial Sequence
  Description of Artificial Sequence: Synthetic oligonucleotide
  Target: ATXN1; (-) strand; PAM type: YTN; PAM sequence: TTA
cctctgcctggtgttgggca

SEQ ID NO: 158537 - DNA, 20 bp, Artificial Sequence
  Description of Artificial Sequence: Synthetic oligonucleotide
  Target: ATXN1; (-) strand; PAM type: YTN; PAM sequence: CTG
aatgtcacattacctctgcc

SEQ ID NO: 158538 - DNA, 20 bp, Artificial Sequence
  Description of Artificial Sequence: Synthetic oligonucleotide
  Target: ATXN1; (-) strand; PAM type: YTN; PAM sequence: TTC
tgaatgtcacattacctctg

SEQ ID NO: 158539 - DNA, 20 bp, Artificial Sequence
  Description of Artificial Sequence: Synthetic oligonucleotide
  Target: ATXN1; (-) strand; PAM type: YTN; PAM sequence: CTT
ctgaatgtcacattacctct

SEQ ID NO: 158540 - DNA, 20 bp, Artificial Sequence
  Description of Artificial Sequence: Synthetic oligonucleotide
  Target: ATXN1; (-) strand; PAM type: YTN; PAM sequence: CTG
gtcttctgaatgtcacatta

SEQ ID NO: 158541 - DNA, 20 bp, Artificial Sequence
  Description of Artificial Sequence: Synthetic oligonucleotide
  Target: ATXN1; (-) strand; PAM type: YTN; PAM sequence: TTC
tggtcttctgaatgtcacat

SEQ ID NO: 158542 - DNA, 20 bp, Artificial Sequence
  Description of Artificial Sequence: Synthetic oligonucleotide
  Target: ATXN1; (-) strand; PAM type: YTN; PAM sequence: CTT
ctggtcttctgaatgtcaca

SEQ ID NO: 158543 - DNA, 20 bp, Artificial Sequence
  Description of Artificial Sequence: Synthetic oligonucleotide
  Target: ATXN1; (-) strand; PAM type: YTN; PAM sequence: CTA
aggcttctggtcttctgaat

SEQ ID NO: 158544 - DNA, 20 bp, Artificial Sequence
  Description of Artificial Sequence: Synthetic oligonucleotide
  Target: ATXN1; (-) strand; PAM type: YTN; PAM sequence: TTG
gaactaaggcttctggtctt

SEQ ID NO: 158545 - DNA, 20 bp, Artificial Sequence
  Description of Artificial Sequence: Synthetic oligonucleotide
  Target: ATXN1; (-) strand; PAM type: YTN; PAM sequence: TTT
ggaactaaggcttctggtct

SEQ ID NO: 158546 - DNA, 20 bp, Artificial Sequence
  Description of Artificial Sequence: Synthetic oligonucleotide
  Target: ATXN1; (-) strand; PAM type: YTN; PAM sequence: CTG
acatgtttggaactaaggct

SEQ ID NO: 158547 - DNA, 20 bp, Artificial Sequence
  Description of Artificial Sequence: Synthetic oligonucleotide
  Target: ATXN1; (-) strand; PAM type: YTN; PAM sequence: TTA
tccgggaacacgcagaacca

SEQ ID NO: 158548 - DNA, 20 bp, Artificial Sequence
  Description of Artificial Sequence: Synthetic oligonucleotide
  Target: ATXN1; (-) strand; PAM type: YTN; PAM sequence: CTG
ccagcaaggagacagggagt

SEQ ID NO: 158549 - DNA, 20 bp, Artificial Sequence
  Description of Artificial Sequence: Synthetic oligonucleotide
  Target: ATXN1; (-) strand; PAM type: YTN; PAM sequence: CTC
catgggtaggtgtccggcca

SEQ ID NO: 158550 - DNA, 20 bp, Artificial Sequence
  Description of Artificial Sequence: Synthetic oligonucleotide
  Target: ATXN1; (-) strand; PAM type: YTN; PAM sequence: CTC
tccatgggtaggtgtccggc

SEQ ID NO: 158551 - DNA, 20 bp, Artificial Sequence
  Description of Artificial Sequence: Synthetic oligonucleotide
  Target: ATXN1; (-) strand; PAM type: YTN; PAM sequence: CTC
acacaccaagggcctctcca

SEQ ID NO: 158552 - DNA, 20 bp, Artificial Sequence
  Description of Artificial Sequence: Synthetic oligonucleotide
  Target: ATXN1; (-) strand; PAM type: YTN; PAM sequence: CTG
tgaagtgtgtataatgtggc

SEQ ID NO: 158553 - DNA, 20 bp, Artificial Sequence
  Description of Artificial Sequence: Synthetic oligonucleotide
  Target: ATXN1; (-) strand; PAM type: YTN; PAM sequence: CTG
ccctgtgaagtgtgtataat

SEQ ID NO: 158554 - DNA, 20 bp, Artificial Sequence
  Description of Artificial Sequence: Synthetic oligonucleotide
  Target: ATXN1; (-) strand; PAM type: YTN; PAM sequence: TTG
cctgccctgtgaagtgtgta

SEQ ID NO: 158555 - DNA, 20 bp, Artificial Sequence
  Description of Artificial Sequence: Synthetic oligonucleotide
  Target: ATXN1; (-) strand; PAM type: YTN; PAM sequence: TTA
aatattgcctgccctgtgaa

SEQ ID NO: 158556 - DNA, 20 bp, Artificial Sequence
  Description of Artificial Sequence: Synthetic oligonucleotide
  Target: ATXN1; (-) strand; PAM type: YTN; PAM sequence: TTC
agaaaattaaatattgcctg

SEQ ID NO: 158557 - DNA, 20 bp, Artificial Sequence
  Description of Artificial Sequence: Synthetic oligonucleotide
  Target: ATXN1; (-) strand; PAM type: YTN; PAM sequence: TTT
cagaaaattaaatattgcct

SEQ ID NO: 158558 - DNA, 20 bp, Artificial Sequence
  Description of Artificial Sequence: Synthetic oligonucleotide
  Target: ATXN1; (-) strand; PAM type: YTN; PAM sequence: TTT
tcagaaaattaaatattgcc

SEQ ID NO: 158559 - DNA, 20 bp, Artificial Sequence
  Description of Artificial Sequence: Synthetic oligonucleotide
  Target: ATXN1; (-) strand; PAM type: YTN; PAM sequence: TTA
ttttcagaaaattaaatatt

SEQ ID NO: 158560 - DNA, 20 bp, Artificial Sequence
  Description of Artificial Sequence: Synthetic oligonucleotide
  Target: ATXN1; (-) strand; PAM type: YTN; PAM sequence: CTA
tgagaacacagtagatgtta

SEQ ID NO: 158561 - DNA, 20 bp, Artificial Sequence
  Description of Artificial Sequence: Synthetic oligonucleotide
  Target: ATXN1; (-) strand; PAM type: YTN; PAM sequence: TTA
cctatgagaacacagtagat

SEQ ID NO: 158562 - DNA, 20 bp, Artificial Sequence
  Description of Artificial Sequence: Synthetic oligonucleotide
  Target: ATXN1; (-) strand; PAM type: YTN; PAM sequence: TTT
acctatgagaacacagtaga

SEQ ID NO: 158563 - DNA, 20 bp, Artificial Sequence
  Description of Artificial Sequence: Synthetic oligonucleotide
  Target: ATXN1; (-) strand; PAM type: YTN; PAM sequence: CTC
agataagtttacctatgaga

SEQ ID NO: 158564 - DNA, 20 bp, Artificial Sequence
  Description of Artificial Sequence: Synthetic oligonucleotide
  Target: ATXN1; (-) strand; PAM type: YTN; PAM sequence: TTG
gtaacgtggaaatcctcaga

SEQ ID NO: 158565 - DNA, 20 bp, Artificial Sequence
  Description of Artificial Sequence: Synthetic oligonucleotide
  Target: ATXN1; (-) strand; PAM type: YTN; PAM sequence: CTT
ggtaacgtggaaatcctcag

SEQ ID NO: 158566 - DNA, 20 bp, Artificial Sequence
  Description of Artificial Sequence: Synthetic oligonucleotide
  Target: ATXN1; (-) strand; PAM type: YTN; PAM sequence: CTA
cagatacttggtaacgtgga

SEQ ID NO: 158567 - DNA, 20 bp, Artificial Sequence
  Description of Artificial Sequence: Synthetic oligonucleotide
  Target: ATXN1; (-) strand; PAM type: YTN; PAM sequence: TTA
atgagtctacagatacttgg

SEQ ID NO: 158568 - DNA, 20 bp, Artificial Sequence
  Description of Artificial Sequence: Synthetic oligonucleotide
  Target: ATXN1; (-) strand; PAM type: YTN; PAM sequence: CTT
aatgagtctacagatacttg

SEQ ID NO: 158569 - DNA, 20 bp, Artificial Sequence
  Description of Artificial Sequence: Synthetic oligonucleotide
  Target: ATXN1; (-) strand; PAM type: YTN; PAM sequence: TTC
ttaatgagtctacagatact

SEQ ID NO: 158570 - DNA, 20 bp, Artificial Sequence
  Description of Artificial Sequence: Synthetic oligonucleotide
  Target: ATXN1; (-) strand; PAM type: YTN; PAM sequence: TTT
cttaatgagtctacagatac

SEQ ID NO: 158571 - DNA, 20 bp, Artificial Sequence
  Description of Artificial Sequence: Synthetic oligonucleotide
  Target: ATXN1; (-) strand; PAM type: YTN; PAM sequence: TTG
tagacatttcttaatgagtc

SEQ ID NO: 158572 - DNA, 20 bp, Artificial Sequence
  Description of Artificial Sequence: Synthetic oligonucleotide
  Target: ATXN1; (-) strand; PAM type: YTN; PAM sequence: CTT
gtagacatttcttaatgagt

SEQ ID NO: 158573 - DNA, 20 bp, Artificial Sequence
  Description of Artificial Sequence: Synthetic oligonucleotide
  Target: ATXN1; (-) strand; PAM type: YTN; PAM sequence: TTA
taaagggcttgtagacattt

SEQ ID NO: 158574 - DNA, 20 bp, Artificial Sequence
  Description of Artificial Sequence: Synthetic oligonucleotide
  Target: ATXN1; (-) strand; PAM type: YTN; PAM sequence: CTG
ttataaagggcttgtagaca

SEQ ID NO: 158575 - DNA, 20 bp, Artificial Sequence
  Description of Artificial Sequence: Synthetic oligonucleotide
  Target: ATXN1; (-) strand; PAM type: YTN; PAM sequence: TTA
tagtacctgttataaagggc

SEQ ID NO: 158576 - DNA, 20 bp, Artificial Sequence
  Description of Artificial Sequence: Synthetic oligonucleotide
  Target: ATXN1; (-) strand; PAM type: YTN; PAM sequence: CTA
atcaattatagtacctgtta

SEQ ID NO: 158577 - DNA, 20 bp, Artificial Sequence
  Description of Artificial Sequence: Synthetic oligonucleotide
  Target: ATXN1; (-) strand; PAM type: YTN; PAM sequence: TTG
cactaatcaattatagtacc

SEQ ID NO: 158578 - DNA, 20 bp, Artificial Sequence
  Description of Artificial Sequence: Synthetic oligonucleotide
  Target: ATXN1; (-) strand; PAM type: YTN; PAM sequence: TTT
gcactaatcaattatagtac

SEQ ID NO: 158579 - DNA, 20 bp, Artificial Sequence
  Description of Artificial Sequence: Synthetic oligonucleotide
  Target: ATXN1; (-) strand; PAM type: YTN; PAM sequence: TTT
tgcactaatcaattatagta

SEQ ID NO: 158580 - DNA, 20 bp, Artificial Sequence
  Description of Artificial Sequence: Synthetic oligonucleotide
  Target: ATXN1; (-) strand; PAM type: YTN; PAM sequence: CTT
ttgcactaatcaattatagt

SEQ ID NO: 158581 - DNA, 20 bp, Artificial Sequence
  Description of Artificial Sequence: Synthetic oligonucleotide
  Target: ATXN1; (-) strand; PAM type: YTN; PAM sequence: CTG
acttttgcactaatcaatta

SEQ ID NO: 158582 - DNA, 20 bp, Artificial Sequence
  Description of Artificial Sequence: Synthetic oligonucleotide
  Target: ATXN1; (-) strand; PAM type: YTN; PAM sequence: CTG
tatcctgacttttgcactaa

SEQ ID NO: 158583 - DNA, 20 bp, Artificial Sequence
  Description of Artificial Sequence: Synthetic oligonucleotide
  Target: ATXN1; (-) strand; PAM type: YTN; PAM sequence: TTA
gagggaaacacgtgtatctg

SEQ ID NO: 158584 - DNA, 20 bp, Artificial Sequence
  Description of Artificial Sequence: Synthetic oligonucleotide
  Target: ATXN1; (-) strand; PAM type: YTN; PAM sequence: TTT
agagggaaacacgtgtatct

SEQ ID NO: 158585 - DNA, 20 bp, Artificial Sequence
  Description of Artificial Sequence: Synthetic oligonucleotide
  Target: ATXN1; (-) strand; PAM type: YTN; PAM sequence: CTT
tagagggaaacacgtgtatc

SEQ ID NO: 158586 - DNA, 20 bp, Artificial Sequence
  Description of Artificial Sequence: Synthetic oligonucleotide
  Target: ATXN1; (-) strand; PAM type: YTN; PAM sequence: TTA
tgaagtctttagagggaaac

SEQ ID NO: 158587 - DNA, 20 bp, Artificial Sequence
  Description of Artificial Sequence: Synthetic oligonucleotide
  Target: ATXN1; (-) strand; PAM type: YTN; PAM sequence: TTC
aaaatgtccaataacattat

SEQ ID NO: 158588 - DNA, 20 bp, Artificial Sequence
  Description of Artificial Sequence: Synthetic oligonucleotide
  Target: ATXN1; (-) strand; PAM type: YTN; PAM sequence: TTT
caaaatgtccaataacatta

SEQ ID NO: 158589 - DNA, 20 bp, Artificial Sequence
  Description of Artificial Sequence: Synthetic oligonucleotide
  Target: ATXN1; (-) strand; PAM type: YTN; PAM sequence: CTT
tcaaaatgtccaataacatt

SEQ ID NO: 158590 - DNA, 20 bp, Artificial Sequence
  Description of Artificial Sequence: Synthetic oligonucleotide
  Target: ATXN1; (-) strand; PAM type: YTN; PAM sequence: TTG
agatgcggaaataatgaaag

SEQ ID NO: 158591 - DNA, 20 bp, Artificial Sequence
  Description of Artificial Sequence: Synthetic oligonucleotide
  Target: ATXN1; (-) strand; PAM type: YTN; PAM sequence: TTT
gagatgcggaaataatgaaa

SEQ ID NO: 158592 - DNA, 20 bp, Artificial Sequence
  Description of Artificial Sequence: Synthetic oligonucleotide
  Target: ATXN1; (-) strand; PAM type: YTN; PAM sequence: TTT
tgagatgcggaaataatgaa

SEQ ID NO: 158593 - DNA, 20 bp, Artificial Sequence
  Description of Artificial Sequence: Synthetic oligonucleotide
  Target: ATXN1; (-) strand; PAM type: YTN; PAM sequence: TTG
gagttttgagatgcggaaat

SEQ ID NO: 158594 - DNA, 20 bp, Artificial Sequence
  Description of Artificial Sequence: Synthetic oligonucleotide
  Target: ATXN1; (-) strand; PAM type: YTN; PAM sequence: TTT
ggagttttgagatgcggaaa

SEQ ID NO: 158595 - DNA, 20 bp, Artificial Sequence
  Description of Artificial Sequence: Synthetic oligonucleotide
  Target: ATXN1; (-) strand; PAM type: YTN; PAM sequence: CTT
tggagttttgagatgcggaa

SEQ ID NO: 158596 - DNA, 20 bp, Artificial Sequence
  Description of Artificial Sequence: Synthetic oligonucleotide
  Target: ATXN1; (-) strand; PAM type: YTN; PAM sequence: TTA
caagagtggtgtctttggag

SEQ ID NO: 158597 - DNA, 20 bp, Artificial Sequence
  Description of Artificial Sequence: Synthetic oligonucleotide
  Target: ATXN1; (-) strand; PAM type: YTN; PAM sequence: CTG
ggattacaagagtggtgtct

SEQ ID NO: 158598 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacaa

SEQ ID NO: 158599 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 158600 - DNA, 20 bp, Artificial Sequence
  Description of Artificial Sequence: Synthetic oligonucleotide
  Target: ATXN1; (-) strand; PAM type: YTN; PAM sequence: TTG
tacctcagcctcccaaagtg

SEQ ID NO: 158601 - DNA, 20 bp, Artificial Sequence
  Description of Artificial Sequence: Synthetic oligonucleotide
  Target: ATXN1; (-) strand; PAM type: YTN; PAM sequence: TTC
acaattgtacctcagcctcc

SEQ ID NO: 158602 - DNA, 20 bp, Artificial Sequence
  Description of Artificial Sequence: Synthetic oligonucleotide
  Target: ATXN1; (-) strand; PAM type: YTN; PAM sequence: TTT
cacaattgtacctcagcctc

SEQ ID NO: 158603 - DNA, 20 bp, Artificial Sequence
  Description of Artificial Sequence: Synthetic oligonucleotide
  Target: ATXN1; (-) strand; PAM type: YTN; PAM sequence: CTA
tttcacaattgtacctcagc

SEQ ID NO: 158604 - DNA, 20 bp, Artificial Sequence
  Description of Artificial Sequence: Synthetic oligonucleotide
  Target: ATXN1; (-) strand; PAM type: YTN; PAM sequence: TTG
ctatttcacaattgtacctc

SEQ ID NO: 158605 - DNA, 20 bp, Artificial Sequence
  Description of Artificial Sequence: Synthetic oligonucleotide
  Target: ATXN1; (-) strand; PAM type: YTN; PAM sequence: TTT
gctatttcacaattgtacct

SEQ ID NO: 158606 - DNA, 20 bp, Artificial Sequence
  Description of Artificial Sequence: Synthetic oligonucleotide
  Target: ATXN1; (-) strand; PAM type: YTN; PAM sequence: TTT
tgctatttcacaattgtacc

SEQ ID NO: 158607 - DNA, 20 bp, Artificial Sequence
  Description of Artificial Sequence: Synthetic oligonucleotide
  Target: ATXN1; (-) strand; PAM type: YTN; PAM sequence: CTT
ttgctatttcacaattgtac

SEQ ID NO: 158608 - DNA, 20 bp, Artificial Sequence
  Description of Artificial Sequence: Synthetic oligonucleotide
  Target: ATXN1; (-) strand; PAM type: YTN; PAM sequence: TTC
ttttgctatttcacaattgt

SEQ ID NO: 158609 - DNA, 20 bp, Artificial Sequence
  Description of Artificial Sequence: Synthetic oligonucleotide
  Target: ATXN1; (-) strand; PAM type: YTN; PAM sequence: TTC
gttcttttgctatttcacaa

SEQ ID NO: 158610 - DNA, 20 bp, Artificial Sequence
  Description of Artificial Sequence: Synthetic oligonucleotide
  Target: ATXN1; (-) strand; PAM type: YTN; PAM sequence: TTA
tgttcgttcttttgctattt

SEQ ID NO: 158611 - DNA, 20 bp, Artificial Sequence
  Description of Artificial Sequence: Synthetic oligonucleotide
  Target: ATXN1; (-) strand; PAM type: YTN; PAM sequence: TTA
gttatgttcgttcttttgct

SEQ ID NO: 158612 - DNA, 20 bp, Artificial Sequence
  Description of Artificial Sequence: Synthetic oligonucleotide
  Target: ATXN1; (-) strand; PAM type: YTN; PAM sequence: TTA
aacaaaaatggagttagtta

SEQ ID NO: 158613 - DNA, 20 bp, Artificial Sequence
  Description of Artificial Sequence: Synthetic oligonucleotide
  Target: ATXN1; (-) strand; PAM type: YTN; PAM sequence: TTT
aaacaaaaatggagttagtt

SEQ ID NO: 158614 - DNA, 20 bp, Artificial Sequence
  Description of Artificial Sequence: Synthetic oligonucleotide
  Target: ATXN1; (-) strand; PAM type: YTN; PAM sequence: CTT
taaacaaaaatggagttagt

SEQ ID NO: 158615 - DNA, 20 bp, Artificial Sequence
  Description of Artificial Sequence: Synthetic oligonucleotide
  Target: ATXN1; (-) strand; PAM type: YTN; PAM sequence: CTA
cgtgcaggaaagggtaaaac

SEQ ID NO: 158616 - DNA, 20 bp, Artificial Sequence
  Description of Artificial Sequence: Synthetic oligonucleotide
  Target: ATXN1; (-) strand; PAM type: YTN; PAM sequence: CTA
gcctacgtgcaggaaagggt

SEQ ID NO: 158617 - DNA, 20 bp, Artificial Sequence
  Description of Artificial Sequence: Synthetic oligonucleotide
  Target: ATXN1; (-) strand; PAM type: YTN; PAM sequence: TTA
tcctagcctacgtgcaggaa

SEQ ID NO: 158618 - DNA, 20 bp, Artificial Sequence
  Description of Artificial Sequence: Synthetic oligonucleotide
  Target: ATXN1; (-) strand; PAM type: YTN; PAM sequence: CTC
ggtgccataaaattatccta

SEQ ID NO: 158619 - DNA, 20 bp, Artificial Sequence
  Description of Artificial Sequence: Synthetic oligonucleotide
  Target: ATXN1; (-) strand; PAM type: YTN; PAM sequence: TTA
tctcggtgccataaaattat

SEQ ID NO: 158620 - DNA, 20 bp, Artificial Sequence
  Description of Artificial Sequence: Synthetic oligonucleotide
  Target: ATXN1; (-) strand; PAM type: YTN; PAM sequence: TTG
tgtatattatctcggtgcca

SEQ ID NO: 158621 - DNA, 20 bp, Artificial Sequence
  Description of Artificial Sequence: Synthetic oligonucleotide
  Target: ATXN1; (-) strand; PAM type: YTN; PAM sequence: TTT
gtgtatattatctcggtgcc

SEQ ID NO: 158622 - DNA, 20 bp, Artificial Sequence
  Description of Artificial Sequence: Synthetic oligonucleotide
  Target: ATXN1; (-) strand; PAM type: YTN; PAM sequence: TTG
tttgtgtatattatctcggt

SEQ ID NO: 158623 - DNA, 20 bp, Artificial Sequence
  Description of Artificial Sequence: Synthetic oligonucleotide
  Target: ATXN1; (-) strand; PAM type: YTN; PAM sequence: TTG
ttgtttgtgtatattatctc

SEQ ID NO: 158624 - DNA, 20 bp, Artificial Sequence
  Description of Artificial Sequence: Synthetic oligonucleotide
  Target: ATXN1; (-) strand; PAM type: YTN; PAM sequence: CTA
aaagtacatgattgttgttt

SEQ ID NO: 158625 - DNA, 20 bp, Artificial Sequence
  Description of Artificial Sequence: Synthetic oligonucleotide
  Target: ATXN1; (-) strand; PAM type: YTN; PAM sequence: TTC
taaaagtacatgattgttgt

SEQ ID NO: 158626 - DNA, 20 bp, Artificial Sequence
  Description of Artificial Sequence: Synthetic oligonucleotide
  Target: ATXN1; (-) strand; PAM type: YTN; PAM sequence: TTT
ctaaaagtacatgattgttg

SEQ ID NO: 158627 - DNA, 20 bp, Artificial Sequence
  Description of Artificial Sequence: Synthetic oligonucleotide
  Target: ATXN1; (-) strand; PAM type: YTN; PAM sequence: TTA
gtttctaaaagtacatgatt

SEQ ID NO: 158628 - DNA, 20 bp, Artificial Sequence
  Description of Artificial Sequence: Synthetic oligonucleotide
  Target: ATXN1; (-) strand; PAM type: YTN; PAM sequence: TTA
atcccagagttagtttctaa

SEQ ID NO: 158629 - DNA, 20 bp, Artificial Sequence
  Description of Artificial Sequence: Synthetic oligonucleotide
  Target: ATXN1; (-) strand; PAM type: YTN; PAM sequence: TTT
aatcccagagttagtttcta

SEQ ID NO: 158630 - DNA, 20 bp, Artificial Sequence
  Description of Artificial Sequence: Synthetic oligonucleotide
  Target: ATXN1; (-) strand; PAM type: YTN; PAM sequence: CTT
taatcccagagttagtttct

SEQ ID NO: 158631 - DNA, 20 bp, Artificial Sequence
  Description of Artificial Sequence: Synthetic oligonucleotide
  Target: ATXN1; (-) strand; PAM type: YTN; PAM sequence: TTC
ccctttaatcccagagttag

SEQ ID NO: 158632 - DNA, 20 bp, Artificial Sequence
  Description of Artificial Sequence: Synthetic oligonucleotide
  Target: ATXN1; (-) strand; PAM type: YTN; PAM sequence: CTT
cccctttaatcccagagtta

SEQ ID NO: 158633 - DNA, 20 bp, Artificial Sequence
  Description of Artificial Sequence: Synthetic oligonucleotide
  Target: ATXN1; (-) strand; PAM type: YTN; PAM sequence: TTA
tatacttcccctttaatccc

SEQ ID NO: 158634 - DNA, 20 bp, Artificial Sequence
  Description of Artificial Sequence: Synthetic oligonucleotide
  Target: ATXN1; (-) strand; PAM type: YTN; PAM sequence: TTT
atatacttcccctttaatcc

SEQ ID NO: 158635 - DNA, 20 bp, Artificial Sequence
  Description of Artificial Sequence: Synthetic oligonucleotide
  Target: ATXN1; (-) strand; PAM type: YTN; PAM sequence: TTG
tttatatacttcccctttaa

SEQ ID NO: 158636 - DNA, 20 bp, Artificial Sequence
  Description of Artificial Sequence: Synthetic oligonucleotide
  Target: ATXN1; (-) strand; PAM type: YTN; PAM sequence: TTA
gttgtttatatacttcccct

SEQ ID NO: 158637 - DNA, 20 bp, Artificial Sequence
  Description of Artificial Sequence: Synthetic oligonucleotide
  Target: ATXN1; (-) strand; PAM type: YTN; PAM sequence: TTA
acaatatatagttagttgtt

SEQ ID NO: 158638 - DNA, 20 bp, Artificial Sequence
  Description of Artificial Sequence: Synthetic oligonucleotide
  Target: ATXN1; (-) strand; PAM type: YTN; PAM sequence: TTT
aacaatatatagttagttgt

SEQ ID NO: 158639 - DNA, 20 bp, Artificial Sequence
  Description of Artificial Sequence: Synthetic oligonucleotide
  Target: ATXN1; (-) strand; PAM type: YTN; PAM sequence: CTT
taacaatatatagttagttg

SEQ ID NO: 158640 - DNA, 20 bp, Artificial Sequence
  Description of Artificial Sequence: Synthetic oligonucleotide
  Target: ATXN1; (-) strand; PAM type: YTN; PAM sequence: CTA
tcagtctttaacaatatata

SEQ ID NO: 158641 - DNA, 20 bp, Artificial Sequence
  Description of Artificial Sequence: Synthetic oligonucleotide
  Target: ATXN1; (-) strand; PAM type: YTN; PAM sequence: CTC
ctatcagtctttaacaatat

SEQ ID NO: 158642 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccgtgcc

SEQ ID NO: 158643 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 158644 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 158645 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 158646 - DNA, 20 bp, Artificial Sequence
  Description of Artificial Sequence: Synthetic oligonucleotide
  Target: ATXN1; (-) strand; PAM type: YTN; PAM sequence: CTC
aggtgatccgcccgcctcgg

SEQ ID NO: 158647 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatccgcccgc

SEQ ID NO: 158648 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgatccgcc

SEQ ID NO: 158649 - DNA, 20 bp, Artificial Sequence
  Description of Artificial Sequence: Synthetic oligonucleotide
  Target: ATXN1; (-) strand; PAM type: YTN; PAM sequence: CTA
actcctgacctcaggtgatc

SEQ ID NO: 158650 - DNA, 20 bp, Artificial Sequence
  Description of Artificial Sequence: Synthetic oligonucleotide
  Target: ATXN1; (-) strand; PAM type: YTN; PAM sequence: CTC
taactcctgacctcaggtga

SEQ ID NO: 158651 - DNA, 20 bp, Artificial Sequence
  Description of Artificial Sequence: Synthetic oligonucleotide
  Target: ATXN1; (-) strand; PAM type: YTN; PAM sequence: CTG
gtctctaactcctgacctca

SEQ ID NO: 158652 - DNA, 20 bp, Artificial Sequence
  Description of Artificial Sequence: Synthetic oligonucleotide
  Target: ATXN1; (-) strand; PAM type: YTN; PAM sequence: TTG
gccagactggtctctaactc

SEQ ID NO: 158653 - DNA, 20 bp, Artificial Sequence
  Description of Artificial Sequence: Synthetic oligonucleotide
  Target: ATXN1; (-) strand; PAM type: YTN; PAM sequence: TTC
accatattggccagactggt

SEQ ID NO: 158654 - DNA, 20 bp, Artificial Sequence
  Description of Artificial Sequence: Synthetic oligonucleotide
  Target: ATXN1; (-) strand; PAM type: YTN; PAM sequence: TTT
caccatattggccagactgg

SEQ ID NO: 158655 - DNA, 20 bp, Artificial Sequence
  Description of Artificial Sequence: Synthetic oligonucleotide
  Target: ATXN1; (-) strand; PAM type: YTN; PAM sequence: TTA
atagagggtttcaccatatt

SEQ ID NO: 158656 - DNA, 20 bp, Artificial Sequence
  Description of Artificial Sequence: Synthetic oligonucleotide
  Target: ATXN1; (-) strand; PAM type: YTN; PAM sequence: TTT
aatagagggtttcaccatat

SEQ ID NO: 158657 - DNA, 20 bp, Artificial Sequence
  Description of Artificial Sequence: Synthetic oligonucleotide
  Target: ATXN1; (-) strand; PAM type: YTN; PAM sequence: TTT
taatagagggtttcaccata

SEQ ID NO: 158658 - DNA, 20 bp, Artificial Sequence
  Description of Artificial Sequence: Synthetic oligonucleotide
  Target: ATXN1; (-) strand; PAM type: YTN; PAM sequence: TTT
ttaatagagggtttcaccat

SEQ ID NO: 158659 - DNA, 20 bp, Artificial Sequence
  Description of Artificial Sequence: Synthetic oligonucleotide
  Target: ATXN1; (-) strand; PAM type: YTN; PAM sequence: TTA
gtatttttaatagagggttt

SEQ ID NO: 158660 - DNA, 20 bp, Artificial Sequence
  Description of Artificial Sequence: Synthetic oligonucleotide
  Target: ATXN1; (-) strand; PAM type: YTN; PAM sequence: TTT
agtatttttaatagagggtt

SEQ ID NO: 158661 - DNA, 20 bp, Artificial Sequence
  Description of Artificial Sequence: Synthetic oligonucleotide
  Target: ATXN1; (-) strand; PAM type: YTN; PAM sequence: CTT
tagtatttttaatagagggt

SEQ ID NO: 158662 - DNA, 20 bp, Artificial Sequence
  Description of Artificial Sequence: Synthetic oligonucleotide
  Target: ATXN1; (-) strand; PAM type: YTN; PAM sequence: TTC
agtctttagtatttttaata

SEQ ID NO: 158663 - DNA, 20 bp, Artificial Sequence
  Description of Artificial Sequence: Synthetic oligonucleotide
  Target: ATXN1; (-) strand; PAM type: YTN; PAM sequence: CTT
cagtctttagtatttttaat

SEQ ID NO: 158664 - DNA, 20 bp, Artificial Sequence
  Description of Artificial Sequence: Synthetic oligonucleotide
  Target: ATXN1; (-) strand; PAM type: YTN; PAM sequence: CTC
cttcagtctttagtattttt

SEQ ID NO: 158665 - DNA, 20 bp, Artificial Sequence
  Description of Artificial Sequence: Synthetic oligonucleotide
  Target: ATXN1; (-) strand; PAM type: YTN; PAM sequence: TTG
gtcaggtcataatgctcctt

SEQ ID NO: 158666 - DNA, 20 bp, Artificial Sequence
  Description of Artificial Sequence: Synthetic oligonucleotide
  Target: ATXN1; (-) strand; PAM type: YTN; PAM sequence: CTT
ggtcaggtcataatgctcct

SEQ ID NO: 158667 - DNA, 20 bp, Artificial Sequence
  Description of Artificial Sequence: Synthetic oligonucleotide
  Target: ATXN1; (-) strand; PAM type: YTN; PAM sequence: TTG
tccttggtcaggtcataatg

SEQ ID NO: 158668 - DNA, 20 bp, Artificial Sequence
  Description of Artificial Sequence: Synthetic oligonucleotide
  Target: ATXN1; (-) strand; PAM type: YTN; PAM sequence: TTT
gtccttggtcaggtcataat

SEQ ID NO: 158669 - DNA, 20 bp, Artificial Sequence
  Description of Artificial Sequence: Synthetic oligonucleotide
  Target: ATXN1; (-) strand; PAM type: YTN; PAM sequence: CTT
tgtccttggtcaggtcataa

SEQ ID NO: 158670 - DNA, 20 bp, Artificial Sequence
  Description of Artificial Sequence: Synthetic oligonucleotide
  Target: ATXN1; (-) strand; PAM type: YTN; PAM sequence: TTC
tttgtccttggtcaggtcat

SEQ ID NO: 158671 - DNA, 20 bp, Artificial Sequence
  Description of Artificial Sequence: Synthetic oligonucleotide
  Target: ATXN1; (-) strand; PAM type: YTN; PAM sequence: CTT
ctttgtccttggtcaggtca

SEQ ID NO: 158672 - DNA, 20 bp, Artificial Sequence
  Description of Artificial Sequence: Synthetic oligonucleotide
  Target: ATXN1; (-) strand; PAM type: YTN; PAM sequence: TTG
agaacttctttgtccttggt

SEQ ID NO: 158673 - DNA, 20 bp, Artificial Sequence
  Description of Artificial Sequence: Synthetic oligonucleotide
  Target: ATXN1; (-) strand; PAM type: YTN; PAM sequence: TTC
aagaaggttgagaacttctt

SEQ ID NO: 158674 - DNA, 20 bp, Artificial Sequence
  Description of Artificial Sequence: Synthetic oligonucleotide
  Target: ATXN1; (-) strand; PAM type: YTN; PAM sequence: TTG
ggcaccagtgagggttcaag

SEQ ID NO: 158675 - DNA, 20 bp, Artificial Sequence
  Description of Artificial Sequence: Synthetic oligonucleotide
  Target: ATXN1; (-) strand; PAM type: YTN; PAM sequence: TTT
gggcaccagtgagggttcaa

SEQ ID NO: 158676 - DNA, 20 bp, Artificial Sequence
  Description of Artificial Sequence: Synthetic oligonucleotide
  Target: ATXN1; (-) strand; PAM type: YTN; PAM sequence: CTG
aggaccatagacatttgggc

SEQ ID NO: 158677 - DNA, 20 bp, Artificial Sequence
  Description of Artificial Sequence: Synthetic oligonucleotide
  Target: ATXN1; (-) strand; PAM type: YTN; PAM sequence: TTA
gtatcgaggagactgaggac

SEQ ID NO: 158678 - DNA, 20 bp, Artificial Sequence
  Description of Artificial Sequence: Synthetic oligonucleotide
  Target: ATXN1; (-) strand; PAM type: YTN; PAM sequence: TTA
tgggaggggggtatgggggg

SEQ ID NO: 158679 - DNA, 20 bp, Artificial Sequence
  Description of Artificial Sequence: Synthetic oligonucleotide
  Target: ATXN1; (-) strand; PAM type: YTN; PAM sequence: TTT
atgggaggggggtatggggg

SEQ ID NO: 158680 - DNA, 20 bp, Artificial Sequence
  Description of Artificial Sequence: Synthetic oligonucleotide
  Target: ATXN1; (-) strand; PAM type: YTN; PAM sequence: TTT
tatgggaggggggtatgggg

SEQ ID NO: 158681 - DNA, 20 bp, Artificial Sequence
  Description of Artificial Sequence: Synthetic oligonucleotide
  Target: ATXN1; (-) strand; PAM type: YTN; PAM sequence: TTT
ttatgggaggggggtatggg

SEQ ID NO: 158682 - DNA, 20 bp, Artificial Sequence
  Description of Artificial Sequence: Synthetic oligonucleotide
  Target: ATXN1; (-) strand; PAM type: YTN; PAM sequence: TTG
gagggtttttatgggagggg

SEQ ID NO: 158683 - DNA, 20 bp, Artificial Sequence
  Description of Artificial Sequence: Synthetic oligonucleotide
  Target: ATXN1; (-) strand; PAM type: YTN; PAM sequence: CTG
gttggagggtttttatggga

SEQ ID NO: 158684 - DNA, 20 bp, Artificial Sequence
  Description of Artificial Sequence: Synthetic oligonucleotide
  Target: ATXN1; (-) strand; PAM type: YTN; PAM sequence: TTA
ggctggttggagggttttta

SEQ ID NO: 158685 - DNA, 20 bp, Artificial Sequence
  Description of Artificial Sequence: Synthetic oligonucleotide
  Target: ATXN1; (-) strand; PAM type: YTN; PAM sequence: TTT
aggctggttggagggttttt

SEQ ID NO: 158686 - DNA, 20 bp, Artificial Sequence
  Description of Artificial Sequence: Synthetic oligonucleotide
  Target: ATXN1; (-) strand; PAM type: YTN; PAM sequence: TTT
taggctggttggagggtttt

SEQ ID NO: 158687 - DNA, 20 bp, Artificial Sequence
  Description of Artificial Sequence: Synthetic oligonucleotide
  Target: ATXN1; (-) strand; PAM type: YTN; PAM sequence: TTT
ttaggctggttggagggttt

SEQ ID NO: 158688 - DNA, 20 bp, Artificial Sequence
  Description of Artificial Sequence: Synthetic oligonucleotide
  Target: ATXN1; (-) strand; PAM type: YTN; PAM sequence: TTT
tttaggctggttggagggtt

SEQ ID NO: 158689 - DNA, 20 bp, Artificial Sequence
  Description of Artificial Sequence: Synthetic oligonucleotide
  Target: ATXN1; (-) strand; PAM type: YTN; PAM sequence: CTC
caattttttaggctggttgg

SEQ ID NO: 158690 - DNA, 20 bp, Artificial Sequence
  Description of Artificial Sequence: Synthetic oligonucleotide
  Target: ATXN1; (-) strand; PAM type: YTN; PAM sequence: TTA
agtaaaatctccaatttttt

SEQ ID NO: 158691 - DNA, 20 bp, Artificial Sequence
  Description of Artificial Sequence: Synthetic oligonucleotide
  Target: ATXN1; (-) strand; PAM type: YTN; PAM sequence: TTG
taaaaattaagtaaaatctc

SEQ ID NO: 158692 - DNA, 20 bp, Artificial Sequence
  Description of Artificial Sequence: Synthetic oligonucleotide
  Target: ATXN1; (-) strand; PAM type: YTN; PAM sequence: TTT
gtaaaaattaagtaaaatct

SEQ ID NO: 158693 - DNA, 20 bp, Artificial Sequence
  Description of Artificial Sequence: Synthetic oligonucleotide
  Target: ATXN1; (-) strand; PAM type: YTN; PAM sequence: TTT
tgtaaaaattaagtaaaatc

SEQ ID NO: 158694 - DNA, 20 bp, Artificial Sequence
  Description of Artificial Sequence: Synthetic oligonucleotide
  Target: ATXN1; (-) strand; PAM type: YTN; PAM sequence: CTC
aagaaataataattttgtaa

SEQ ID NO: 158695 - DNA, 20 bp, Artificial Sequence
  Description of Artificial Sequence: Synthetic oligonucleotide
  Target: ATXN1; (-) strand; PAM type: YTN; PAM sequence: CTG
ggcaacagagaatccatctc

SEQ ID NO: 158696 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcaacagagaat

SEQ ID NO: 158697 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggcaacag

SEQ ID NO: 158698 - DNA, 20 bp, Artificial Sequence
  Description of Artificial Sequence: Synthetic oligonucleotide
  Target: ATXN1; (-) strand; PAM type: YTN; PAM sequence: TTG
taccactgcactccagcctg

SEQ ID NO: 158699 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagattgtacc

SEQ ID NO: 158700 - DNA, 20 bp, Artificial Sequence
  Description of Artificial Sequence: Synthetic oligonucleotide
  Target: ATXN1; (-) strand; PAM type: YTN; PAM sequence: CTA
ggaagcagaggttgcagtga

SEQ ID NO: 158701 - DNA, 20 bp, Artificial Sequence
  Description of Artificial Sequence: Synthetic oligonucleotide
  Target: ATXN1; (-) strand; PAM type: YTN; PAM sequence: TTG
aacctaggaagcagaggttg

SEQ ID NO: 158702 - DNA, 20 bp, Artificial Sequence
  Description of Artificial Sequence: Synthetic oligonucleotide
  Target: ATXN1; (-) strand; PAM type: YTN; PAM sequence: CTT
gaacctaggaagcagaggtt

SEQ ID NO: 158703 - DNA, 20 bp, Artificial Sequence
  Description of Artificial Sequence: Synthetic oligonucleotide
  Target: ATXN1; (-) strand; PAM type: YTN; PAM sequence: CTG
agacaggagaatagcttgaa

SEQ ID NO: 158704 - DNA, 20 bp, Artificial Sequence
  Description of Artificial Sequence: Synthetic oligonucleotide
  Target: ATXN1; (-) strand; PAM type: YTN; PAM sequence: CTC
aggaggctgagacaggagaa

SEQ ID NO: 158705 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgagacagga

SEQ ID NO: 158706 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctactcaggag

SEQ ID NO: 158707 - DNA, 20 bp, Artificial Sequence
  Description of Artificial Sequence: Synthetic oligonucleotide
  Target: ATXN1; (-) strand; PAM type: YTN; PAM sequence: TTA
gccaggtgtggtggcacatg

SEQ ID NO: 158708 - DNA, 20 bp, Artificial Sequence
  Description of Artificial Sequence: Synthetic oligonucleotide
  Target: ATXN1; (-) strand; PAM type: YTN; PAM sequence: CTA
aaaaatacaaaaattagcca

SEQ ID NO: 158709 - DNA, 20 bp, Artificial Sequence
  Description of Artificial Sequence: Synthetic oligonucleotide
  Target: ATXN1; (-) strand; PAM type: YTN; PAM sequence: CTA
ctaaaaaatacaaaaattag

SEQ ID NO: 158710 - DNA, 20 bp, Artificial Sequence
  Description of Artificial Sequence: Synthetic oligonucleotide
  Target: ATXN1; (-) strand; PAM type: YTN; PAM sequence: CTC
tactaaaaaatacaaaaatt

SEQ ID NO: 158711 - DNA, 20 bp, Artificial Sequence
  Description of Artificial Sequence: Synthetic oligonucleotide
  Target: ATXN1; (-) strand; PAM type: YTN; PAM sequence: CTG
acccacaatggccaaacacc

SEQ ID NO: 158712 - DNA, 20 bp, Artificial Sequence
  Description of Artificial Sequence: Synthetic oligonucleotide
  Target: ATXN1; (-) strand; PAM type: YTN; PAM sequence: TTG
agaccagcctgacccacaat

SEQ ID NO: 158713 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctgacccacaa

SEQ ID NO: 158714 - DNA, 20 bp, Artificial Sequence
  Description of Artificial Sequence: Synthetic oligonucleotide
  Target: ATXN1; (-) strand; PAM type: YTN; PAM sequence: CTA
aggtcaggagtttgagacca

SEQ ID NO: 158715 - DNA, 20 bp, Artificial Sequence
  Description of Artificial Sequence: Synthetic oligonucleotide
  Target: ATXN1; (-) strand; PAM type: YTN; PAM sequence: TTG
ggatgccaaggcaggcggat

SEQ ID NO: 158716 - DNA, 20 bp, Artificial Sequence
  Description of Artificial Sequence: Synthetic oligonucleotide
  Target: ATXN1; (-) strand; PAM type: YTN; PAM sequence: TTT
gggatgccaaggcaggcgga

SEQ ID NO: 158717 - DNA, 20 bp, Artificial Sequence
  Description of Artificial Sequence: Synthetic oligonucleotide
  Target: ATXN1; (-) strand; PAM type: YTN; PAM sequence: CTT
tgggatgccaaggcaggcgg

SEQ ID NO: 158718 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggat

SEQ ID NO: 158719 - DNA, 20 bp, Artificial Sequence
  Description of Artificial Sequence: Synthetic oligonucleotide
  Target: ATXN1; (-) strand; PAM type: YTN; PAM sequence: CTC
acatctgtaatcccagcact

SEQ ID NO: 158720 - DNA, 20 bp, Artificial Sequence
  Description of Artificial Sequence: Synthetic oligonucleotide
  Target: ATXN1; (-) strand; PAM type: YTN; PAM sequence: CTC
caggccaggcatggtagctc

SEQ ID NO: 158721 - DNA, 20 bp, Artificial Sequence
  Description of Artificial Sequence: Synthetic oligonucleotide
  Target: ATXN1; (-) strand; PAM type: YTN; PAM sequence: CTA
aagtaccatctccaggccag

SEQ ID NO: 158722 - DNA, 20 bp, Artificial Sequence
  Description of Artificial Sequence: Synthetic oligonucleotide
  Target: ATXN1; (-) strand; PAM type: YTN; PAM sequence: TTC
taaagtaccatctccaggcc

SEQ ID NO: 158723 - DNA, 20 bp, Artificial Sequence
  Description of Artificial Sequence: Synthetic oligonucleotide
  Target: ATXN1; (-) strand; PAM type: YTN; PAM sequence: CTT
ctaaagtaccatctccaggc

SEQ ID NO: 158724 - DNA, 20 bp, Artificial Sequence
  Description of Artificial Sequence: Synthetic oligonucleotide
  Target: ATXN1; (-) strand; PAM type: YTN; PAM sequence: CTA
gccttctaaagtaccatctc

SEQ ID NO: 158725 - DNA, 20 bp, Artificial Sequence
  Description of Artificial Sequence: Synthetic oligonucleotide
  Target: ATXN1; (-) strand; PAM type: YTN; PAM sequence: TTG
agaagatgatgagctagcct

SEQ ID NO: 158726 - DNA, 20 bp, Artificial Sequence
  Description of Artificial Sequence: Synthetic oligonucleotide
  Target: ATXN1; (-) strand; PAM type: YTN; PAM sequence: TTG
ggaaagccagagaaattgag

SEQ ID NO: 158727 - DNA, 20 bp, Artificial Sequence
  Description of Artificial Sequence: Synthetic oligonucleotide
  Target: ATXN1; (-) strand; PAM type: YTN; PAM sequence: TTA
ttgggaaagccagagaaatt

SEQ ID NO: 158728 - DNA, 20 bp, Artificial Sequence
  Description of Artificial Sequence: Synthetic oligonucleotide
  Target: ATXN1; (-) strand; PAM type: YTN; PAM sequence: TTT
attgggaaagccagagaaat

SEQ ID NO: 158729 - DNA, 20 bp, Artificial Sequence
  Description of Artificial Sequence: Synthetic oligonucleotide
  Target: ATXN1; (-) strand; PAM type: YTN; PAM sequence: TTG
gtgagaggaaaagcaggttt

SEQ ID NO: 158730 - DNA, 20 bp, Artificial Sequence
  Description of Artificial Sequence: Synthetic oligonucleotide
  Target: ATXN1; (-) strand; PAM type: YTN; PAM sequence: CTC
aaaagccaaatacgagagat

SEQ ID NO: 158731 - DNA, 20 bp, Artificial Sequence
  Description of Artificial Sequence: Synthetic oligonucleotide
  Target: ATXN1; (-) strand; PAM type: YTN; PAM sequence: CTC
accactcaaaagccaaatac

SEQ ID NO: 158732 - DNA, 20 bp, Artificial Sequence
  Description of Artificial Sequence: Synthetic oligonucleotide
  Target: ATXN1; (-) strand; PAM type: YTN; PAM sequence: CTG
ctcaccactcaaaagccaaa

SEQ ID NO: 158733 - DNA, 20 bp, Artificial Sequence
  Description of Artificial Sequence: Synthetic oligonucleotide
  Target: ATXN1; (-) strand; PAM type: YTN; PAM sequence: TTG
gctgctcaccactcaaaagc

SEQ ID NO: 158734 - DNA, 20 bp, Artificial Sequence
  Description of Artificial Sequence: Synthetic oligonucleotide
  Target: ATXN1; (-) strand; PAM type: YTN; PAM sequence: TTT
ggctgctcaccactcaaaag

SEQ ID NO: 158735 - DNA, 20 bp, Artificial Sequence
  Description of Artificial Sequence: Synthetic oligonucleotide
  Target: ATXN1; (-) strand; PAM type: YTN; PAM sequence: TTA
ggtttggctgctcaccactc

SEQ ID NO: 158736 - DNA, 20 bp, Artificial Sequence
  Description of Artificial Sequence: Synthetic oligonucleotide
  Target: ATXN1; (-) strand; PAM type: YTN; PAM sequence: CTT
aggtttggctgctcaccact

SEQ ID NO: 158737 - DNA, 20 bp, Artificial Sequence
  Description of Artificial Sequence: Synthetic oligonucleotide
  Target: ATXN1; (-) strand; PAM type: YTN; PAM sequence: CTG
aacttaggtttggctgctca

SEQ ID NO: 158738 - DNA, 20 bp, Artificial Sequence
  Description of Artificial Sequence: Synthetic oligonucleotide
  Target: ATXN1; (-) strand; PAM type: YTN; PAM sequence: CTG
taactgaacttaggtttggc

SEQ ID NO: 158739 - DNA, 20 bp, Artificial Sequence
  Description of Artificial Sequence: Synthetic oligonucleotide
  Target: ATXN1; (-) strand; PAM type: YTN; PAM sequence: CTC
tgtaactgaacttaggtttg

SEQ ID NO: 158740 - DNA, 20 bp, Artificial Sequence
  Description of Artificial Sequence: Synthetic oligonucleotide
  Target: ATXN1; (-) strand; PAM type: YTN; PAM sequence: CTC
gcacctctgtaactgaactt

SEQ ID NO: 158741 - DNA, 20 bp, Artificial Sequence
  Description of Artificial Sequence: Synthetic oligonucleotide
  Target: ATXN1; (-) strand; PAM type: YTN; PAM sequence: CTC
gagtgaccctcgcacctctg

SEQ ID NO: 158742 - DNA, 20 bp, Artificial Sequence
  Description of Artificial Sequence: Synthetic oligonucleotide
  Target: ATXN1; (-) strand; PAM type: YTN; PAM sequence: CTG
gagtggtgcagtagctcgag

SEQ ID NO: 158743 - DNA, 20 bp, Artificial Sequence
  Description of Artificial Sequence: Synthetic oligonucleotide
  Target: ATXN1; (-) strand; PAM type: YTN; PAM sequence: CTG
gcacacaggctggagtggtg

SEQ ID NO: 158744 - DNA, 20 bp, Artificial Sequence
  Description of Artificial Sequence: Synthetic oligonucleotide
  Target: ATXN1; (-) strand; PAM type: YTN; PAM sequence: CTC
tggcacacaggctggagtgg

SEQ ID NO: 158745 - DNA, 20 bp, Artificial Sequence
  Description of Artificial Sequence: Synthetic oligonucleotide
  Target: ATXN1; (-) strand; PAM type: YTN; PAM sequence: TTG
ctctggcacacaggctggag

SEQ ID NO: 158746 - DNA, 20 bp, Artificial Sequence
  Description of Artificial Sequence: Synthetic oligonucleotide
  Target: ATXN1; (-) strand; PAM type: YTN; PAM sequence: CTT
gctctggcacacaggctgga

SEQ ID NO: 158747 - DNA, 20 bp, Artificial Sequence
  Description of Artificial Sequence: Synthetic oligonucleotide
  Target: ATXN1; (-) strand; PAM type: YTN; PAM sequence: TTA
gagacagagtcttgctctgg

SEQ ID NO: 158748 - DNA, 20 bp, Artificial Sequence
  Description of Artificial Sequence: Synthetic oligonucleotide
  Target: ATXN1; (-) strand; PAM type: YTN; PAM sequence: TTT
agagacagagtcttgctctg

SEQ ID NO: 158749 - DNA, 20 bp, Artificial Sequence
  Description of Artificial Sequence: Synthetic oligonucleotide
  Target: ATXN1; (-) strand; PAM type: YTN; PAM sequence: TTT
tagagacagagtcttgctct

SEQ ID NO: 158750 - DNA, 20 bp, Artificial Sequence
  Description of Artificial Sequence: Synthetic oligonucleotide
  Target: ATXN1; (-) strand; PAM type: YTN; PAM sequence: TTT
ttagagacagagtcttgctc

SEQ ID NO: 158751 - DNA, 20 bp, Artificial Sequence
  Description of Artificial Sequence: Synthetic oligonucleotide
  Target: ATXN1; (-) strand; PAM type: YTN; PAM sequence: TTG
gtttttagagacagagtctt

SEQ ID NO: 158752 - DNA, 20 bp, Artificial Sequence
  Description of Artificial Sequence: Synthetic oligonucleotide
  Target: ATXN1; (-) strand; PAM type: YTN; PAM sequence: TTT
ggtttttagagacagagtct

SEQ ID NO: 158753 - DNA, 20 bp, Artificial Sequence
  Description of Artificial Sequence: Synthetic oligonucleotide
  Target: ATXN1; (-) strand; PAM type: YTN; PAM sequence: TTG
gtttggtttttagagacaga

SEQ ID NO: 158754 - DNA, 20 bp, Artificial Sequence
  Description of Artificial Sequence: Synthetic oligonucleotide
  Target: ATXN1; (-) strand; PAM type: YTN; PAM sequence: TTT
ggtttggtttttagagacag

SEQ ID NO: 158755 - DNA, 20 bp, Artificial Sequence
  Description of Artificial Sequence: Synthetic oligonucleotide
  Target: ATXN1; (-) strand; PAM type: YTN; PAM sequence: TTG
gtttggtttggtttttagag

SEQ ID NO: 158756 - DNA, 20 bp, Artificial Sequence
  Description of Artificial Sequence: Synthetic oligonucleotide
  Target: ATXN1; (-) strand; PAM type: YTN; PAM sequence: TTT
ggtttggtttggtttttaga

SEQ ID NO: 158757 - DNA, 20 bp, Artificial Sequence
  Description of Artificial Sequence: Synthetic oligonucleotide
  Target: ATXN1; (-) strand; PAM type: YTN; PAM sequence: TTG
gtttggtttggtttggtttt

SEQ ID NO: 158758 - DNA, 20 bp, Artificial Sequence
  Description of Artificial Sequence: Synthetic oligonucleotide
  Target: ATXN1; (-) strand; PAM type: YTN; PAM sequence: TTT
ggtttggtttggtttggttt

SEQ ID NO: 158759 - DNA, 20 bp, Artificial Sequence
  Description of Artificial Sequence: Synthetic oligonucleotide
  Target: ATXN1; (-) strand; PAM type: YTN; PAM sequence: TTG
gagtttggtttggtttggtt

SEQ ID NO: 158760 - DNA, 20 bp, Artificial Sequence
  Description of Artificial Sequence: Synthetic oligonucleotide
  Target: ATXN1; (-) strand; PAM type: YTN; PAM sequence: TTT
ggagtttggtttggtttggt

SEQ ID NO: 158761 - DNA, 20 bp, Artificial Sequence
  Description of Artificial Sequence: Synthetic oligonucleotide
  Target: ATXN1; (-) strand; PAM type: YTN; PAM sequence: TTG
gagatttggagtttggtttg

SEQ ID NO: 158762 - DNA, 20 bp, Artificial Sequence
  Description of Artificial Sequence: Synthetic oligonucleotide
  Target: ATXN1; (-) strand; PAM type: YTN; PAM sequence: TTT
ggagatttggagtttggttt

SEQ ID NO: 158763 - DNA, 20 bp, Artificial Sequence
  Description of Artificial Sequence: Synthetic oligonucleotide
  Target: ATXN1; (-) strand; PAM type: YTN; PAM sequence: CTT
tggagatttggagtttggtt

SEQ ID NO: 158764 - DNA, 20 bp, Artificial Sequence
  Description of Artificial Sequence: Synthetic oligonucleotide
  Target: ATXN1; (-) strand; PAM type: YTN; PAM sequence: CTG
tctttggagatttggagttt

SEQ ID NO: 158765 - DNA, 20 bp, Artificial Sequence
  Description of Artificial Sequence: Synthetic oligonucleotide
  Target: ATXN1; (-) strand; PAM type: YTN; PAM sequence: CTA
aggcctgtctttggagattt

SEQ ID NO: 158766 - DNA, 20 bp, Artificial Sequence
  Description of Artificial Sequence: Synthetic oligonucleotide
  Target: ATXN1; (-) strand; PAM type: YTN; PAM sequence: TTC
taaggcctgtctttggagat

SEQ ID NO: 158767 - DNA, 20 bp, Artificial Sequence
  Description of Artificial Sequence: Synthetic oligonucleotide
  Target: ATXN1; (-) strand; PAM type: YTN; PAM sequence: TTA
attctaaggcctgtctttgg

SEQ ID NO: 158768 - DNA, 20 bp, Artificial Sequence
  Description of Artificial Sequence: Synthetic oligonucleotide
  Target: ATXN1; (-) strand; PAM type: YTN; PAM sequence: TTT
aattctaaggcctgtctttg

SEQ ID NO: 158769 - DNA, 20 bp, Artificial Sequence
  Description of Artificial Sequence: Synthetic oligonucleotide
  Target: ATXN1; (-) strand; PAM type: YTN; PAM sequence: TTC
acaccacagcatttaattct

SEQ ID NO: 158770 - DNA, 20 bp, Artificial Sequence
  Description of Artificial Sequence: Synthetic oligonucleotide
  Target: ATXN1; (-) strand; PAM type: YTN; PAM sequence: CTA
tggttcacaccacagcattt

SEQ ID NO: 158771 - DNA, 20 bp, Artificial Sequence
  Description of Artificial Sequence: Synthetic oligonucleotide
  Target: ATXN1; (-) strand; PAM type: YTN; PAM sequence: CTA
gctatggttcacaccacagc

SEQ ID NO: 158772 - DNA, 20 bp, Artificial Sequence
  Description of Artificial Sequence: Synthetic oligonucleotide
  Target: ATXN1; (-) strand; PAM type: YTN; PAM sequence: TTC
tagctatggttcacaccaca

SEQ ID NO: 158773 - DNA, 20 bp, Artificial Sequence
  Description of Artificial Sequence: Synthetic oligonucleotide
  Target: ATXN1; (-) strand; PAM type: YTN; PAM sequence: CTG
ttctagctatggttcacacc

SEQ ID NO: 158774 - DNA, 20 bp, Artificial Sequence
  Description of Artificial Sequence: Synthetic oligonucleotide
  Target: ATXN1; (-) strand; PAM type: YTN; PAM sequence: TTC
ggcaggctgttctagctatg

SEQ ID NO: 158775 - DNA, 20 bp, Artificial Sequence
  Description of Artificial Sequence: Synthetic oligonucleotide
  Target: ATXN1; (-) strand; PAM type: YTN; PAM sequence: TTT
cggcaggctgttctagctat

SEQ ID NO: 158776 - DNA, 20 bp, Artificial Sequence
  Description of Artificial Sequence: Synthetic oligonucleotide
  Target: ATXN1; (-) strand; PAM type: YTN; PAM sequence: TTT
tcggcaggctgttctagcta

SEQ ID NO: 158777 - DNA, 20 bp, Artificial Sequence
  Description of Artificial Sequence: Synthetic oligonucleotide
  Target: ATXN1; (-) strand; PAM type: YTN; PAM sequence: TTT
ttcggcaggctgttctagct

SEQ ID NO: 158778 - DNA, 20 bp, Artificial Sequence
  Description of Artificial Sequence: Synthetic oligonucleotide
  Target: ATXN1; (-) strand; PAM type: YTN; PAM sequence: CTC
gtgaatttttcggcaggctg

SEQ ID NO: 158779 - DNA, 20 bp, Artificial Sequence
  Description of Artificial Sequence: Synthetic oligonucleotide
  Target: ATXN1; (-) strand; PAM type: YTN; PAM sequence: CTC
tcgtgaatttttcggcaggc

SEQ ID NO: 158780 - DNA, 20 bp, Artificial Sequence
  Description of Artificial Sequence: Synthetic oligonucleotide
  Target: ATXN1; (-) strand; PAM type: YTN; PAM sequence: TTC
tctcgtgaatttttcggcag

SEQ ID NO: 158781 - DNA, 20 bp, Artificial Sequence
  Description of Artificial Sequence: Synthetic oligonucleotide
  Target: ATXN1; (-) strand; PAM type: YTN; PAM sequence: TTT
ctctcgtgaatttttcggca

SEQ ID NO: 158782 - DNA, 20 bp, Artificial Sequence
  Description of Artificial Sequence: Synthetic oligonucleotide
  Target: ATXN1; (-) strand; PAM type: YTN; PAM sequence: TTT
tctctcgtgaatttttcggc

SEQ ID NO: 158783 - DNA, 20 bp, Artificial Sequence
  Description of Artificial Sequence: Synthetic oligonucleotide
  Target: ATXN1; (-) strand; PAM type: YTN; PAM sequence: CTT
ttctctcgtgaatttttcgg

SEQ ID NO: 158784 - DNA, 20 bp, Artificial Sequence
  Description of Artificial Sequence: Synthetic oligonucleotide
  Target: ATXN1; (-) strand; PAM type: YTN; PAM sequence: CTC
catcacttttctctcgtgaa

SEQ ID NO: 158785 - DNA, 20 bp, Artificial Sequence
  Description of Artificial Sequence: Synthetic oligonucleotide
  Target: ATXN1; (-) strand; PAM type: YTN; PAM sequence: CTC
tccatcacttttctctcgtg

SEQ ID NO: 158786 - DNA, 20 bp, Artificial Sequence
  Description of Artificial Sequence: Synthetic oligonucleotide
  Target: ATXN1; (-) strand; PAM type: YTN; PAM sequence: CTC
tctccatcacttttctctcg

SEQ ID NO: 158787 - DNA, 20 bp, Artificial Sequence
  Description of Artificial Sequence: Synthetic oligonucleotide
  Target: ATXN1; (-) strand; PAM type: YTN; PAM sequence: CTC
tctctccatcacttttctct

SEQ ID NO: 158788 - DNA, 20 bp, Artificial Sequence
  Description of Artificial Sequence: Synthetic oligonucleotide
  Target: ATXN1; (-) strand; PAM type: YTN; PAM sequence: TTC
tctctctccatcacttttct

SEQ ID NO: 158789 - DNA, 20 bp, Artificial Sequence
  Description of Artificial Sequence: Synthetic oligonucleotide
  Target: ATXN1; (-) strand; PAM type: YTN; PAM sequence: CTC
aaatattctctctctccatc

SEQ ID NO: 158790 - DNA, 20 bp, Artificial Sequence
  Description of Artificial Sequence: Synthetic oligonucleotide
  Target: ATXN1; (-) strand; PAM type: YTN; PAM sequence: TTA
gtacgcatctcaaatattct

SEQ ID NO: 158791 - DNA, 20 bp, Artificial Sequence
  Description of Artificial Sequence: Synthetic oligonucleotide
  Target: ATXN1; (-) strand; PAM type: YTN; PAM sequence: TTT
agtacgcatctcaaatattc

SEQ ID NO: 158792 - DNA, 20 bp, Artificial Sequence
  Description of Artificial Sequence: Synthetic oligonucleotide
  Target: ATXN1; (-) strand; PAM type: YTN; PAM sequence: TTT
tagtacgcatctcaaatatt

SEQ ID NO: 158793 - DNA, 20 bp, Artificial Sequence
  Description of Artificial Sequence: Synthetic oligonucleotide
  Target: ATXN1; (-) strand; PAM type: YTN; PAM sequence: TTG
ttttagtacgcatctcaaat

SEQ ID NO: 158794 - DNA, 20 bp, Artificial Sequence
  Description of Artificial Sequence: Synthetic oligonucleotide
  Target: ATXN1; (-) strand; PAM type: YTN; PAM sequence: CTT
gttttagtacgcatctcaaa

SEQ ID NO: 158795 - DNA, 20 bp, Artificial Sequence
  Description of Artificial Sequence: Synthetic oligonucleotide
  Target: ATXN1; (-) strand; PAM type: YTN; PAM sequence: TTA
acgtcatcttgttttagtac

SEQ ID NO: 158796 - DNA, 20 bp, Artificial Sequence
  Description of Artificial Sequence: Synthetic oligonucleotide
  Target: ATXN1; (-) strand; PAM type: YTN; PAM sequence: TTC
cattaacgtcatcttgtttt

SEQ ID NO: 158797 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaaaaaattcc

SEQ ID NO: 158798 - DNA, 20 bp, Artificial Sequence
  Description of Artificial Sequence: Synthetic oligonucleotide
  Target: ATXN1; (-) strand; PAM type: YTN; PAM sequence: CTG
tctcaaaaaaaaaaaaaaaa

SEQ ID NO: 158799 - DNA, 20 bp, Artificial Sequence
  Description of Artificial Sequence: Synthetic oligonucleotide
  Target: ATXN1; (-) strand; PAM type: YTN; PAM sequence: CTC
tgtctcaaaaaaaaaaaaaa

SEQ ID NO: 158800 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagcgagactctg

SEQ ID NO: 158801 - DNA, 20 bp, Artificial Sequence
  Description of Artificial Sequence: Synthetic oligonucleotide
  Target: ATXN1; (-) strand; PAM type: YTN; PAM sequence: CTC
caacctgggtgacagagcga

SEQ ID NO: 158802 - DNA, 20 bp, Artificial Sequence
  Description of Artificial Sequence: Synthetic oligonucleotide
  Target: ATXN1; (-) strand; PAM type: YTN; PAM sequence: CTG
cactccaacctgggtgacag

SEQ ID NO: 158803 - DNA, 20 bp, Artificial Sequence
  Description of Artificial Sequence: Synthetic oligonucleotide
  Target: ATXN1; (-) strand; PAM type: YTN; PAM sequence: CTG
agatggtgccactgcactcc

SEQ ID NO: 158804 - DNA, 20 bp, Artificial Sequence
  Description of Artificial Sequence: Synthetic oligonucleotide
  Target: ATXN1; (-) strand; PAM type: YTN; PAM sequence: TTG
cagtgagctgagatggtgcc

SEQ ID NO: 158805 - DNA, 20 bp, Artificial Sequence
  Description of Artificial Sequence: Synthetic oligonucleotide
  Target: ATXN1; (-) strand; PAM type: YTN; PAM sequence: CTC
gaatccaggaggcagagatt

SEQ ID NO: 158806 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcgctcgaa

SEQ ID NO: 158807 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggagaat

SEQ ID NO: 158808 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggagaa

SEQ ID NO: 158809 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcagga

SEQ ID NO: 158810 - DNA, 20 bp, Artificial Sequence
  Description of Artificial Sequence: Synthetic oligonucleotide
  Target: ATXN1; (-) strand; PAM type: YTN; PAM sequence: CTG
ctacttgggaggctgaggca

SEQ ID NO: 158811 - DNA, 20 bp, Artificial Sequence
  Description of Artificial Sequence: Synthetic oligonucleotide
  Target: ATXN1; (-) strand; PAM type: YTN; PAM sequence: CTG
taatccctgctacttgggag

SEQ ID NO: 158812 - DNA, 20 bp, Artificial Sequence
  Description of Artificial Sequence: Synthetic oligonucleotide
  Target: ATXN1; (-) strand; PAM type: YTN; PAM sequence: TTA
gccaggggtggtggtgggca

SEQ ID NO: 158813 - DNA, 20 bp, Artificial Sequence
  Description of Artificial Sequence: Synthetic oligonucleotide
  Target: ATXN1; (-) strand; PAM type: YTN; PAM sequence: CTA
aaaatataaaaaattagcca

SEQ ID NO: 158814 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatataaaaaattag

SEQ ID NO: 158815 - DNA, 20 bp, Artificial Sequence
  Description of Artificial Sequence: Synthetic oligonucleotide
  Target: ATXN1; (-) strand; PAM type: YTN; PAM sequence: TTG
gccaacatggtgaatgaaac

SEQ ID NO: 158816 - DNA, 20 bp, Artificial Sequence
  Description of Artificial Sequence: Synthetic oligonucleotide
  Target: ATXN1; (-) strand; PAM type: YTN; PAM sequence: CTT
ggccaacatggtgaatgaaa

SEQ ID NO: 158817 - DNA, 20 bp, Artificial Sequence
  Description of Artificial Sequence: Synthetic oligonucleotide
  Target: ATXN1; (-) strand; PAM type: YTN; PAM sequence: CTA
gcttggccaacatggtgaat

SEQ ID NO: 158818 - DNA, 20 bp, Artificial Sequence
  Description of Artificial Sequence: Synthetic oligonucleotide
  Target: ATXN1; (-) strand; PAM type: YTN; PAM sequence: TTC
aagactagcttggccaacat

SEQ ID NO: 158819 - DNA, 20 bp, Artificial Sequence
  Description of Artificial Sequence: Synthetic oligonucleotide
  Target: ATXN1; (-) strand; PAM type: YTN; PAM sequence: CTG
agatcaggagttcaagacta

SEQ ID NO: 158820 - DNA, 20 bp, Artificial Sequence
  Description of Artificial Sequence: Synthetic oligonucleotide
  Target: ATXN1; (-) strand; PAM type: YTN; PAM sequence: CTG
tggcgggcagatcgcctgag

SEQ ID NO: 158821 - DNA, 20 bp, Artificial Sequence
  Description of Artificial Sequence: Synthetic oligonucleotide
  Target: ATXN1; (-) strand; PAM type: YTN; PAM sequence: TTG
ggaggctgtggcgggcagat

SEQ ID NO: 158822 - DNA, 20 bp, Artificial Sequence
  Description of Artificial Sequence: Synthetic oligonucleotide
  Target: ATXN1; (-) strand; PAM type: YTN; PAM sequence: TTT
gggaggctgtggcgggcaga

SEQ ID NO: 158823 - DNA, 20 bp, Artificial Sequence
  Description of Artificial Sequence: Synthetic oligonucleotide
  Target: ATXN1; (-) strand; PAM type: YTN; PAM sequence: TTT
tgggaggctgtggcgggcag

SEQ ID NO: 158824 - DNA, 20 bp, Artificial Sequence
  Description of Artificial Sequence: Synthetic oligonucleotide
  Target: ATXN1; (-) strand; PAM type: YTN; PAM sequence: CTA
gcattttgggaggctgtggc

SEQ ID NO: 158825 - DNA, 20 bp, Artificial Sequence
  Description of Artificial Sequence: Synthetic oligonucleotide
  Target: ATXN1; (-) strand; PAM type: YTN; PAM sequence: CTG
taatcctagcattttgggag

SEQ ID NO: 158826 - DNA, 20 bp, Artificial Sequence
  Description of Artificial Sequence: Synthetic oligonucleotide
  Target: ATXN1; (-) strand; PAM type: YTN; PAM sequence: TTC
tgtaatcctagcattttggg

SEQ ID NO: 158827 - DNA, 20 bp, Artificial Sequence
  Description of Artificial Sequence: Synthetic oligonucleotide
  Target: ATXN1; (-) strand; PAM type: YTN; PAM sequence: CTT
ctgtaatcctagcattttgg

SEQ ID NO: 158828 - DNA, 20 bp, Artificial Sequence
  Description of Artificial Sequence: Synthetic oligonucleotide
  Target: ATXN1; (-) strand; PAM type: YTN; PAM sequence: CTC
acttctgtaatcctagcatt

SEQ ID NO: 158829 - DNA, 20 bp, Artificial Sequence
  Description of Artificial Sequence: Synthetic oligonucleotide
  Target: ATXN1; (-) strand; PAM type: YTN; PAM sequence: TTA
acaggccaggtgggcgcggt

SEQ ID NO: 158830 - DNA, 20 bp, Artificial Sequence
  Description of Artificial Sequence: Synthetic oligonucleotide
  Target: ATXN1; (-) strand; PAM type: YTN; PAM sequence: TTC
attaacaggccaggtgggcg

SEQ ID NO: 158831 - DNA, 20 bp, Artificial Sequence
  Description of Artificial Sequence: Synthetic oligonucleotide
  Target: ATXN1; (-) strand; PAM type: YTN; PAM sequence: TTT
cattaacaggccaggtgggc

SEQ ID NO: 158832 - DNA, 20 bp, Artificial Sequence
  Description of Artificial Sequence: Synthetic oligonucleotide
  Target: ATXN1; (-) strand; PAM type: YTN; PAM sequence: TTA
acataaatttcattaacagg

SEQ ID NO: 158833 - DNA, 20 bp, Artificial Sequence
  Description of Artificial Sequence: Synthetic oligonucleotide
  Target: ATXN1; (-) strand; PAM type: YTN; PAM sequence: CTA
ggttaacataaatttcatta

SEQ ID NO: 158834 - DNA, 20 bp, Artificial Sequence
  Description of Artificial Sequence: Synthetic oligonucleotide
  Target: ATXN1; (-) strand; PAM type: YTN; PAM sequence: CTA
tctaggttaacataaatttc

SEQ ID NO: 158835 - DNA, 20 bp, Artificial Sequence
  Description of Artificial Sequence: Synthetic oligonucleotide
  Target: ATXN1; (-) strand; PAM type: YTN; PAM sequence: CTC
ccaagcctatctaggttaac

SEQ ID NO: 158836 - DNA, 20 bp, Artificial Sequence
  Description of Artificial Sequence: Synthetic oligonucleotide
  Target: ATXN1; (-) strand; PAM type: YTN; PAM sequence: TTA
aagaagaatctcccaagcct

SEQ ID NO: 158837 - DNA, 20 bp, Artificial Sequence
  Description of Artificial Sequence: Synthetic oligonucleotide
  Target: ATXN1; (-) strand; PAM type: YTN; PAM sequence: TTG
aagtgattaaagaagaatct

SEQ ID NO: 158838 - DNA, 20 bp, Artificial Sequence
  Description of Artificial Sequence: Synthetic oligonucleotide
  Target: ATXN1; (-) strand; PAM type: YTN; PAM sequence: TTT
gaagtgattaaagaagaatc

SEQ ID NO: 158839 - DNA, 20 bp, Artificial Sequence
  Description of Artificial Sequence: Synthetic oligonucleotide
  Target: ATXN1; (-) strand; PAM type: YTN; PAM sequence: CTT
tgaagtgattaaagaagaat

SEQ ID NO: 158840 - DNA, 20 bp, Artificial Sequence
  Description of Artificial Sequence: Synthetic oligonucleotide
  Target: ATXN1; (-) strand; PAM type: YTN; PAM sequence: TTA
ggcaaaaagaaacaaagaga

SEQ ID NO: 158841 - DNA, 20 bp, Artificial Sequence
  Description of Artificial Sequence: Synthetic oligonucleotide
  Target: ATXN1; (-) strand; PAM type: YTN; PAM sequence: TTT
aggcaaaaagaaacaaagag

SEQ ID NO: 158842 - DNA, 20 bp, Artificial Sequence
  Description of Artificial Sequence: Synthetic oligonucleotide
  Target: ATXN1; (-) strand; PAM type: YTN; PAM sequence: TTG
gtaggaagcaaaggcagaat

SEQ ID NO: 158843 - DNA, 20 bp, Artificial Sequence
  Description of Artificial Sequence: Synthetic oligonucleotide
  Target: ATXN1; (-) strand; PAM type: YTN; PAM sequence: TTT
ggtaggaagcaaaggcagaa

SEQ ID NO: 158844 - DNA, 20 bp, Artificial Sequence
  Description of Artificial Sequence: Synthetic oligonucleotide
  Target: ATXN1; (-) strand; PAM type: YTN; PAM sequence: CTT
tggtaggaagcaaaggcaga

SEQ ID NO: 158845 - DNA, 20 bp, Artificial Sequence
  Description of Artificial Sequence: Synthetic oligonucleotide
  Target: ATXN1; (-) strand; PAM type: YTN; PAM sequence: CTC
ctttggtaggaagcaaaggc

SEQ ID NO: 158846 - DNA, 20 bp, Artificial Sequence
  Description of Artificial Sequence: Synthetic oligonucleotide
  Target: ATXN1; (-) strand; PAM type: YTN; PAM sequence: TTC
gcagggtgacacagctcctt

SEQ ID NO: 158847 - DNA, 20 bp, Artificial Sequence
  Description of Artificial Sequence: Synthetic oligonucleotide
  Target: ATXN1; (-) strand; PAM type: YTN; PAM sequence: TTT
cgcagggtgacacagctcct

SEQ ID NO: 158848 - DNA, 20 bp, Artificial Sequence
  Description of Artificial Sequence: Synthetic oligonucleotide
  Target: ATXN1; (-) strand; PAM type: YTN; PAM sequence: TTT
tcgcagggtgacacagctcc

SEQ ID NO: 158849 - DNA, 20 bp, Artificial Sequence
  Description of Artificial Sequence: Synthetic oligonucleotide
  Target: ATXN1; (-) strand; PAM type: YTN; PAM sequence: CTT
ttcgcagggtgacacagctc

SEQ ID NO: 158850 - DNA, 20 bp, Artificial Sequence
  Description of Artificial Sequence: Synthetic oligonucleotide
  Target: ATXN1; (-) strand; PAM type: YTN; PAM sequence: CTG
gtcgtggcatcttttcgcag

SEQ ID NO: 158851 - DNA, 20 bp, Artificial Sequence
  Description of Artificial Sequence: Synthetic oligonucleotide
  Target: ATXN1; (-) strand; PAM type: YTN; PAM sequence: CTG
atatctggtcgtggcatctt

SEQ ID NO: 158852 - DNA, 20 bp, Artificial Sequence
  Description of Artificial Sequence: Synthetic oligonucleotide
  Target: ATXN1; (-) strand; PAM type: YTN; PAM sequence: TTC
atggacccagctgatatctg

SEQ ID NO: 158853 - DNA, 20 bp, Artificial Sequence
  Description of Artificial Sequence: Synthetic oligonucleotide
  Target: ATXN1; (-) strand; PAM type: YTN; PAM sequence: TTT
catggacccagctgatatct

SEQ ID NO: 158854 - DNA, 20 bp, Artificial Sequence
  Description of Artificial Sequence: Synthetic oligonucleotide
  Target: ATXN1; (-) strand; PAM type: YTN; PAM sequence: CTT
tcatggacccagctgatatc

SEQ ID NO: 158855 - DNA, 20 bp, Artificial Sequence
  Description of Artificial Sequence: Synthetic oligonucleotide
  Target: ATXN1; (-) strand; PAM type: YTN; PAM sequence: CTC
agctttcatggacccagctg

SEQ ID NO: 158856 - DNA, 20 bp, Artificial Sequence
  Description of Artificial Sequence: Synthetic oligonucleotide
  Target: ATXN1; (-) strand; PAM type: YTN; PAM sequence: CTC
ccacctcagctttcatggac

SEQ ID NO: 158857 - DNA, 20 bp, Artificial Sequence
  Description of Artificial Sequence: Synthetic oligonucleotide
  Target: ATXN1; (-) strand; PAM type: YTN; PAM sequence: TTC
cgctcccacctcagctttca

SEQ ID NO: 158858 - DNA, 20 bp, Artificial Sequence
  Description of Artificial Sequence: Synthetic oligonucleotide
  Target: ATXN1; (-) strand; PAM type: YTN; PAM sequence: CTT
ccgctcccacctcagctttc

SEQ ID NO: 158859 - DNA, 20 bp, Artificial Sequence
  Description of Artificial Sequence: Synthetic oligonucleotide
  Target: ATXN1; (-) strand; PAM type: YTN; PAM sequence: CTG
aataatcttccgctcccacc

SEQ ID NO: 158860 - DNA, 20 bp, Artificial Sequence
  Description of Artificial Sequence: Synthetic oligonucleotide
  Target: ATXN1; (-) strand; PAM type: YTN; PAM sequence: TTA
tctgaataatcttccgctcc

SEQ ID NO: 158861 - DNA, 20 bp, Artificial Sequence
  Description of Artificial Sequence: Synthetic oligonucleotide
  Target: ATXN1; (-) strand; PAM type: YTN; PAM sequence: CTA
caatgatcagattatctgaa

SEQ ID NO: 158862 - DNA, 20 bp, Artificial Sequence
  Description of Artificial Sequence: Synthetic oligonucleotide
  Target: ATXN1; (-) strand; PAM type: YTN; PAM sequence: CTG
tgcctacaatgatcagatta

SEQ ID NO: 158863 - DNA, 20 bp, Artificial Sequence
  Description of Artificial Sequence: Synthetic oligonucleotide
  Target: ATXN1; (-) strand; PAM type: YTN; PAM sequence: CTA
tccgatctgtgcctacaatg

SEQ ID NO: 158864 - DNA, 20 bp, Artificial Sequence
  Description of Artificial Sequence: Synthetic oligonucleotide
  Target: ATXN1; (-) strand; PAM type: YTN; PAM sequence: CTG
gcaagctatccgatctgtgc

SEQ ID NO: 158865 - DNA, 20 bp, Artificial Sequence
  Description of Artificial Sequence: Synthetic oligonucleotide
  Target: ATXN1; (-) strand; PAM type: YTN; PAM sequence: TTG
ggctggcaagctatccgatc

SEQ ID NO: 158866 - DNA, 20 bp, Artificial Sequence
  Description of Artificial Sequence: Synthetic oligonucleotide
  Target: ATXN1; (-) strand; PAM type: YTN; PAM sequence: CTA
gcattgggctggcaagctat

SEQ ID NO: 158867 - DNA, 20 bp, Artificial Sequence
  Description of Artificial Sequence: Synthetic oligonucleotide
  Target: ATXN1; (-) strand; PAM type: YTN; PAM sequence: TTA
gtgaggagaaaactagcatt

SEQ ID NO: 158868 - DNA, 20 bp, Artificial Sequence
  Description of Artificial Sequence: Synthetic oligonucleotide
  Target: ATXN1; (-) strand; PAM type: YTN; PAM sequence: CTA
attagtgaggagaaaactag

SEQ ID NO: 158869 - DNA, 20 bp, Artificial Sequence
  Description of Artificial Sequence: Synthetic oligonucleotide
  Target: ATXN1; (-) strand; PAM type: YTN; PAM sequence: TTC
acactaattagtgaggagaa

SEQ ID NO: 158870 - DNA, 20 bp, Artificial Sequence
  Description of Artificial Sequence: Synthetic oligonucleotide
  Target: ATXN1; (-) strand; PAM type: YTN; PAM sequence: CTA
ggtagttcacactaattagt

SEQ ID NO: 158871 - DNA, 20 bp, Artificial Sequence
  Description of Artificial Sequence: Synthetic oligonucleotide
  Target: ATXN1; (-) strand; PAM type: YTN; PAM sequence: TTG
tctaggtagttcacactaat

SEQ ID NO: 158872 - DNA, 20 bp, Artificial Sequence
  Description of Artificial Sequence: Synthetic oligonucleotide
  Target: ATXN1; (-) strand; PAM type: YTN; PAM sequence: TTC
agaccccaagggggaaaaag

SEQ ID NO: 158873 - DNA, 20 bp, Artificial Sequence
  Description of Artificial Sequence: Synthetic oligonucleotide
  Target: ATXN1; (-) strand; PAM type: YTN; PAM sequence: CTC
atacattcagaccccaaggg

SEQ ID NO: 158874 - DNA, 20 bp, Artificial Sequence
  Description of Artificial Sequence: Synthetic oligonucleotide
  Target: ATXN1; (-) strand; PAM type: YTN; PAM sequence: TTC
tcatacattcagaccccaag

SEQ ID NO: 158875 - DNA, 20 bp, Artificial Sequence
  Description of Artificial Sequence: Synthetic oligonucleotide
  Target: ATXN1; (-) strand; PAM type: YTN; PAM sequence: CTT
ctcatacattcagaccccaa

SEQ ID NO: 158876 - DNA, 20 bp, Artificial Sequence
  Description of Artificial Sequence: Synthetic oligonucleotide
  Target: ATXN1; (-) strand; PAM type: YTN; PAM sequence: TTA
cttctcatacattcagaccc

SEQ ID NO: 158877 - DNA, 20 bp, Artificial Sequence
  Description of Artificial Sequence: Synthetic oligonucleotide
  Target: ATXN1; (-) strand; PAM type: YTN; PAM sequence: TTT
acttctcatacattcagacc

SEQ ID NO: 158878 - DNA, 20 bp, Artificial Sequence
  Description of Artificial Sequence: Synthetic oligonucleotide
  Target: ATXN1; (-) strand; PAM type: YTN; PAM sequence: TTT
tacttctcatacattcagac

SEQ ID NO: 158879 - DNA, 20 bp, Artificial Sequence
  Description of Artificial Sequence: Synthetic oligonucleotide
  Target: ATXN1; (-) strand; PAM type: YTN; PAM sequence: TTA
ttttacttctcatacattca

SEQ ID NO: 158880 - DNA, 20 bp, Artificial Sequence
  Description of Artificial Sequence: Synthetic oligonucleotide
  Target: ATXN1; (-) strand; PAM type: YTN; PAM sequence: CTT
attttacttctcatacattc

SEQ ID NO: 158881 - DNA, 20 bp, Artificial Sequence
  Description of Artificial Sequence: Synthetic oligonucleotide
  Target: ATXN1; (-) strand; PAM type: YTN; PAM sequence: TTC
accaaagaagggaaaaaaac

SEQ ID NO: 158882 - DNA, 20 bp, Artificial Sequence
  Description of Artificial Sequence: Synthetic oligonucleotide
  Target: ATXN1; (-) strand; PAM type: YTN; PAM sequence: TTT
caccaaagaagggaaaaaaa

SEQ ID NO: 158883 - DNA, 20 bp, Artificial Sequence
  Description of Artificial Sequence: Synthetic oligonucleotide
  Target: ATXN1; (-) strand; PAM type: YTN; PAM sequence: CTT
tcaccaaagaagggaaaaaa

SEQ ID NO: 158884 - DNA, 20 bp, Artificial Sequence
  Description of Artificial Sequence: Synthetic oligonucleotide
  Target: ATXN1; (-) strand; PAM type: YTN; PAM sequence: TTA
actttcaccaaagaagggaa

SEQ ID NO: 158885 - DNA, 20 bp, Artificial Sequence
  Description of Artificial Sequence: Synthetic oligonucleotide
  Target: ATXN1; (-) strand; PAM type: YTN; PAM sequence: TTT
aactttcaccaaagaaggga

SEQ ID NO: 158886 - DNA, 20 bp, Artificial Sequence
  Description of Artificial Sequence: Synthetic oligonucleotide
  Target: ATXN1; (-) strand; PAM type: YTN; PAM sequence: TTT
taactttcaccaaagaaggg

SEQ ID NO: 158887 - DNA, 20 bp, Artificial Sequence
  Description of Artificial Sequence: Synthetic oligonucleotide
  Target: ATXN1; (-) strand; PAM type: YTN; PAM sequence: TTG
agatgtgtgcaacaagattt

SEQ ID NO: 158888 - DNA, 20 bp, Artificial Sequence
  Description of Artificial Sequence: Synthetic oligonucleotide
  Target: ATXN1; (-) strand; PAM type: YTN; PAM sequence: TTT
gagatgtgtgcaacaagatt

SEQ ID NO: 158889 - DNA, 20 bp, Artificial Sequence
  Description of Artificial Sequence: Synthetic oligonucleotide
  Target: ATXN1; (-) strand; PAM type: YTN; PAM sequence: CTA
tttgagatgtgtgcaacaag

SEQ ID NO: 158890 - DNA, 20 bp, Artificial Sequence
  Description of Artificial Sequence: Synthetic oligonucleotide
  Target: ATXN1; (-) strand; PAM type: YTN; PAM sequence: TTG
agtgtacctatttgagatgt

SEQ ID NO: 158891 - DNA, 20 bp, Artificial Sequence
  Description of Artificial Sequence: Synthetic oligonucleotide
  Target: ATXN1; (-) strand; PAM type: YTN; PAM sequence: CTT
gagtgtacctatttgagatg

SEQ ID NO: 158892 - DNA, 20 bp, Artificial Sequence
  Description of Artificial Sequence: Synthetic oligonucleotide
  Target: ATXN1; (-) strand; PAM type: YTN; PAM sequence: CTA
tgaatgcttgagtgtaccta

SEQ ID NO: 158893 - DNA, 20 bp, Artificial Sequence
  Description of Artificial Sequence: Synthetic oligonucleotide
  Target: ATXN1; (-) strand; PAM type: YTN; PAM sequence: TTG
ctatgaatgcttgagtgtac

SEQ ID NO: 158894 - DNA, 20 bp, Artificial Sequence
  Description of Artificial Sequence: Synthetic oligonucleotide
  Target: ATXN1; (-) strand; PAM type: YTN; PAM sequence: TTT
gctatgaatgcttgagtgta

SEQ ID NO: 158895 - DNA, 20 bp, Artificial Sequence
  Description of Artificial Sequence: Synthetic oligonucleotide
  Target: ATXN1; (-) strand; PAM type: YTN; PAM sequence: TTA
taaaataaagatagatttgc

SEQ ID NO: 158896 - DNA, 20 bp, Artificial Sequence
  Description of Artificial Sequence: Synthetic oligonucleotide
  Target: ATXN1; (-) strand; PAM type: YTN; PAM sequence: CTA
attataaaataaagatagat

SEQ ID NO: 158897 - DNA, 20 bp, Artificial Sequence
  Description of Artificial Sequence: Synthetic oligonucleotide
  Target: ATXN1; (-) strand; PAM type: YTN; PAM sequence: TTA
tgacaaacctaattataaaa

SEQ ID NO: 158898 - DNA, 20 bp, Artificial Sequence
  Description of Artificial Sequence: Synthetic oligonucleotide
  Target: ATXN1; (-) strand; PAM type: YTN; PAM sequence: CTT
atgacaaacctaattataaa

SEQ ID NO: 158899 - DNA, 20 bp, Artificial Sequence
  Description of Artificial Sequence: Synthetic oligonucleotide
  Target: ATXN1; (-) strand; PAM type: YTN; PAM sequence: TTA
tatccttatgacaaacctaa

SEQ ID NO: 158900 - DNA, 20 bp, Artificial Sequence
  Description of Artificial Sequence: Synthetic oligonucleotide
  Target: ATXN1; (-) strand; PAM type: YTN; PAM sequence: TTT
atatccttatgacaaaccta

SEQ ID NO: 158901 - DNA, 20 bp, Artificial Sequence
  Description of Artificial Sequence: Synthetic oligonucleotide
  Target: ATXN1; (-) strand; PAM type: YTN; PAM sequence: TTA
agaatgtttatatccttatg

SEQ ID NO: 158902 - DNA, 20 bp, Artificial Sequence
  Description of Artificial Sequence: Synthetic oligonucleotide
  Target: ATXN1; (-) strand; PAM type: YTN; PAM sequence: TTT
aagaatgtttatatccttat

SEQ ID NO: 158903 - DNA, 20 bp, Artificial Sequence
  Description of Artificial Sequence: Synthetic oligonucleotide
  Target: ATXN1; (-) strand; PAM type: YTN; PAM sequence: CTT
taagaatgtttatatcctta

SEQ ID NO: 158904 - DNA, 20 bp, Artificial Sequence
  Description of Artificial Sequence: Synthetic oligonucleotide
  Target: ATXN1; (-) strand; PAM type: YTN; PAM sequence: TTA
acctttaagaatgtttatat

SEQ ID NO: 158905 - DNA, 20 bp, Artificial Sequence
  Description of Artificial Sequence: Synthetic oligonucleotide
  Target: ATXN1; (-) strand; PAM type: YTN; PAM sequence: TTA
atgatcagttaacctttaag

SEQ ID NO: 158906 - DNA, 20 bp, Artificial Sequence
  Description of Artificial Sequence: Synthetic oligonucleotide
  Target: ATXN1; (-) strand; PAM type: YTN; PAM sequence: TTA
acggttaatgatcagttaac

SEQ ID NO: 158907 - DNA, 20 bp, Artificial Sequence
  Description of Artificial Sequence: Synthetic oligonucleotide
  Target: ATXN1; (-) strand; PAM type: YTN; PAM sequence: TTC
attaacggttaatgatcagt

SEQ ID NO: 158908 - DNA, 20 bp, Artificial Sequence
  Description of Artificial Sequence: Synthetic oligonucleotide
  Target: ATXN1; (-) strand; PAM type: YTN; PAM sequence: CTT
cattaacggttaatgatcag

SEQ ID NO: 158909 - DNA, 20 bp, Artificial Sequence
  Description of Artificial Sequence: Synthetic oligonucleotide
  Target: ATXN1; (-) strand; PAM type: YTN; PAM sequence: TTC
ttcattaacggttaatgatc

SEQ ID NO: 158910 - DNA, 20 bp, Artificial Sequence
  Description of Artificial Sequence: Synthetic oligonucleotide
  Target: ATXN1; (-) strand; PAM type: YTN; PAM sequence: TTT
cttcattaacggttaatgat

SEQ ID NO: 158911 - DNA, 20 bp, Artificial Sequence
  Description of Artificial Sequence: Synthetic oligonucleotide
  Target: ATXN1; (-) strand; PAM type: YTN; PAM sequence: CTC
agtgagatttcttcattaac

SEQ ID NO: 158912 - DNA, 20 bp, Artificial Sequence
  Description of Artificial Sequence: Synthetic oligonucleotide
  Target: ATXN1; (-) strand; PAM type: YTN; PAM sequence: CTG
agaaacccctcagtgagatt

SEQ ID NO: 158913 - DNA, 20 bp, Artificial Sequence
  Description of Artificial Sequence: Synthetic oligonucleotide
  Target: ATXN1; (-) strand; PAM type: YTN; PAM sequence: CTC
actgagaaacccctcagtga

SEQ ID NO: 158914 - DNA, 20 bp, Artificial Sequence
  Description of Artificial Sequence: Synthetic oligonucleotide
  Target: ATXN1; (-) strand; PAM type: YTN; PAM sequence: TTC
tcactgagaaacccctcagt

SEQ ID NO: 158915 - DNA, 20 bp, Artificial Sequence
  Description of Artificial Sequence: Synthetic oligonucleotide
  Target: ATXN1; (-) strand; PAM type: YTN; PAM sequence: TTG
atgatatatattctcactga

SEQ ID NO: 158916 - DNA, 20 bp, Artificial Sequence
  Description of Artificial Sequence: Synthetic oligonucleotide
  Target: ATXN1; (-) strand; PAM type: YTN; PAM sequence: TTT
gatgatatatattctcactg

SEQ ID NO: 158917 - DNA, 20 bp, Artificial Sequence
  Description of Artificial Sequence: Synthetic oligonucleotide
  Target: ATXN1; (-) strand; PAM type: YTN; PAM sequence: TTC
aagcaacagatttgatgata

SEQ ID NO: 158918 - DNA, 20 bp, Artificial Sequence
  Description of Artificial Sequence: Synthetic oligonucleotide
  Target: ATXN1; (-) strand; PAM type: YTN; PAM sequence: TTT
caagcaacagatttgatgat

SEQ ID NO: 158919 - DNA, 20 bp, Artificial Sequence
  Description of Artificial Sequence: Synthetic oligonucleotide
  Target: ATXN1; (-) strand; PAM type: YTN; PAM sequence: CTC
caagggaatttcaagcaaca

SEQ ID NO: 158920 - DNA, 20 bp, Artificial Sequence
  Description of Artificial Sequence: Synthetic oligonucleotide
  Target: ATXN1; (-) strand; PAM type: YTN; PAM sequence: CTC
tccaagggaatttcaagcaa

SEQ ID NO: 158921 - DNA, 20 bp, Artificial Sequence
  Description of Artificial Sequence: Synthetic oligonucleotide
  Target: ATXN1; (-) strand; PAM type: YTN; PAM sequence: CTC
ctctccaagggaatttcaag

SEQ ID NO: 158922 - DNA, 20 bp, Artificial Sequence
  Description of Artificial Sequence: Synthetic oligonucleotide
  Target: ATXN1; (-) strand; PAM type: YTN; PAM sequence: TTG
agatggagaaggctcctctc

SEQ ID NO: 158923 - DNA, 20 bp, Artificial Sequence
  Description of Artificial Sequence: Synthetic oligonucleotide
  Target: ATXN1; (-) strand; PAM type: YTN; PAM sequence: TTT
gagatggagaaggctcctct

SEQ ID NO: 158924 - DNA, 20 bp, Artificial Sequence
  Description of Artificial Sequence: Synthetic oligonucleotide
  Target: ATXN1; (-) strand; PAM type: YTN; PAM sequence: TTT
tgagatggagaaggctcctc

SEQ ID NO: 158925 - DNA, 20 bp, Artificial Sequence
  Description of Artificial Sequence: Synthetic oligonucleotide
  Target: ATXN1; (-) strand; PAM type: YTN; PAM sequence: TTG
acagcatgttttgagatgga

SEQ ID NO: 158926 - DNA, 20 bp, Artificial Sequence
  Description of Artificial Sequence: Synthetic oligonucleotide
  Target: ATXN1; (-) strand; PAM type: YTN; PAM sequence: CTG
gcattgacagcatgttttga

SEQ ID NO: 158927 - DNA, 20 bp, Artificial Sequence
  Description of Artificial Sequence: Synthetic oligonucleotide
  Target: ATXN1; (-) strand; PAM type: YTN; PAM sequence: TTC
acatccaaaccagtccccgc

SEQ ID NO: 158928 - DNA, 20 bp, Artificial Sequence
  Description of Artificial Sequence: Synthetic oligonucleotide
  Target: ATXN1; (-) strand; PAM type: YTN; PAM sequence: TTT
cacatccaaaccagtccccg

SEQ ID NO: 158929 - DNA, 20 bp, Artificial Sequence
  Description of Artificial Sequence: Synthetic oligonucleotide
  Target: ATXN1; (-) strand; PAM type: YTN; PAM sequence: CTG
tttcacatccaaaccagtcc

SEQ ID NO: 158930 - DNA, 20 bp, Artificial Sequence
  Description of Artificial Sequence: Synthetic oligonucleotide
  Target: ATXN1; (-) strand; PAM type: YTN; PAM sequence: CTC
tgtttcacatccaaaccagt

SEQ ID NO: 158931 - DNA, 20 bp, Artificial Sequence
  Description of Artificial Sequence: Synthetic oligonucleotide
  Target: ATXN1; (-) strand; PAM type: YTN; PAM sequence: CTA
caaaatcacaccgtctctgt

SEQ ID NO: 158932 - DNA, 20 bp, Artificial Sequence
  Description of Artificial Sequence: Synthetic oligonucleotide
  Target: ATXN1; (-) strand; PAM type: YTN; PAM sequence: TTG
aagatgacatcatcctacaa

SEQ ID NO: 158933 - DNA, 20 bp, Artificial Sequence
  Description of Artificial Sequence: Synthetic oligonucleotide
  Target: ATXN1; (-) strand; PAM type: YTN; PAM sequence: TTC
cagttgaagatgacatcatc

SEQ ID NO: 158934 - DNA, 20 bp, Artificial Sequence
  Description of Artificial Sequence: Synthetic oligonucleotide
  Target: ATXN1; (-) strand; PAM type: YTN; PAM sequence: TTG
ttccagttgaagatgacatc

SEQ ID NO: 158935 - DNA, 20 bp, Artificial Sequence
  Description of Artificial Sequence: Synthetic oligonucleotide
  Target: ATXN1; (-) strand; PAM type: YTN; PAM sequence: TTA
ttgttccagttgaagatgac

SEQ ID NO: 158936 - DNA, 20 bp, Artificial Sequence
  Description of Artificial Sequence: Synthetic oligonucleotide
  Target: ATXN1; (-) strand; PAM type: YTN; PAM sequence: CTT
attgttccagttgaagatga

SEQ ID NO: 158937 - DNA, 20 bp, Artificial Sequence
  Description of Artificial Sequence: Synthetic oligonucleotide
  Target: ATXN1; (-) strand; PAM type: YTN; PAM sequence: TTC
acagacttattgttccagtt

SEQ ID NO: 158938 - DNA, 20 bp, Artificial Sequence
  Description of Artificial Sequence: Synthetic oligonucleotide
  Target: ATXN1; (-) strand; PAM type: YTN; PAM sequence: TTC
aaggaattcacagacttatt

SEQ ID NO: 158939 - DNA, 20 bp, Artificial Sequence
  Description of Artificial Sequence: Synthetic oligonucleotide
  Target: ATXN1; (-) strand; PAM type: YTN; PAM sequence: TTA
aattcaaggaattcacagac

SEQ ID NO: 158940 - DNA, 20 bp, Artificial Sequence
  Description of Artificial Sequence: Synthetic oligonucleotide
  Target: ATXN1; (-) strand; PAM type: YTN; PAM sequence: TTT
aaattcaaggaattcacaga

SEQ ID NO: 158941 - DNA, 20 bp, Artificial Sequence
  Description of Artificial Sequence: Synthetic oligonucleotide
  Target: ATXN1; (-) strand; PAM type: YTN; PAM sequence: TTT
taaattcaaggaattcacag

SEQ ID NO: 158942 - DNA, 20 bp, Artificial Sequence
  Description of Artificial Sequence: Synthetic oligonucleotide
  Target: ATXN1; (-) strand; PAM type: YTN; PAM sequence: CTA
tcagcatcatagagaatacc

SEQ ID NO: 158943 - DNA, 20 bp, Artificial Sequence
  Description of Artificial Sequence: Synthetic oligonucleotide
  Target: ATXN1; (-) strand; PAM type: YTN; PAM sequence: TTG
aagctatcagcatcatagag

SEQ ID NO: 158944 - DNA, 20 bp, Artificial Sequence
  Description of Artificial Sequence: Synthetic oligonucleotide
  Target: ATXN1; (-) strand; PAM type: YTN; PAM sequence: TTT
gaagctatcagcatcataga

SEQ ID NO: 158945 - DNA, 20 bp, Artificial Sequence
  Description of Artificial Sequence: Synthetic oligonucleotide
  Target: ATXN1; (-) strand; PAM type: YTN; PAM sequence: TTT
tgaagctatcagcatcatag

SEQ ID NO: 158946 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaataataataa

SEQ ID NO: 158947 - DNA, 20 bp, Artificial Sequence
  Description of Artificial Sequence: Synthetic oligonucleotide
  Target: ATXN1; (-) strand; PAM type: YTN; PAM sequence: CTC
catctcaaaaaaaaaaataa

SEQ ID NO: 158948 - DNA, 20 bp, Artificial Sequence
  Description of Artificial Sequence: Synthetic oligonucleotide
  Target: ATXN1; (-) strand; PAM type: YTN; PAM sequence: CTG
ggcaacagagcaagactcca

SEQ ID NO: 158949 - DNA, 20 bp, Artificial Sequence
  Description of Artificial Sequence: Synthetic oligonucleotide
  Target: ATXN1; (-) strand; PAM type: YTN; PAM sequence: TTC
cagcctgggcaacagagcaa

SEQ ID NO: 158950 - DNA, 20 bp, Artificial Sequence
  Description of Artificial Sequence: Synthetic oligonucleotide
  Target: ATXN1; (-) strand; PAM type: YTN; PAM sequence: CTA
cattccagcctgggcaacag

SEQ ID NO: 158951 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatagtgcc

SEQ ID NO: 158952 - DNA, 20 bp, Artificial Sequence
  Description of Artificial Sequence: Synthetic oligonucleotide
  Target: ATXN1; (-) strand; PAM type: YTN; PAM sequence: TTT
gcagtgagccgagatagtgc

SEQ ID NO: 158953 - DNA, 20 bp, Artificial Sequence
  Description of Artificial Sequence: Synthetic oligonucleotide
  Target: ATXN1; (-) strand; PAM type: YTN; PAM sequence: TTG
aacccaggaggtggagtttg

SEQ ID NO: 158954 - DNA, 20 bp, Artificial Sequence
  Description of Artificial Sequence: Synthetic oligonucleotide
  Target: ATXN1; (-) strand; PAM type: YTN; PAM sequence: CTT
gaacccaggaggtggagttt

SEQ ID NO: 158955 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcgcttgaa

SEQ ID NO: 158956 - DNA, 20 bp, Artificial Sequence
  Description of Artificial Sequence: Synthetic oligonucleotide
  Target: ATXN1; (-) strand; PAM type: YTN; PAM sequence: CTC
gggaggctgaggcaggagaa

SEQ ID NO: 158957 - DNA, 20 bp, Artificial Sequence
  Description of Artificial Sequence: Synthetic oligonucleotide
  Target: ATXN1; (-) strand; PAM type: YTN; PAM sequence: CTA
ctcgggaggctgaggcagga

SEQ ID NO: 158958 - DNA, 20 bp, Artificial Sequence
  Description of Artificial Sequence: Synthetic oligonucleotide
  Target: ATXN1; (-) strand; PAM type: YTN; PAM sequence: CTC
ccagctactcgggaggctga

SEQ ID NO: 158959 - DNA, 20 bp, Artificial Sequence
  Description of Artificial Sequence: Synthetic oligonucleotide
  Target: ATXN1; (-) strand; PAM type: YTN; PAM sequence: TTA
tgcctcccagctactcggga

SEQ ID NO: 158960 - DNA, 20 bp, Artificial Sequence
  Description of Artificial Sequence: Synthetic oligonucleotide
  Target: ATXN1; (-) strand; PAM type: YTN; PAM sequence: CTT
atgcctcccagctactcggg

SEQ ID NO: 158961 - DNA, 20 bp, Artificial Sequence
  Description of Artificial Sequence: Synthetic oligonucleotide
  Target: ATXN1; (-) strand; PAM type: YTN; PAM sequence: TTA
gccaggtgtggtggcttatg

SEQ ID NO: 158962 - DNA, 20 bp, Artificial Sequence
  Description of Artificial Sequence: Synthetic oligonucleotide
  Target: ATXN1; (-) strand; PAM type: YTN; PAM sequence: CTA
aacatacaaaaattagccag

SEQ ID NO: 158963 - DNA, 20 bp, Artificial Sequence
  Description of Artificial Sequence: Synthetic oligonucleotide
  Target: ATXN1; (-) strand; PAM type: YTN; PAM sequence: CTA
ctaaacatacaaaaattagc

SEQ ID NO: 158964 - DNA, 20 bp, Artificial Sequence
  Description of Artificial Sequence: Synthetic oligonucleotide
  Target: ATXN1; (-) strand; PAM type: YTN; PAM sequence: CTC
tactaaacatacaaaaatta

SEQ ID NO: 158965 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtaaaaccccg

SEQ ID NO: 158966 - DNA, 20 bp, Artificial Sequence
  Description of Artificial Sequence: Synthetic oligonucleotide
  Target: ATXN1; (-) strand; PAM type: YTN; PAM sequence: TTC
aagaccagcctggccaacat

SEQ ID NO: 158967 - DNA, 20 bp, Artificial Sequence
  Description of Artificial Sequence: Synthetic oligonucleotide
  Target: ATXN1; (-) strand; PAM type: YTN; PAM sequence: TTG
aggtcaggagttcaagacca

SEQ ID NO: 158968 - DNA, 20 bp, Artificial Sequence
  Description of Artificial Sequence: Synthetic oligonucleotide
  Target: ATXN1; (-) strand; PAM type: YTN; PAM sequence: CTT
gaggtcaggagttcaagacc

SEQ ID NO: 158969 - DNA, 20 bp, Artificial Sequence
  Description of Artificial Sequence: Synthetic oligonucleotide
  Target: ATXN1; (-) strand; PAM type: YTN; PAM sequence: TTA
ggaggccaaggcaggcagat

SEQ ID NO: 158970 - DNA, 20 bp, Artificial Sequence
  Description of Artificial Sequence: Synthetic oligonucleotide
  Target: ATXN1; (-) strand; PAM type: YTN; PAM sequence: TTT
aggaggccaaggcaggcaga

SEQ ID NO: 158971 - DNA, 20 bp, Artificial Sequence
  Description of Artificial Sequence: Synthetic oligonucleotide
  Target: ATXN1; (-) strand; PAM type: YTN; PAM sequence: CTT
taggaggccaaggcaggcag

SEQ ID NO: 158972 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttaggag

SEQ ID NO: 158973 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatcccagcact

SEQ ID NO: 158974 - DNA, 20 bp, Artificial Sequence
  Description of Artificial Sequence: Synthetic oligonucleotide
  Target: ATXN1; (-) strand; PAM type: YTN; PAM sequence: TTG
aggccgggcacggtggctca

SEQ ID NO: 158975 - DNA, 20 bp, Artificial Sequence
  Description of Artificial Sequence: Synthetic oligonucleotide
  Target: ATXN1; (-) strand; PAM type: YTN; PAM sequence: TTT
gaggccgggcacggtggctc

SEQ ID NO: 158976 - DNA, 20 bp, Artificial Sequence
  Description of Artificial Sequence: Synthetic oligonucleotide
  Target: ATXN1; (-) strand; PAM type: YTN; PAM sequence: TTT
tgaggccgggcacggtggct

SEQ ID NO: 158977 - DNA, 20 bp, Artificial Sequence
  Description of Artificial Sequence: Synthetic oligonucleotide
  Target: ATXN1; (-) strand; PAM type: YTN; PAM sequence: CTC
aataatattttgaggccggg

SEQ ID NO: 158978 - DNA, 20 bp, Artificial Sequence
  Description of Artificial Sequence: Synthetic oligonucleotide
  Target: ATXN1; (-) strand; PAM type: YTN; PAM sequence: TTA
ggaaccctcaataatatttt

SEQ ID NO: 158979 - DNA, 20 bp, Artificial Sequence
  Description of Artificial Sequence: Synthetic oligonucleotide
  Target: ATXN1; (-) strand; PAM type: YTN; PAM sequence: CTG
aaatgtatcattaggaaccc

SEQ ID NO: 158980 - DNA, 20 bp, Artificial Sequence
  Description of Artificial Sequence: Synthetic oligonucleotide
  Target: ATXN1; (-) strand; PAM type: YTN; PAM sequence: CTG
gaaagcctgaaatgtatcat

SEQ ID NO: 158981 - DNA, 20 bp, Artificial Sequence
  Description of Artificial Sequence: Synthetic oligonucleotide
  Target: ATXN1; (-) strand; PAM type: YTN; PAM sequence: TTA
aaactggaaagcctgaaatg

SEQ ID NO: 158982 - DNA, 20 bp, Artificial Sequence
  Description of Artificial Sequence: Synthetic oligonucleotide
  Target: ATXN1; (-) strand; PAM type: YTN; PAM sequence: TTA
ttaaaactggaaagcctgaa

SEQ ID NO: 158983 - DNA, 20 bp, Artificial Sequence
  Description of Artificial Sequence: Synthetic oligonucleotide
  Target: ATXN1; (-) strand; PAM type: YTN; PAM sequence: TTT
attaaaactggaaagcctga

SEQ ID NO: 158984 - DNA, 20 bp, Artificial Sequence
  Description of Artificial Sequence: Synthetic oligonucleotide
  Target: ATXN1; (-) strand; PAM type: YTN; PAM sequence: TTT
tattaaaactggaaagcctg

SEQ ID NO: 158985 - DNA, 20 bp, Artificial Sequence
  Description of Artificial Sequence: Synthetic oligonucleotide
  Target: ATXN1; (-) strand; PAM type: YTN; PAM sequence: CTT
ttattaaaactggaaagcct

SEQ ID NO: 158986 - DNA, 20 bp, Artificial Sequence
  Description of Artificial Sequence: Synthetic oligonucleotide
  Target: ATXN1; (-) strand; PAM type: YTN; PAM sequence: TTG
aacttttattaaaactggaa

SEQ ID NO: 158987 - DNA, 20 bp, Artificial Sequence
  Description of Artificial Sequence: Synthetic oligonucleotide
  Target: ATXN1; (-) strand; PAM type: YTN; PAM sequence: TTG
ttgaacttttattaaaactg

SEQ ID NO: 158988 - DNA, 20 bp, Artificial Sequence
  Description of Artificial Sequence: Synthetic oligonucleotide
  Target: ATXN1; (-) strand; PAM type: YTN; PAM sequence: CTT
gttgaacttttattaaaact

SEQ ID NO: 158989 - DNA, 20 bp, Artificial Sequence
  Description of Artificial Sequence: Synthetic oligonucleotide
  Target: ATXN1; (-) strand; PAM type: YTN; PAM sequence: CTC
ggtgtatacttgttgaactt

SEQ ID NO: 158990 - DNA, 20 bp, Artificial Sequence
  Description of Artificial Sequence: Synthetic oligonucleotide
  Target: ATXN1; (-) strand; PAM type: YTN; PAM sequence: TTA
gcaggtgctcggtgtatact

SEQ ID NO: 158991 - DNA, 20 bp, Artificial Sequence
  Description of Artificial Sequence: Synthetic oligonucleotide
  Target: ATXN1; (-) strand; PAM type: YTN; PAM sequence: CTT
agcaggtgctcggtgtatac

SEQ ID NO: 158992 - DNA, 20 bp, Artificial Sequence
  Description of Artificial Sequence: Synthetic oligonucleotide
  Target: ATXN1; (-) strand; PAM type: YTN; PAM sequence: CTA
acacttagcaggtgctcggt

SEQ ID NO: 158993 - DNA, 20 bp, Artificial Sequence
  Description of Artificial Sequence: Synthetic oligonucleotide
  Target: ATXN1; (-) strand; PAM type: YTN; PAM sequence: TTC
ctaacacttagcaggtgctc

SEQ ID NO: 158994 - DNA, 20 bp, Artificial Sequence
  Description of Artificial Sequence: Synthetic oligonucleotide
  Target: ATXN1; (-) strand; PAM type: YTN; PAM sequence: CTA
aggttcctaacacttagcag

SEQ ID NO: 158995 - DNA, 20 bp, Artificial Sequence
  Description of Artificial Sequence: Synthetic oligonucleotide
  Target: ATXN1; (-) strand; PAM type: YTN; PAM sequence: TTC
taaggttcctaacacttagc

SEQ ID NO: 158996 - DNA, 20 bp, Artificial Sequence
  Description of Artificial Sequence: Synthetic oligonucleotide
  Target: ATXN1; (-) strand; PAM type: YTN; PAM sequence: CTT
ctaaggttcctaacacttag

SEQ ID NO: 158997 - DNA, 20 bp, Artificial Sequence
  Description of Artificial Sequence: Synthetic oligonucleotide
  Target: ATXN1; (-) strand; PAM type: YTN; PAM sequence: CTC
ttctaaggttcctaacactt

SEQ ID NO: 158998 - DNA, 20 bp, Artificial Sequence
  Description of Artificial Sequence: Synthetic oligonucleotide
  Target: ATXN1; (-) strand; PAM type: YTN; PAM sequence: TTA
accaatagatactcttctaa

SEQ ID NO: 158999 - DNA, 20 bp, Artificial Sequence
  Description of Artificial Sequence: Synthetic oligonucleotide
  Target: ATXN1; (-) strand; PAM type: YTN; PAM sequence: CTT
aaccaatagatactcttcta

SEQ ID NO: 159000 - DNA, 20 bp, Artificial Sequence
  Description of Artificial Sequence: Synthetic oligonucleotide
  Target: ATXN1; (-) strand; PAM type: YTN; PAM sequence: CTA
ggtcttaaccaatagatact

SEQ ID NO: 159001 - DNA, 20 bp, Artificial Sequence
  Description of Artificial Sequence: Synthetic oligonucleotide
  Target: ATXN1; (-) strand; PAM type: YTN; PAM sequence: CTG
gtgggaggcaagaaactagg

SEQ ID NO: 159002 - DNA, 20 bp, Artificial Sequence
  Description of Artificial Sequence: Synthetic oligonucleotide
  Target: ATXN1; (-) strand; PAM type: YTN; PAM sequence: CTC
ctggtgggaggcaagaaact

SEQ ID NO: 159003 - DNA, 20 bp, Artificial Sequence
  Description of Artificial Sequence: Synthetic oligonucleotide
  Target: ATXN1; (-) strand; PAM type: YTN; PAM sequence: CTG
tctcctggtgggaggcaaga

SEQ ID NO: 159004 - DNA, 20 bp, Artificial Sequence
  Description of Artificial Sequence: Synthetic oligonucleotide
  Target: ATXN1; (-) strand; PAM type: YTN; PAM sequence: TTC
tgtctcctggtgggaggcaa

SEQ ID NO: 159005 - DNA, 20 bp, Artificial Sequence
  Description of Artificial Sequence: Synthetic oligonucleotide
  Target: ATXN1; (-) strand; PAM type: YTN; PAM sequence: TTG
cgtgtatgttctgtctcctg

SEQ ID NO: 159006 - DNA, 20 bp, Artificial Sequence
  Description of Artificial Sequence: Synthetic oligonucleotide
  Target: ATXN1; (-) strand; PAM type: YTN; PAM sequence: TTT
gcgtgtatgttctgtctcct

SEQ ID NO: 159007 - DNA, 20 bp, Artificial Sequence
  Description of Artificial Sequence: Synthetic oligonucleotide
  Target: ATXN1; (-) strand; PAM type: YTN; PAM sequence: TTT
tgcgtgtatgttctgtctcc

SEQ ID NO: 159008 - DNA, 20 bp, Artificial Sequence
  Description of Artificial Sequence: Synthetic oligonucleotide
  Target: ATXN1; (-) strand; PAM type: YTN; PAM sequence: CTG
gtgtccaaatgtacccgttt

SEQ ID NO: 159009 - DNA, 20 bp, Artificial Sequence
  Description of Artificial Sequence: Synthetic oligonucleotide
  Target: ATXN1; (-) strand; PAM type: YTN; PAM sequence: CTG
agtggacgtcatcggatagt

SEQ ID NO: 159010 - DNA, 20 bp, Artificial Sequence
  Description of Artificial Sequence: Synthetic oligonucleotide
  Target: ATXN1; (-) strand; PAM type: YTN; PAM sequence: TTC
gacatctgagtggacgtcat

SEQ ID NO: 159011 - DNA, 20 bp, Artificial Sequence
  Description of Artificial Sequence: Synthetic oligonucleotide
  Target: ATXN1; (-) strand; PAM type: YTN; PAM sequence: TTG
cccattcgacatctgagtgg

SEQ ID NO: 159012 - DNA, 20 bp, Artificial Sequence
  Description of Artificial Sequence: Synthetic oligonucleotide
  Target: ATXN1; (-) strand; PAM type: YTN; PAM sequence: TTG
agttgcccattcgacatctg

SEQ ID NO: 159013 - DNA, 20 bp, Artificial Sequence
  Description of Artificial Sequence: Synthetic oligonucleotide
  Target: ATXN1; (-) strand; PAM type: YTN; PAM sequence: TTT
gagttgcccattcgacatct

SEQ ID NO: 159014 - DNA, 20 bp, Artificial Sequence
  Description of Artificial Sequence: Synthetic oligonucleotide
  Target: ATXN1; (-) strand; PAM type: YTN; PAM sequence: TTA
agtttgagttgcccattcga

SEQ ID NO: 159015 - DNA, 20 bp, Artificial Sequence
  Description of Artificial Sequence: Synthetic oligonucleotide
  Target: ATXN1; (-) strand; PAM type: YTN; PAM sequence: TTT
aagtttgagttgcccattcg

SEQ ID NO: 159016 - DNA, 20 bp, Artificial Sequence
  Description of Artificial Sequence: Synthetic oligonucleotide
  Target: ATXN1; (-) strand; PAM type: YTN; PAM sequence: CTT
taagtttgagttgcccattc

SEQ ID NO: 159017 - DNA, 20 bp, Artificial Sequence
  Description of Artificial Sequence: Synthetic oligonucleotide
  Target: ATXN1; (-) strand; PAM type: YTN; PAM sequence: TTA
ggtcactttaagtttgagtt

SEQ ID NO: 159018 - DNA, 20 bp, Artificial Sequence
  Description of Artificial Sequence: Synthetic oligonucleotide
  Target: ATXN1; (-) strand; PAM type: YTN; PAM sequence: TTT
aggtcactttaagtttgagt

SEQ ID NO: 159019 - DNA, 20 bp, Artificial Sequence
  Description of Artificial Sequence: Synthetic oligonucleotide
  Target: ATXN1; (-) strand; PAM type: YTN; PAM sequence: TTT
taggtcactttaagtttgag

SEQ ID NO: 159020 - DNA, 20 bp, Artificial Sequence
  Description of Artificial Sequence: Synthetic oligonucleotide
  Target: ATXN1; (-) strand; PAM type: YTN; PAM sequence: CTG
gtgtgttttaggtcacttta

SEQ ID NO: 159021 - DNA, 20 bp, Artificial Sequence
  Description of Artificial Sequence: Synthetic oligonucleotide
  Target: ATXN1; (-) strand; PAM type: YTN; PAM sequence: TTA
tggagatggggaagaacatg

SEQ ID NO: 159022 - DNA, 20 bp, Artificial Sequence
  Description of Artificial Sequence: Synthetic oligonucleotide
  Target: ATXN1; (-) strand; PAM type: YTN; PAM sequence: TTT
atggagatggggaagaacat

SEQ ID NO: 159023 - DNA, 20 bp, Artificial Sequence
  Description of Artificial Sequence: Synthetic oligonucleotide
  Target: ATXN1; (-) strand; PAM type: YTN; PAM sequence: TTG
aacagccggaagaatgggat

SEQ ID NO: 159024 - DNA, 20 bp, Artificial Sequence
  Description of Artificial Sequence: Synthetic oligonucleotide
  Target: ATXN1; (-) strand; PAM type: YTN; PAM sequence: TTG
attgaacagccggaagaatg

SEQ ID NO: 159025 - DNA, 20 bp, Artificial Sequence
  Description of Artificial Sequence: Synthetic oligonucleotide
  Target: ATXN1; (-) strand; PAM type: YTN; PAM sequence: CTT
gattgaacagccggaagaat

SEQ ID NO: 159026 - DNA, 20 bp, Artificial Sequence
  Description of Artificial Sequence: Synthetic oligonucleotide
  Target: ATXN1; (-) strand; PAM type: YTN; PAM sequence: TTC
caaggtgcttgattgaacag

SEQ ID NO: 159027 - DNA, 20 bp, Artificial Sequence
  Description of Artificial Sequence: Synthetic oligonucleotide
  Target: ATXN1; (-) strand; PAM type: YTN; PAM sequence: TTG
tgatgtaagagaaagagcgg

SEQ ID NO: 159028 - DNA, 20 bp, Artificial Sequence
  Description of Artificial Sequence: Synthetic oligonucleotide
  Target: ATXN1; (-) strand; PAM type: YTN; PAM sequence: TTT
gtgatgtaagagaaagagcg

SEQ ID NO: 159029 - DNA, 20 bp, Artificial Sequence
  Description of Artificial Sequence: Synthetic oligonucleotide
  Target: ATXN1; (-) strand; PAM type: YTN; PAM sequence: TTG
ggatgtttgtgatgtaagag

SEQ ID NO: 159030 - DNA, 20 bp, Artificial Sequence
  Description of Artificial Sequence: Synthetic oligonucleotide
  Target: ATXN1; (-) strand; PAM type: YTN; PAM sequence: TTA
taattgggatgtttgtgatg

SEQ ID NO: 159031 - DNA, 20 bp, Artificial Sequence
  Description of Artificial Sequence: Synthetic oligonucleotide
  Target: ATXN1; (-) strand; PAM type: YTN; PAM sequence: CTT
ataattgggatgtttgtgat

SEQ ID NO: 159032 - DNA, 20 bp, Artificial Sequence
  Description of Artificial Sequence: Synthetic oligonucleotide
  Target: ATXN1; (-) strand; PAM type: YTN; PAM sequence: TTG
cttataattgggatgtttgt

SEQ ID NO: 159033 - DNA, 20 bp, Artificial Sequence
  Description of Artificial Sequence: Synthetic oligonucleotide
  Target: ATXN1; (-) strand; PAM type: YTN; PAM sequence: TTT
gcttataattgggatgtttg

SEQ ID NO: 159034 - DNA, 20 bp, Artificial Sequence
  Description of Artificial Sequence: Synthetic oligonucleotide
  Target: ATXN1; (-) strand; PAM type: YTN; PAM sequence: TTG
gaaaaggaacccatacagtt

SEQ ID NO: 159035 - DNA, 20 bp, Artificial Sequence
  Description of Artificial Sequence: Synthetic oligonucleotide
  Target: ATXN1; (-) strand; PAM type: YTN; PAM sequence: TTT
ggaaaaggaacccatacagt

SEQ ID NO: 159036 - DNA, 20 bp, Artificial Sequence
  Description of Artificial Sequence: Synthetic oligonucleotide
  Target: ATXN1; (-) strand; PAM type: YTN; PAM sequence: CTA
ggtgtatttggaaaaggaac

SEQ ID NO: 159037 - DNA, 20 bp, Artificial Sequence
  Description of Artificial Sequence: Synthetic oligonucleotide
  Target: ATXN1; (-) strand; PAM type: YTN; PAM sequence: TTC
taggtgtatttggaaaagga

SEQ ID NO: 159038 - DNA, 20 bp, Artificial Sequence
  Description of Artificial Sequence: Synthetic oligonucleotide
  Target: ATXN1; (-) strand; PAM type: YTN; PAM sequence: TTG
gccaggacaaaggtggtgga

SEQ ID NO: 159039 - DNA, 20 bp, Artificial Sequence
  Description of Artificial Sequence: Synthetic oligonucleotide
  Target: ATXN1; (-) strand; PAM type: YTN; PAM sequence: CTT
ggccaggacaaaggtggtgg

SEQ ID NO: 159040 - DNA, 20 bp, Artificial Sequence
  Description of Artificial Sequence: Synthetic oligonucleotide
  Target: ATXN1; (-) strand; PAM type: YTN; PAM sequence: TTG
catgtggtgaccgagcgagt

SEQ ID NO: 159041 - DNA, 20 bp, Artificial Sequence
  Description of Artificial Sequence: Synthetic oligonucleotide
  Target: ATXN1; (-) strand; PAM type: YTN; PAM sequence: CTT
gcatgtggtgaccgagcgag

SEQ ID NO: 159042 - DNA, 20 bp, Artificial Sequence
  Description of Artificial Sequence: Synthetic oligonucleotide
  Target: ATXN1; (-) strand; PAM type: YTN; PAM sequence: CTA
cagtgtagggagtaaggggc

SEQ ID NO: 159043 - DNA, 20 bp, Artificial Sequence
  Description of Artificial Sequence: Synthetic oligonucleotide
  Target: ATXN1; (-) strand; PAM type: YTN; PAM sequence: TTG
ctacagtgtagggagtaagg

SEQ ID NO: 159044 - DNA, 20 bp, Artificial Sequence
  Description of Artificial Sequence: Synthetic oligonucleotide
  Target: ATXN1; (-) strand; PAM type: YTN; PAM sequence: CTG
ttgctacagtgtagggagta

SEQ ID NO: 159045 - DNA, 20 bp, Artificial Sequence
  Description of Artificial Sequence: Synthetic oligonucleotide
  Target: ATXN1; (-) strand; PAM type: YTN; PAM sequence: TTA
aagaaccagcaaggagacca

SEQ ID NO: 159046 - DNA, 20 bp, Artificial Sequence
  Description of Artificial Sequence: Synthetic oligonucleotide
  Target: ATXN1; (-) strand; PAM type: YTN; PAM sequence: TTC
caaatgaatggagagagtag

SEQ ID NO: 159047 - DNA, 20 bp, Artificial Sequence
  Description of Artificial Sequence: Synthetic oligonucleotide
  Target: ATXN1; (-) strand; PAM type: YTN; PAM sequence: CTG
aaaaggacagtgggtggcaa

SEQ ID NO: 159048 - DNA, 20 bp, Artificial Sequence
  Description of Artificial Sequence: Synthetic oligonucleotide
  Target: ATXN1; (-) strand; PAM type: YTN; PAM sequence: CTC
tgaaaaggacagtgggtggc

SEQ ID NO: 159049 - DNA, 20 bp, Artificial Sequence
  Description of Artificial Sequence: Synthetic oligonucleotide
  Target: ATXN1; (-) strand; PAM type: YTN; PAM sequence: CTC
tctgaaaaggacagtgggtg

SEQ ID NO: 159050 - DNA, 20 bp, Artificial Sequence
  Description of Artificial Sequence: Synthetic oligonucleotide
  Target: ATXN1; (-) strand; PAM type: YTN; PAM sequence: TTC
tctctgaaaaggacagtggg

SEQ ID NO: 159051 - DNA, 20 bp, Artificial Sequence
  Description of Artificial Sequence: Synthetic oligonucleotide
  Target: ATXN1; (-) strand; PAM type: YTN; PAM sequence: CTG
tcaggggagttctctctgaa

SEQ ID NO: 159052 - DNA, 20 bp, Artificial Sequence
  Description of Artificial Sequence: Synthetic oligonucleotide
  Target: ATXN1; (-) strand; PAM type: YTN; PAM sequence: TTA
aatagaactgtcaggggagt

SEQ ID NO: 159053 - DNA, 20 bp, Artificial Sequence
  Description of Artificial Sequence: Synthetic oligonucleotide
  Target: ATXN1; (-) strand; PAM type: YTN; PAM sequence: TTT
aaatagaactgtcaggggag

SEQ ID NO: 159054 - DNA, 20 bp, Artificial Sequence
  Description of Artificial Sequence: Synthetic oligonucleotide
  Target: ATXN1; (-) strand; PAM type: YTN; PAM sequence: TTT
taaatagaactgtcagggga

SEQ ID NO: 159055 - DNA, 20 bp, Artificial Sequence
  Description of Artificial Sequence: Synthetic oligonucleotide
  Target: ATXN1; (-) strand; PAM type: YTN; PAM sequence: TTA
ttttaaatagaactgtcagg

SEQ ID NO: 159056 - DNA, 20 bp, Artificial Sequence
  Description of Artificial Sequence: Synthetic oligonucleotide
  Target: ATXN1; (-) strand; PAM type: YTN; PAM sequence: TTG
ttattttaaatagaactgtc

SEQ ID NO: 159057 - DNA, 20 bp, Artificial Sequence
  Description of Artificial Sequence: Synthetic oligonucleotide
  Target: ATXN1; (-) strand; PAM type: YTN; PAM sequence: CTA
gagggttgttattttaaata

SEQ ID NO: 159058 - DNA, 20 bp, Artificial Sequence
  Description of Artificial Sequence: Synthetic oligonucleotide
  Target: ATXN1; (-) strand; PAM type: YTN; PAM sequence: CTA
tggaaactagagggttgtta

SEQ ID NO: 159059 - DNA, 20 bp, Artificial Sequence
  Description of Artificial Sequence: Synthetic oligonucleotide
  Target: ATXN1; (-) strand; PAM type: YTN; PAM sequence: CTC
aaaataaaaaaaggaagcta

SEQ ID NO: 159060 - DNA, 20 bp, Artificial Sequence
  Description of Artificial Sequence: Synthetic oligonucleotide
  Target: ATXN1; (-) strand; PAM type: YTN; PAM sequence: CTA
tctcaaaataaaaaaaggaa

SEQ ID NO: 159061 - DNA, 20 bp, Artificial Sequence
  Description of Artificial Sequence: Synthetic oligonucleotide
  Target: ATXN1; (-) strand; PAM type: YTN; PAM sequence: CTG
ggcaacagaacaagacccta

SEQ ID NO: 159062 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcaacagaacaa

SEQ ID NO: 159063 - DNA, 20 bp, Artificial Sequence
  Description of Artificial Sequence: Synthetic oligonucleotide
  Target: ATXN1; (-) strand; PAM type: YTN; PAM sequence: CTG
tactccagcctgggcaacag

SEQ ID NO: 159064 - DNA, 20 bp, Artificial Sequence
  Description of Artificial Sequence: Synthetic oligonucleotide
  Target: ATXN1; (-) strand; PAM type: YTN; PAM sequence: CTA
ctgtactccagcctgggcaa

SEQ ID NO: 159065 - DNA, 20 bp, Artificial Sequence
  Description of Artificial Sequence: Synthetic oligonucleotide
  Target: ATXN1; (-) strand; PAM type: YTN; PAM sequence: CTG
cagtgagccatgatcatgct

SEQ ID NO: 159066 - DNA, 20 bp, Artificial Sequence
  Description of Artificial Sequence: Synthetic oligonucleotide
  Target: ATXN1; (-) strand; PAM type: YTN; PAM sequence: TTG
agcccacgaggtcaaggctg

SEQ ID NO: 159067 - DNA, 20 bp, Artificial Sequence
  Description of Artificial Sequence: Synthetic oligonucleotide
  Target: ATXN1; (-) strand; PAM type: YTN; PAM sequence: CTT
gagcccacgaggtcaaggct

SEQ ID NO: 159068 - DNA, 20 bp, Artificial Sequence
  Description of Artificial Sequence: Synthetic oligonucleotide
  Target: ATXN1; (-) strand; PAM type: YTN; PAM sequence: CTG
aggcaggaagatatcttgag

SEQ ID NO: 159069 - DNA, 20 bp, Artificial Sequence
  Description of Artificial Sequence: Synthetic oligonucleotide
  Target: ATXN1; (-) strand; PAM type: YTN; PAM sequence: CTC
aggcggctgaggcaggaaga

SEQ ID NO: 159070 - DNA, 20 bp, Artificial Sequence
  Description of Artificial Sequence: Synthetic oligonucleotide
  Target: ATXN1; (-) strand; PAM type: YTN; PAM sequence: CTA
ctcaggcggctgaggcagga

SEQ ID NO: 159071 - DNA, 20 bp, Artificial Sequence
  Description of Artificial Sequence: Synthetic oligonucleotide
  Target: ATXN1; (-) strand; PAM type: YTN; PAM sequence: CTG
gacatggtggtgcatgcatg

SEQ ID NO: 159072 - DNA, 20 bp, Artificial Sequence
  Description of Artificial Sequence: Synthetic oligonucleotide
  Target: ATXN1; (-) strand; PAM type: YTN; PAM sequence: TTA
gctggacatggtggtgcatg

SEQ ID NO: 159073 - DNA, 20 bp, Artificial Sequence
  Description of Artificial Sequence: Synthetic oligonucleotide
  Target: ATXN1; (-) strand; PAM type: YTN; PAM sequence: TTC
accaacaaaacattagctgg

SEQ ID NO: 159074 - DNA, 20 bp, Artificial Sequence
  Description of Artificial Sequence: Synthetic oligonucleotide
  Target: ATXN1; (-) strand; PAM type: YTN; PAM sequence: CTT
caccaacaaaacattagctg

SEQ ID NO: 159075 - DNA, 20 bp, Artificial Sequence
  Description of Artificial Sequence: Synthetic oligonucleotide
  Target: ATXN1; (-) strand; PAM type: YTN; PAM sequence: TTA
tcttcaccaacaaaacatta

SEQ ID NO: 159076 - DNA, 20 bp, Artificial Sequence
  Description of Artificial Sequence: Synthetic oligonucleotide
  Target: ATXN1; (-) strand; PAM type: YTN; PAM sequence: CTA
cataatgatcatcattatct

SEQ ID NO: 159077 - DNA, 20 bp, Artificial Sequence
  Description of Artificial Sequence: Synthetic oligonucleotide
  Target: ATXN1; (-) strand; PAM type: YTN; PAM sequence: CTC
tacataatgatcatcattat

SEQ ID NO: 159078 - DNA, 20 bp, Artificial Sequence
  Description of Artificial Sequence: Synthetic oligonucleotide
  Target: ATXN1; (-) strand; PAM type: YTN; PAM sequence: CTC
catctctacataatgatcat

SEQ ID NO: 159079 - DNA, 20 bp, Artificial Sequence
  Description of Artificial Sequence: Synthetic oligonucleotide
  Target: ATXN1; (-) strand; PAM type: YTN; PAM sequence: TTG
aaaccagccaggccaacata

SEQ ID NO: 159080 - DNA, 20 bp, Artificial Sequence
  Description of Artificial Sequence: Synthetic oligonucleotide
  Target: ATXN1; (-) strand; PAM type: YTN; PAM sequence: TTT
gaaaccagccaggccaacat

SEQ ID NO: 159081 - DNA, 20 bp, Artificial Sequence
  Description of Artificial Sequence: Synthetic oligonucleotide
  Target: ATXN1; (-) strand; PAM type: YTN; PAM sequence: TTT
tgaaaccagccaggccaaca

SEQ ID NO: 159082 - DNA, 20 bp, Artificial Sequence
  Description of Artificial Sequence: Synthetic oligonucleotide
  Target: ATXN1; (-) strand; PAM type: YTN; PAM sequence: TTG
aggccaggagttttgaaacc

SEQ ID NO: 159083 - DNA, 20 bp, Artificial Sequence
  Description of Artificial Sequence: Synthetic oligonucleotide
  Target: ATXN1; (-) strand; PAM type: YTN; PAM sequence: CTT
gaggccaggagttttgaaac

SEQ ID NO: 159084 - DNA, 20 bp, Artificial Sequence
  Description of Artificial Sequence: Synthetic oligonucleotide
  Target: ATXN1; (-) strand; PAM type: YTN; PAM sequence: CTG
aggcaagagggcacttgagg

SEQ ID NO: 159085 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaagagggc

SEQ ID NO: 159086 - DNA, 20 bp, Artificial Sequence
  Description of Artificial Sequence: Synthetic oligonucleotide
  Target: ATXN1; (-) strand; PAM type: YTN; PAM sequence: TTT
gggaggctgaggcaagaggg

SEQ ID NO: 159087 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgaggcaagagg

SEQ ID NO: 159088 - DNA, 20 bp, Artificial Sequence
  Description of Artificial Sequence: Synthetic oligonucleotide
  Target: ATXN1; (-) strand; PAM type: YTN; PAM sequence: CTC
agcactttgggaggctgagg

SEQ ID NO: 159089 - DNA, 20 bp, Artificial Sequence
  Description of Artificial Sequence: Synthetic oligonucleotide
  Target: ATXN1; (-) strand; PAM type: YTN; PAM sequence: TTG
taatctcagcactttgggag

SEQ ID NO: 159090 - DNA, 20 bp, Artificial Sequence
  Description of Artificial Sequence: Synthetic oligonucleotide
  Target: ATXN1; (-) strand; PAM type: YTN; PAM sequence: CTT
gtaatctcagcactttggga

SEQ ID NO: 159091 - DNA, 20 bp, Artificial Sequence
  Description of Artificial Sequence: Synthetic oligonucleotide
  Target: ATXN1; (-) strand; PAM type: YTN; PAM sequence: CTC
atgcttgtaatctcagcact

SEQ ID NO: 159092 - DNA, 20 bp, Artificial Sequence
  Description of Artificial Sequence: Synthetic oligonucleotide
  Target: ATXN1; (-) strand; PAM type: YTN; PAM sequence: CTA
ggtggctcatgcttgtaatc

SEQ ID NO: 159093 - DNA, 20 bp, Artificial Sequence
  Description of Artificial Sequence: Synthetic oligonucleotide
  Target: ATXN1; (-) strand; PAM type: YTN; PAM sequence: CTG
gtataaagaggagaaggggc

SEQ ID NO: 159094 - DNA, 20 bp, Artificial Sequence
  Description of Artificial Sequence: Synthetic oligonucleotide
  Target: ATXN1; (-) strand; PAM type: YTN; PAM sequence: TTG
gggatccctggtataaagag

SEQ ID NO: 159095 - DNA, 20 bp, Artificial Sequence
  Description of Artificial Sequence: Synthetic oligonucleotide
  Target: ATXN1; (-) strand; PAM type: YTN; PAM sequence: CTG
ggggttggggatccctggta

SEQ ID NO: 159096 - DNA, 20 bp, Artificial Sequence
  Description of Artificial Sequence: Synthetic oligonucleotide
  Target: ATXN1; (-) strand; PAM type: YTN; PAM sequence: TTG
cctgggggttggggatccct

SEQ ID NO: 159097 - DNA, 20 bp, Artificial Sequence
  Description of Artificial Sequence: Synthetic oligonucleotide
  Target: ATXN1; (-) strand; PAM type: YTN; PAM sequence: CTG
ttgcctgggggttggggatc

SEQ ID NO: 159098 - DNA, 20 bp, Artificial Sequence
  Description of Artificial Sequence: Synthetic oligonucleotide
  Target: ATXN1; (-) strand; PAM type: YTN; PAM sequence: CTG
gtctgttgcctgggggttgg

SEQ ID NO: 159099 - DNA, 20 bp, Artificial Sequence
  Description of Artificial Sequence: Synthetic oligonucleotide
  Target: ATXN1; (-) strand; PAM type: YTN; PAM sequence: CTA
ctggtctgttgcctgggggt

SEQ ID NO: 159100 - DNA, 20 bp, Artificial Sequence
  Description of Artificial Sequence: Synthetic oligonucleotide
  Target: ATXN1; (-) strand; PAM type: YTN; PAM sequence: CTG
ctactggtctgttgcctggg

SEQ ID NO: 159101 - DNA, 20 bp, Artificial Sequence
  Description of Artificial Sequence: Synthetic oligonucleotide
  Target: ATXN1; (-) strand; PAM type: YTN; PAM sequence: CTA
acaggccatggactgctact

SEQ ID NO: 159102 - DNA, 20 bp, Artificial Sequence
  Description of Artificial Sequence: Synthetic oligonucleotide
  Target: ATXN1; (-) strand; PAM type: YTN; PAM sequence: CTG
tgcagcccagtacctaacag

SEQ ID NO: 159103 - DNA, 20 bp, Artificial Sequence
  Description of Artificial Sequence: Synthetic oligonucleotide
  Target: ATXN1; (-) strand; PAM type: YTN; PAM sequence: CTC
cagctgtgcagcccagtacc

SEQ ID NO: 159104 - DNA, 20 bp, Artificial Sequence
  Description of Artificial Sequence: Synthetic oligonucleotide
  Target: ATXN1; (-) strand; PAM type: YTN; PAM sequence: CTC
acctccagctgtgcagccca

SEQ ID NO: 159105 - DNA, 20 bp, Artificial Sequence
  Description of Artificial Sequence: Synthetic oligonucleotide
  Target: ATXN1; (-) strand; PAM type: YTN; PAM sequence: TTG
ctcacctccagctgtgcagc

SEQ ID NO: 159106 - DNA, 20 bp, Artificial Sequence
  Description of Artificial Sequence: Synthetic oligonucleotide
  Target: ATXN1; (-) strand; PAM type: YTN; PAM sequence: CTG
gaatggttgctcacctccag

SEQ ID NO: 159107 - DNA, 20 bp, Artificial Sequence
  Description of Artificial Sequence: Synthetic oligonucleotide
  Target: ATXN1; (-) strand; PAM type: YTN; PAM sequence: CTC
agtctggaatggttgctcac

SEQ ID NO: 159108 - DNA, 20 bp, Artificial Sequence
  Description of Artificial Sequence: Synthetic oligonucleotide
  Target: ATXN1; (-) strand; PAM type: YTN; PAM sequence: CTG
acaggaggcggagctcagtc

SEQ ID NO: 159109 - DNA, 20 bp, Artificial Sequence
  Description of Artificial Sequence: Synthetic oligonucleotide
  Target: ATXN1; (-) strand; PAM type: YTN; PAM sequence: CTG
atctgacaggaggcggagct

SEQ ID NO: 159110 - DNA, 20 bp, Artificial Sequence
  Description of Artificial Sequence: Synthetic oligonucleotide
  Target: ATXN1; (-) strand; PAM type: YTN; PAM sequence: TTG
cgactgatctgacaggaggc

SEQ ID NO: 159111 - DNA, 20 bp, Artificial Sequence
  Description of Artificial Sequence: Synthetic oligonucleotide
  Target: ATXN1; (-) strand; PAM type: YTN; PAM sequence: CTT
gcgactgatctgacaggagg

SEQ ID NO: 159112 - DNA, 20 bp, Artificial Sequence
  Description of Artificial Sequence: Synthetic oligonucleotide
  Target: ATXN1; (-) strand; PAM type: YTN; PAM sequence: CTA
atgcttgcgactgatctgac

SEQ ID NO: 159113 - DNA, 20 bp, Artificial Sequence
  Description of Artificial Sequence: Synthetic oligonucleotide
  Target: ATXN1; (-) strand; PAM type: YTN; PAM sequence: CTA
tgagaatctaatgcttgcga

SEQ ID NO: 159114 - DNA, 20 bp, Artificial Sequence
  Description of Artificial Sequence: Synthetic oligonucleotide
  Target: ATXN1; (-) strand; PAM type: YTN; PAM sequence: CTC
ctatgagaatctaatgcttg

SEQ ID NO: 159115 - DNA, 20 bp, Artificial Sequence
  Description of Artificial Sequence: Synthetic oligonucleotide
  Target: ATXN1; (-) strand; PAM type: YTN; PAM sequence: TTC
acgctcctatgagaatctaa

SEQ ID NO: 159116 - DNA, 20 bp, Artificial Sequence
  Description of Artificial Sequence: Synthetic oligonucleotide
  Target: ATXN1; (-) strand; PAM type: YTN; PAM sequence: TTA
caatagggttcacgctccta

SEQ ID NO: 159117 - DNA, 20 bp, Artificial Sequence
  Description of Artificial Sequence: Synthetic oligonucleotide
  Target: ATXN1; (-) strand; PAM type: YTN; PAM sequence: TTT
acaatagggttcacgctcct

SEQ ID NO: 159118 - DNA, 20 bp, Artificial Sequence
  Description of Artificial Sequence: Synthetic oligonucleotide
  Target: ATXN1; (-) strand; PAM type: YTN; PAM sequence: TTG
catgcgcagtttacaatagg

SEQ ID NO: 159119 - DNA, 20 bp, Artificial Sequence
  Description of Artificial Sequence: Synthetic oligonucleotide
  Target: ATXN1; (-) strand; PAM type: YTN; PAM sequence: CTT
gcatgcgcagtttacaatag

SEQ ID NO: 159120 - DNA, 20 bp, Artificial Sequence
  Description of Artificial Sequence: Synthetic oligonucleotide
  Target: ATXN1; (-) strand; PAM type: YTN; PAM sequence: TTC
cttgcatgcgcagtttacaa

SEQ ID NO: 159121 - DNA, 20 bp, Artificial Sequence
  Description of Artificial Sequence: Synthetic oligonucleotide
  Target: ATXN1; (-) strand; PAM type: YTN; PAM sequence: CTG
gattccttgcatgcgcagtt

SEQ ID NO: 159122 - DNA, 20 bp, Artificial Sequence
  Description of Artificial Sequence: Synthetic oligonucleotide
  Target: ATXN1; (-) strand; PAM type: YTN; PAM sequence: CTC
ataaggagtgcacaacctgg

SEQ ID NO: 159123 - DNA, 20 bp, Artificial Sequence
  Description of Artificial Sequence: Synthetic oligonucleotide
  Target: ATXN1; (-) strand; PAM type: YTN; PAM sequence: TTC
tcataaggagtgcacaacct

SEQ ID NO: 159124 - DNA, 20 bp, Artificial Sequence
  Description of Artificial Sequence: Synthetic oligonucleotide
  Target: ATXN1; (-) strand; PAM type: YTN; PAM sequence: TTA
gattctcataaggagtgcac

SEQ ID NO: 159125 - DNA, 20 bp, Artificial Sequence
  Description of Artificial Sequence: Synthetic oligonucleotide
  Target: ATXN1; (-) strand; PAM type: YTN; PAM sequence: TTA
gttagattctcataaggagt

SEQ ID NO: 159126 - DNA, 20 bp, Artificial Sequence
  Description of Artificial Sequence: Synthetic oligonucleotide
  Target: ATXN1; (-) strand; PAM type: YTN; PAM sequence: CTC
agatcatcaggcattagtta

SEQ ID NO: 159127 - DNA, 20 bp, Artificial Sequence
  Description of Artificial Sequence: Synthetic oligonucleotide
  Target: ATXN1; (-) strand; PAM type: YTN; PAM sequence: TTC
cacctcagatcatcaggcat

SEQ ID NO: 159128 - DNA, 20 bp, Artificial Sequence
  Description of Artificial Sequence: Synthetic oligonucleotide
  Target: ATXN1; (-) strand; PAM type: YTN; PAM sequence: CTG
ttccacctcagatcatcagg

SEQ ID NO: 159129 - DNA, 20 bp, Artificial Sequence
  Description of Artificial Sequence: Synthetic oligonucleotide
  Target: ATXN1; (-) strand; PAM type: YTN; PAM sequence: TTG
ggatgaaactgttccacctc

SEQ ID NO: 159130 - DNA, 20 bp, Artificial Sequence
  Description of Artificial Sequence: Synthetic oligonucleotide
  Target: ATXN1; (-) strand; PAM type: YTN; PAM sequence: TTT
gggatgaaactgttccacct

SEQ ID NO: 159131 - DNA, 20 bp, Artificial Sequence
  Description of Artificial Sequence: Synthetic oligonucleotide
  Target: ATXN1; (-) strand; PAM type: YTN; PAM sequence: TTT
tgggatgaaactgttccacc

SEQ ID NO: 159132 - DNA, 20 bp, Artificial Sequence
  Description of Artificial Sequence: Synthetic oligonucleotide
  Target: ATXN1; (-) strand; PAM type: YTN; PAM sequence: TTG
gcaggatgggaagagggagg

SEQ ID NO: 159133 - DNA, 20 bp, Artificial Sequence
  Description of Artificial Sequence: Synthetic oligonucleotide
  Target: ATXN1; (-) strand; PAM type: YTN; PAM sequence: TTT
ggcaggatgggaagagggag

SEQ ID NO: 159134 - DNA, 20 bp, Artificial Sequence
  Description of Artificial Sequence: Synthetic oligonucleotide
  Target: ATXN1; (-) strand; PAM type: YTN; PAM sequence: TTT
tggcaggatgggaagaggga

SEQ ID NO: 159135 - DNA, 20 bp, Artificial Sequence
  Description of Artificial Sequence: Synthetic oligonucleotide
  Target: ATXN1; (-) strand; PAM type: YTN; PAM sequence: TTT
ttggcaggatgggaagaggg

SEQ ID NO: 159136 - DNA, 20 bp, Artificial Sequence
  Description of Artificial Sequence: Synthetic oligonucleotide
  Target: ATXN1; (-) strand; PAM type: YTN; PAM sequence: TTT
tttggcaggatgggaagagg

SEQ ID NO: 159137 - DNA, 20 bp, Artificial Sequence
  Description of Artificial Sequence: Synthetic oligonucleotide
  Target: ATXN1; (-) strand; PAM type: YTN; PAM sequence: TTC
atggaagaagattttttggc

SEQ ID NO: 159138 - DNA, 20 bp, Artificial Sequence
  Description of Artificial Sequence: Synthetic oligonucleotide
  Target: ATXN1; (-) strand; PAM type: YTN; PAM sequence: TTT
catggaagaagattttttgg

SEQ ID NO: 159139 - DNA, 20 bp, Artificial Sequence
  Description of Artificial Sequence: Synthetic oligonucleotide
  Target: ATXN1; (-) strand; PAM type: YTN; PAM sequence: CTG
gtttcatggaagaagatttt

SEQ ID NO: 159140 - DNA, 20 bp, Artificial Sequence
  Description of Artificial Sequence: Synthetic oligonucleotide
  Target: ATXN1; (-) strand; PAM type: YTN; PAM sequence: TTG
gcaccagggactggtttcat

SEQ ID NO: 159141 - DNA, 20 bp, Artificial Sequence
  Description of Artificial Sequence: Synthetic oligonucleotide
  Target: ATXN1; (-) strand; PAM type: YTN; PAM sequence: TTT
ggcaccagggactggtttca

SEQ ID NO: 159142 - DNA, 20 bp, Artificial Sequence
  Description of Artificial Sequence: Synthetic oligonucleotide
  Target: ATXN1; (-) strand; PAM type: YTN; PAM sequence: TTT
tggcaccagggactggtttc

SEQ ID NO: 159143 - DNA, 20 bp, Artificial Sequence
  Description of Artificial Sequence: Synthetic oligonucleotide
  Target: ATXN1; (-) strand; PAM type: YTN; PAM sequence: CTT
ttggcaccagggactggttt

SEQ ID NO: 159144 - DNA, 20 bp, Artificial Sequence
  Description of Artificial Sequence: Synthetic oligonucleotide
  Target: ATXN1; (-) strand; PAM type: YTN; PAM sequence: TTG
gggaaagaggcaaaacagac

SEQ ID NO: 159145 - DNA, 20 bp, Artificial Sequence
  Description of Artificial Sequence: Synthetic oligonucleotide
  Target: ATXN1; (-) strand; PAM type: YTN; PAM sequence: TTT
ggggaaagaggcaaaacaga

SEQ ID NO: 159146 - DNA, 20 bp, Artificial Sequence
  Description of Artificial Sequence: Synthetic oligonucleotide
  Target: ATXN1; (-) strand; PAM type: YTN; PAM sequence: CTG
agtttggggaaagaggcaaa

SEQ ID NO: 159147 - DNA, 20 bp, Artificial Sequence
  Description of Artificial Sequence: Synthetic oligonucleotide
  Target: ATXN1; (-) strand; PAM type: YTN; PAM sequence: CTG
gagatagaacactgagtttg

SEQ ID NO: 159148 - DNA, 20 bp, Artificial Sequence
  Description of Artificial Sequence: Synthetic oligonucleotide
  Target: ATXN1; (-) strand; PAM type: YTN; PAM sequence: CTC
tggagatagaacactgagtt

SEQ ID NO: 159149 - DNA, 20 bp, Artificial Sequence
  Description of Artificial Sequence: Synthetic oligonucleotide
  Target: ATXN1; (-) strand; PAM type: YTN; PAM sequence: TTA
gactctggagatagaacact

SEQ ID NO: 159150 - DNA, 20 bp, Artificial Sequence
  Description of Artificial Sequence: Synthetic oligonucleotide
  Target: ATXN1; (-) strand; PAM type: YTN; PAM sequence: TTT
agactctggagatagaacac

SEQ ID NO: 159151 - DNA, 20 bp, Artificial Sequence
  Description of Artificial Sequence: Synthetic oligonucleotide
  Target: ATXN1; (-) strand; PAM type: YTN; PAM sequence: TTT
tagactctggagatagaaca

SEQ ID NO: 159152 - DNA, 20 bp, Artificial Sequence
  Description of Artificial Sequence: Synthetic oligonucleotide
  Target: ATXN1; (-) strand; PAM type: YTN; PAM sequence: CTT
ttagactctggagatagaac

SEQ ID NO: 159153 - DNA, 20 bp, Artificial Sequence
  Description of Artificial Sequence: Synthetic oligonucleotide
  Target: ATXN1; (-) strand; PAM type: YTN; PAM sequence: CTA
ggaagtcttttagactctgg

SEQ ID NO: 159154 - DNA, 20 bp, Artificial Sequence
  Description of Artificial Sequence: Synthetic oligonucleotide
  Target: ATXN1; (-) strand; PAM type: YTN; PAM sequence: TTG
ctaggaagtcttttagactc

SEQ ID NO: 159155 - DNA, 20 bp, Artificial Sequence
  Description of Artificial Sequence: Synthetic oligonucleotide
  Target: ATXN1; (-) strand; PAM type: YTN; PAM sequence: CTT
gctaggaagtcttttagact

SEQ ID NO: 159156 - DNA, 20 bp, Artificial Sequence
  Description of Artificial Sequence: Synthetic oligonucleotide
  Target: ATXN1; (-) strand; PAM type: YTN; PAM sequence: TTA
cttgctaggaagtcttttag

SEQ ID NO: 159157 - DNA, 20 bp, Artificial Sequence
  Description of Artificial Sequence: Synthetic oligonucleotide
  Target: ATXN1; (-) strand; PAM type: YTN; PAM sequence: CTA
ttacttgctaggaagtcttt

SEQ ID NO: 159158 - DNA, 20 bp, Artificial Sequence
  Description of Artificial Sequence: Synthetic oligonucleotide
  Target: ATXN1; (-) strand; PAM type: YTN; PAM sequence: CTG
agcacctattacttgctagg

SEQ ID NO: 159159 - DNA, 20 bp, Artificial Sequence
  Description of Artificial Sequence: Synthetic oligonucleotide
  Target: ATXN1; (-) strand; PAM type: YTN; PAM sequence: TTA
actgagcacctattacttgc

SEQ ID NO: 159160 - DNA, 20 bp, Artificial Sequence
  Description of Artificial Sequence: Synthetic oligonucleotide
  Target: ATXN1; (-) strand; PAM type: YTN; PAM sequence: TTT
aactgagcacctattacttg

SEQ ID NO: 159161 - DNA, 20 bp, Artificial Sequence
  Description of Artificial Sequence: Synthetic oligonucleotide
  Target: ATXN1; (-) strand; PAM type: YTN; PAM sequence: TTT
taactgagcacctattactt

SEQ ID NO: 159162 - DNA, 20 bp, Artificial Sequence
  Description of Artificial Sequence: Synthetic oligonucleotide
  Target: ATXN1; (-) strand; PAM type: YTN; PAM sequence: TTC
agattttaactgagcaccta

SEQ ID NO: 159163 - DNA, 20 bp, Artificial Sequence
  Description of Artificial Sequence: Synthetic oligonucleotide
  Target: ATXN1; (-) strand; PAM type: YTN; PAM sequence: TTT
cagattttaactgagcacct

SEQ ID NO: 159164 - DNA, 20 bp, Artificial Sequence
  Description of Artificial Sequence: Synthetic oligonucleotide
  Target: ATXN1; (-) strand; PAM type: YTN; PAM sequence: CTT
tcagattttaactgagcacc

SEQ ID NO: 159165 - DNA, 20 bp, Artificial Sequence
  Description of Artificial Sequence: Synthetic oligonucleotide
  Target: ATXN1; (-) strand; PAM type: YTN; PAM sequence: TTC
tttcagattttaactgagca

SEQ ID NO: 159166 - DNA, 20 bp, Artificial Sequence
  Description of Artificial Sequence: Synthetic oligonucleotide
  Target: ATXN1; (-) strand; PAM type: YTN; PAM sequence: CTT
ctttcagattttaactgagc

SEQ ID NO: 159167 - DNA, 20 bp, Artificial Sequence
  Description of Artificial Sequence: Synthetic oligonucleotide
  Target: ATXN1; (-) strand; PAM type: YTN; PAM sequence: CTC
ttctttcagattttaactga

SEQ ID NO: 159168 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccaccatgcc

SEQ ID NO: 159169 - DNA, 20 bp, Artificial Sequence
  Description of Artificial Sequence: Synthetic oligonucleotide
  Target: ATXN1; (-) strand; PAM type: YTN; PAM sequence: CTC
ccaaagtggtgggattacag

SEQ ID NO: 159170 - DNA, 20 bp, Artificial Sequence
  Description of Artificial Sequence: Synthetic oligonucleotide
  Target: ATXN1; (-) strand; PAM type: YTN; PAM sequence: CTG
cctcccaaagtggtgggatt

SEQ ID NO: 159171 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaaagtggtggga

SEQ ID NO: 159172 - DNA, 20 bp, Artificial Sequence
  Description of Artificial Sequence: Synthetic oligonucleotide
  Target: ATXN1; (-) strand; PAM type: YTN; PAM sequence: CTC
atgatcagcccgcctctgcc

SEQ ID NO: 159173 - DNA, 20 bp, Artificial Sequence
  Description of Artificial Sequence: Synthetic oligonucleotide
  Target: ATXN1; (-) strand; PAM type: YTN; PAM sequence: CTG
acctcatgatcagcccgcct

SEQ ID NO: 159174 - DNA, 20 bp, Artificial Sequence
  Description of Artificial Sequence: Synthetic oligonucleotide
  Target: ATXN1; (-) strand; PAM type: YTN; PAM sequence: CTC
ctgacctcatgatcagcccg

SEQ ID NO: 159175 - DNA, 20 bp, Artificial Sequence
  Description of Artificial Sequence: Synthetic oligonucleotide
  Target: ATXN1; (-) strand; PAM type: YTN; PAM sequence: TTG
aactcctgacctcatgatca

SEQ ID NO: 159176 - DNA, 20 bp, Artificial Sequence
  Description of Artificial Sequence: Synthetic oligonucleotide
  Target: ATXN1; (-) strand; PAM type: YTN; PAM sequence: CTT
gaactcctgacctcatgatc

SEQ ID NO: 159177 - DNA, 20 bp, Artificial Sequence
  Description of Artificial Sequence: Synthetic oligonucleotide
  Target: ATXN1; (-) strand; PAM type: YTN; PAM sequence: CTG
gtcttgaactcctgacctca

SEQ ID NO: 159178 - DNA, 20 bp, Artificial Sequence
  Description of Artificial Sequence: Synthetic oligonucleotide
  Target: ATXN1; (-) strand; PAM type: YTN; PAM sequence: TTG
gtcaggctggtcttgaactc

SEQ ID NO: 159179 - DNA, 20 bp, Artificial Sequence
  Description of Artificial Sequence: Synthetic oligonucleotide
  Target: ATXN1; (-) strand; PAM type: YTN; PAM sequence: TTC
accatgttggtcaggctggt

SEQ ID NO: 159180 - DNA, 20 bp, Artificial Sequence
  Description of Artificial Sequence: Synthetic oligonucleotide
  Target: ATXN1; (-) strand; PAM type: YTN; PAM sequence: TTT
caccatgttggtcaggctgg

SEQ ID NO: 159181 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcacca

SEQ ID NO: 159182 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcacc

SEQ ID NO: 159183 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagggtttcac

SEQ ID NO: 159184 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagggtttca

SEQ ID NO: 159185 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacaggg

SEQ ID NO: 159186 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacagg

SEQ ID NO: 159187 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacag

SEQ ID NO: 159188 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagaca

SEQ ID NO: 159189 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttagtagagac

SEQ ID NO: 159190 - DNA, 20 bp, Artificial Sequence
  Description of Artificial Sequence: Synthetic oligonucleotide
  Target: ATXN1; (-) strand; PAM type: YTN; PAM sequence: TTT
ttttgtatttttagtagaga

SEQ ID NO: 159191 - DNA, 20 bp, Artificial Sequence
  Description of Artificial Sequence: Synthetic oligonucleotide
  Target: ATXN1; (-) strand; PAM type: YTN; PAM sequence: CTA
atttttttgtatttttagta

SEQ ID NO: 159192 - DNA, 20 bp, Artificial Sequence
  Description of Artificial Sequence: Synthetic oligonucleotide
  Target: ATXN1; (-) strand; PAM type: YTN; PAM sequence: CTG
gctaatttttttgtattttt

SEQ ID NO: 159193 - DNA, 20 bp, Artificial Sequence
  Description of Artificial Sequence: Synthetic oligonucleotide
  Target: ATXN1; (-) strand; PAM type: YTN; PAM sequence: CTC
ccacgcctggctaatttttt

SEQ ID NO: 159194 - DNA, 20 bp, Artificial Sequence
  Description of Artificial Sequence: Synthetic oligonucleotide
  Target: ATXN1; (-) strand; PAM type: YTN; PAM sequence: CTG
ctcccacgcctggctaattt

SEQ ID NO: 159195 - DNA, 20 bp, Artificial Sequence
  Description of Artificial Sequence: Synthetic oligonucleotide
  Target: ATXN1; (-) strand; PAM type: YTN; PAM sequence: TTA
caggcacctgctcccacgcc

SEQ ID NO: 159196 - DNA, 20 bp, Artificial Sequence
  Description of Artificial Sequence: Synthetic oligonucleotide
  Target: ATXN1; (-) strand; PAM type: YTN; PAM sequence: CTG
agattacaggcacctgctcc

SEQ ID NO: 159197 - DNA, 20 bp, Artificial Sequence
  Description of Artificial Sequence: Synthetic oligonucleotide
  Target: ATXN1; (-) strand; PAM type: YTN; PAM sequence: TTC
agagtagctgagattacagg

SEQ ID NO: 159198 - DNA, 20 bp, Artificial Sequence
  Description of Artificial Sequence: Synthetic oligonucleotide
  Target: ATXN1; (-) strand; PAM type: YTN; PAM sequence: CTT
cagagtagctgagattacag

SEQ ID NO: 159199 - DNA, 20 bp, Artificial Sequence
  Description of Artificial Sequence: Synthetic oligonucleotide
  Target: ATXN1; (-) strand; PAM type: YTN; PAM sequence: TTC
agccttcagagtagctgaga

SEQ ID NO: 159200 - DNA, 20 bp, Artificial Sequence
  Description of Artificial Sequence: Synthetic oligonucleotide
  Target: ATXN1; (-) strand; PAM type: YTN; PAM sequence: CTT
cagccttcagagtagctgag

SEQ ID NO: 159201 - DNA, 20 bp, Artificial Sequence
  Description of Artificial Sequence: Synthetic oligonucleotide
  Target: ATXN1; (-) strand; PAM type: YTN; PAM sequence: CTG
cttcagccttcagagtagct

SEQ ID NO: 159202 - DNA, 20 bp, Artificial Sequence
  Description of Artificial Sequence: Synthetic oligonucleotide
  Target: ATXN1; (-) strand; PAM type: YTN; PAM sequence: CTC
ctgcttcagccttcagagta

SEQ ID NO: 159203 - DNA, 20 bp, Artificial Sequence
  Description of Artificial Sequence: Synthetic oligonucleotide
  Target: ATXN1; (-) strand; PAM type: YTN; PAM sequence: TTC
tcctgcttcagccttcagag

SEQ ID NO: 159204 - DNA, 20 bp, Artificial Sequence
  Description of Artificial Sequence: Synthetic oligonucleotide
  Target: ATXN1; (-) strand; PAM type: YTN; PAM sequence: TTC
aagcaattctcctgcttcag

SEQ ID NO: 159205 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagcaattctcc

SEQ ID NO: 159206 - DNA, 20 bp, Artificial Sequence
  Description of Artificial Sequence: Synthetic oligonucleotide
  Target: ATXN1; (-) strand; PAM type: YTN; PAM sequence: CTC
cgcctcccaggttcaagcaa

SEQ ID NO: 159207 - DNA, 20 bp, Artificial Sequence
  Description of Artificial Sequence: Synthetic oligonucleotide
  Target: ATXN1; (-) strand; PAM type: YTN; PAM sequence: CTG
caacctccgcctcccaggtt

SEQ ID NO: 159208 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccgcctccca

SEQ ID NO: 159209 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacctccgcct

SEQ ID NO: 159210 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaacctccgcc

SEQ ID NO: 159211 - DNA, 20 bp, Artificial Sequence
  Description of Artificial Sequence: Synthetic oligonucleotide
  Target: ATXN1; (-) strand; PAM type: YTN; PAM sequence: CTG
gggtgcaatggcgtgatctt

SEQ ID NO: 159212 - DNA, 20 bp, Artificial Sequence
  Description of Artificial Sequence: Synthetic oligonucleotide
  Target: ATXN1; (-) strand; PAM type: YTN; PAM sequence: CTG
ggctggggtgcaatggcgtg

SEQ ID NO: 159213 - DNA, 20 bp, Artificial Sequence
  Description of Artificial Sequence: Synthetic oligonucleotide
  Target: ATXN1; (-) strand; PAM type: YTN; PAM sequence: CTG
tcacctgggctggggtgcaa

SEQ ID NO: 159214 - DNA, 20 bp, Artificial Sequence
  Description of Artificial Sequence: Synthetic oligonucleotide
  Target: ATXN1; (-) strand; PAM type: YTN; PAM sequence: TTG
cactgtcacctgggctgggg

SEQ ID NO: 159215 - DNA, 20 bp, Artificial Sequence
  Description of Artificial Sequence: Synthetic oligonucleotide
  Target: ATXN1; (-) strand; PAM type: YTN; PAM sequence: CTT
gcactgtcacctgggctggg

SEQ ID NO: 159216 - DNA, 20 bp, Artificial Sequence
  Description of Artificial Sequence: Synthetic oligonucleotide
  Target: ATXN1; (-) strand; PAM type: YTN; PAM sequence: TTA
agacggagtcttgcactgtc

SEQ ID NO: 159217 - DNA, 20 bp, Artificial Sequence
  Description of Artificial Sequence: Synthetic oligonucleotide
  Target: ATXN1; (-) strand; PAM type: YTN; PAM sequence: TTT
aagacggagtcttgcactgt

SEQ ID NO: 159218 - DNA, 20 bp, Artificial Sequence
  Description of Artificial Sequence: Synthetic oligonucleotide
  Target: ATXN1; (-) strand; PAM type: YTN; PAM sequence: TTT
taagacggagtcttgcactg

SEQ ID NO: 159219 - DNA, 20 bp, Artificial Sequence
  Description of Artificial Sequence: Synthetic oligonucleotide
  Target: ATXN1; (-) strand; PAM type: YTN; PAM sequence: TTT
ttaagacggagtcttgcact

SEQ ID NO: 159220 - DNA, 20 bp, Artificial Sequence
  Description of Artificial Sequence: Synthetic oligonucleotide
  Target: ATXN1; (-) strand; PAM type: YTN; PAM sequence: TTT
tttaagacggagtcttgcac

SEQ ID NO: 159221 - DNA, 20 bp, Artificial Sequence
  Description of Artificial Sequence: Synthetic oligonucleotide
  Target: ATXN1; (-) strand; PAM type: YTN; PAM sequence: TTT
ttttaagacggagtcttgca

SEQ ID NO: 159222 - DNA, 20 bp, Artificial Sequence
  Description of Artificial Sequence: Synthetic oligonucleotide
  Target: ATXN1; (-) strand; PAM type: YTN; PAM sequence: TTT
tttttaagacggagtcttgc

SEQ ID NO: 159223 - DNA, 20 bp, Artificial Sequence
  Description of Artificial Sequence: Synthetic oligonucleotide
  Target: ATXN1; (-) strand; PAM type: YTN; PAM sequence: TTG
ttttttttaagacggagtct

SEQ ID NO: 159224 - DNA, 20 bp, Artificial Sequence
  Description of Artificial Sequence: Synthetic oligonucleotide
  Target: ATXN1; (-) strand; PAM type: YTN; PAM sequence: TTT
gttttttttaagacggagtc

SEQ ID NO: 159225 - DNA, 20 bp, Artificial Sequence
  Description of Artificial Sequence: Synthetic oligonucleotide
  Target: ATXN1; (-) strand; PAM type: YTN; PAM sequence: TTT
tgttttttttaagacggagt

SEQ ID NO: 159226 - DNA, 20 bp, Artificial Sequence
  Description of Artificial Sequence: Synthetic oligonucleotide
  Target: ATXN1; (-) strand; PAM type: YTN; PAM sequence: TTT
ttgttttttttaagacggag

SEQ ID NO: 159227 - DNA, 20 bp, Artificial Sequence
  Description of Artificial Sequence: Synthetic oligonucleotide
  Target: ATXN1; (-) strand; PAM type: YTN; PAM sequence: TTG
tttttgttttttttaagacg

SEQ ID NO: 159228 - DNA, 20 bp, Artificial Sequence
  Description of Artificial Sequence: Synthetic oligonucleotide
  Target: ATXN1; (-) strand; PAM type: YTN; PAM sequence: TTT
gtttttgttttttttaagac

SEQ ID NO: 159229 - DNA, 20 bp, Artificial Sequence
  Description of Artificial Sequence: Synthetic oligonucleotide
  Target: ATXN1; (-) strand; PAM type: YTN; PAM sequence: TTT
tgtttttgttttttttaaga

SEQ ID NO: 159230 - DNA, 20 bp, Artificial Sequence
  Description of Artificial Sequence: Synthetic oligonucleotide
  Target: ATXN1; (-) strand; PAM type: YTN; PAM sequence: TTG
ttttgtttttgtttttttta

SEQ ID NO: 159231 - DNA, 20 bp, Artificial Sequence
  Description of Artificial Sequence: Synthetic oligonucleotide
  Target: ATXN1; (-) strand; PAM type: YTN; PAM sequence: TTT
gttttgtttttgtttttttt

SEQ ID NO: 159232 - DNA, 20 bp, Artificial Sequence
  Description of Artificial Sequence: Synthetic oligonucleotide
  Target: ATXN1; (-) strand; PAM type: YTN; PAM sequence: TTT
tgttttgtttttgttttttt

SEQ ID NO: 159233 - DNA, 20 bp, Artificial Sequence
  Description of Artificial Sequence: Synthetic oligonucleotide
  Target: ATXN1; (-) strand; PAM type: YTN; PAM sequence: TTT
ttgttttgtttttgtttttt

SEQ ID NO: 159234 - DNA, 20 bp, Artificial Sequence
  Description of Artificial Sequence: Synthetic oligonucleotide
  Target: ATXN1; (-) strand; PAM type: YTN; PAM sequence: TTT
tttgttttgtttttgttttt

SEQ ID NO: 159235 - DNA, 20 bp, Artificial Sequence
  Description of Artificial Sequence: Synthetic oligonucleotide
  Target: ATXN1; (-) strand; PAM type: YTN; PAM sequence: TTT
ttttgttttgtttttgtttt

SEQ ID NO: 159236 - DNA, 20 bp, Artificial Sequence
  Description of Artificial Sequence: Synthetic oligonucleotide
  Target: ATXN1; (-) strand; PAM type: YTN; PAM sequence: TTT
tttttgttttgtttttgttt

SEQ ID NO: 159237 - DNA, 20 bp, Artificial Sequence
  Description of Artificial Sequence: Synthetic oligonucleotide
  Target: ATXN1; (-) strand; PAM type: YTN; PAM sequence: TTT
ttttttgttttgtttttgtt

SEQ ID NO: 159238 - DNA, 20 bp, Artificial Sequence
  Description of Artificial Sequence: Synthetic oligonucleotide
  Target: ATXN1; (-) strand; PAM type: YTN; PAM sequence: TTT
tttttttgttttgtttttgt

SEQ ID NO: 159239 - DNA, 20 bp, Artificial Sequence
  Description of Artificial Sequence: Synthetic oligonucleotide
  Target: ATXN1; (-) strand; PAM type: YTN; PAM sequence: TTC
agttttttttttgttttgtt

SEQ ID NO: 159240 - DNA, 20 bp, Artificial Sequence
  Description of Artificial Sequence: Synthetic oligonucleotide
  Target: ATXN1; (-) strand; PAM type: YTN; PAM sequence: TTT
cagttttttttttgttttgt

SEQ ID NO: 159241 - DNA, 20 bp, Artificial Sequence
  Description of Artificial Sequence: Synthetic oligonucleotide
  Target: ATXN1; (-) strand; PAM type: YTN; PAM sequence: CTT
tcagttttttttttgttttg

SEQ ID NO: 159242 - DNA, 20 bp, Artificial Sequence
  Description of Artificial Sequence: Synthetic oligonucleotide
  Target: ATXN1; (-) strand; PAM type: YTN; PAM sequence: TTC
tttcagttttttttttgttt

SEQ ID NO: 159243 - DNA, 20 bp, Artificial Sequence
  Description of Artificial Sequence: Synthetic oligonucleotide
  Target: ATXN1; (-) strand; PAM type: YTN; PAM sequence: CTA
ttctttcagttttttttttg

SEQ ID NO: 159244 - DNA, 20 bp, Artificial Sequence
  Description of Artificial Sequence: Synthetic oligonucleotide
  Target: ATXN1; (-) strand; PAM type: YTN; PAM sequence: TTC
catacagaaggcaaacagaa

SEQ ID NO: 159245 - DNA, 20 bp, Artificial Sequence
  Description of Artificial Sequence: Synthetic oligonucleotide
  Target: ATXN1; (-) strand; PAM type: YTN; PAM sequence: TTT
ccatacagaaggcaaacaga

SEQ ID NO: 159246 - DNA, 20 bp, Artificial Sequence
  Description of Artificial Sequence: Synthetic oligonucleotide
  Target: ATXN1; (-) strand; PAM type: YTN; PAM sequence: TTT
tccatacagaaggcaaacag

SEQ ID NO: 159247 - DNA, 20 bp, Artificial Sequence
  Description of Artificial Sequence: Synthetic oligonucleotide
  Target: ATXN1; (-) strand; PAM type: YTN; PAM sequence: TTT
ttccatacagaaggcaaaca

SEQ ID NO: 159248 - DNA, 20 bp, Artificial Sequence
  Description of Artificial Sequence: Synthetic oligonucleotide
  Target: ATXN1; (-) strand; PAM type: YTN; PAM sequence: TTG
caatgtttttccatacagaa

SEQ ID NO: 159249 - DNA, 20 bp, Artificial Sequence
  Description of Artificial Sequence: Synthetic oligonucleotide
  Target: ATXN1; (-) strand; PAM type: YTN; PAM sequence: TTG
taccattgcaatgtttttcc

SEQ ID NO: 159250 - DNA, 20 bp, Artificial Sequence
  Description of Artificial Sequence: Synthetic oligonucleotide
  Target: ATXN1; (-) strand; PAM type: YTN; PAM sequence: CTT
gtaccattgcaatgtttttc

SEQ ID NO: 159251 - DNA, 20 bp, Artificial Sequence
  Description of Artificial Sequence: Synthetic oligonucleotide
  Target: ATXN1; (-) strand; PAM type: YTN; PAM sequence: TTG
tccacttgtaccattgcaat

SEQ ID NO: 159252 - DNA, 20 bp, Artificial Sequence
  Description of Artificial Sequence: Synthetic oligonucleotide
  Target: ATXN1; (-) strand; PAM type: YTN; PAM sequence: CTG
ttgtccacttgtaccattgc

SEQ ID NO: 159253 - DNA, 20 bp, Artificial Sequence
  Description of Artificial Sequence: Synthetic oligonucleotide
  Target: ATXN1; (-) strand; PAM type: YTN; PAM sequence: TTG
ccccctgttgtccacttgta

SEQ ID NO: 159254 - DNA, 20 bp, Artificial Sequence
  Description of Artificial Sequence: Synthetic oligonucleotide
  Target: ATXN1; (-) strand; PAM type: YTN; PAM sequence: CTA
ttgccccctgttgtccactt

SEQ ID NO: 159255 - DNA, 20 bp, Artificial Sequence
  Description of Artificial Sequence: Synthetic oligonucleotide
  Target: ATXN1; (-) strand; PAM type: YTN; PAM sequence: CTC
tattgccccctgttgtccac

SEQ ID NO: 159256 - DNA, 20 bp, Artificial Sequence
  Description of Artificial Sequence: Synthetic oligonucleotide
  Target: ATXN1; (-) strand; PAM type: YTN; PAM sequence: CTC
tctattgccccctgttgtcc

SEQ ID NO: 159257 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaaaaaaaaaaaaa

SEQ ID NO: 159258 - DNA, 20 bp, Artificial Sequence
  Description of Artificial Sequence: Synthetic oligonucleotide
  Target: ATXN1; (-) strand; PAM type: YTN; PAM sequence: CTG
gttaaaaaaaaaaaaaaaaa

SEQ ID NO: 159259 - DNA, 20 bp, Artificial Sequence
  Description of Artificial Sequence: Synthetic oligonucleotide
  Target: ATXN1; (-) strand; PAM type: YTN; PAM sequence: CTG
gctggttaaaaaaaaaaaaa

SEQ ID NO: 159260 - DNA, 20 bp, Artificial Sequence
  Description of Artificial Sequence: Synthetic oligonucleotide
  Target: ATXN1; (-) strand; PAM type: YTN; PAM sequence: TTC
tggctggttaaaaaaaaaaa

SEQ ID NO: 159261 - DNA, 20 bp, Artificial Sequence
  Description of Artificial Sequence: Synthetic oligonucleotide
  Target: ATXN1; (-) strand; PAM type: YTN; PAM sequence: TTA
gttctggctggttaaaaaaa

SEQ ID NO: 159262 - DNA, 20 bp, Artificial Sequence
  Description of Artificial Sequence: Synthetic oligonucleotide
  Target: ATXN1; (-) strand; PAM type: YTN; PAM sequence: TTT
agttctggctggttaaaaaa

SEQ ID NO: 159263 - DNA, 20 bp, Artificial Sequence
  Description of Artificial Sequence: Synthetic oligonucleotide
  Target: ATXN1; (-) strand; PAM type: YTN; PAM sequence: CTT
tagttctggctggttaaaaa

SEQ ID NO: 159264 - DNA, 20 bp, Artificial Sequence
  Description of Artificial Sequence: Synthetic oligonucleotide
  Target: ATXN1; (-) strand; PAM type: YTN; PAM sequence: CTG
ggggaggtcacagcccactt

SEQ ID NO: 159265 - DNA, 20 bp, Artificial Sequence
  Description of Artificial Sequence: Synthetic oligonucleotide
  Target: ATXN1; (-) strand; PAM type: YTN; PAM sequence: CTC
cctgggggaggtcacagccc

SEQ ID NO: 159266 - DNA, 20 bp, Artificial Sequence
  Description of Artificial Sequence: Synthetic oligonucleotide
  Target: ATXN1; (-) strand; PAM type: YTN; PAM sequence: CTC
tccctgggggaggtcacagc

SEQ ID NO: 159267 - DNA, 20 bp, Artificial Sequence
  Description of Artificial Sequence: Synthetic oligonucleotide
  Target: ATXN1; (-) strand; PAM type: YTN; PAM sequence: CTC
ctctccctgggggaggtcac

SEQ ID NO: 159268 - DNA, 20 bp, Artificial Sequence
  Description of Artificial Sequence: Synthetic oligonucleotide
  Target: ATXN1; (-) strand; PAM type: YTN; PAM sequence: CTG
ctcctctccctgggggaggt

SEQ ID NO: 159269 - DNA, 20 bp, Artificial Sequence
  Description of Artificial Sequence: Synthetic oligonucleotide
  Target: ATXN1; (-) strand; PAM type: YTN; PAM sequence: CTG
gagaaagcactgctcctctc

SEQ ID NO: 159270 - DNA, 20 bp, Artificial Sequence
  Description of Artificial Sequence: Synthetic oligonucleotide
  Target: ATXN1; (-) strand; PAM type: YTN; PAM sequence: TTA
ggcggtaaagccacaccctg

SEQ ID NO: 159271 - DNA, 20 bp, Artificial Sequence
  Description of Artificial Sequence: Synthetic oligonucleotide
  Target: ATXN1; (-) strand; PAM type: YTN; PAM sequence: CTG
ttaggcggtaaagccacacc

SEQ ID NO: 159272 - DNA, 20 bp, Artificial Sequence
  Description of Artificial Sequence: Synthetic oligonucleotide
  Target: ATXN1; (-) strand; PAM type: YTN; PAM sequence: CTG
cctgttaggcggtaaagcca

SEQ ID NO: 159273 - DNA, 20 bp, Artificial Sequence
  Description of Artificial Sequence: Synthetic oligonucleotide
  Target: ATXN1; (-) strand; PAM type: YTN; PAM sequence: CTG
agaaagctgcctgttaggcg

SEQ ID NO: 159274 - DNA, 20 bp, Artificial Sequence
  Description of Artificial Sequence: Synthetic oligonucleotide
  Target: ATXN1; (-) strand; PAM type: YTN; PAM sequence: CTC
cgctgagaaagctgcctgtt

SEQ ID NO: 159275 - DNA, 20 bp, Artificial Sequence
  Description of Artificial Sequence: Synthetic oligonucleotide
  Target: ATXN1; (-) strand; PAM type: YTN; PAM sequence: CTA
tggctccgctgagaaagctg

SEQ ID NO: 159276 - DNA, 20 bp, Artificial Sequence
  Description of Artificial Sequence: Synthetic oligonucleotide
  Target: ATXN1; (-) strand; PAM type: YTN; PAM sequence: CTG
acaaggtgaggtggctatgg

SEQ ID NO: 159277 - DNA, 20 bp, Artificial Sequence
  Description of Artificial Sequence: Synthetic oligonucleotide
  Target: ATXN1; (-) strand; PAM type: YTN; PAM sequence: CTC
agcatctgacaaggtgaggt

SEQ ID NO: 159278 - DNA, 20 bp, Artificial Sequence
  Description of Artificial Sequence: Synthetic oligonucleotide
  Target: ATXN1; (-) strand; PAM type: YTN; PAM sequence: TTC
aataaaatcatgacgacctc

SEQ ID NO: 159279 - DNA, 20 bp, Artificial Sequence
  Description of Artificial Sequence: Synthetic oligonucleotide
  Target: ATXN1; (-) strand; PAM type: YTN; PAM sequence: CTG
aagtgtgattcaataaaatc

SEQ ID NO: 159280 - DNA, 20 bp, Artificial Sequence
  Description of Artificial Sequence: Synthetic oligonucleotide
  Target: ATXN1; (-) strand; PAM type: YTN; PAM sequence: CTG
caagaacgagagtggagaga

SEQ ID NO: 159281 - DNA, 20 bp, Artificial Sequence
  Description of Artificial Sequence: Synthetic oligonucleotide
  Target: ATXN1; (-) strand; PAM type: YTN; PAM sequence: CTA
acacagctgcaagaacgaga

SEQ ID NO: 159282 - DNA, 20 bp, Artificial Sequence
  Description of Artificial Sequence: Synthetic oligonucleotide
  Target: ATXN1; (-) strand; PAM type: YTN; PAM sequence: TTA
ctaacacagctgcaagaacg

SEQ ID NO: 159283 - DNA, 20 bp, Artificial Sequence
  Description of Artificial Sequence: Synthetic oligonucleotide
  Target: ATXN1; (-) strand; PAM type: YTN; PAM sequence: TTA
atgattactaacacagctgc

SEQ ID NO: 159284 - DNA, 20 bp, Artificial Sequence
  Description of Artificial Sequence: Synthetic oligonucleotide
  Target: ATXN1; (-) strand; PAM type: YTN; PAM sequence: CTT
aatgattactaacacagctg

SEQ ID NO: 159285 - DNA, 20 bp, Artificial Sequence
  Description of Artificial Sequence: Synthetic oligonucleotide
  Target: ATXN1; (-) strand; PAM type: YTN; PAM sequence: CTG
gaaaatgtgtggaaccccag

SEQ ID NO: 159286 - DNA, 20 bp, Artificial Sequence
  Description of Artificial Sequence: Synthetic oligonucleotide
  Target: ATXN1; (-) strand; PAM type: YTN; PAM sequence: TTC
tggaaaatgtgtggaacccc

SEQ ID NO: 159287 - DNA, 20 bp, Artificial Sequence
  Description of Artificial Sequence: Synthetic oligonucleotide
  Target: ATXN1; (-) strand; PAM type: YTN; PAM sequence: TTA
atcagaaaccattctggaaa

SEQ ID NO: 159288 - DNA, 20 bp, Artificial Sequence
  Description of Artificial Sequence: Synthetic oligonucleotide
  Target: ATXN1; (-) strand; PAM type: YTN; PAM sequence: TTT
aatcagaaaccattctggaa

SEQ ID NO: 159289 - DNA, 20 bp, Artificial Sequence
  Description of Artificial Sequence: Synthetic oligonucleotide
  Target: ATXN1; (-) strand; PAM type: YTN; PAM sequence: TTG
ggatttaatcagaaaccatt

SEQ ID NO: 159290 - DNA, 20 bp, Artificial Sequence
  Description of Artificial Sequence: Synthetic oligonucleotide
  Target: ATXN1; (-) strand; PAM type: YTN; PAM sequence: TTC
attgggatttaatcagaaac

SEQ ID NO: 159291 - DNA, 20 bp, Artificial Sequence
  Description of Artificial Sequence: Synthetic oligonucleotide
  Target: ATXN1; (-) strand; PAM type: YTN; PAM sequence: TTT
cattgggatttaatcagaaa

SEQ ID NO: 159292 - DNA, 20 bp, Artificial Sequence
  Description of Artificial Sequence: Synthetic oligonucleotide
  Target: ATXN1; (-) strand; PAM type: YTN; PAM sequence: TTT
tcattgggatttaatcagaa

SEQ ID NO: 159293 - DNA, 20 bp, Artificial Sequence
  Description of Artificial Sequence: Synthetic oligonucleotide
  Target: ATXN1; (-) strand; PAM type: YTN; PAM sequence: TTA
ttttcattgggatttaatca

SEQ ID NO: 159294 - DNA, 20 bp, Artificial Sequence
  Description of Artificial Sequence: Synthetic oligonucleotide
  Target: ATXN1; (-) strand; PAM type: YTN; PAM sequence: TTT
attttcattgggatttaatc

SEQ ID NO: 159295 - DNA, 20 bp, Artificial Sequence
  Description of Artificial Sequence: Synthetic oligonucleotide
  Target: ATXN1; (-) strand; PAM type: YTN; PAM sequence: CTC
ccatgagtttattttcattg

SEQ ID NO: 159296 - DNA, 20 bp, Artificial Sequence
  Description of Artificial Sequence: Synthetic oligonucleotide
  Target: ATXN1; (-) strand; PAM type: YTN; PAM sequence: CTG
ctcccatgagtttattttca

SEQ ID NO: 159297 - DNA, 20 bp, Artificial Sequence
  Description of Artificial Sequence: Synthetic oligonucleotide
  Target: ATXN1; (-) strand; PAM type: YTN; PAM sequence: CTG
tggtactgctcccatgagtt

SEQ ID NO: 159298 - DNA, 20 bp, Artificial Sequence
  Description of Artificial Sequence: Synthetic oligonucleotide
  Target: ATXN1; (-) strand; PAM type: YTN; PAM sequence: TTA
tctgtggtactgctcccatg

SEQ ID NO: 159299 - DNA, 20 bp, Artificial Sequence
  Description of Artificial Sequence: Synthetic oligonucleotide
  Target: ATXN1; (-) strand; PAM type: YTN; PAM sequence: TTG
gttatctgtggtactgctcc

SEQ ID NO: 159300 - DNA, 20 bp, Artificial Sequence
  Description of Artificial Sequence: Synthetic oligonucleotide
  Target: ATXN1; (-) strand; PAM type: YTN; PAM sequence: TTT
ggttatctgtggtactgctc

SEQ ID NO: 159301 - DNA, 20 bp, Artificial Sequence
  Description of Artificial Sequence: Synthetic oligonucleotide
  Target: ATXN1; (-) strand; PAM type: YTN; PAM sequence: CTT
tggttatctgtggtactgct

SEQ ID NO: 159302 - DNA, 20 bp, Artificial Sequence
  Description of Artificial Sequence: Synthetic oligonucleotide
  Target: ATXN1; (-) strand; PAM type: YTN; PAM sequence: TTA
tgtaacgtgctttggttatc

SEQ ID NO: 159303 - DNA, 20 bp, Artificial Sequence
  Description of Artificial Sequence: Synthetic oligonucleotide
  Target: ATXN1; (-) strand; PAM type: YTN; PAM sequence: CTG
gcgttatgtaacgtgctttg

SEQ ID NO: 159304 - DNA, 20 bp, Artificial Sequence
  Description of Artificial Sequence: Synthetic oligonucleotide
  Target: ATXN1; (-) strand; PAM type: YTN; PAM sequence: CTG
tctggcgttatgtaacgtgc

SEQ ID NO: 159305 - DNA, 20 bp, Artificial Sequence
  Description of Artificial Sequence: Synthetic oligonucleotide
  Target: ATXN1; (-) strand; PAM type: YTN; PAM sequence: TTG
agctgtctggcgttatgtaa

SEQ ID NO: 159306 - DNA, 20 bp, Artificial Sequence
  Description of Artificial Sequence: Synthetic oligonucleotide
  Target: ATXN1; (-) strand; PAM type: YTN; PAM sequence: CTA
tattgagctgtctggcgtta

SEQ ID NO: 159307 - DNA, 20 bp, Artificial Sequence
  Description of Artificial Sequence: Synthetic oligonucleotide
  Target: ATXN1; (-) strand; PAM type: YTN; PAM sequence: CTG
gatgaaaaaatgggctatat

SEQ ID NO: 159308 - DNA, 20 bp, Artificial Sequence
  Description of Artificial Sequence: Synthetic oligonucleotide
  Target: ATXN1; (-) strand; PAM type: YTN; PAM sequence: TTA
ctggatgaaaaaatgggcta

SEQ ID NO: 159309 - DNA, 20 bp, Artificial Sequence
  Description of Artificial Sequence: Synthetic oligonucleotide
  Target: ATXN1; (-) strand; PAM type: YTN; PAM sequence: TTT
actggatgaaaaaatgggct

SEQ ID NO: 159310 - DNA, 20 bp, Artificial Sequence
  Description of Artificial Sequence: Synthetic oligonucleotide
  Target: ATXN1; (-) strand; PAM type: YTN; PAM sequence: TTG
aaacaggatatatttactgg

SEQ ID NO: 159311 - DNA, 20 bp, Artificial Sequence
  Description of Artificial Sequence: Synthetic oligonucleotide
  Target: ATXN1; (-) strand; PAM type: YTN; PAM sequence: TTT
gaaacaggatatatttactg

SEQ ID NO: 159312 - DNA, 20 bp, Artificial Sequence
  Description of Artificial Sequence: Synthetic oligonucleotide
  Target: ATXN1; (-) strand; PAM type: YTN; PAM sequence: TTA
gggtgtttgaaacaggatat

SEQ ID NO: 159313 - DNA, 20 bp, Artificial Sequence
  Description of Artificial Sequence: Synthetic oligonucleotide
  Target: ATXN1; (-) strand; PAM type: YTN; PAM sequence: CTT
agggtgtttgaaacaggata

SEQ ID NO: 159314 - DNA, 20 bp, Artificial Sequence
  Description of Artificial Sequence: Synthetic oligonucleotide
  Target: ATXN1; (-) strand; PAM type: YTN; PAM sequence: CTG
cttagggtgtttgaaacagg

SEQ ID NO: 159315 - DNA, 20 bp, Artificial Sequence
  Description of Artificial Sequence: Synthetic oligonucleotide
  Target: ATXN1; (-) strand; PAM type: YTN; PAM sequence: TTA
ctgcttagggtgtttgaaac

SEQ ID NO: 159316 - DNA, 20 bp, Artificial Sequence
  Description of Artificial Sequence: Synthetic oligonucleotide
  Target: ATXN1; (-) strand; PAM type: YTN; PAM sequence: CTT
actgcttagggtgtttgaaa

SEQ ID NO: 159317 - DNA, 20 bp, Artificial Sequence
  Description of Artificial Sequence: Synthetic oligonucleotide
  Target: ATXN1; (-) strand; PAM type: YTN; PAM sequence: CTA
cttactgcttagggtgtttg

SEQ ID NO: 159318 - DNA, 20 bp, Artificial Sequence
  Description of Artificial Sequence: Synthetic oligonucleotide
  Target: ATXN1; (-) strand; PAM type: YTN; PAM sequence: TTC
tacttactgcttagggtgtt

SEQ ID NO: 159319 - DNA, 20 bp, Artificial Sequence
  Description of Artificial Sequence: Synthetic oligonucleotide
  Target: ATXN1; (-) strand; PAM type: YTN; PAM sequence: CTA
ttctacttactgcttagggt

SEQ ID NO: 159320 - DNA, 20 bp, Artificial Sequence
  Description of Artificial Sequence: Synthetic oligonucleotide
  Target: ATXN1; (-) strand; PAM type: YTN; PAM sequence: TTA
taaaggctattctacttact

SEQ ID NO: 159321 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaagaaagaaagaa

SEQ ID NO: 159322 - DNA, 20 bp, Artificial Sequence
  Description of Artificial Sequence: Synthetic oligonucleotide
  Target: ATXN1; (-) strand; PAM type: YTN; PAM sequence: CTG
tctcaaaaaaaaagaaagaa

SEQ ID NO: 159323 - DNA, 20 bp, Artificial Sequence
  Description of Artificial Sequence: Synthetic oligonucleotide
  Target: ATXN1; (-) strand; PAM type: YTN; PAM sequence: CTC
tgtctcaaaaaaaaagaaag

SEQ ID NO: 159324 - DNA, 20 bp, Artificial Sequence
  Description of Artificial Sequence: Synthetic oligonucleotide
  Target: ATXN1; (-) strand; PAM type: YTN; PAM sequence: TTG
gcgacagagtgagactctgt

SEQ ID NO: 159325 - DNA, 20 bp, Artificial Sequence
  Description of Artificial Sequence: Synthetic oligonucleotide
  Target: ATXN1; (-) strand; PAM type: YTN; PAM sequence: CTT
ggcgacagagtgagactctg

SEQ ID NO: 159326 - DNA, 20 bp, Artificial Sequence
  Description of Artificial Sequence: Synthetic oligonucleotide
  Target: ATXN1; (-) strand; PAM type: YTN; PAM sequence: CTA
gccttggcgacagagtgaga

SEQ ID NO: 159327 - DNA, 20 bp, Artificial Sequence
  Description of Artificial Sequence: Synthetic oligonucleotide
  Target: ATXN1; (-) strand; PAM type: YTN; PAM sequence: CTC
tagccttggcgacagagtga

SEQ ID NO: 159328 - DNA, 20 bp, Artificial Sequence
  Description of Artificial Sequence: Synthetic oligonucleotide
  Target: ATXN1; (-) strand; PAM type: YTN; PAM sequence: CTA
cactctagccttggcgacag

SEQ ID NO: 159329 - DNA, 20 bp, Artificial Sequence
  Description of Artificial Sequence: Synthetic oligonucleotide
  Target: ATXN1; (-) strand; PAM type: YTN; PAM sequence: TTA
ccgtgaatcaagatggcacc

SEQ ID NO: 159330 - DNA, 20 bp, Artificial Sequence
  Description of Artificial Sequence: Synthetic oligonucleotide
  Target: ATXN1; (-) strand; PAM type: YTN; PAM sequence: CTG
ggaggcagaggttaccgtga

SEQ ID NO: 159331 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggcagaggtta

SEQ ID NO: 159332 - DNA, 20 bp, Artificial Sequence
  Description of Artificial Sequence: Synthetic oligonucleotide
  Target: ATXN1; (-) strand; PAM type: YTN; PAM sequence: CTT
gaacctgggaggcagaggtt

SEQ ID NO: 159333 - DNA, 20 bp, Artificial Sequence
  Description of Artificial Sequence: Synthetic oligonucleotide
  Target: ATXN1; (-) strand; PAM type: YTN; PAM sequence: TTG
cttgaacctgggaggcagag

SEQ ID NO: 159334 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaattgcttgaa

SEQ ID NO: 159335 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggagaat

SEQ ID NO: 159336 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggagaa

SEQ ID NO: 159337 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcagga

SEQ ID NO: 159338 - DNA, 20 bp, Artificial Sequence
  Description of Artificial Sequence: Synthetic oligonucleotide
  Target: ATXN1; (-) strand; PAM type: YTN; PAM sequence: CTA
taatcccagctacttgggag

SEQ ID NO: 159339 - DNA, 20 bp, Artificial Sequence
  Description of Artificial Sequence: Synthetic oligonucleotide
  Target: ATXN1; (-) strand; PAM type: YTN; PAM sequence: CTG
gtgtggtggcaggcgcctat

SEQ ID NO: 159340 - DNA, 20 bp, Artificial Sequence
  Description of Artificial Sequence: Synthetic oligonucleotide
  Target: ATXN1; (-) strand; PAM type: YTN; PAM sequence: TTA
gcctggtgtggtggcaggcg

SEQ ID NO: 159341 - DNA, 20 bp, Artificial Sequence
  Description of Artificial Sequence: Synthetic oligonucleotide
  Target: ATXN1; (-) strand; PAM type: YTN; PAM sequence: CTA
aatacaaaaaaattagcctg

SEQ ID NO: 159342 - DNA, 20 bp, Artificial Sequence
  Description of Artificial Sequence: Synthetic oligonucleotide
  Target: ATXN1; (-) strand; PAM type: YTN; PAM sequence: CTA
ctaaatacaaaaaaattagc

SEQ ID NO: 159343 - DNA, 20 bp, Artificial Sequence
  Description of Artificial Sequence: Synthetic oligonucleotide
  Target: ATXN1; (-) strand; PAM type: YTN; PAM sequence: CTC
tactaaatacaaaaaaatta

SEQ ID NO: 159344 - DNA, 20 bp, Artificial Sequence
  Description of Artificial Sequence: Synthetic oligonucleotide
  Target: ATXN1; (-) strand; PAM type: YTN; PAM sequence: CTA
acatggtgaaaacccgtctc

SEQ ID NO: 159345 - DNA, 20 bp, Artificial Sequence
  Description of Artificial Sequence: Synthetic oligonucleotide
  Target: ATXN1; (-) strand; PAM type: YTN; PAM sequence: CTG
actaacatggtgaaaacccg

SEQ ID NO: 159346 - DNA, 20 bp, Artificial Sequence
  Description of Artificial Sequence: Synthetic oligonucleotide
  Target: ATXN1; (-) strand; PAM type: YTN; PAM sequence: TTC
aagaccagcctgactaacat

SEQ ID NO: 159347 - DNA, 20 bp, Artificial Sequence
  Description of Artificial Sequence: Synthetic oligonucleotide
  Target: ATXN1; (-) strand; PAM type: YTN; PAM sequence: CTG
aggtcaagagttcaagacca

SEQ ID NO: 159348 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggtgggtggat

SEQ ID NO: 159349 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggtgggtgga

SEQ ID NO: 159350 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggtgggtgg

SEQ ID NO: 159351 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 159352 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatcccagcact

SEQ ID NO: 159353 - DNA, 20 bp, Artificial Sequence
  Description of Artificial Sequence: Synthetic oligonucleotide
  Target: ATXN1; (-) strand; PAM type: YTN; PAM sequence: CTG
ggcgcggtggctcacacctg

SEQ ID NO: 159354 - DNA, 20 bp, Artificial Sequence
  Description of Artificial Sequence: Synthetic oligonucleotide
  Target: ATXN1; (-) strand; PAM type: YTN; PAM sequence: TTA
caaaagtataaaggccatcc

SEQ ID NO: 159355 - DNA, 20 bp, Artificial Sequence
  Description of Artificial Sequence: Synthetic oligonucleotide
  Target: ATXN1; (-) strand; PAM type: YTN; PAM sequence: CTT
acaaaagtataaaggccatc

SEQ ID NO: 159356 - DNA, 20 bp, Artificial Sequence
  Description of Artificial Sequence: Synthetic oligonucleotide
  Target: ATXN1; (-) strand; PAM type: YTN; PAM sequence: CTC
aagcttacaaaagtataaag

SEQ ID NO: 159357 - DNA, 20 bp, Artificial Sequence
  Description of Artificial Sequence: Synthetic oligonucleotide
  Target: ATXN1; (-) strand; PAM type: YTN; PAM sequence: CTG
gcgacagggcatccagagat

SEQ ID NO: 159358 - DNA, 20 bp, Artificial Sequence
  Description of Artificial Sequence: Synthetic oligonucleotide
  Target: ATXN1; (-) strand; PAM type: YTN; PAM sequence: CTG
gcagcagtgggaggagggag

SEQ ID NO: 159359 - DNA, 20 bp, Artificial Sequence
  Description of Artificial Sequence: Synthetic oligonucleotide
  Target: ATXN1; (-) strand; PAM type: YTN; PAM sequence: TTG
ctggcagcagtgggaggagg

SEQ ID NO: 159360 - DNA, 20 bp, Artificial Sequence
  Description of Artificial Sequence: Synthetic oligonucleotide
  Target: ATXN1; (-) strand; PAM type: YTN; PAM sequence: CTT
gctggcagcagtgggaggag

SEQ ID NO: 159361 - DNA, 20 bp, Artificial Sequence
  Description of Artificial Sequence: Synthetic oligonucleotide
  Target: ATXN1; (-) strand; PAM type: YTN; PAM sequence: CTG
atgagcacatgggcttgctg

SEQ ID NO: 159362 - DNA, 20 bp, Artificial Sequence
  Description of Artificial Sequence: Synthetic oligonucleotide
  Target: ATXN1; (-) strand; PAM type: YTN; PAM sequence: TTA
taaccacactgatgagcaca

SEQ ID NO: 159363 - DNA, 20 bp, Artificial Sequence
  Description of Artificial Sequence: Synthetic oligonucleotide
  Target: ATXN1; (-) strand; PAM type: YTN; PAM sequence: CTT
ataaccacactgatgagcac

SEQ ID NO: 159364 - DNA, 20 bp, Artificial Sequence
  Description of Artificial Sequence: Synthetic oligonucleotide
  Target: ATXN1; (-) strand; PAM type: YTN; PAM sequence: CTC
ttataaccacactgatgagc

SEQ ID NO: 159365 - DNA, 20 bp, Artificial Sequence
  Description of Artificial Sequence: Synthetic oligonucleotide
  Target: ATXN1; (-) strand; PAM type: YTN; PAM sequence: TTA
gggggatggatggaggaagg

SEQ ID NO: 159366 - DNA, 20 bp, Artificial Sequence
  Description of Artificial Sequence: Synthetic oligonucleotide
  Target: ATXN1; (-) strand; PAM type: YTN; PAM sequence: TTT
agggggatggatggaggaag

SEQ ID NO: 159367 - DNA, 20 bp, Artificial Sequence
  Description of Artificial Sequence: Synthetic oligonucleotide
  Target: ATXN1; (-) strand; PAM type: YTN; PAM sequence: CTA
gaggagtcgatttaggggga

SEQ ID NO: 159368 - DNA, 20 bp, Artificial Sequence
  Description of Artificial Sequence: Synthetic oligonucleotide
  Target: ATXN1; (-) strand; PAM type: YTN; PAM sequence: TTC
tagaggagtcgatttagggg

SEQ ID NO: 159369 - DNA, 20 bp, Artificial Sequence
  Description of Artificial Sequence: Synthetic oligonucleotide
  Target: ATXN1; (-) strand; PAM type: YTN; PAM sequence: TTG
gaggtgacagttctagagga

SEQ ID NO: 159370 - DNA, 20 bp, Artificial Sequence
  Description of Artificial Sequence: Synthetic oligonucleotide
  Target: ATXN1; (-) strand; PAM type: YTN; PAM sequence: TTC
gtccatccaaaatgggagtt

SEQ ID NO: 159371 - DNA, 20 bp, Artificial Sequence
  Description of Artificial Sequence: Synthetic oligonucleotide
  Target: ATXN1; (-) strand; PAM type: YTN; PAM sequence: CTA
ggttcgtccatccaaaatgg

SEQ ID NO: 159372 - DNA, 20 bp, Artificial Sequence
  Description of Artificial Sequence: Synthetic oligonucleotide
  Target: ATXN1; (-) strand; PAM type: YTN; PAM sequence: CTG
tctaggttcgtccatccaaa

SEQ ID NO: 159373 - DNA, 20 bp, Artificial Sequence
  Description of Artificial Sequence: Synthetic oligonucleotide
  Target: ATXN1; (-) strand; PAM type: YTN; PAM sequence: CTC
cctgtctaggttcgtccatc

SEQ ID NO: 159374 - DNA, 20 bp, Artificial Sequence
  Description of Artificial Sequence: Synthetic oligonucleotide
  Target: ATXN1; (-) strand; PAM type: YTN; PAM sequence: TTG
tctccctgtctaggttcgtc

SEQ ID NO: 159375 - DNA, 20 bp, Artificial Sequence
  Description of Artificial Sequence: Synthetic oligonucleotide
  Target: ATXN1; (-) strand; PAM type: YTN; PAM sequence: TTA
tgagcccagaagtgagtcgg

SEQ ID NO: 159376 - DNA, 20 bp, Artificial Sequence
  Description of Artificial Sequence: Synthetic oligonucleotide
  Target: ATXN1; (-) strand; PAM type: YTN; PAM sequence: TTA
aaaaataattatgagcccag

SEQ ID NO: 159377 - DNA, 20 bp, Artificial Sequence
  Description of Artificial Sequence: Synthetic oligonucleotide
  Target: ATXN1; (-) strand; PAM type: YTN; PAM sequence: TTT
aaaaaataattatgagccca

SEQ ID NO: 159378 - DNA, 20 bp, Artificial Sequence
  Description of Artificial Sequence: Synthetic oligonucleotide
  Target: ATXN1; (-) strand; PAM type: YTN; PAM sequence: TTA
ggaaggtgacatttaaaaaa

SEQ ID NO: 159379 - DNA, 20 bp, Artificial Sequence
  Description of Artificial Sequence: Synthetic oligonucleotide
  Target: ATXN1; (-) strand; PAM type: YTN; PAM sequence: TTA
gtcagattaggaaggtgaca

SEQ ID NO: 159380 - DNA, 20 bp, Artificial Sequence
  Description of Artificial Sequence: Synthetic oligonucleotide
  Target: ATXN1; (-) strand; PAM type: YTN; PAM sequence: TTA
aaagccagtcattagtcaga

SEQ ID NO: 159381 - DNA, 20 bp, Artificial Sequence
  Description of Artificial Sequence: Synthetic oligonucleotide
  Target: ATXN1; (-) strand; PAM type: YTN; PAM sequence: CTT
aaaagccagtcattagtcag

SEQ ID NO: 159382 - DNA, 20 bp, Artificial Sequence
  Description of Artificial Sequence: Synthetic oligonucleotide
  Target: ATXN1; (-) strand; PAM type: YTN; PAM sequence: TTC
ttaaaagccagtcattagtc

SEQ ID NO: 159383 - DNA, 20 bp, Artificial Sequence
  Description of Artificial Sequence: Synthetic oligonucleotide
  Target: ATXN1; (-) strand; PAM type: YTN; PAM sequence: TTT
cttaaaagccagtcattagt

SEQ ID NO: 159384 - DNA, 20 bp, Artificial Sequence
  Description of Artificial Sequence: Synthetic oligonucleotide
  Target: ATXN1; (-) strand; PAM type: YTN; PAM sequence: TTT
tcttaaaagccagtcattag

SEQ ID NO: 159385 - DNA, 20 bp, Artificial Sequence
  Description of Artificial Sequence: Synthetic oligonucleotide
  Target: ATXN1; (-) strand; PAM type: YTN; PAM sequence: TTT
ttcttaaaagccagtcatta

SEQ ID NO: 159386 - DNA, 20 bp, Artificial Sequence
  Description of Artificial Sequence: Synthetic oligonucleotide
  Target: ATXN1; (-) strand; PAM type: YTN; PAM sequence: CTA
aaatttttcttaaaagccag

SEQ ID NO: 159387 - DNA, 20 bp, Artificial Sequence
  Description of Artificial Sequence: Synthetic oligonucleotide
  Target: ATXN1; (-) strand; PAM type: YTN; PAM sequence: TTC
atacagaggagctaaaattt

SEQ ID NO: 159388 - DNA, 20 bp, Artificial Sequence
  Description of Artificial Sequence: Synthetic oligonucleotide
  Target: ATXN1; (-) strand; PAM type: YTN; PAM sequence: TTT
catacagaggagctaaaatt

SEQ ID NO: 159389 - DNA, 20 bp, Artificial Sequence
  Description of Artificial Sequence: Synthetic oligonucleotide
  Target: ATXN1; (-) strand; PAM type: YTN; PAM sequence: TTT
tcatacagaggagctaaaat

SEQ ID NO: 159390 - DNA, 20 bp, Artificial Sequence
  Description of Artificial Sequence: Synthetic oligonucleotide
  Target: ATXN1; (-) strand; PAM type: YTN; PAM sequence: TTG
aattttcatacagaggagct

SEQ ID NO: 159391 - DNA, 20 bp, Artificial Sequence
  Description of Artificial Sequence: Synthetic oligonucleotide
  Target: ATXN1; (-) strand; PAM type: YTN; PAM sequence: TTA
ttgaattttcatacagagga

SEQ ID NO: 159392 - DNA, 20 bp, Artificial Sequence
  Description of Artificial Sequence: Synthetic oligonucleotide
  Target: ATXN1; (-) strand; PAM type: YTN; PAM sequence: TTT
attgaattttcatacagagg

SEQ ID NO: 159393 - DNA, 20 bp, Artificial Sequence
  Description of Artificial Sequence: Synthetic oligonucleotide
  Target: ATXN1; (-) strand; PAM type: YTN; PAM sequence: TTT
tattgaattttcatacagag

SEQ ID NO: 159394 - DNA, 20 bp, Artificial Sequence
  Description of Artificial Sequence: Synthetic oligonucleotide
  Target: ATXN1; (-) strand; PAM type: YTN; PAM sequence: CTA
agtggtgaaaggaattttat

SEQ ID NO: 159395 - DNA, 20 bp, Artificial Sequence
  Description of Artificial Sequence: Synthetic oligonucleotide
  Target: ATXN1; (-) strand; PAM type: YTN; PAM sequence: TTG
actaagtggtgaaaggaatt

SEQ ID NO: 159396 - DNA, 20 bp, Artificial Sequence
  Description of Artificial Sequence: Synthetic oligonucleotide
  Target: ATXN1; (-) strand; PAM type: YTN; PAM sequence: TTA
ttgactaagtggtgaaagga

SEQ ID NO: 159397 - DNA, 20 bp, Artificial Sequence
  Description of Artificial Sequence: Synthetic oligonucleotide
  Target: ATXN1; (-) strand; PAM type: YTN; PAM sequence: TTA
gatatagtagttattgacta

SEQ ID NO: 159398 - DNA, 20 bp, Artificial Sequence
  Description of Artificial Sequence: Synthetic oligonucleotide
  Target: ATXN1; (-) strand; PAM type: YTN; PAM sequence: TTT
agatatagtagttattgact

SEQ ID NO: 159399 - DNA, 20 bp, Artificial Sequence
  Description of Artificial Sequence: Synthetic oligonucleotide
  Target: ATXN1; (-) strand; PAM type: YTN; PAM sequence: TTG
aaatatacaatcaaacagca

SEQ ID NO: 159400 - DNA, 20 bp, Artificial Sequence
  Description of Artificial Sequence: Synthetic oligonucleotide
  Target: ATXN1; (-) strand; PAM type: YTN; PAM sequence: CTA
agattgaaatatacaatcaa

SEQ ID NO: 159401 - DNA, 20 bp, Artificial Sequence
  Description of Artificial Sequence: Synthetic oligonucleotide
  Target: ATXN1; (-) strand; PAM type: YTN; PAM sequence: TTG
gtgatatgtacatatgtgtg

SEQ ID NO: 159402 - DNA, 20 bp, Artificial Sequence
  Description of Artificial Sequence: Synthetic oligonucleotide
  Target: ATXN1; (-) strand; PAM type: YTN; PAM sequence: TTT
ggtgatatgtacatatgtgt

SEQ ID NO: 159403 - DNA, 20 bp, Artificial Sequence
  Description of Artificial Sequence: Synthetic oligonucleotide
  Target: ATXN1; (-) strand; PAM type: YTN; PAM sequence: TTT
tggtgatatgtacatatgtg

SEQ ID NO: 159404 - DNA, 20 bp, Artificial Sequence
  Description of Artificial Sequence: Synthetic oligonucleotide
  Target: ATXN1; (-) strand; PAM type: YTN; PAM sequence: TTT
ttggtgatatgtacatatgt

SEQ ID NO: 159405 - DNA, 20 bp, Artificial Sequence
  Description of Artificial Sequence: Synthetic oligonucleotide
  Target: ATXN1; (-) strand; PAM type: YTN; PAM sequence: TTG
tttttggtgatatgtacata

SEQ ID NO: 159406 - DNA, 20 bp, Artificial Sequence
  Description of Artificial Sequence: Synthetic oligonucleotide
  Target: ATXN1; (-) strand; PAM type: YTN; PAM sequence: CTT
gtttttggtgatatgtacat

SEQ ID NO: 159407 - DNA, 20 bp, Artificial Sequence
  Description of Artificial Sequence: Synthetic oligonucleotide
  Target: ATXN1; (-) strand; PAM type: YTN; PAM sequence: CTA
tcttgtttttggtgatatgt

SEQ ID NO: 159408 - DNA, 20 bp, Artificial Sequence
  Description of Artificial Sequence: Synthetic oligonucleotide
  Target: ATXN1; (-) strand; PAM type: YTN; PAM sequence: TTC
tatcttgtttttggtgatat

SEQ ID NO: 159409 - DNA, 20 bp, Artificial Sequence
  Description of Artificial Sequence: Synthetic oligonucleotide
  Target: ATXN1; (-) strand; PAM type: YTN; PAM sequence: TTT
ctatcttgtttttggtgata

SEQ ID NO: 159410 - DNA, 20 bp, Artificial Sequence
  Description of Artificial Sequence: Synthetic oligonucleotide
  Target: ATXN1; (-) strand; PAM type: YTN; PAM sequence: CTT
tctatcttgtttttggtgat

SEQ ID NO: 159411 - DNA, 20 bp, Artificial Sequence
  Description of Artificial Sequence: Synthetic oligonucleotide
  Target: ATXN1; (-) strand; PAM type: YTN; PAM sequence: TTC
tttctatcttgtttttggtg

SEQ ID NO: 159412 - DNA, 20 bp, Artificial Sequence
  Description of Artificial Sequence: Synthetic oligonucleotide
  Target: ATXN1; (-) strand; PAM type: YTN; PAM sequence: TTT
ctttctatcttgtttttggt

SEQ ID NO: 159413 - DNA, 20 bp, Artificial Sequence
  Description of Artificial Sequence: Synthetic oligonucleotide
  Target: ATXN1; (-) strand; PAM type: YTN; PAM sequence: TTT
tctttctatcttgtttttgg

SEQ ID NO: 159414 - DNA, 20 bp, Artificial Sequence
  Description of Artificial Sequence: Synthetic oligonucleotide
  Target: ATXN1; (-) strand; PAM type: YTN; PAM sequence: TTG
ttttctttctatcttgtttt

SEQ ID NO: 159415 - DNA, 20 bp, Artificial Sequence
  Description of Artificial Sequence: Synthetic oligonucleotide
  Target: ATXN1; (-) strand; PAM type: YTN; PAM sequence: TTT
gttttctttctatcttgttt

SEQ ID NO: 159416 - DNA, 20 bp, Artificial Sequence
  Description of Artificial Sequence: Synthetic oligonucleotide
  Target: ATXN1; (-) strand; PAM type: YTN; PAM sequence: TTT
tgttttctttctatcttgtt

SEQ ID NO: 159417 - DNA, 20 bp, Artificial Sequence
  Description of Artificial Sequence: Synthetic oligonucleotide
  Target: ATXN1; (-) strand; PAM type: YTN; PAM sequence: TTA
aacaacagacgttttgtttt

SEQ ID NO: 159418 - DNA, 20 bp, Artificial Sequence
  Description of Artificial Sequence: Synthetic oligonucleotide
  Target: ATXN1; (-) strand; PAM type: YTN; PAM sequence: TTT
aaacaacagacgttttgttt

SEQ ID NO: 159419 - DNA, 20 bp, Artificial Sequence
  Description of Artificial Sequence: Synthetic oligonucleotide
  Target: ATXN1; (-) strand; PAM type: YTN; PAM sequence: TTG
tgaaggaaatgggagacata

SEQ ID NO: 159420 - DNA, 20 bp, Artificial Sequence
  Description of Artificial Sequence: Synthetic oligonucleotide
  Target: ATXN1; (-) strand; PAM type: YTN; PAM sequence: CTT
gtgaaggaaatgggagacat

SEQ ID NO: 159421 - DNA, 20 bp, Artificial Sequence
  Description of Artificial Sequence: Synthetic oligonucleotide
  Target: ATXN1; (-) strand; PAM type: YTN; PAM sequence: CTC
ttgtgaaggaaatgggagac

SEQ ID NO: 159422 - DNA, 20 bp, Artificial Sequence
  Description of Artificial Sequence: Synthetic oligonucleotide
  Target: ATXN1; (-) strand; PAM type: YTN; PAM sequence: TTG
tgaaaacagggactcttgtg

SEQ ID NO: 159423 - DNA, 20 bp, Artificial Sequence
  Description of Artificial Sequence: Synthetic oligonucleotide
  Target: ATXN1; (-) strand; PAM type: YTN; PAM sequence: TTT
gtgaaaacagggactcttgt

SEQ ID NO: 159424 - DNA, 20 bp, Artificial Sequence
  Description of Artificial Sequence: Synthetic oligonucleotide
  Target: ATXN1; (-) strand; PAM type: YTN; PAM sequence: TTC
gcaatttgtgaaaacaggga

SEQ ID NO: 159425 - DNA, 20 bp, Artificial Sequence
  Description of Artificial Sequence: Synthetic oligonucleotide
  Target: ATXN1; (-) strand; PAM type: YTN; PAM sequence: CTT
cgcaatttgtgaaaacaggg

SEQ ID NO: 159426 - DNA, 20 bp, Artificial Sequence
  Description of Artificial Sequence: Synthetic oligonucleotide
  Target: ATXN1; (-) strand; PAM type: YTN; PAM sequence: TTG
taaaacagatgcccttcgca

SEQ ID NO: 159427 - DNA, 20 bp, Artificial Sequence
  Description of Artificial Sequence: Synthetic oligonucleotide
  Target: ATXN1; (-) strand; PAM type: YTN; PAM sequence: TTT
gtaaaacagatgcccttcgc

SEQ ID NO: 159428 - DNA, 20 bp, Artificial Sequence
  Description of Artificial Sequence: Synthetic oligonucleotide
  Target: ATXN1; (-) strand; PAM type: YTN; PAM sequence: TTT
tgtaaaacagatgcccttcg

SEQ ID NO: 159429 - DNA, 20 bp, Artificial Sequence
  Description of Artificial Sequence: Synthetic oligonucleotide
  Target: ATXN1; (-) strand; PAM type: YTN; PAM sequence: CTG
ggatagtgtcatgaaaaaat

SEQ ID NO: 159430 - DNA, 20 bp, Artificial Sequence
  Description of Artificial Sequence: Synthetic oligonucleotide
  Target: ATXN1; (-) strand; PAM type: YTN; PAM sequence: TTG
tatgtctgggatagtgtcat

SEQ ID NO: 159431 - DNA, 20 bp, Artificial Sequence
  Description of Artificial Sequence: Synthetic oligonucleotide
  Target: ATXN1; (-) strand; PAM type: YTN; PAM sequence: TTT
gtatgtctgggatagtgtca

SEQ ID NO: 159432 - DNA, 20 bp, Artificial Sequence
  Description of Artificial Sequence: Synthetic oligonucleotide
  Target: ATXN1; (-) strand; PAM type: YTN; PAM sequence: CTC
ccagcaacaggcgaaatttg

SEQ ID NO: 159433 - DNA, 20 bp, Artificial Sequence
  Description of Artificial Sequence: Synthetic oligonucleotide
  Target: ATXN1; (-) strand; PAM type: YTN; PAM sequence: TTG
ctcccagcaacaggcgaaat

SEQ ID NO: 159434 - DNA, 20 bp, Artificial Sequence
  Description of Artificial Sequence: Synthetic oligonucleotide
  Target: ATXN1; (-) strand; PAM type: YTN; PAM sequence: TTC
attgctcccagcaacaggcg

SEQ ID NO: 159435 - DNA, 20 bp, Artificial Sequence
  Description of Artificial Sequence: Synthetic oligonucleotide
  Target: ATXN1; (-) strand; PAM type: YTN; PAM sequence: TTA
tgagagaattcattgctccc

SEQ ID NO: 159436 - DNA, 20 bp, Artificial Sequence
  Description of Artificial Sequence: Synthetic oligonucleotide
  Target: ATXN1; (-) strand; PAM type: YTN; PAM sequence: CTT
atgagagaattcattgctcc

SEQ ID NO: 159437 - DNA, 20 bp, Artificial Sequence
  Description of Artificial Sequence: Synthetic oligonucleotide
  Target: ATXN1; (-) strand; PAM type: YTN; PAM sequence: CTA
gcttatgagagaattcattg

SEQ ID NO: 159438 - DNA, 20 bp, Artificial Sequence
  Description of Artificial Sequence: Synthetic oligonucleotide
  Target: ATXN1; (-) strand; PAM type: YTN; PAM sequence: CTG
aaacctagcttatgagagaa

SEQ ID NO: 159439 - DNA, 20 bp, Artificial Sequence
  Description of Artificial Sequence: Synthetic oligonucleotide
  Target: ATXN1; (-) strand; PAM type: YTN; PAM sequence: TTA
ctgaaacctagcttatgaga

SEQ ID NO: 159440 - DNA, 20 bp, Artificial Sequence
  Description of Artificial Sequence: Synthetic oligonucleotide
  Target: ATXN1; (-) strand; PAM type: YTN; PAM sequence: CTT
actgaaacctagcttatgag

SEQ ID NO: 159441 - DNA, 20 bp, Artificial Sequence
  Description of Artificial Sequence: Synthetic oligonucleotide
  Target: ATXN1; (-) strand; PAM type: YTN; PAM sequence: TTC
gccaaaaaacaagacatact

SEQ ID NO: 159442 - DNA, 20 bp, Artificial Sequence
  Description of Artificial Sequence: Synthetic oligonucleotide
  Target: ATXN1; (-) strand; PAM type: YTN; PAM sequence: TTT
cgccaaaaaacaagacatac

SEQ ID NO: 159443 - DNA, 20 bp, Artificial Sequence
  Description of Artificial Sequence: Synthetic oligonucleotide
  Target: ATXN1; (-) strand; PAM type: YTN; PAM sequence: TTA
ataatttcgccaaaaaacaa

SEQ ID NO: 159444 - DNA, 20 bp, Artificial Sequence
  Description of Artificial Sequence: Synthetic oligonucleotide
  Target: ATXN1; (-) strand; PAM type: YTN; PAM sequence: TTT
aataatttcgccaaaaaaca

SEQ ID NO: 159445 - DNA, 20 bp, Artificial Sequence
  Description of Artificial Sequence: Synthetic oligonucleotide
  Target: ATXN1; (-) strand; PAM type: YTN; PAM sequence: TTA
agaatgcccaatttaataat

SEQ ID NO: 159446 - DNA, 20 bp, Artificial Sequence
  Description of Artificial Sequence: Synthetic oligonucleotide
  Target: ATXN1; (-) strand; PAM type: YTN; PAM sequence: TTG
cagacaaagttaagaatgcc

SEQ ID NO: 159447 - DNA, 20 bp, Artificial Sequence
  Description of Artificial Sequence: Synthetic oligonucleotide
  Target: ATXN1; (-) strand; PAM type: YTN; PAM sequence: CTT
gcagacaaagttaagaatgc

SEQ ID NO: 159448 - DNA, 20 bp, Artificial Sequence
  Description of Artificial Sequence: Synthetic oligonucleotide
  Target: ATXN1; (-) strand; PAM type: YTN; PAM sequence: TTC
acttgcagacaaagttaaga

SEQ ID NO: 159449 - DNA, 20 bp, Artificial Sequence
  Description of Artificial Sequence: Synthetic oligonucleotide
  Target: ATXN1; (-) strand; PAM type: YTN; PAM sequence: TTT
cacttgcagacaaagttaag

SEQ ID NO: 159450 - DNA, 20 bp, Artificial Sequence
  Description of Artificial Sequence: Synthetic oligonucleotide
  Target: ATXN1; (-) strand; PAM type: YTN; PAM sequence: CTG
agaatttcacttgcagacaa

SEQ ID NO: 159451 - DNA, 20 bp, Artificial Sequence
  Description of Artificial Sequence: Synthetic oligonucleotide
  Target: ATXN1; (-) strand; PAM type: YTN; PAM sequence: CTA
caggtaaaacaagactgaga

SEQ ID NO: 159452 - DNA, 20 bp, Artificial Sequence
  Description of Artificial Sequence: Synthetic oligonucleotide
  Target: ATXN1; (-) strand; PAM type: YTN; PAM sequence: CTC
tacaggtaaaacaagactga

SEQ ID NO: 159453 - DNA, 20 bp, Artificial Sequence
  Description of Artificial Sequence: Synthetic oligonucleotide
  Target: ATXN1; (-) strand; PAM type: YTN; PAM sequence: TTC
tctacaggtaaaacaagact

SEQ ID NO: 159454 - DNA, 20 bp, Artificial Sequence
  Description of Artificial Sequence: Synthetic oligonucleotide
  Target: ATXN1; (-) strand; PAM type: YTN; PAM sequence: TTT
ctctacaggtaaaacaagac

SEQ ID NO: 159455 - DNA, 20 bp, Artificial Sequence
  Description of Artificial Sequence: Synthetic oligonucleotide
  Target: ATXN1; (-) strand; PAM type: YTN; PAM sequence: CTT
tctctacaggtaaaacaaga

SEQ ID NO: 159456 - DNA, 20 bp, Artificial Sequence
  Description of Artificial Sequence: Synthetic oligonucleotide
  Target: ATXN1; (-) strand; PAM type: YTN; PAM sequence: TTC
caggaaagcagaccggcctt

SEQ ID NO: 159457 - DNA, 20 bp, Artificial Sequence
  Description of Artificial Sequence: Synthetic oligonucleotide
  Target: ATXN1; (-) strand; PAM type: YTN; PAM sequence: CTT
ccaggaaagcagaccggcct

SEQ ID NO: 159458 - DNA, 20 bp, Artificial Sequence
  Description of Artificial Sequence: Synthetic oligonucleotide
  Target: ATXN1; (-) strand; PAM type: YTN; PAM sequence: TTA
gccttccaggaaagcagacc

SEQ ID NO: 159459 - DNA, 20 bp, Artificial Sequence
  Description of Artificial Sequence: Synthetic oligonucleotide
  Target: ATXN1; (-) strand; PAM type: YTN; PAM sequence: CTT
agccttccaggaaagcagac

SEQ ID NO: 159460 - DNA, 20 bp, Artificial Sequence
  Description of Artificial Sequence: Synthetic oligonucleotide
  Target: ATXN1; (-) strand; PAM type: YTN; PAM sequence: CTG
agaacgtaaccatgcagact

SEQ ID NO: 159461 - DNA, 20 bp, Artificial Sequence
  Description of Artificial Sequence: Synthetic oligonucleotide
  Target: ATXN1; (-) strand; PAM type: YTN; PAM sequence: TTC
atgctgagaacgtaaccatg

SEQ ID NO: 159462 - DNA, 20 bp, Artificial Sequence
  Description of Artificial Sequence: Synthetic oligonucleotide
  Target: ATXN1; (-) strand; PAM type: YTN; PAM sequence: TTT
catgctgagaacgtaaccat

SEQ ID NO: 159463 - DNA, 20 bp, Artificial Sequence
  Description of Artificial Sequence: Synthetic oligonucleotide
  Target: ATXN1; (-) strand; PAM type: YTN; PAM sequence: TTT
tcatgctgagaacgtaacca

SEQ ID NO: 159464 - DNA, 20 bp, Artificial Sequence
  Description of Artificial Sequence: Synthetic oligonucleotide
  Target: ATXN1; (-) strand; PAM type: YTN; PAM sequence: TTT
ttcatgctgagaacgtaacc

SEQ ID NO: 159465 - DNA, 20 bp, Artificial Sequence
  Description of Artificial Sequence: Synthetic oligonucleotide
  Target: ATXN1; (-) strand; PAM type: YTN; PAM sequence: TTT
tttcatgctgagaacgtaac

SEQ ID NO: 159466 - DNA, 20 bp, Artificial Sequence
  Description of Artificial Sequence: Synthetic oligonucleotide
  Target: ATXN1; (-) strand; PAM type: YTN; PAM sequence: TTT
ttttcatgctgagaacgtaa

SEQ ID NO: 159467 - DNA, 20 bp, Artificial Sequence
  Description of Artificial Sequence: Synthetic oligonucleotide
  Target: ATXN1; (-) strand; PAM type: YTN; PAM sequence: CTG
atttttttcatgctgagaac

SEQ ID NO: 159468 - DNA, 20 bp, Artificial Sequence
  Description of Artificial Sequence: Synthetic oligonucleotide
  Target: ATXN1; (-) strand; PAM type: YTN; PAM sequence: TTC
tgatttttttcatgctgaga

SEQ ID NO: 159469 - DNA, 20 bp, Artificial Sequence
  Description of Artificial Sequence: Synthetic oligonucleotide
  Target: ATXN1; (-) strand; PAM type: YTN; PAM sequence: TTT
ctgatttttttcatgctgag

SEQ ID NO: 159470 - DNA, 20 bp, Artificial Sequence
  Description of Artificial Sequence: Synthetic oligonucleotide
  Target: ATXN1; (-) strand; PAM type: YTN; PAM sequence: TTT
tctgatttttttcatgctga

SEQ ID NO: 159471 - DNA, 20 bp, Artificial Sequence
  Description of Artificial Sequence: Synthetic oligonucleotide
  Target: ATXN1; (-) strand; PAM type: YTN; PAM sequence: TTG
agacggggttttctgatttt

SEQ ID NO: 159472 - DNA, 20 bp, Artificial Sequence
  Description of Artificial Sequence: Synthetic oligonucleotide
  Target: ATXN1; (-) strand; PAM type: YTN; PAM sequence: TTT
gagacggggttttctgattt

SEQ ID NO: 159473 - DNA, 20 bp, Artificial Sequence
  Description of Artificial Sequence: Synthetic oligonucleotide
  Target: ATXN1; (-) strand; PAM type: YTN; PAM sequence: CTT
tgagacggggttttctgatt

SEQ ID NO: 159474 - DNA, 20 bp, Artificial Sequence
  Description of Artificial Sequence: Synthetic oligonucleotide
  Target: ATXN1; (-) strand; PAM type: YTN; PAM sequence: TTC
atctttgagacggggttttc

SEQ ID NO: 159475 - DNA, 20 bp, Artificial Sequence
  Description of Artificial Sequence: Synthetic oligonucleotide
  Target: ATXN1; (-) strand; PAM type: YTN; PAM sequence: CTT
catctttgagacggggtttt

SEQ ID NO: 159476 - DNA, 20 bp, Artificial Sequence
  Description of Artificial Sequence: Synthetic oligonucleotide
  Target: ATXN1; (-) strand; PAM type: YTN; PAM sequence: TTA
cccccttcatctttgagacg

SEQ ID NO: 159477 - DNA, 20 bp, Artificial Sequence
  Description of Artificial Sequence: Synthetic oligonucleotide
  Target: ATXN1; (-) strand; PAM type: YTN; PAM sequence: CTT
acccccttcatctttgagac

SEQ ID NO: 159478 - DNA, 20 bp, Artificial Sequence
  Description of Artificial Sequence: Synthetic oligonucleotide
  Target: ATXN1; (-) strand; PAM type: YTN; PAM sequence: CTC
gcttacccccttcatctttg

SEQ ID NO: 159479 - DNA, 20 bp, Artificial Sequence
  Description of Artificial Sequence: Synthetic oligonucleotide
  Target: ATXN1; (-) strand; PAM type: YTN; PAM sequence: CTC
tcgcttacccccttcatctt

SEQ ID NO: 159480 - DNA, 20 bp, Artificial Sequence
  Description of Artificial Sequence: Synthetic oligonucleotide
  Target: ATXN1; (-) strand; PAM type: YTN; PAM sequence: TTG
cagtaaatgggtctctcgct

SEQ ID NO: 159481 - DNA, 20 bp, Artificial Sequence
  Description of Artificial Sequence: Synthetic oligonucleotide
  Target: ATXN1; (-) strand; PAM type: YTN; PAM sequence: TTA
aacattgcagtaaatgggtc

SEQ ID NO: 159482 - DNA, 20 bp, Artificial Sequence
  Description of Artificial Sequence: Synthetic oligonucleotide
  Target: ATXN1; (-) strand; PAM type: YTN; PAM sequence: TTT
aaacattgcagtaaatgggt

SEQ ID NO: 159483 - DNA, 20 bp, Artificial Sequence
  Description of Artificial Sequence: Synthetic oligonucleotide
  Target: ATXN1; (-) strand; PAM type: YTN; PAM sequence: TTT
taaacattgcagtaaatggg

SEQ ID NO: 159484 - DNA, 20 bp, Artificial Sequence
  Description of Artificial Sequence: Synthetic oligonucleotide
  Target: ATXN1; (-) strand; PAM type: YTN; PAM sequence: TTT
ttaaacattgcagtaaatgg

SEQ ID NO: 159485 - DNA, 20 bp, Artificial Sequence
  Description of Artificial Sequence: Synthetic oligonucleotide
  Target: ATXN1; (-) strand; PAM type: YTN; PAM sequence: TTA
atgatttttaaacattgcag

SEQ ID NO: 159486 - DNA, 20 bp, Artificial Sequence
  Description of Artificial Sequence: Synthetic oligonucleotide
  Target: ATXN1; (-) strand; PAM type: YTN; PAM sequence: TTA
ttaatgatttttaaacattg

SEQ ID NO: 159487 - DNA, 20 bp, Artificial Sequence
  Description of Artificial Sequence: Synthetic oligonucleotide
  Target: ATXN1; (-) strand; PAM type: YTN; PAM sequence: TTT
attaatgatttttaaacatt

SEQ ID NO: 159488 - DNA, 20 bp, Artificial Sequence
  Description of Artificial Sequence: Synthetic oligonucleotide
  Target: ATXN1; (-) strand; PAM type: YTN; PAM sequence: TTT
tattaatgatttttaaacat

SEQ ID NO: 159489 - DNA, 20 bp, Artificial Sequence
  Description of Artificial Sequence: Synthetic oligonucleotide
  Target: ATXN1; (-) strand; PAM type: YTN; PAM sequence: TTT
ttattaatgatttttaaaca

SEQ ID NO: 159490 - DNA, 20 bp, Artificial Sequence
  Description of Artificial Sequence: Synthetic oligonucleotide
  Target: ATXN1; (-) strand; PAM type: YTN; PAM sequence: CTG
tttttattaatgatttttaa

SEQ ID NO: 159491 - DNA, 20 bp, Artificial Sequence
  Description of Artificial Sequence: Synthetic oligonucleotide
  Target: ATXN1; (-) strand; PAM type: YTN; PAM sequence: TTG
actgtttttattaatgattt

SEQ ID NO: 159492 - DNA, 20 bp, Artificial Sequence
  Description of Artificial Sequence: Synthetic oligonucleotide
  Target: ATXN1; (-) strand; PAM type: YTN; PAM sequence: TTT
gactgtttttattaatgatt

SEQ ID NO: 159493 - DNA, 20 bp, Artificial Sequence
  Description of Artificial Sequence: Synthetic oligonucleotide
  Target: ATXN1; (-) strand; PAM type: YTN; PAM sequence: TTT
tgactgtttttattaatgat

SEQ ID NO: 159494 - DNA, 20 bp, Artificial Sequence
  Description of Artificial Sequence: Synthetic oligonucleotide
  Target: ATXN1; (-) strand; PAM type: YTN; PAM sequence: CTC
agccaaagcgttttgactgt

SEQ ID NO: 159495 - DNA, 20 bp, Artificial Sequence
  Description of Artificial Sequence: Synthetic oligonucleotide
  Target: ATXN1; (-) strand; PAM type: YTN; PAM sequence: TTA
cactcagccaaagcgttttg

SEQ ID NO: 159496 - DNA, 20 bp, Artificial Sequence
  Description of Artificial Sequence: Synthetic oligonucleotide
  Target: ATXN1; (-) strand; PAM type: YTN; PAM sequence: CTT
acactcagccaaagcgtttt

SEQ ID NO: 159497 - DNA, 20 bp, Artificial Sequence
  Description of Artificial Sequence: Synthetic oligonucleotide
  Target: ATXN1; (-) strand; PAM type: YTN; PAM sequence: TTC
ttacactcagccaaagcgtt

SEQ ID NO: 159498 - DNA, 20 bp, Artificial Sequence
  Description of Artificial Sequence: Synthetic oligonucleotide
  Target: ATXN1; (-) strand; PAM type: YTN; PAM sequence: CTC
acagagattcttacactcag

SEQ ID NO: 159499 - DNA, 20 bp, Artificial Sequence
  Description of Artificial Sequence: Synthetic oligonucleotide
  Target: ATXN1; (-) strand; PAM type: YTN; PAM sequence: TTA
aatagaacactcacagagat

SEQ ID NO: 159500 - DNA, 20 bp, Artificial Sequence
  Description of Artificial Sequence: Synthetic oligonucleotide
  Target: ATXN1; (-) strand; PAM type: YTN; PAM sequence: TTT
aaatagaacactcacagaga

SEQ ID NO: 159501 - DNA, 20 bp, Artificial Sequence
  Description of Artificial Sequence: Synthetic oligonucleotide
  Target: ATXN1; (-) strand; PAM type: YTN; PAM sequence: TTT
taaatagaacactcacagag

SEQ ID NO: 159502 - DNA, 20 bp, Artificial Sequence
  Description of Artificial Sequence: Synthetic oligonucleotide
  Target: ATXN1; (-) strand; PAM type: YTN; PAM sequence: TTC
agtgttttaaatagaacact

SEQ ID NO: 159503 - DNA, 20 bp, Artificial Sequence
  Description of Artificial Sequence: Synthetic oligonucleotide
  Target: ATXN1; (-) strand; PAM type: YTN; PAM sequence: TTG
cgtgaacatgattcagtgtt

SEQ ID NO: 159504 - DNA, 20 bp, Artificial Sequence
  Description of Artificial Sequence: Synthetic oligonucleotide
  Target: ATXN1; (-) strand; PAM type: YTN; PAM sequence: TTT
gcgtgaacatgattcagtgt

SEQ ID NO: 159505 - DNA, 20 bp, Artificial Sequence
  Description of Artificial Sequence: Synthetic oligonucleotide
  Target: ATXN1; (-) strand; PAM type: YTN; PAM sequence: CTT
tgcgtgaacatgattcagtg

SEQ ID NO: 159506 - DNA, 20 bp, Artificial Sequence
  Description of Artificial Sequence: Synthetic oligonucleotide
  Target: ATXN1; (-) strand; PAM type: YTN; PAM sequence: CTG
agtcaggctttgcgtgaaca

SEQ ID NO: 159507 - DNA, 20 bp, Artificial Sequence
  Description of Artificial Sequence: Synthetic oligonucleotide
  Target: ATXN1; (-) strand; PAM type: YTN; PAM sequence: TTC
caccaaggactgagtcaggc

SEQ ID NO: 159508 - DNA, 20 bp, Artificial Sequence
  Description of Artificial Sequence: Synthetic oligonucleotide
  Target: ATXN1; (-) strand; PAM type: YTN; PAM sequence: CTT
ccaccaaggactgagtcagg

SEQ ID NO: 159509 - DNA, 20 bp, Artificial Sequence
  Description of Artificial Sequence: Synthetic oligonucleotide
  Target: ATXN1; (-) strand; PAM type: YTN; PAM sequence: CTG
aaacacttccaccaaggact

SEQ ID NO: 159510 - DNA, 20 bp, Artificial Sequence
  Description of Artificial Sequence: Synthetic oligonucleotide
  Target: ATXN1; (-) strand; PAM type: YTN; PAM sequence: CTG
aacaaccctgaaacacttcc

SEQ ID NO: 159511 - DNA, 20 bp, Artificial Sequence
  Description of Artificial Sequence: Synthetic oligonucleotide
  Target: ATXN1; (-) strand; PAM type: YTN; PAM sequence: TTA
ctgaacaaccctgaaacact

SEQ ID NO: 159512 - DNA, 20 bp, Artificial Sequence
  Description of Artificial Sequence: Synthetic oligonucleotide
  Target: ATXN1; (-) strand; PAM type: YTN; PAM sequence: TTT
actgaacaaccctgaaacac

SEQ ID NO: 159513 - DNA, 20 bp, Artificial Sequence
  Description of Artificial Sequence: Synthetic oligonucleotide
  Target: ATXN1; (-) strand; PAM type: YTN; PAM sequence: CTA
gggtgtgggtttactgaaca

SEQ ID NO: 159514 - DNA, 20 bp, Artificial Sequence
  Description of Artificial Sequence: Synthetic oligonucleotide
  Target: ATXN1; (-) strand; PAM type: YTN; PAM sequence: TTA
ggaggcgtcccggtgctagg

SEQ ID NO: 159515 - DNA, 20 bp, Artificial Sequence
  Description of Artificial Sequence: Synthetic oligonucleotide
  Target: ATXN1; (-) strand; PAM type: YTN; PAM sequence: TTG
tgttaggaggcgtcccggtg

SEQ ID NO: 159516 - DNA, 20 bp, Artificial Sequence
  Description of Artificial Sequence: Synthetic oligonucleotide
  Target: ATXN1; (-) strand; PAM type: YTN; PAM sequence: TTT
gtgttaggaggcgtcccggt

SEQ ID NO: 159517 - DNA, 20 bp, Artificial Sequence
  Description of Artificial Sequence: Synthetic oligonucleotide
  Target: ATXN1; (-) strand; PAM type: YTN; PAM sequence: TTA
atgtgggatttgtgttagga

SEQ ID NO: 159518 - DNA, 20 bp, Artificial Sequence
  Description of Artificial Sequence: Synthetic oligonucleotide
  Target: ATXN1; (-) strand; PAM type: YTN; PAM sequence: TTT
aatgtgggatttgtgttagg

SEQ ID NO: 159519 - DNA, 20 bp, Artificial Sequence
  Description of Artificial Sequence: Synthetic oligonucleotide
  Target: ATXN1; (-) strand; PAM type: YTN; PAM sequence: TTT
taatgtgggatttgtgttag

SEQ ID NO: 159520 - DNA, 20 bp, Artificial Sequence
  Description of Artificial Sequence: Synthetic oligonucleotide
  Target: ATXN1; (-) strand; PAM type: YTN; PAM sequence: CTT
ttaatgtgggatttgtgtta

SEQ ID NO: 159521 - DNA, 20 bp, Artificial Sequence
  Description of Artificial Sequence: Synthetic oligonucleotide
  Target: ATXN1; (-) strand; PAM type: YTN; PAM sequence: CTA
ccatgtgtaagaaaaaccca

SEQ ID NO: 159522 - DNA, 20 bp, Artificial Sequence
  Description of Artificial Sequence: Synthetic oligonucleotide
  Target: ATXN1; (-) strand; PAM type: YTN; PAM sequence: CTG
tgagccacgctaccatgtgt

SEQ ID NO: 159523 - DNA, 20 bp, Artificial Sequence
  Description of Artificial Sequence: Synthetic oligonucleotide
  Target: ATXN1; (-) strand; PAM type: YTN; PAM sequence: CTC
tgtgagccacgctaccatgt

SEQ ID NO: 159524 - DNA, 20 bp, Artificial Sequence
  Description of Artificial Sequence: Synthetic oligonucleotide
  Target: ATXN1; (-) strand; PAM type: YTN; PAM sequence: TTC
ccacaagggagctctgtgag

SEQ ID NO: 159525 - DNA, 20 bp, Artificial Sequence
  Description of Artificial Sequence: Synthetic oligonucleotide
  Target: ATXN1; (-) strand; PAM type: YTN; PAM sequence: CTT
cccacaagggagctctgtga

SEQ ID NO: 159526 - DNA, 20 bp, Artificial Sequence
  Description of Artificial Sequence: Synthetic oligonucleotide
  Target: ATXN1; (-) strand; PAM type: YTN; PAM sequence: CTC
cccacagggccttcccacaa

SEQ ID NO: 159527 - DNA, 20 bp, Artificial Sequence
  Description of Artificial Sequence: Synthetic oligonucleotide
  Target: ATXN1; (-) strand; PAM type: YTN; PAM sequence: CTG
agcctccccacagggccttc

SEQ ID NO: 159528 - DNA, 20 bp, Artificial Sequence
  Description of Artificial Sequence: Synthetic oligonucleotide
  Target: ATXN1; (-) strand; PAM type: YTN; PAM sequence: CTG
gccatccctgagcctcccca

SEQ ID NO: 159529 - DNA, 20 bp, Artificial Sequence
  Description of Artificial Sequence: Synthetic oligonucleotide
  Target: ATXN1; (-) strand; PAM type: YTN; PAM sequence: TTC
ctggccatccctgagcctcc

SEQ ID NO: 159530 - DNA, 20 bp, Artificial Sequence
  Description of Artificial Sequence: Synthetic oligonucleotide
  Target: ATXN1; (-) strand; PAM type: YTN; PAM sequence: CTT
cctggccatccctgagcctc

SEQ ID NO: 159531 - DNA, 20 bp, Artificial Sequence
  Description of Artificial Sequence: Synthetic oligonucleotide
  Target: ATXN1; (-) strand; PAM type: YTN; PAM sequence: CTG
ggcagtgtccttcctggcca

SEQ ID NO: 159532 - DNA, 20 bp, Artificial Sequence
  Description of Artificial Sequence: Synthetic oligonucleotide
  Target: ATXN1; (-) strand; PAM type: YTN; PAM sequence: CTC
actgggcagtgtccttcctg

SEQ ID NO: 159533 - DNA, 20 bp, Artificial Sequence
  Description of Artificial Sequence: Synthetic oligonucleotide
  Target: ATXN1; (-) strand; PAM type: YTN; PAM sequence: CTG
tggtcactcactgggcagtg

SEQ ID NO: 159534 - DNA, 20 bp, Artificial Sequence
  Description of Artificial Sequence: Synthetic oligonucleotide
  Target: ATXN1; (-) strand; PAM type: YTN; PAM sequence: CTG
ctgtggtcactcactgggca

SEQ ID NO: 159535 - DNA, 20 bp, Artificial Sequence
  Description of Artificial Sequence: Synthetic oligonucleotide
  Target: ATXN1; (-) strand; PAM type: YTN; PAM sequence: TTC
cgtgtcacagctgctgtggt

SEQ ID NO: 159536 - DNA, 20 bp, Artificial Sequence
  Description of Artificial Sequence: Synthetic oligonucleotide
  Target: ATXN1; (-) strand; PAM type: YTN; PAM sequence: CTT
ccgtgtcacagctgctgtgg

SEQ ID NO: 159537 - DNA, 20 bp, Artificial Sequence
  Description of Artificial Sequence: Synthetic oligonucleotide
  Target: ATXN1; (-) strand; PAM type: YTN; PAM sequence: CTA
agggcttccgtgtcacagct

SEQ ID NO: 159538 - DNA, 20 bp, Artificial Sequence
  Description of Artificial Sequence: Synthetic oligonucleotide
  Target: ATXN1; (-) strand; PAM type: YTN; PAM sequence: CTG
tgtgcctaagggcttccgtg

SEQ ID NO: 159539 - DNA, 20 bp, Artificial Sequence
  Description of Artificial Sequence: Synthetic oligonucleotide
  Target: ATXN1; (-) strand; PAM type: YTN; PAM sequence: CTA
gaacctgtgtgcctaagggc

SEQ ID NO: 159540 - DNA, 20 bp, Artificial Sequence
  Description of Artificial Sequence: Synthetic oligonucleotide
  Target: ATXN1; (-) strand; PAM type: YTN; PAM sequence: TTA
aggccccagaaaaggaaggc

SEQ ID NO: 159541 - DNA, 20 bp, Artificial Sequence
  Description of Artificial Sequence: Synthetic oligonucleotide
  Target: ATXN1; (-) strand; PAM type: YTN; PAM sequence: TTT
aaggccccagaaaaggaagg

SEQ ID NO: 159542 - DNA, 20 bp, Artificial Sequence
  Description of Artificial Sequence: Synthetic oligonucleotide
  Target: ATXN1; (-) strand; PAM type: YTN; PAM sequence: TTT
taaggccccagaaaaggaag

SEQ ID NO: 159543 - DNA, 20 bp, Artificial Sequence
  Description of Artificial Sequence: Synthetic oligonucleotide
  Target: ATXN1; (-) strand; PAM type: YTN; PAM sequence: CTA
aggcacacattttaaggccc

SEQ ID NO: 159544 - DNA, 20 bp, Artificial Sequence
  Description of Artificial Sequence: Synthetic oligonucleotide
  Target: ATXN1; (-) strand; PAM type: YTN; PAM sequence: CTG
cctaaggcacacattttaag

SEQ ID NO: 159545 - DNA, 20 bp, Artificial Sequence
  Description of Artificial Sequence: Synthetic oligonucleotide
  Target: ATXN1; (-) strand; PAM type: YTN; PAM sequence: TTC
cctgcctaaggcacacattt

SEQ ID NO: 159546 - DNA, 20 bp, Artificial Sequence
  Description of Artificial Sequence: Synthetic oligonucleotide
  Target: ATXN1; (-) strand; PAM type: YTN; PAM sequence: CTT
ccctgcctaaggcacacatt

SEQ ID NO: 159547 - DNA, 20 bp, Artificial Sequence
  Description of Artificial Sequence: Synthetic oligonucleotide
  Target: ATXN1; (-) strand; PAM type: YTN; PAM sequence: TTA
cagggatgagccacccttcc

SEQ ID NO: 159548 - DNA, 20 bp, Artificial Sequence
  Description of Artificial Sequence: Synthetic oligonucleotide
  Target: ATXN1; (-) strand; PAM type: YTN; PAM sequence: CTG
ggattacagggatgagccac

SEQ ID NO: 159549 - DNA, 20 bp, Artificial Sequence
  Description of Artificial Sequence: Synthetic oligonucleotide
  Target: ATXN1; (-) strand; PAM type: YTN; PAM sequence: CTC
aggcccccaaagtgctggga

SEQ ID NO: 159550 - DNA, 20 bp, Artificial Sequence
  Description of Artificial Sequence: Synthetic oligonucleotide
  Target: ATXN1; (-) strand; PAM type: YTN; PAM sequence: CTC
ccgcctcaggcccccaaagt

SEQ ID NO: 159551 - DNA, 20 bp, Artificial Sequence
  Description of Artificial Sequence: Synthetic oligonucleotide
  Target: ATXN1; (-) strand; PAM type: YTN; PAM sequence: CTC
atgtgatcctcccgcctcag

SEQ ID NO: 159552 - DNA, 20 bp, Artificial Sequence
  Description of Artificial Sequence: Synthetic oligonucleotide
  Target: ATXN1; (-) strand; PAM type: YTN; PAM sequence: CTG
agctcatgtgatcctcccgc

SEQ ID NO: 159553 - DNA, 20 bp, Artificial Sequence
  Description of Artificial Sequence: Synthetic oligonucleotide
  Target: ATXN1; (-) strand; PAM type: YTN; PAM sequence: CTC
ctgagctcatgtgatcctcc

SEQ ID NO: 159554 - DNA, 20 bp, Artificial Sequence
  Description of Artificial Sequence: Synthetic oligonucleotide
  Target: ATXN1; (-) strand; PAM type: YTN; PAM sequence: TTG
aactcctgagctcatgtgat

SEQ ID NO: 159555 - DNA, 20 bp, Artificial Sequence
  Description of Artificial Sequence: Synthetic oligonucleotide
  Target: ATXN1; (-) strand; PAM type: YTN; PAM sequence: CTT
gaactcctgagctcatgtga

SEQ ID NO: 159556 - DNA, 20 bp, Artificial Sequence
  Description of Artificial Sequence: Synthetic oligonucleotide
  Target: ATXN1; (-) strand; PAM type: YTN; PAM sequence: CTC
ttgaactcctgagctcatgt

SEQ ID NO: 159557 - DNA, 20 bp, Artificial Sequence
  Description of Artificial Sequence: Synthetic oligonucleotide
  Target: ATXN1; (-) strand; PAM type: YTN; PAM sequence: CTG
ctcttgaactcctgagctca

SEQ ID NO: 159558 - DNA, 20 bp, Artificial Sequence
  Description of Artificial Sequence: Synthetic oligonucleotide
  Target: ATXN1; (-) strand; PAM type: YTN; PAM sequence: TTG
cccaggctgctcttgaactc

SEQ ID NO: 159559 - DNA, 20 bp, Artificial Sequence
  Description of Artificial Sequence: Synthetic oligonucleotide
  Target: ATXN1; (-) strand; PAM type: YTN; PAM sequence: TTG
ccatgttgcccaggctgctc

SEQ ID NO: 159560 - DNA, 20 bp, Artificial Sequence
  Description of Artificial Sequence: Synthetic oligonucleotide
  Target: ATXN1; (-) strand; PAM type: YTN; PAM sequence: CTT
gccatgttgcccaggctgct

SEQ ID NO: 159561 - DNA, 20 bp, Artificial Sequence
  Description of Artificial Sequence: Synthetic oligonucleotide
  Target: ATXN1; (-) strand; PAM type: YTN; PAM sequence: TTG
tagagacggggtcttgccat

SEQ ID NO: 159562 - DNA, 20 bp, Artificial Sequence
  Description of Artificial Sequence: Synthetic oligonucleotide
  Target: ATXN1; (-) strand; PAM type: YTN; PAM sequence: TTT
gtagagacggggtcttgcca

SEQ ID NO: 159563 - DNA, 20 bp, Artificial Sequence
  Description of Artificial Sequence: Synthetic oligonucleotide
  Target: ATXN1; (-) strand; PAM type: YTN; PAM sequence: TTT
tgtagagacggggtcttgcc

SEQ ID NO: 159564 - DNA, 20 bp, Artificial Sequence
  Description of Artificial Sequence: Synthetic oligonucleotide
  Target: ATXN1; (-) strand; PAM type: YTN; PAM sequence: TTT
ttgtagagacggggtcttgc

SEQ ID NO: 159565 - DNA, 20 bp, Artificial Sequence
  Description of Artificial Sequence: Synthetic oligonucleotide
  Target: ATXN1; (-) strand; PAM type: YTN; PAM sequence: TTT
tttgtagagacggggtcttg

SEQ ID NO: 159566 - DNA, 20 bp, Artificial Sequence
  Description of Artificial Sequence: Synthetic oligonucleotide
  Target: ATXN1; (-) strand; PAM type: YTN; PAM sequence: TTT
ttttgtagagacggggtctt

SEQ ID NO: 159567 - DNA, 20 bp, Artificial Sequence
  Description of Artificial Sequence: Synthetic oligonucleotide
  Target: ATXN1; (-) strand; PAM type: YTN; PAM sequence: CTA
tttttttgtagagacggggt

SEQ ID NO: 159568 - DNA, 20 bp, Artificial Sequence
  Description of Artificial Sequence: Synthetic oligonucleotide
  Target: ATXN1; (-) strand; PAM type: YTN; PAM sequence: TTC
tatttttttgtagagacggg

SEQ ID NO: 159569 - DNA, 20 bp, Artificial Sequence
  Description of Artificial Sequence: Synthetic oligonucleotide
  Target: ATXN1; (-) strand; PAM type: YTN; PAM sequence: TTT
ctatttttttgtagagacgg

SEQ ID NO: 159570 - DNA, 20 bp, Artificial Sequence
  Description of Artificial Sequence: Synthetic oligonucleotide
  Target: ATXN1; (-) strand; PAM type: YTN; PAM sequence: TTT
tctatttttttgtagagacg

SEQ ID NO: 159571 - DNA, 20 bp, Artificial Sequence
  Description of Artificial Sequence: Synthetic oligonucleotide
  Target: ATXN1; (-) strand; PAM type: YTN; PAM sequence: TTT
ttctatttttttgtagagac

SEQ ID NO: 159572 - DNA, 20 bp, Artificial Sequence
  Description of Artificial Sequence: Synthetic oligonucleotide
  Target: ATXN1; (-) strand; PAM type: YTN; PAM sequence: CTA
atttttctatttttttgtag

SEQ ID NO: 159573 - DNA, 20 bp, Artificial Sequence
  Description of Artificial Sequence: Synthetic oligonucleotide
  Target: ATXN1; (-) strand; PAM type: YTN; PAM sequence: CTA
ggaacagggaccacaagtac

SEQ ID NO: 159574 - DNA, 20 bp, Artificial Sequence
  Description of Artificial Sequence: Synthetic oligonucleotide
  Target: ATXN1; (-) strand; PAM type: YTN; PAM sequence: CTC
cctaggaacagggaccacaa

SEQ ID NO: 159575 - DNA, 20 bp, Artificial Sequence
  Description of Artificial Sequence: Synthetic oligonucleotide
  Target: ATXN1; (-) strand; PAM type: YTN; PAM sequence: TTC
agcctccctaggaacaggga

SEQ ID NO: 159576 - DNA, 20 bp, Artificial Sequence
  Description of Artificial Sequence: Synthetic oligonucleotide
  Target: ATXN1; (-) strand; PAM type: YTN; PAM sequence: CTT
cagcctccctaggaacaggg

SEQ ID NO: 159577 - DNA, 20 bp, Artificial Sequence
  Description of Artificial Sequence: Synthetic oligonucleotide
  Target: ATXN1; (-) strand; PAM type: YTN; PAM sequence: CTC
ccacttcagcctccctagga

SEQ ID NO: 159578 - DNA, 20 bp, Artificial Sequence
  Description of Artificial Sequence: Synthetic oligonucleotide
  Target: ATXN1; (-) strand; PAM type: YTN; PAM sequence: CTC
aagcaatcctcccacttcag

SEQ ID NO: 159579 - DNA, 20 bp, Artificial Sequence
  Description of Artificial Sequence: Synthetic oligonucleotide
  Target: ATXN1; (-) strand; PAM type: YTN; PAM sequence: CTA
ggctcaagcaatcctcccac

SEQ ID NO: 159580 - DNA, 20 bp, Artificial Sequence
  Description of Artificial Sequence: Synthetic oligonucleotide
  Target: ATXN1; (-) strand; PAM type: YTN; PAM sequence: CTC
ctaggctcaagcaatcctcc

SEQ ID NO: 159581 - DNA, 20 bp, Artificial Sequence
  Description of Artificial Sequence: Synthetic oligonucleotide
  Target: ATXN1; (-) strand; PAM type: YTN; PAM sequence: TTG
acctcctaggctcaagcaat

SEQ ID NO: 159582 - DNA, 20 bp, Artificial Sequence
  Description of Artificial Sequence: Synthetic oligonucleotide
  Target: ATXN1; (-) strand; PAM type: YTN; PAM sequence: TTT
gacctcctaggctcaagcaa

SEQ ID NO: 159583 - DNA, 20 bp, Artificial Sequence
  Description of Artificial Sequence: Synthetic oligonucleotide
  Target: ATXN1; (-) strand; PAM type: YTN; PAM sequence: CTT
tgacctcctaggctcaagca

SEQ ID NO: 159584 - DNA, 20 bp, Artificial Sequence
  Description of Artificial Sequence: Synthetic oligonucleotide
  Target: ATXN1; (-) strand; PAM type: YTN; PAM sequence: CTG
cagctttgacctcctaggct

SEQ ID NO: 159585 - DNA, 20 bp, Artificial Sequence
  Description of Artificial Sequence: Synthetic oligonucleotide
  Target: ATXN1; (-) strand; PAM type: YTN; PAM sequence: CTC
actgcagctttgacctccta

SEQ ID NO: 159586 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtgacaccataat

SEQ ID NO: 159587 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtgcagtga

SEQ ID NO: 159588 - DNA, 20 bp, Artificial Sequence
  Description of Artificial Sequence: Synthetic oligonucleotide
  Target: ATXN1; (-) strand; PAM type: YTN; PAM sequence: CTG
ttgcccaggctggagtgcag

SEQ ID NO: 159589 - DNA, 20 bp, Artificial Sequence
  Description of Artificial Sequence: Synthetic oligonucleotide
  Target: ATXN1; (-) strand; PAM type: YTN; PAM sequence: CTC
tgttgcccaggctggagtgc

SEQ ID NO: 159590 - DNA, 20 bp, Artificial Sequence
  Description of Artificial Sequence: Synthetic oligonucleotide
  Target: ATXN1; (-) strand; PAM type: YTN; PAM sequence: TTG
ctctgttgcccaggctggag

SEQ ID NO: 159591 - DNA, 20 bp, Artificial Sequence
  Description of Artificial Sequence: Synthetic oligonucleotide
  Target: ATXN1; (-) strand; PAM type: YTN; PAM sequence: CTT
gctctgttgcccaggctgga

SEQ ID NO: 159592 - DNA, 20 bp, Artificial Sequence
  Description of Artificial Sequence: Synthetic oligonucleotide
  Target: ATXN1; (-) strand; PAM type: YTN; PAM sequence: TTG
agatagggtcttgctctgtt

SEQ ID NO: 159593 - DNA, 20 bp, Artificial Sequence
  Description of Artificial Sequence: Synthetic oligonucleotide
  Target: ATXN1; (-) strand; PAM type: YTN; PAM sequence: TTT
gagatagggtcttgctctgt

SEQ ID NO: 159594 - DNA, 20 bp, Artificial Sequence
  Description of Artificial Sequence: Synthetic oligonucleotide
  Target: ATXN1; (-) strand; PAM type: YTN; PAM sequence: TTT
tgagatagggtcttgctctg

SEQ ID NO: 159595 - DNA, 20 bp, Artificial Sequence
  Description of Artificial Sequence: Synthetic oligonucleotide
  Target: ATXN1; (-) strand; PAM type: YTN; PAM sequence: TTT
ttgagatagggtcttgctct

SEQ ID NO: 159596 - DNA, 20 bp, Artificial Sequence
  Description of Artificial Sequence: Synthetic oligonucleotide
  Target: ATXN1; (-) strand; PAM type: YTN; PAM sequence: TTT
tttgagatagggtcttgctc

SEQ ID NO: 159597 - DNA, 20 bp, Artificial Sequence
  Description of Artificial Sequence: Synthetic oligonucleotide
  Target: ATXN1; (-) strand; PAM type: YTN; PAM sequence: TTT
ttttgagatagggtcttgct

SEQ ID NO: 159598 - DNA, 20 bp, Artificial Sequence
  Description of Artificial Sequence: Synthetic oligonucleotide
  Target: ATXN1; (-) strand; PAM type: YTN; PAM sequence: TTT
tttttgagatagggtcttgc

SEQ ID NO: 159599 - DNA, 20 bp, Artificial Sequence
  Description of Artificial Sequence: Synthetic oligonucleotide
  Target: ATXN1; (-) strand; PAM type: YTN; PAM sequence: TTT
ttttttgagatagggtcttg

SEQ ID NO: 159600 - DNA, 20 bp, Artificial Sequence
  Description of Artificial Sequence: Synthetic oligonucleotide
  Target: ATXN1; (-) strand; PAM type: YTN; PAM sequence: TTT
tttttttgagatagggtctt

SEQ ID NO: 159601 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagatagggtct

SEQ ID NO: 159602 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagatagggtc

SEQ ID NO: 159603 - DNA, 20 bp, Artificial Sequence
  Description of Artificial Sequence: Synthetic oligonucleotide
  Target: ATXN1; (-) strand; PAM type: YTN; PAM sequence: TTA
aggcacattttttttttttg

SEQ ID NO: 159604 - DNA, 20 bp, Artificial Sequence
  Description of Artificial Sequence: Synthetic oligonucleotide
  Target: ATXN1; (-) strand; PAM type: YTN; PAM sequence: TTT
aaggcacatttttttttttt

SEQ ID NO: 159605 - DNA, 20 bp, Artificial Sequence
  Description of Artificial Sequence: Synthetic oligonucleotide
  Target: ATXN1; (-) strand; PAM type: YTN; PAM sequence: CTT
taaggcacattttttttttt

SEQ ID NO: 159606 - DNA, 20 bp, Artificial Sequence
  Description of Artificial Sequence: Synthetic oligonucleotide
  Target: ATXN1; (-) strand; PAM type: YTN; PAM sequence: TTC
tttaaggcacattttttttt

SEQ ID NO: 159607 - DNA, 20 bp, Artificial Sequence
  Description of Artificial Sequence: Synthetic oligonucleotide
  Target: ATXN1; (-) strand; PAM type: YTN; PAM sequence: TTG
ttctttaaggcacatttttt

SEQ ID NO: 159608 - DNA, 20 bp, Artificial Sequence
  Description of Artificial Sequence: Synthetic oligonucleotide
  Target: ATXN1; (-) strand; PAM type: YTN; PAM sequence: TTA
tgttgttctttaaggcacat

SEQ ID NO: 159609 - DNA, 20 bp, Artificial Sequence
  Description of Artificial Sequence: Synthetic oligonucleotide
  Target: ATXN1; (-) strand; PAM type: YTN; PAM sequence: CTG
aatattatgttgttctttaa

SEQ ID NO: 159610 - DNA, 20 bp, Artificial Sequence
  Description of Artificial Sequence: Synthetic oligonucleotide
  Target: ATXN1; (-) strand; PAM type: YTN; PAM sequence: TTA
gcactgaatattatgttgtt

SEQ ID NO: 159611 - DNA, 20 bp, Artificial Sequence
  Description of Artificial Sequence: Synthetic oligonucleotide
  Target: ATXN1; (-) strand; PAM type: YTN; PAM sequence: TTT
agcactgaatattatgttgt

SEQ ID NO: 159612 - DNA, 20 bp, Artificial Sequence
  Description of Artificial Sequence: Synthetic oligonucleotide
  Target: ATXN1; (-) strand; PAM type: YTN; PAM sequence: TTT
tagcactgaatattatgttg

SEQ ID NO: 159613 - DNA, 20 bp, Artificial Sequence
  Description of Artificial Sequence: Synthetic oligonucleotide
  Target: ATXN1; (-) strand; PAM type: YTN; PAM sequence: TTT
ttagcactgaatattatgtt

SEQ ID NO: 159614 - DNA, 20 bp, Artificial Sequence
  Description of Artificial Sequence: Synthetic oligonucleotide
  Target: ATXN1; (-) strand; PAM type: YTN; PAM sequence: CTT
tttagcactgaatattatgt

SEQ ID NO: 159615 - DNA, 20 bp, Artificial Sequence
  Description of Artificial Sequence: Synthetic oligonucleotide
  Target: ATXN1; (-) strand; PAM type: YTN; PAM sequence: TTC
tttttagcactgaatattat

SEQ ID NO: 159616 - DNA, 20 bp, Artificial Sequence
  Description of Artificial Sequence: Synthetic oligonucleotide
  Target: ATXN1; (-) strand; PAM type: YTN; PAM sequence: TTT
ctttttagcactgaatatta

SEQ ID NO: 159617 - DNA, 20 bp, Artificial Sequence
  Description of Artificial Sequence: Synthetic oligonucleotide
  Target: ATXN1; (-) strand; PAM type: YTN; PAM sequence: CTC
atttctttttagcactgaat

SEQ ID NO: 159618 - DNA, 20 bp, Artificial Sequence
  Description of Artificial Sequence: Synthetic oligonucleotide
  Target: ATXN1; (-) strand; PAM type: YTN; PAM sequence: CTG
atagctcatttctttttagc

SEQ ID NO: 159619 - DNA, 20 bp, Artificial Sequence
  Description of Artificial Sequence: Synthetic oligonucleotide
  Target: ATXN1; (-) strand; PAM type: YTN; PAM sequence: CTC
tgatagctcatttcttttta

SEQ ID NO: 159620 - DNA, 20 bp, Artificial Sequence
  Description of Artificial Sequence: Synthetic oligonucleotide
  Target: ATXN1; (-) strand; PAM type: YTN; PAM sequence: TTG
ctctgatagctcatttcttt

SEQ ID NO: 159621 - DNA, 20 bp, Artificial Sequence
  Description of Artificial Sequence: Synthetic oligonucleotide
  Target: ATXN1; (-) strand; PAM type: YTN; PAM sequence: TTG
ttgctctgatagctcatttc

SEQ ID NO: 159622 - DNA, 20 bp, Artificial Sequence
  Description of Artificial Sequence: Synthetic oligonucleotide
  Target: ATXN1; (-) strand; PAM type: YTN; PAM sequence: CTT
gttgctctgatagctcattt

SEQ ID NO: 159623 - DNA, 20 bp, Artificial Sequence
  Description of Artificial Sequence: Synthetic oligonucleotide
  Target: ATXN1; (-) strand; PAM type: YTN; PAM sequence: TTC
ttgttgctctgatagctcat

SEQ ID NO: 159624 - DNA, 20 bp, Artificial Sequence
  Description of Artificial Sequence: Synthetic oligonucleotide
  Target: ATXN1; (-) strand; PAM type: YTN; PAM sequence: CTT
cttgttgctctgatagctca

SEQ ID NO: 159625 - DNA, 20 bp, Artificial Sequence
  Description of Artificial Sequence: Synthetic oligonucleotide
  Target: ATXN1; (-) strand; PAM type: YTN; PAM sequence: TTC
catgtcttcttgttgctctg

SEQ ID NO: 159626 - DNA, 20 bp, Artificial Sequence
  Description of Artificial Sequence: Synthetic oligonucleotide
  Target: ATXN1; (-) strand; PAM type: YTN; PAM sequence: CTT
ccatgtcttcttgttgctct

SEQ ID NO: 159627 - DNA, 20 bp, Artificial Sequence
  Description of Artificial Sequence: Synthetic oligonucleotide
  Target: ATXN1; (-) strand; PAM type: YTN; PAM sequence: TTC
ttccatgtcttcttgttgct

SEQ ID NO: 159628 - DNA, 20 bp, Artificial Sequence
  Description of Artificial Sequence: Synthetic oligonucleotide
  Target: ATXN1; (-) strand; PAM type: YTN; PAM sequence: TTC
aggttcttccatgtcttctt

SEQ ID NO: 159629 - DNA, 20 bp, Artificial Sequence
  Description of Artificial Sequence: Synthetic oligonucleotide
  Target: ATXN1; (-) strand; PAM type: YTN; PAM sequence: TTT
caggttcttccatgtcttct

SEQ ID NO: 159630 - DNA, 20 bp, Artificial Sequence
  Description of Artificial Sequence: Synthetic oligonucleotide
  Target: ATXN1; (-) strand; PAM type: YTN; PAM sequence: TTA
gcgatatgcatttcaggttc

SEQ ID NO: 159631 - DNA, 20 bp, Artificial Sequence
  Description of Artificial Sequence: Synthetic oligonucleotide
  Target: ATXN1; (-) strand; PAM type: YTN; PAM sequence: CTT
agcgatatgcatttcaggtt

SEQ ID NO: 159632 - DNA, 20 bp, Artificial Sequence
  Description of Artificial Sequence: Synthetic oligonucleotide
  Target: ATXN1; (-) strand; PAM type: YTN; PAM sequence: CTC
acttagcgatatgcatttca

SEQ ID NO: 159633 - DNA, 20 bp, Artificial Sequence
  Description of Artificial Sequence: Synthetic oligonucleotide
  Target: ATXN1; (-) strand; PAM type: YTN; PAM sequence: CTC
tcacttagcgatatgcattt

SEQ ID NO: 159634 - DNA, 20 bp, Artificial Sequence
  Description of Artificial Sequence: Synthetic oligonucleotide
  Target: ATXN1; (-) strand; PAM type: YTN; PAM sequence: TTG
gcgtctctcacttagcgata

SEQ ID NO: 159635 - DNA, 20 bp, Artificial Sequence
  Description of Artificial Sequence: Synthetic oligonucleotide
  Target: ATXN1; (-) strand; PAM type: YTN; PAM sequence: TTC
acattggcgtctctcactta

SEQ ID NO: 159636 - DNA, 20 bp, Artificial Sequence
  Description of Artificial Sequence: Synthetic oligonucleotide
  Target: ATXN1; (-) strand; PAM type: YTN; PAM sequence: TTT
cacattggcgtctctcactt

SEQ ID NO: 159637 - DNA, 20 bp, Artificial Sequence
  Description of Artificial Sequence: Synthetic oligonucleotide
  Target: ATXN1; (-) strand; PAM type: YTN; PAM sequence: TTT
tcacattggcgtctctcact

SEQ ID NO: 159638 - DNA, 20 bp, Artificial Sequence
  Description of Artificial Sequence: Synthetic oligonucleotide
  Target: ATXN1; (-) strand; PAM type: YTN; PAM sequence: CTT
ttcacattggcgtctctcac

SEQ ID NO: 159639 - DNA, 20 bp, Artificial Sequence
  Description of Artificial Sequence: Synthetic oligonucleotide
  Target: ATXN1; (-) strand; PAM type: YTN; PAM sequence: TTG
gaatcatccggtatgtcgcc

SEQ ID NO: 159640 - DNA, 20 bp, Artificial Sequence
  Description of Artificial Sequence: Synthetic oligonucleotide
  Target: ATXN1; (-) strand; PAM type: YTN; PAM sequence: TTC
cagaatgccatgcagttgga

SEQ ID NO: 159641 - DNA, 20 bp, Artificial Sequence
  Description of Artificial Sequence: Synthetic oligonucleotide
  Target: ATXN1; (-) strand; PAM type: YTN; PAM sequence: CTG
ttccagaatgccatgcagtt

SEQ ID NO: 159642 - DNA, 20 bp, Artificial Sequence
  Description of Artificial Sequence: Synthetic oligonucleotide
  Target: ATXN1; (-) strand; PAM type: YTN; PAM sequence: TTG
cctgttccagaatgccatgc

SEQ ID NO: 159643 - DNA, 20 bp, Artificial Sequence
  Description of Artificial Sequence: Synthetic oligonucleotide
  Target: ATXN1; (-) strand; PAM type: YTN; PAM sequence: TTT
gcctgttccagaatgccatg

SEQ ID NO: 159644 - DNA, 20 bp, Artificial Sequence
  Description of Artificial Sequence: Synthetic oligonucleotide
  Target: ATXN1; (-) strand; PAM type: YTN; PAM sequence: TTT
tgcctgttccagaatgccat

SEQ ID NO: 159645 - DNA, 20 bp, Artificial Sequence
  Description of Artificial Sequence: Synthetic oligonucleotide
  Target: ATXN1; (-) strand; PAM type: YTN; PAM sequence: CTC
catagttttgcctgttccag

SEQ ID NO: 159646 - DNA, 20 bp, Artificial Sequence
  Description of Artificial Sequence: Synthetic oligonucleotide
  Target: ATXN1; (-) strand; PAM type: YTN; PAM sequence: CTC
tccatagttttgcctgttcc

SEQ ID NO: 159647 - DNA, 20 bp, Artificial Sequence
  Description of Artificial Sequence: Synthetic oligonucleotide
  Target: ATXN1; (-) strand; PAM type: YTN; PAM sequence: CTC
tctccatagttttgcctgtt

SEQ ID NO: 159648 - DNA, 20 bp, Artificial Sequence
  Description of Artificial Sequence: Synthetic oligonucleotide
  Target: ATXN1; (-) strand; PAM type: YTN; PAM sequence: TTA
ctctctccatagttttgcct

SEQ ID NO: 159649 - DNA, 20 bp, Artificial Sequence
  Description of Artificial Sequence: Synthetic oligonucleotide
  Target: ATXN1; (-) strand; PAM type: YTN; PAM sequence: TTT
actctctccatagttttgcc

SEQ ID NO: 159650 - DNA, 20 bp, Artificial Sequence
  Description of Artificial Sequence: Synthetic oligonucleotide
  Target: ATXN1; (-) strand; PAM type: YTN; PAM sequence: TTT
tactctctccatagttttgc

SEQ ID NO: 159651 - DNA, 20 bp, Artificial Sequence
  Description of Artificial Sequence: Synthetic oligonucleotide
  Target: ATXN1; (-) strand; PAM type: YTN; PAM sequence: CTG
atcattttactctctccata

SEQ ID NO: 159652 - DNA, 20 bp, Artificial Sequence
  Description of Artificial Sequence: Synthetic oligonucleotide
  Target: ATXN1; (-) strand; PAM type: YTN; PAM sequence: CTG
gcacccactgatcattttac

SEQ ID NO: 159653 - DNA, 20 bp, Artificial Sequence
  Description of Artificial Sequence: Synthetic oligonucleotide
  Target: ATXN1; (-) strand; PAM type: YTN; PAM sequence: CTC
ctggcacccactgatcattt

SEQ ID NO: 159654 - DNA, 20 bp, Artificial Sequence
  Description of Artificial Sequence: Synthetic oligonucleotide
  Target: ATXN1; (-) strand; PAM type: YTN; PAM sequence: CTG
aaactcctggcacccactga

SEQ ID NO: 159655 - DNA, 20 bp, Artificial Sequence
  Description of Artificial Sequence: Synthetic oligonucleotide
  Target: ATXN1; (-) strand; PAM type: YTN; PAM sequence: TTG
tcccccacaccccacctgaa

SEQ ID NO: 159656 - DNA, 20 bp, Artificial Sequence
  Description of Artificial Sequence: Synthetic oligonucleotide
  Target: ATXN1; (-) strand; PAM type: YTN; PAM sequence: TTT
gtcccccacaccccacctga

SEQ ID NO: 159657 - DNA, 20 bp, Artificial Sequence
  Description of Artificial Sequence: Synthetic oligonucleotide
  Target: ATXN1; (-) strand; PAM type: YTN; PAM sequence: CTA
tttgtcccccacaccccacc

SEQ ID NO: 159658 - DNA, 20 bp, Artificial Sequence
  Description of Artificial Sequence: Synthetic oligonucleotide
  Target: ATXN1; (-) strand; PAM type: YTN; PAM sequence: TTA
tgcatcaactatttgtcccc

SEQ ID NO: 159659 - DNA, 20 bp, Artificial Sequence
  Description of Artificial Sequence: Synthetic oligonucleotide
  Target: ATXN1; (-) strand; PAM type: YTN; PAM sequence: CTT
atgcatcaactatttgtccc

SEQ ID NO: 159660 - DNA, 20 bp, Artificial Sequence
  Description of Artificial Sequence: Synthetic oligonucleotide
  Target: ATXN1; (-) strand; PAM type: YTN; PAM sequence: CTA
aaaatcccttatgcatcaac

SEQ ID NO: 159661 - DNA, 20 bp, Artificial Sequence
  Description of Artificial Sequence: Synthetic oligonucleotide
  Target: ATXN1; (-) strand; PAM type: YTN; PAM sequence: CTG
taccaccctaaaaatccctt

SEQ ID NO: 159662 - DNA, 20 bp, Artificial Sequence
  Description of Artificial Sequence: Synthetic oligonucleotide
  Target: ATXN1; (-) strand; PAM type: YTN; PAM sequence: TTA
tacagaacagctgtaccacc

SEQ ID NO: 159663 - DNA, 20 bp, Artificial Sequence
  Description of Artificial Sequence: Synthetic oligonucleotide
  Target: ATXN1; (-) strand; PAM type: YTN; PAM sequence: TTA
ttatacagaacagctgtacc

SEQ ID NO: 159664 - DNA, 20 bp, Artificial Sequence
  Description of Artificial Sequence: Synthetic oligonucleotide
  Target: ATXN1; (-) strand; PAM type: YTN; PAM sequence: TTA
cattattatacagaacagct

SEQ ID NO: 159665 - DNA, 20 bp, Artificial Sequence
  Description of Artificial Sequence: Synthetic oligonucleotide
  Target: ATXN1; (-) strand; PAM type: YTN; PAM sequence: TTA
tgatgtcatgtatccagcat

SEQ ID NO: 159666 - DNA, 20 bp, Artificial Sequence
  Description of Artificial Sequence: Synthetic oligonucleotide
  Target: ATXN1; (-) strand; PAM type: YTN; PAM sequence: TTT
atgatgtcatgtatccagca

SEQ ID NO: 159667 - DNA, 20 bp, Artificial Sequence
  Description of Artificial Sequence: Synthetic oligonucleotide
  Target: ATXN1; (-) strand; PAM type: YTN; PAM sequence: TTG
atgaatttatgatgtcatgt

SEQ ID NO: 159668 - DNA, 20 bp, Artificial Sequence
  Description of Artificial Sequence: Synthetic oligonucleotide
  Target: ATXN1; (-) strand; PAM type: YTN; PAM sequence: TTT
gatgaatttatgatgtcatg

SEQ ID NO: 159669 - DNA, 20 bp, Artificial Sequence
  Description of Artificial Sequence: Synthetic oligonucleotide
  Target: ATXN1; (-) strand; PAM type: YTN; PAM sequence: TTT
tgatgaatttatgatgtcat

SEQ ID NO: 159670 - DNA, 20 bp, Artificial Sequence
  Description of Artificial Sequence: Synthetic oligonucleotide
  Target: ATXN1; (-) strand; PAM type: YTN; PAM sequence: TTT
ttgatgaatttatgatgtca

SEQ ID NO: 159671 - DNA, 20 bp, Artificial Sequence
  Description of Artificial Sequence: Synthetic oligonucleotide
  Target: ATXN1; (-) strand; PAM type: YTN; PAM sequence: CTG
tttttgatgaatttatgatg

SEQ ID NO: 159672 - DNA, 20 bp, Artificial Sequence
  Description of Artificial Sequence: Synthetic oligonucleotide
  Target: ATXN1; (-) strand; PAM type: YTN; PAM sequence: TTG
tacatgctgtttttgatgaa

SEQ ID NO: 159673 - DNA, 20 bp, Artificial Sequence
  Description of Artificial Sequence: Synthetic oligonucleotide
  Target: ATXN1; (-) strand; PAM type: YTN; PAM sequence: CTG
tgttgtacatgctgtttttg

SEQ ID NO: 159674 - DNA, 20 bp, Artificial Sequence
  Description of Artificial Sequence: Synthetic oligonucleotide
  Target: ATXN1; (-) strand; PAM type: YTN; PAM sequence: CTC
tgtgttgtacatgctgtttt

SEQ ID NO: 159675 - DNA, 20 bp, Artificial Sequence
  Description of Artificial Sequence: Synthetic oligonucleotide
  Target: ATXN1; (-) strand; PAM type: YTN; PAM sequence: TTC
actctgtgttgtacatgctg

SEQ ID NO: 159676 - DNA, 20 bp, Artificial Sequence
  Description of Artificial Sequence: Synthetic oligonucleotide
  Target: ATXN1; (-) strand; PAM type: YTN; PAM sequence: CTA
cagttcactctgtgttgtac

SEQ ID NO: 159677 - DNA, 20 bp, Artificial Sequence
  Description of Artificial Sequence: Synthetic oligonucleotide
  Target: ATXN1; (-) strand; PAM type: YTN; PAM sequence: TTA
tactacagttcactctgtgt

SEQ ID NO: 159678 - DNA, 20 bp, Artificial Sequence
  Description of Artificial Sequence: Synthetic oligonucleotide
  Target: ATXN1; (-) strand; PAM type: YTN; PAM sequence: TTT
atactacagttcactctgtg

SEQ ID NO: 159679 - DNA, 20 bp, Artificial Sequence
  Description of Artificial Sequence: Synthetic oligonucleotide
  Target: ATXN1; (-) strand; PAM type: YTN; PAM sequence: CTA
aagtccatagtttatactac

SEQ ID NO: 159680 - DNA, 20 bp, Artificial Sequence
  Description of Artificial Sequence: Synthetic oligonucleotide
  Target: ATXN1; (-) strand; PAM type: YTN; PAM sequence: TTA
actaaagtccatagtttata

SEQ ID NO: 159681 - DNA, 20 bp, Artificial Sequence
  Description of Artificial Sequence: Synthetic oligonucleotide
  Target: ATXN1; (-) strand; PAM type: YTN; PAM sequence: TTT
aactaaagtccatagtttat

SEQ ID NO: 159682 - DNA, 20 bp, Artificial Sequence
  Description of Artificial Sequence: Synthetic oligonucleotide
  Target: ATXN1; (-) strand; PAM type: YTN; PAM sequence: TTT
taactaaagtccatagttta

SEQ ID NO: 159683 - DNA, 20 bp, Artificial Sequence
  Description of Artificial Sequence: Synthetic oligonucleotide
  Target: ATXN1; (-) strand; PAM type: YTN; PAM sequence: TTT
ttaactaaagtccatagttt

SEQ ID NO: 159684 - DNA, 20 bp, Artificial Sequence
  Description of Artificial Sequence: Synthetic oligonucleotide
  Target: ATXN1; (-) strand; PAM type: YTN; PAM sequence: TTA
tttttaactaaagtccatag

SEQ ID NO: 159685 - DNA, 20 bp, Artificial Sequence
  Description of Artificial Sequence: Synthetic oligonucleotide
  Target: ATXN1; (-) strand; PAM type: YTN; PAM sequence: CTT
atttttaactaaagtccata

SEQ ID NO: 159686 - DNA, 20 bp, Artificial Sequence
  Description of Artificial Sequence: Synthetic oligonucleotide
  Target: ATXN1; (-) strand; PAM type: YTN; PAM sequence: CTG
atgagccagtaccgatacct

SEQ ID NO: 159687 - DNA, 20 bp, Artificial Sequence
  Description of Artificial Sequence: Synthetic oligonucleotide
  Target: ATXN1; (-) strand; PAM type: YTN; PAM sequence: TTA
caactgatgagccagtaccg

SEQ ID NO: 159688 - DNA, 20 bp, Artificial Sequence
  Description of Artificial Sequence: Synthetic oligonucleotide
  Target: ATXN1; (-) strand; PAM type: YTN; PAM sequence: TTG
gttacaactgatgagccagt

SEQ ID NO: 159689 - DNA, 20 bp, Artificial Sequence
  Description of Artificial Sequence: Synthetic oligonucleotide
  Target: ATXN1; (-) strand; PAM type: YTN; PAM sequence: TTG
gtgtgatagattggttacaa

SEQ ID NO: 159690 - DNA, 20 bp, Artificial Sequence
  Description of Artificial Sequence: Synthetic oligonucleotide
  Target: ATXN1; (-) strand; PAM type: YTN; PAM sequence: TTG
cattggtgtgatagattggt

SEQ ID NO: 159691 - DNA, 20 bp, Artificial Sequence
  Description of Artificial Sequence: Synthetic oligonucleotide
  Target: ATXN1; (-) strand; PAM type: YTN; PAM sequence: CTT
gcattggtgtgatagattgg

SEQ ID NO: 159692 - DNA, 20 bp, Artificial Sequence
  Description of Artificial Sequence: Synthetic oligonucleotide
  Target: ATXN1; (-) strand; PAM type: YTN; PAM sequence: TTA
aaatcttgcattggtgtgat

SEQ ID NO: 159693 - DNA, 20 bp, Artificial Sequence
  Description of Artificial Sequence: Synthetic oligonucleotide
  Target: ATXN1; (-) strand; PAM type: YTN; PAM sequence: TTA
ttaaaatcttgcattggtgt

SEQ ID NO: 159694 - DNA, 20 bp, Artificial Sequence
  Description of Artificial Sequence: Synthetic oligonucleotide
  Target: ATXN1; (-) strand; PAM type: YTN; PAM sequence: CTG
ttattaaaatcttgcattgg

SEQ ID NO: 159695 - DNA, 20 bp, Artificial Sequence
  Description of Artificial Sequence: Synthetic oligonucleotide
  Target: ATXN1; (-) strand; PAM type: YTN; PAM sequence: TTC
cctgttattaaaatcttgca

SEQ ID NO: 159696 - DNA, 20 bp, Artificial Sequence
  Description of Artificial Sequence: Synthetic oligonucleotide
  Target: ATXN1; (-) strand; PAM type: YTN; PAM sequence: TTT
ccctgttattaaaatcttgc

SEQ ID NO: 159697 - DNA, 20 bp, Artificial Sequence
  Description of Artificial Sequence: Synthetic oligonucleotide
  Target: ATXN1; (-) strand; PAM type: YTN; PAM sequence: TTT
tccctgttattaaaatcttg

SEQ ID NO: 159698 - DNA, 20 bp, Artificial Sequence
  Description of Artificial Sequence: Synthetic oligonucleotide
  Target: ATXN1; (-) strand; PAM type: YTN; PAM sequence: CTA
acagttttccctgttattaa

SEQ ID NO: 159699 - DNA, 20 bp, Artificial Sequence
  Description of Artificial Sequence: Synthetic oligonucleotide
  Target: ATXN1; (-) strand; PAM type: YTN; PAM sequence: CTC
acacacctaacagttttccc

SEQ ID NO: 159700 - DNA, 20 bp, Artificial Sequence
  Description of Artificial Sequence: Synthetic oligonucleotide
  Target: ATXN1; (-) strand; PAM type: YTN; PAM sequence: TTA
ggtgtacagcaagtagagag

SEQ ID NO: 159701 - DNA, 20 bp, Artificial Sequence
  Description of Artificial Sequence: Synthetic oligonucleotide
  Target: ATXN1; (-) strand; PAM type: YTN; PAM sequence: TTT
aggtgtacagcaagtagaga

SEQ ID NO: 159702 - DNA, 20 bp, Artificial Sequence
  Description of Artificial Sequence: Synthetic oligonucleotide
  Target: ATXN1; (-) strand; PAM type: YTN; PAM sequence: TTT
taggtgtacagcaagtagag

SEQ ID NO: 159703 - DNA, 20 bp, Artificial Sequence
  Description of Artificial Sequence: Synthetic oligonucleotide
  Target: ATXN1; (-) strand; PAM type: YTN; PAM sequence: TTA
aagcagttttaggtgtacag

SEQ ID NO: 159704 - DNA, 20 bp, Artificial Sequence
  Description of Artificial Sequence: Synthetic oligonucleotide
  Target: ATXN1; (-) strand; PAM type: YTN; PAM sequence: TTT
aaagcagttttaggtgtaca

SEQ ID NO: 159705 - DNA, 20 bp, Artificial Sequence
  Description of Artificial Sequence: Synthetic oligonucleotide
  Target: ATXN1; (-) strand; PAM type: YTN; PAM sequence: TTG
tttaaagcagttttaggtgt

SEQ ID NO: 159706 - DNA, 20 bp, Artificial Sequence
  Description of Artificial Sequence: Synthetic oligonucleotide
  Target: ATXN1; (-) strand; PAM type: YTN; PAM sequence: CTA
ttgtttaaagcagttttagg

SEQ ID NO: 159707 - DNA, 20 bp, Artificial Sequence
  Description of Artificial Sequence: Synthetic oligonucleotide
  Target: ATXN1; (-) strand; PAM type: YTN; PAM sequence: TTA
aagactattgtttaaagcag

SEQ ID NO: 159708 - DNA, 20 bp, Artificial Sequence
  Description of Artificial Sequence: Synthetic oligonucleotide
  Target: ATXN1; (-) strand; PAM type: YTN; PAM sequence: TTA
gaaaaaaattaaagactatt

SEQ ID NO: 159709 - DNA, 20 bp, Artificial Sequence
  Description of Artificial Sequence: Synthetic oligonucleotide
  Target: ATXN1; (-) strand; PAM type: YTN; PAM sequence: TTT
agaaaaaaattaaagactat

SEQ ID NO: 159710 - DNA, 20 bp, Artificial Sequence
  Description of Artificial Sequence: Synthetic oligonucleotide
  Target: ATXN1; (-) strand; PAM type: YTN; PAM sequence: TTA
tagcatttagaaaaaaatta

SEQ ID NO: 159711 - DNA, 20 bp, Artificial Sequence
  Description of Artificial Sequence: Synthetic oligonucleotide
  Target: ATXN1; (-) strand; PAM type: YTN; PAM sequence: TTT
atagcatttagaaaaaaatt

SEQ ID NO: 159712 - DNA, 20 bp, Artificial Sequence
  Description of Artificial Sequence: Synthetic oligonucleotide
  Target: ATXN1; (-) strand; PAM type: YTN; PAM sequence: TTG
tttatagcatttagaaaaaa

SEQ ID NO: 159713 - DNA, 20 bp, Artificial Sequence
  Description of Artificial Sequence: Synthetic oligonucleotide
  Target: ATXN1; (-) strand; PAM type: YTN; PAM sequence: TTG
ttgtttatagcatttagaaa

SEQ ID NO: 159714 - DNA, 20 bp, Artificial Sequence
  Description of Artificial Sequence: Synthetic oligonucleotide
  Target: ATXN1; (-) strand; PAM type: YTN; PAM sequence: CTG
ttgttgtttatagcatttag

SEQ ID NO: 159715 - DNA, 20 bp, Artificial Sequence
  Description of Artificial Sequence: Synthetic oligonucleotide
  Target: ATXN1; (-) strand; PAM type: YTN; PAM sequence: CTC
agactgttgttgtttatagc

SEQ ID NO: 159716 - DNA, 20 bp, Artificial Sequence
  Description of Artificial Sequence: Synthetic oligonucleotide
  Target: ATXN1; (-) strand; PAM type: YTN; PAM sequence: CTC
tcagactgttgttgtttata

SEQ ID NO: 159717 - DNA, 20 bp, Artificial Sequence
  Description of Artificial Sequence: Synthetic oligonucleotide
  Target: ATXN1; (-) strand; PAM type: YTN; PAM sequence: TTC
tctcagactgttgttgttta

SEQ ID NO: 159718 - DNA, 20 bp, Artificial Sequence
  Description of Artificial Sequence: Synthetic oligonucleotide
  Target: ATXN1; (-) strand; PAM type: YTN; PAM sequence: TTG
attctctcagactgttgttg

SEQ ID NO: 159719 - DNA, 20 bp, Artificial Sequence
  Description of Artificial Sequence: Synthetic oligonucleotide
  Target: ATXN1; (-) strand; PAM type: YTN; PAM sequence: TTT
gattctctcagactgttgtt

SEQ ID NO: 159720 - DNA, 20 bp, Artificial Sequence
  Description of Artificial Sequence: Synthetic oligonucleotide
  Target: ATXN1; (-) strand; PAM type: YTN; PAM sequence: TTT
tgattctctcagactgttgt

SEQ ID NO: 159721 - DNA, 20 bp, Artificial Sequence
  Description of Artificial Sequence: Synthetic oligonucleotide
  Target: ATXN1; (-) strand; PAM type: YTN; PAM sequence: TTA
tatgttttgattctctcaga

SEQ ID NO: 159722 - DNA, 20 bp, Artificial Sequence
  Description of Artificial Sequence: Synthetic oligonucleotide
  Target: ATXN1; (-) strand; PAM type: YTN; PAM sequence: CTT
atatgttttgattctctcag

SEQ ID NO: 159723 - DNA, 20 bp, Artificial Sequence
  Description of Artificial Sequence: Synthetic oligonucleotide
  Target: ATXN1; (-) strand; PAM type: YTN; PAM sequence: CTG
ggtcatcttatatgttttga

SEQ ID NO: 159724 - DNA, 20 bp, Artificial Sequence
  Description of Artificial Sequence: Synthetic oligonucleotide
  Target: ATXN1; (-) strand; PAM type: YTN; PAM sequence: CTA
tatgtgcccccaactgggtc

SEQ ID NO: 159725 - DNA, 20 bp, Artificial Sequence
  Description of Artificial Sequence: Synthetic oligonucleotide
  Target: ATXN1; (-) strand; PAM type: YTN; PAM sequence: CTG
tatgtgctatatgtgccccc

SEQ ID NO: 159726 - DNA, 20 bp, Artificial Sequence
  Description of Artificial Sequence: Synthetic oligonucleotide
  Target: ATXN1; (-) strand; PAM type: YTN; PAM sequence: TTA
aactgtatgtgctatatgtg

SEQ ID NO: 159727 - DNA, 20 bp, Artificial Sequence
  Description of Artificial Sequence: Synthetic oligonucleotide
  Target: ATXN1; (-) strand; PAM type: YTN; PAM sequence: TTT
aaactgtatgtgctatatgt

SEQ ID NO: 159728 - DNA, 20 bp, Artificial Sequence
  Description of Artificial Sequence: Synthetic oligonucleotide
  Target: ATXN1; (-) strand; PAM type: YTN; PAM sequence: CTT
taaactgtatgtgctatatg

SEQ ID NO: 159729 - DNA, 20 bp, Artificial Sequence
  Description of Artificial Sequence: Synthetic oligonucleotide
  Target: ATXN1; (-) strand; PAM type: YTN; PAM sequence: CTC
ctttaaactgtatgtgctat

SEQ ID NO: 159730 - DNA, 20 bp, Artificial Sequence
  Description of Artificial Sequence: Synthetic oligonucleotide
  Target: ATXN1; (-) strand; PAM type: YTN; PAM sequence: CTC
tcctttaaactgtatgtgct

SEQ ID NO: 159731 - DNA, 20 bp, Artificial Sequence
  Description of Artificial Sequence: Synthetic oligonucleotide
  Target: ATXN1; (-) strand; PAM type: YTN; PAM sequence: CTA
aaaaaaaaaaaaaaggagaa

SEQ ID NO: 159732 - DNA, 20 bp, Artificial Sequence
  Description of Artificial Sequence: Synthetic oligonucleotide
  Target: ATXN1; (-) strand; PAM type: YTN; PAM sequence: CTC
taaaaaaaaaaaaaaaggag

SEQ ID NO: 159733 - DNA, 20 bp, Artificial Sequence
  Description of Artificial Sequence: Synthetic oligonucleotide
  Target: ATXN1; (-) strand; PAM type: YTN; PAM sequence: CTC
tctaaaaaaaaaaaaaaagg

SEQ ID NO: 159734 - DNA, 20 bp, Artificial Sequence
  Description of Artificial Sequence: Synthetic oligonucleotide
  Target: ATXN1; (-) strand; PAM type: YTN; PAM sequence: TTG
tacctctctaaaaaaaaaaa

SEQ ID NO: 159735 - DNA, 20 bp, Artificial Sequence
  Description of Artificial Sequence: Synthetic oligonucleotide
  Target: ATXN1; (-) strand; PAM type: YTN; PAM sequence: TTT
gtacctctctaaaaaaaaaa

SEQ ID NO: 159736 - DNA, 20 bp, Artificial Sequence
  Description of Artificial Sequence: Synthetic oligonucleotide
  Target: ATXN1; (-) strand; PAM type: YTN; PAM sequence: CTT
tgtacctctctaaaaaaaaa

SEQ ID NO: 159737 - DNA, 20 bp, Artificial Sequence
  Description of Artificial Sequence: Synthetic oligonucleotide
  Target: ATXN1; (-) strand; PAM type: YTN; PAM sequence: TTG
tgggtctttgtacctctcta

SEQ ID NO: 159738 - DNA, 20 bp, Artificial Sequence
  Description of Artificial Sequence: Synthetic oligonucleotide
  Target: ATXN1; (-) strand; PAM type: YTN; PAM sequence: TTT
gtgggtctttgtacctctct

SEQ ID NO: 159739 - DNA, 20 bp, Artificial Sequence
  Description of Artificial Sequence: Synthetic oligonucleotide
  Target: ATXN1; (-) strand; PAM type: YTN; PAM sequence: TTG
tttgtgggtctttgtacctc

SEQ ID NO: 159740 - DNA, 20 bp, Artificial Sequence
  Description of Artificial Sequence: Synthetic oligonucleotide
  Target: ATXN1; (-) strand; PAM type: YTN; PAM sequence: TTT
gtttgtgggtctttgtacct

SEQ ID NO: 159741 - DNA, 20 bp, Artificial Sequence
  Description of Artificial Sequence: Synthetic oligonucleotide
  Target: ATXN1; (-) strand; PAM type: YTN; PAM sequence: TTT
tgtttgtgggtctttgtacc

SEQ ID NO: 159742 - DNA, 20 bp, Artificial Sequence
  Description of Artificial Sequence: Synthetic oligonucleotide
  Target: ATXN1; (-) strand; PAM type: YTN; PAM sequence: TTT
ttgtttgtgggtctttgtac

SEQ ID NO: 159743 - DNA, 20 bp, Artificial Sequence
  Description of Artificial Sequence: Synthetic oligonucleotide
  Target: ATXN1; (-) strand; PAM type: YTN; PAM sequence: CTA
tgtcaaaccacatttttgtt

SEQ ID NO: 159744 - DNA, 20 bp, Artificial Sequence
  Description of Artificial Sequence: Synthetic oligonucleotide
  Target: ATXN1; (-) strand; PAM type: YTN; PAM sequence: CTC
caacagagaaactatgtcaa

SEQ ID NO: 159745 - DNA, 20 bp, Artificial Sequence
  Description of Artificial Sequence: Synthetic oligonucleotide
  Target: ATXN1; (-) strand; PAM type: YTN; PAM sequence: CTG
gaaaggctccaacagagaaa

SEQ ID NO: 159746 - DNA, 20 bp, Artificial Sequence
  Description of Artificial Sequence: Synthetic oligonucleotide
  Target: ATXN1; (-) strand; PAM type: YTN; PAM sequence: CTG
gtgctggaaaggctccaaca

SEQ ID NO: 159747 - DNA, 20 bp, Artificial Sequence
  Description of Artificial Sequence: Synthetic oligonucleotide
  Target: ATXN1; (-) strand; PAM type: YTN; PAM sequence: TTC
tggtgctggaaaggctccaa

SEQ ID NO: 159748 - DNA, 20 bp, Artificial Sequence
  Description of Artificial Sequence: Synthetic oligonucleotide
  Target: ATXN1; (-) strand; PAM type: YTN; PAM sequence: CTG
ttctggtgctggaaaggctc

SEQ ID NO: 159749 - DNA, 20 bp, Artificial Sequence
  Description of Artificial Sequence: Synthetic oligonucleotide
  Target: ATXN1; (-) strand; PAM type: YTN; PAM sequence: CTG
tctgttctggtgctggaaag

SEQ ID NO: 159750 - DNA, 20 bp, Artificial Sequence
  Description of Artificial Sequence: Synthetic oligonucleotide
  Target: ATXN1; (-) strand; PAM type: YTN; PAM sequence: TTC
ctgtctgttctggtgctgga

SEQ ID NO: 159751 - DNA, 20 bp, Artificial Sequence
  Description of Artificial Sequence: Synthetic oligonucleotide
  Target: ATXN1; (-) strand; PAM type: YTN; PAM sequence: CTT
cctgtctgttctggtgctgg

SEQ ID NO: 159752 - DNA, 20 bp, Artificial Sequence
  Description of Artificial Sequence: Synthetic oligonucleotide
  Target: ATXN1; (-) strand; PAM type: YTN; PAM sequence: TTG
gtaatacacacttcctgtct

SEQ ID NO: 159753 - DNA, 20 bp, Artificial Sequence
  Description of Artificial Sequence: Synthetic oligonucleotide
  Target: ATXN1; (-) strand; PAM type: YTN; PAM sequence: TTG
ttggtaatacacacttcctg

SEQ ID NO: 159754 - DNA, 20 bp, Artificial Sequence
  Description of Artificial Sequence: Synthetic oligonucleotide
  Target: ATXN1; (-) strand; PAM type: YTN; PAM sequence: TTG
tgccgcagttgttggtaata

SEQ ID NO: 159755 - DNA, 20 bp, Artificial Sequence
  Description of Artificial Sequence: Synthetic oligonucleotide
  Target: ATXN1; (-) strand; PAM type: YTN; PAM sequence: TTT
gtgccgcagttgttggtaat

SEQ ID NO: 159756 - DNA, 20 bp, Artificial Sequence
  Description of Artificial Sequence: Synthetic oligonucleotide
  Target: ATXN1; (-) strand; PAM type: YTN; PAM sequence: CTG
gatttgtgccgcagttgttg

SEQ ID NO: 159757 - DNA, 20 bp, Artificial Sequence
  Description of Artificial Sequence: Synthetic oligonucleotide
  Target: ATXN1; (-) strand; PAM type: YTN; PAM sequence: CTG
tgtgcagagcccagccctgg

SEQ ID NO: 159758 - DNA, 20 bp, Artificial Sequence
  Description of Artificial Sequence: Synthetic oligonucleotide
  Target: ATXN1; (-) strand; PAM type: YTN; PAM sequence: CTG
ccctgtgtgcagagcccagc

SEQ ID NO: 159759 - DNA, 20 bp, Artificial Sequence
  Description of Artificial Sequence: Synthetic oligonucleotide
  Target: ATXN1; (-) strand; PAM type: YTN; PAM sequence: TTG
gtgactgccctgtgtgcaga

SEQ ID NO: 159760 - DNA, 20 bp, Artificial Sequence
  Description of Artificial Sequence: Synthetic oligonucleotide
  Target: ATXN1; (-) strand; PAM type: YTN; PAM sequence: CTA
atgtatcaaaaaatagatag

SEQ ID NO: 159761 - DNA, 20 bp, Artificial Sequence
  Description of Artificial Sequence: Synthetic oligonucleotide
  Target: ATXN1; (-) strand; PAM type: YTN; PAM sequence: TTG
gtggcgatgaatcctaatgt

SEQ ID NO: 159762 - DNA, 20 bp, Artificial Sequence
  Description of Artificial Sequence: Synthetic oligonucleotide
  Target: ATXN1; (-) strand; PAM type: YTN; PAM sequence: CTT
ggtggcgatgaatcctaatg

SEQ ID NO: 159763 - DNA, 20 bp, Artificial Sequence
  Description of Artificial Sequence: Synthetic oligonucleotide
  Target: ATXN1; (-) strand; PAM type: YTN; PAM sequence: TTG
aacatgccgagcttggtggc

SEQ ID NO: 159764 - DNA, 20 bp, Artificial Sequence
  Description of Artificial Sequence: Synthetic oligonucleotide
  Target: ATXN1; (-) strand; PAM type: YTN; PAM sequence: TTG
ccaacattgaacatgccgag

SEQ ID NO: 159765 - DNA, 20 bp, Artificial Sequence
  Description of Artificial Sequence: Synthetic oligonucleotide
  Target: ATXN1; (-) strand; PAM type: YTN; PAM sequence: CTT
gccaacattgaacatgccga

SEQ ID NO: 159766 - DNA, 20 bp, Artificial Sequence
  Description of Artificial Sequence: Synthetic oligonucleotide
  Target: ATXN1; (-) strand; PAM type: YTN; PAM sequence: TTG
cagccaaggcagacccactt

SEQ ID NO: 159767 - DNA, 20 bp, Artificial Sequence
  Description of Artificial Sequence: Synthetic oligonucleotide
  Target: ATXN1; (-) strand; PAM type: YTN; PAM sequence: TTT
gcagccaaggcagacccact

SEQ ID NO: 159768 - DNA, 20 bp, Artificial Sequence
  Description of Artificial Sequence: Synthetic oligonucleotide
  Target: ATXN1; (-) strand; PAM type: YTN; PAM sequence: CTT
tgcagccaaggcagacccac

SEQ ID NO: 159769 - DNA, 20 bp, Artificial Sequence
  Description of Artificial Sequence: Synthetic oligonucleotide
  Target: ATXN1; (-) strand; PAM type: YTN; PAM sequence: CTG
tagagtcagtccctttgcag

SEQ ID NO: 159770 - DNA, 20 bp, Artificial Sequence
  Description of Artificial Sequence: Synthetic oligonucleotide
  Target: ATXN1; (-) strand; PAM type: YTN; PAM sequence: CTC
atgcaggcggcacatgagcc

SEQ ID NO: 159771 - DNA, 20 bp, Artificial Sequence
  Description of Artificial Sequence: Synthetic oligonucleotide
  Target: ATXN1; (-) strand; PAM type: YTN; PAM sequence: CTA
aaaatagccgaggccctcat

SEQ ID NO: 159772 - DNA, 20 bp, Artificial Sequence
  Description of Artificial Sequence: Synthetic oligonucleotide
  Target: ATXN1; (-) strand; PAM type: YTN; PAM sequence: CTG
gtacctaaaaatagccgagg

SEQ ID NO: 159773 - DNA, 20 bp, Artificial Sequence
  Description of Artificial Sequence: Synthetic oligonucleotide
  Target: ATXN1; (-) strand; PAM type: YTN; PAM sequence: TTA
gctggtacctaaaaatagcc

SEQ ID NO: 159774 - DNA, 20 bp, Artificial Sequence
  Description of Artificial Sequence: Synthetic oligonucleotide
  Target: ATXN1; (-) strand; PAM type: YTN; PAM sequence: TTG
aatggattagctggtaccta

SEQ ID NO: 159775 - DNA, 20 bp, Artificial Sequence
  Description of Artificial Sequence: Synthetic oligonucleotide
  Target: ATXN1; (-) strand; PAM type: YTN; PAM sequence: TTA
tgcattgaatggattagctg

SEQ ID NO: 159776 - DNA, 20 bp, Artificial Sequence
  Description of Artificial Sequence: Synthetic oligonucleotide
  Target: ATXN1; (-) strand; PAM type: YTN; PAM sequence: CTG
tgagtcatcggtggtaacat

SEQ ID NO: 159777 - DNA, 20 bp, Artificial Sequence
  Description of Artificial Sequence: Synthetic oligonucleotide
  Target: ATXN1; (-) strand; PAM type: YTN; PAM sequence: CTG
tgagctgtgagtcatcggtg

SEQ ID NO: 159778 - DNA, 20 bp, Artificial Sequence
  Description of Artificial Sequence: Synthetic oligonucleotide
  Target: ATXN1; (-) strand; PAM type: YTN; PAM sequence: TTC
tgtgagctgtgagtcatcgg

SEQ ID NO: 159779 - DNA, 20 bp, Artificial Sequence
  Description of Artificial Sequence: Synthetic oligonucleotide
  Target: ATXN1; (-) strand; PAM type: YTN; PAM sequence: CTT
ctgtgagctgtgagtcatcg

SEQ ID NO: 159780 - DNA, 20 bp, Artificial Sequence
  Description of Artificial Sequence: Synthetic oligonucleotide
  Target: ATXN1; (-) strand; PAM type: YTN; PAM sequence: TTG
acttctgtgagctgtgagtc

SEQ ID NO: 159781 - DNA, 20 bp, Artificial Sequence
  Description of Artificial Sequence: Synthetic oligonucleotide
  Target: ATXN1; (-) strand; PAM type: YTN; PAM sequence: TTG
gttgacttctgtgagctgtg

SEQ ID NO: 159782 - DNA, 20 bp, Artificial Sequence
  Description of Artificial Sequence: Synthetic oligonucleotide
  Target: ATXN1; (-) strand; PAM type: YTN; PAM sequence: TTT
ggttgacttctgtgagctgt

SEQ ID NO: 159783 - DNA, 20 bp, Artificial Sequence
  Description of Artificial Sequence: Synthetic oligonucleotide
  Target: ATXN1; (-) strand; PAM type: YTN; PAM sequence: TTT
tggttgacttctgtgagctg

SEQ ID NO: 159784 - DNA, 20 bp, Artificial Sequence
  Description of Artificial Sequence: Synthetic oligonucleotide
  Target: ATXN1; (-) strand; PAM type: YTN; PAM sequence: TTT
ttggttgacttctgtgagct

SEQ ID NO: 159785 - DNA, 20 bp, Artificial Sequence
  Description of Artificial Sequence: Synthetic oligonucleotide
  Target: ATXN1; (-) strand; PAM type: YTN; PAM sequence: TTT
tttggttgacttctgtgagc

SEQ ID NO: 159786 - DNA, 20 bp, Artificial Sequence
  Description of Artificial Sequence: Synthetic oligonucleotide
  Target: ATXN1; (-) strand; PAM type: YTN; PAM sequence: CTA
ttttttggttgacttctgtg

SEQ ID NO: 159787 - DNA, 20 bp, Artificial Sequence
  Description of Artificial Sequence: Synthetic oligonucleotide
  Target: ATXN1; (-) strand; PAM type: YTN; PAM sequence: CTA
ctattttttggttgacttct

SEQ ID NO: 159788 - DNA, 20 bp, Artificial Sequence
  Description of Artificial Sequence: Synthetic oligonucleotide
  Target: ATXN1; (-) strand; PAM type: YTN; PAM sequence: TTC
tactattttttggttgactt

SEQ ID NO: 159789 - DNA, 20 bp, Artificial Sequence
  Description of Artificial Sequence: Synthetic oligonucleotide
  Target: ATXN1; (-) strand; PAM type: YTN; PAM sequence: TTC
attctactattttttggttg

SEQ ID NO: 159790 - DNA, 20 bp, Artificial Sequence
  Description of Artificial Sequence: Synthetic oligonucleotide
  Target: ATXN1; (-) strand; PAM type: YTN; PAM sequence: TTT
cattctactattttttggtt

SEQ ID NO: 159791 - DNA, 20 bp, Artificial Sequence
  Description of Artificial Sequence: Synthetic oligonucleotide
  Target: ATXN1; (-) strand; PAM type: YTN; PAM sequence: CTT
tcattctactattttttggt

SEQ ID NO: 159792 - DNA, 20 bp, Artificial Sequence
  Description of Artificial Sequence: Synthetic oligonucleotide
  Target: ATXN1; (-) strand; PAM type: YTN; PAM sequence: TTC
ctttcattctactatttttt

SEQ ID NO: 159793 - DNA, 20 bp, Artificial Sequence
  Description of Artificial Sequence: Synthetic oligonucleotide
  Target: ATXN1; (-) strand; PAM type: YTN; PAM sequence: TTT
cctttcattctactattttt

SEQ ID NO: 159794 - DNA, 20 bp, Artificial Sequence
  Description of Artificial Sequence: Synthetic oligonucleotide
  Target: ATXN1; (-) strand; PAM type: YTN; PAM sequence: CTT
tcctttcattctactatttt

SEQ ID NO: 159795 - DNA, 20 bp, Artificial Sequence
  Description of Artificial Sequence: Synthetic oligonucleotide
  Target: ATXN1; (-) strand; PAM type: YTN; PAM sequence: CTA
ccgatggctttcctttcatt

SEQ ID NO: 159796 - DNA, 20 bp, Artificial Sequence
  Description of Artificial Sequence: Synthetic oligonucleotide
  Target: ATXN1; (-) strand; PAM type: YTN; PAM sequence: CTG
tctaccgatggctttccttt

SEQ ID NO: 159797 - DNA, 20 bp, Artificial Sequence
  Description of Artificial Sequence: Synthetic oligonucleotide
  Target: ATXN1; (-) strand; PAM type: YTN; PAM sequence: CTG
gctgtctaccgatggctttc

SEQ ID NO: 159798 - DNA, 20 bp, Artificial Sequence
  Description of Artificial Sequence: Synthetic oligonucleotide
  Target: ATXN1; (-) strand; PAM type: YTN; PAM sequence: TTA
ctggctgtctaccgatggct

SEQ ID NO: 159799 - DNA, 20 bp, Artificial Sequence
  Description of Artificial Sequence: Synthetic oligonucleotide
  Target: ATXN1; (-) strand; PAM type: YTN; PAM sequence: CTT
actggctgtctaccgatggc

SEQ ID NO: 159800 - DNA, 20 bp, Artificial Sequence
  Description of Artificial Sequence: Synthetic oligonucleotide
  Target: ATXN1; (-) strand; PAM type: YTN; PAM sequence: TTA
tcatgatgtacttactggct

SEQ ID NO: 159801 - DNA, 20 bp, Artificial Sequence
  Description of Artificial Sequence: Synthetic oligonucleotide
  Target: ATXN1; (-) strand; PAM type: YTN; PAM sequence: TTG
ttatcatgatgtacttactg

SEQ ID NO: 159802 - DNA, 20 bp, Artificial Sequence
  Description of Artificial Sequence: Synthetic oligonucleotide
  Target: ATXN1; (-) strand; PAM type: YTN; PAM sequence: CTC
gtacagcagttgttatcatg

SEQ ID NO: 159803 - DNA, 20 bp, Artificial Sequence
  Description of Artificial Sequence: Synthetic oligonucleotide
  Target: ATXN1; (-) strand; PAM type: YTN; PAM sequence: CTG
tgtgtgtgctcgtacagcag

SEQ ID NO: 159804 - DNA, 20 bp, Artificial Sequence
  Description of Artificial Sequence: Synthetic oligonucleotide
  Target: ATXN1; (-) strand; PAM type: YTN; PAM sequence: CTG
gcgtgggtgtgagtgtgcct

SEQ ID NO: 159805 - DNA, 20 bp, Artificial Sequence
  Description of Artificial Sequence: Synthetic oligonucleotide
  Target: ATXN1; (-) strand; PAM type: YTN; PAM sequence: CTG
tcctggcgtgggtgtgagtg

SEQ ID NO: 159806 - DNA, 20 bp, Artificial Sequence
  Description of Artificial Sequence: Synthetic oligonucleotide
  Target: ATXN1; (-) strand; PAM type: YTN; PAM sequence: CTC
ccgactgtcctggcgtgggt

SEQ ID NO: 159807 - DNA, 20 bp, Artificial Sequence
  Description of Artificial Sequence: Synthetic oligonucleotide
  Target: ATXN1; (-) strand; PAM type: YTN; PAM sequence: CTC
ctcccgactgtcctggcgtg

SEQ ID NO: 159808 - DNA, 20 bp, Artificial Sequence
  Description of Artificial Sequence: Synthetic oligonucleotide
  Target: ATXN1; (-) strand; PAM type: YTN; PAM sequence: TTC
ctcctcccgactgtcctggc

SEQ ID NO: 159809 - DNA, 20 bp, Artificial Sequence
  Description of Artificial Sequence: Synthetic oligonucleotide
  Target: ATXN1; (-) strand; PAM type: YTN; PAM sequence: TTT
cctcctcccgactgtcctgg

SEQ ID NO: 159810 - DNA, 20 bp, Artificial Sequence
  Description of Artificial Sequence: Synthetic oligonucleotide
  Target: ATXN1; (-) strand; PAM type: YTN; PAM sequence: TTC
agtgccatttcctcctcccg

SEQ ID NO: 159811 - DNA, 20 bp, Artificial Sequence
  Description of Artificial Sequence: Synthetic oligonucleotide
  Target: ATXN1; (-) strand; PAM type: YTN; PAM sequence: TTA
atattcagtgccatttcctc

SEQ ID NO: 159812 - DNA, 20 bp, Artificial Sequence
  Description of Artificial Sequence: Synthetic oligonucleotide
  Target: ATXN1; (-) strand; PAM type: YTN; PAM sequence: CTT
aatattcagtgccatttcct

SEQ ID NO: 159813 - DNA, 20 bp, Artificial Sequence
  Description of Artificial Sequence: Synthetic oligonucleotide
  Target: ATXN1; (-) strand; PAM type: YTN; PAM sequence: CTG
cttaatattcagtgccattt

SEQ ID NO: 159814 - DNA, 20 bp, Artificial Sequence
  Description of Artificial Sequence: Synthetic oligonucleotide
  Target: ATXN1; (-) strand; PAM type: YTN; PAM sequence: CTC
ggtggctgcttaatattcag

SEQ ID NO: 159815 - DNA, 20 bp, Artificial Sequence
  Description of Artificial Sequence: Synthetic oligonucleotide
  Target: ATXN1; (-) strand; PAM type: YTN; PAM sequence: CTG
actcggtggctgcttaatat

SEQ ID NO: 159816 - DNA, 20 bp, Artificial Sequence
  Description of Artificial Sequence: Synthetic oligonucleotide
  Target: ATXN1; (-) strand; PAM type: YTN; PAM sequence: TTC
cctgactcggtggctgctta

SEQ ID NO: 159817 - DNA, 20 bp, Artificial Sequence
  Description of Artificial Sequence: Synthetic oligonucleotide
  Target: ATXN1; (-) strand; PAM type: YTN; PAM sequence: CTT
ccctgactcggtggctgctt

SEQ ID NO: 159818 - DNA, 20 bp, Artificial Sequence
  Description of Artificial Sequence: Synthetic oligonucleotide
  Target: ATXN1; (-) strand; PAM type: YTN; PAM sequence: CTG
cttccctgactcggtggctg

SEQ ID NO: 159819 - DNA, 20 bp, Artificial Sequence
  Description of Artificial Sequence: Synthetic oligonucleotide
  Target: ATXN1; (-) strand; PAM type: YTN; PAM sequence: CTC
ccgaggtgactgcttccctg

SEQ ID NO: 159820 - DNA, 20 bp, Artificial Sequence
  Description of Artificial Sequence: Synthetic oligonucleotide
  Target: ATXN1; (-) strand; PAM type: YTN; PAM sequence: TTC
ccagcgcctcccgaggtgac

SEQ ID NO: 159821 - DNA, 20 bp, Artificial Sequence
  Description of Artificial Sequence: Synthetic oligonucleotide
  Target: ATXN1; (-) strand; PAM type: YTN; PAM sequence: CTT
cccagcgcctcccgaggtga

SEQ ID NO: 159822 - DNA, 20 bp, Artificial Sequence
  Description of Artificial Sequence: Synthetic oligonucleotide
  Target: ATXN1; (-) strand; PAM type: YTN; PAM sequence: CTG
tcgcttcccagcgcctcccg

SEQ ID NO: 159823 - DNA, 20 bp, Artificial Sequence
  Description of Artificial Sequence: Synthetic oligonucleotide
  Target: ATXN1; (-) strand; PAM type: YTN; PAM sequence: TTA
gggccgtctgtcgcttccca

SEQ ID NO: 159824 - DNA, 20 bp, Artificial Sequence
  Description of Artificial Sequence: Synthetic oligonucleotide
  Target: ATXN1; (-) strand; PAM type: YTN; PAM sequence: TTA
ttagggccgtctgtcgcttc

SEQ ID NO: 159825 - DNA, 20 bp, Artificial Sequence
  Description of Artificial Sequence: Synthetic oligonucleotide
  Target: ATXN1; (-) strand; PAM type: YTN; PAM sequence: CTG
tgttattagggccgtctgtc

SEQ ID NO: 159826 - DNA, 20 bp, Artificial Sequence
  Description of Artificial Sequence: Synthetic oligonucleotide
  Target: ATXN1; (-) strand; PAM type: YTN; PAM sequence: CTC
tgtgttattagggccgtctg

SEQ ID NO: 159827 - DNA, 20 bp, Artificial Sequence
  Description of Artificial Sequence: Synthetic oligonucleotide
  Target: ATXN1; (-) strand; PAM type: YTN; PAM sequence: CTA
aatgccaggctctgtgttat

SEQ ID NO: 159828 - DNA, 20 bp, Artificial Sequence
  Description of Artificial Sequence: Synthetic oligonucleotide
  Target: ATXN1; (-) strand; PAM type: YTN; PAM sequence: TTC
ctaaatgccaggctctgtgt

SEQ ID NO: 159829 - DNA, 20 bp, Artificial Sequence
  Description of Artificial Sequence: Synthetic oligonucleotide
  Target: ATXN1; (-) strand; PAM type: YTN; PAM sequence: TTT
cctaaatgccaggctctgtg

SEQ ID NO: 159830 - DNA, 20 bp, Artificial Sequence
  Description of Artificial Sequence: Synthetic oligonucleotide
  Target: ATXN1; (-) strand; PAM type: YTN; PAM sequence: CTT
tcctaaatgccaggctctgt

SEQ ID NO: 159831 - DNA, 20 bp, Artificial Sequence
  Description of Artificial Sequence: Synthetic oligonucleotide
  Target: ATXN1; (-) strand; PAM type: YTN; PAM sequence: TTC
tttcctaaatgccaggctct

SEQ ID NO: 159832 - DNA, 20 bp, Artificial Sequence
  Description of Artificial Sequence: Synthetic oligonucleotide
  Target: ATXN1; (-) strand; PAM type: YTN; PAM sequence: CTT
ctttcctaaatgccaggctc

SEQ ID NO: 159833 - DNA, 20 bp, Artificial Sequence
  Description of Artificial Sequence: Synthetic oligonucleotide
  Target: ATXN1; (-) strand; PAM type: YTN; PAM sequence: TTG
cttctttcctaaatgccagg

SEQ ID NO: 159834 - DNA, 20 bp, Artificial Sequence
  Description of Artificial Sequence: Synthetic oligonucleotide
  Target: ATXN1; (-) strand; PAM type: YTN; PAM sequence: TTT
gcttctttcctaaatgccag

SEQ ID NO: 159835 - DNA, 20 bp, Artificial Sequence
  Description of Artificial Sequence: Synthetic oligonucleotide
  Target: ATXN1; (-) strand; PAM type: YTN; PAM sequence: CTT
tgcttctttcctaaatgcca

SEQ ID NO: 159836 - DNA, 20 bp, Artificial Sequence
  Description of Artificial Sequence: Synthetic oligonucleotide
  Target: ATXN1; (-) strand; PAM type: YTN; PAM sequence: TTC
ctttgcttctttcctaaatg

SEQ ID NO: 159837 - DNA, 20 bp, Artificial Sequence
  Description of Artificial Sequence: Synthetic oligonucleotide
  Target: ATXN1; (-) strand; PAM type: YTN; PAM sequence: TTG
acacgttcctttgcttcttt

SEQ ID NO: 159838 - DNA, 20 bp, Artificial Sequence
  Description of Artificial Sequence: Synthetic oligonucleotide
  Target: ATXN1; (-) strand; PAM type: YTN; PAM sequence: CTG
ggttgacacgttcctttgct

SEQ ID NO: 159839 - DNA, 20 bp, Artificial Sequence
  Description of Artificial Sequence: Synthetic oligonucleotide
  Target: ATXN1; (-) strand; PAM type: YTN; PAM sequence: CTC
tgggttgacacgttcctttg

SEQ ID NO: 159840 - DNA, 20 bp, Artificial Sequence
  Description of Artificial Sequence: Synthetic oligonucleotide
  Target: ATXN1; (-) strand; PAM type: YTN; PAM sequence: TTG
gtaaagtgctctgggttgac

SEQ ID NO: 159841 - DNA, 20 bp, Artificial Sequence
  Description of Artificial Sequence: Synthetic oligonucleotide
  Target: ATXN1; (-) strand; PAM type: YTN; PAM sequence: TTG
taaaatgtattggtaaagtg

SEQ ID NO: 159842 - DNA, 20 bp, Artificial Sequence
  Description of Artificial Sequence: Synthetic oligonucleotide
  Target: ATXN1; (-) strand; PAM type: YTN; PAM sequence: CTC
agtggagttgtaaaatgtat

SEQ ID NO: 159843 - DNA, 20 bp, Artificial Sequence
  Description of Artificial Sequence: Synthetic oligonucleotide
  Target: ATXN1; (-) strand; PAM type: YTN; PAM sequence: TTG
ctcagtggagttgtaaaatg

SEQ ID NO: 159844 - DNA, 20 bp, Artificial Sequence
  Description of Artificial Sequence: Synthetic oligonucleotide
  Target: ATXN1; (-) strand; PAM type: YTN; PAM sequence: TTT
gctcagtggagttgtaaaat

SEQ ID NO: 159845 - DNA, 20 bp, Artificial Sequence
  Description of Artificial Sequence: Synthetic oligonucleotide
  Target: ATXN1; (-) strand; PAM type: YTN; PAM sequence: CTG
aagagtacacagcatttgct

SEQ ID NO: 159846 - DNA, 20 bp, Artificial Sequence
  Description of Artificial Sequence: Synthetic oligonucleotide
  Target: ATXN1; (-) strand; PAM type: YTN; PAM sequence: CTC
tgaagagtacacagcatttg

SEQ ID NO: 159847 - DNA, 20 bp, Artificial Sequence
  Description of Artificial Sequence: Synthetic oligonucleotide
  Target: ATXN1; (-) strand; PAM type: YTN; PAM sequence: TTC
tctgaagagtacacagcatt

SEQ ID NO: 159848 - DNA, 20 bp, Artificial Sequence
  Description of Artificial Sequence: Synthetic oligonucleotide
  Target: ATXN1; (-) strand; PAM type: YTN; PAM sequence: CTT
ctctgaagagtacacagcat

SEQ ID NO: 159849 - DNA, 20 bp, Artificial Sequence
  Description of Artificial Sequence: Synthetic oligonucleotide
  Target: ATXN1; (-) strand; PAM type: YTN; PAM sequence: TTC
agcttctctgaagagtacac

SEQ ID NO: 159850 - DNA, 20 bp, Artificial Sequence
  Description of Artificial Sequence: Synthetic oligonucleotide
  Target: ATXN1; (-) strand; PAM type: YTN; PAM sequence: CTA
ggttcagcttctctgaagag

SEQ ID NO: 159851 - DNA, 20 bp, Artificial Sequence
  Description of Artificial Sequence: Synthetic oligonucleotide
  Target: ATXN1; (-) strand; PAM type: YTN; PAM sequence: TTC
ctaggttcagcttctctgaa

SEQ ID NO: 159852 - DNA, 20 bp, Artificial Sequence
  Description of Artificial Sequence: Synthetic oligonucleotide
  Target: ATXN1; (-) strand; PAM type: YTN; PAM sequence: CTT
cctaggttcagcttctctga

SEQ ID NO: 159853 - DNA, 20 bp, Artificial Sequence
  Description of Artificial Sequence: Synthetic oligonucleotide
  Target: ATXN1; (-) strand; PAM type: YTN; PAM sequence: CTC
acccttcctaggttcagctt

SEQ ID NO: 159854 - DNA, 20 bp, Artificial Sequence
  Description of Artificial Sequence: Synthetic oligonucleotide
  Target: ATXN1; (-) strand; PAM type: YTN; PAM sequence: CTG
tctcacccttcctaggttca

SEQ ID NO: 159855 - DNA, 20 bp, Artificial Sequence
  Description of Artificial Sequence: Synthetic oligonucleotide
  Target: ATXN1; (-) strand; PAM type: YTN; PAM sequence: TTC
tgtctcacccttcctaggtt

SEQ ID NO: 159856 - DNA, 20 bp, Artificial Sequence
  Description of Artificial Sequence: Synthetic oligonucleotide
  Target: ATXN1; (-) strand; PAM type: YTN; PAM sequence: CTT
ctgtctcacccttcctaggt

SEQ ID NO: 159857 - DNA, 20 bp, Artificial Sequence
  Description of Artificial Sequence: Synthetic oligonucleotide
  Target: ATXN1; (-) strand; PAM type: YTN; PAM sequence: TTA
tcccatccttctgtctcacc

SEQ ID NO: 159858 - DNA, 20 bp, Artificial Sequence
  Description of Artificial Sequence: Synthetic oligonucleotide
  Target: ATXN1; (-) strand; PAM type: YTN; PAM sequence: CTA
tattatcccatccttctgtc

SEQ ID NO: 159859 - DNA, 20 bp, Artificial Sequence
  Description of Artificial Sequence: Synthetic oligonucleotide
  Target: ATXN1; (-) strand; PAM type: YTN; PAM sequence: TTC
tatattatcccatccttctg

SEQ ID NO: 159860 - DNA, 20 bp, Artificial Sequence
  Description of Artificial Sequence: Synthetic oligonucleotide
  Target: ATXN1; (-) strand; PAM type: YTN; PAM sequence: CTG
gcggcgttctatattatccc

SEQ ID NO: 159861 - DNA, 20 bp, Artificial Sequence
  Description of Artificial Sequence: Synthetic oligonucleotide
  Target: ATXN1; (-) strand; PAM type: YTN; PAM sequence: TTC
catctggcggcgttctatat

SEQ ID NO: 159862 - DNA, 20 bp, Artificial Sequence
  Description of Artificial Sequence: Synthetic oligonucleotide
  Target: ATXN1; (-) strand; PAM type: YTN; PAM sequence: CTT
ccatctggcggcgttctata

SEQ ID NO: 159863 - DNA, 20 bp, Artificial Sequence
  Description of Artificial Sequence: Synthetic oligonucleotide
  Target: ATXN1; (-) strand; PAM type: YTN; PAM sequence: TTG
gcttccatctggcggcgttc

SEQ ID NO: 159864 - DNA, 20 bp, Artificial Sequence
  Description of Artificial Sequence: Synthetic oligonucleotide
  Target: ATXN1; (-) strand; PAM type: YTN; PAM sequence: TTT
ggcttccatctggcggcgtt

SEQ ID NO: 159865 - DNA, 20 bp, Artificial Sequence
  Description of Artificial Sequence: Synthetic oligonucleotide
  Target: ATXN1; (-) strand; PAM type: YTN; PAM sequence: CTT
tggcttccatctggcggcgt

SEQ ID NO: 159866 - DNA, 20 bp, Artificial Sequence
  Description of Artificial Sequence: Synthetic oligonucleotide
  Target: ATXN1; (-) strand; PAM type: YTN; PAM sequence: CTG
gggagcctttggcttccatc

SEQ ID NO: 159867 - DNA, 20 bp, Artificial Sequence
  Description of Artificial Sequence: Synthetic oligonucleotide
  Target: ATXN1; (-) strand; PAM type: YTN; PAM sequence: CTG
cccaggatggccccagctgg

SEQ ID NO: 159868 - DNA, 20 bp, Artificial Sequence
  Description of Artificial Sequence: Synthetic oligonucleotide
  Target: ATXN1; (-) strand; PAM type: YTN; PAM sequence: CTG
ggacagccctgcccaggatg

SEQ ID NO: 159869 - DNA, 20 bp, Artificial Sequence
  Description of Artificial Sequence: Synthetic oligonucleotide
  Target: ATXN1; (-) strand; PAM type: YTN; PAM sequence: TTA
gtgacgtgcccgctgggaca

SEQ ID NO: 159870 - DNA, 20 bp, Artificial Sequence
  Description of Artificial Sequence: Synthetic oligonucleotide
  Target: ATXN1; (-) strand; PAM type: YTN; PAM sequence: CTG
ttagtgacgtgcccgctggg

SEQ ID NO: 159871 - DNA, 20 bp, Artificial Sequence
  Description of Artificial Sequence: Synthetic oligonucleotide
  Target: ATXN1; (-) strand; PAM type: YTN; PAM sequence: CTG
caagaggctgttagtgacgt

SEQ ID NO: 159872 - DNA, 20 bp, Artificial Sequence
  Description of Artificial Sequence: Synthetic oligonucleotide
  Target: ATXN1; (-) strand; PAM type: YTN; PAM sequence: TTC
tgcaagaggctgttagtgac

SEQ ID NO: 159873 - DNA, 20 bp, Artificial Sequence
  Description of Artificial Sequence: Synthetic oligonucleotide
  Target: ATXN1; (-) strand; PAM type: YTN; PAM sequence: CTT
ctgcaagaggctgttagtga

SEQ ID NO: 159874 - DNA, 20 bp, Artificial Sequence
  Description of Artificial Sequence: Synthetic oligonucleotide
  Target: ATXN1; (-) strand; PAM type: YTN; PAM sequence: CTC
ttctgcaagaggctgttagt

SEQ ID NO: 159875 - DNA, 20 bp, Artificial Sequence
  Description of Artificial Sequence: Synthetic oligonucleotide
  Target: ATXN1; (-) strand; PAM type: YTN; PAM sequence: CTC
ctcttctgcaagaggctgtt

SEQ ID NO: 159876 - DNA, 20 bp, Artificial Sequence
  Description of Artificial Sequence: Synthetic oligonucleotide
  Target: ATXN1; (-) strand; PAM type: YTN; PAM sequence: CTC
ccaggctcctcttctgcaag

SEQ ID NO: 159877 - DNA, 20 bp, Artificial Sequence
  Description of Artificial Sequence: Synthetic oligonucleotide
  Target: ATXN1; (-) strand; PAM type: YTN; PAM sequence: CTC
cagatcagtaagacaaccaa

SEQ ID NO: 159878 - DNA, 20 bp, Artificial Sequence
  Description of Artificial Sequence: Synthetic oligonucleotide
  Target: ATXN1; (-) strand; PAM type: YTN; PAM sequence: CTC
cagccctccagatcagtaag

SEQ ID NO: 159879 - DNA, 20 bp, Artificial Sequence
  Description of Artificial Sequence: Synthetic oligonucleotide
  Target: ATXN1; (-) strand; PAM type: YTN; PAM sequence: TTG
gtgctccagccctccagatc

SEQ ID NO: 159880 - DNA, 20 bp, Artificial Sequence
  Description of Artificial Sequence: Synthetic oligonucleotide
  Target: ATXN1; (-) strand; PAM type: YTN; PAM sequence: TTG
aggggtgcattggtgctcca

SEQ ID NO: 159881 - DNA, 20 bp, Artificial Sequence
  Description of Artificial Sequence: Synthetic oligonucleotide
  Target: ATXN1; (-) strand; PAM type: YTN; PAM sequence: TTT
gaggggtgcattggtgctcc

SEQ ID NO: 159882 - DNA, 20 bp, Artificial Sequence
  Description of Artificial Sequence: Synthetic oligonucleotide
  Target: ATXN1; (-) strand; PAM type: YTN; PAM sequence: CTG
gatttgaggggtgcattggt

SEQ ID NO: 159883 - DNA, 20 bp, Artificial Sequence
  Description of Artificial Sequence: Synthetic oligonucleotide
  Target: ATXN1; (-) strand; PAM type: YTN; PAM sequence: CTG
agtatgaactggatttgagg

SEQ ID NO: 159884 - DNA, 20 bp, Artificial Sequence
  Description of Artificial Sequence: Synthetic oligonucleotide
  Target: ATXN1; (-) strand; PAM type: YTN; PAM sequence: TTC
tgagtatgaactggatttga

SEQ ID NO: 159885 - DNA, 20 bp, Artificial Sequence
  Description of Artificial Sequence: Synthetic oligonucleotide
  Target: ATXN1; (-) strand; PAM type: YTN; PAM sequence: TTT
ctgagtatgaactggatttg

SEQ ID NO: 159886 - DNA, 20 bp, Artificial Sequence
  Description of Artificial Sequence: Synthetic oligonucleotide
  Target: ATXN1; (-) strand; PAM type: YTN; PAM sequence: CTG
tatttctgagtatgaactgg

SEQ ID NO: 159887 - DNA, 20 bp, Artificial Sequence
  Description of Artificial Sequence: Synthetic oligonucleotide
  Target: ATXN1; (-) strand; PAM type: YTN; PAM sequence: CTG
cgtgagcatatcaatctgta

SEQ ID NO: 159888 - DNA, 20 bp, Artificial Sequence
  Description of Artificial Sequence: Synthetic oligonucleotide
  Target: ATXN1; (-) strand; PAM type: YTN; PAM sequence: CTA
aatgatgtcatgccagcctg

SEQ ID NO: 159889 - DNA, 20 bp, Artificial Sequence
  Description of Artificial Sequence: Synthetic oligonucleotide
  Target: ATXN1; (-) strand; PAM type: YTN; PAM sequence: CTA
aggctaaatgatgtcatgcc

SEQ ID NO: 159890 - DNA, 20 bp, Artificial Sequence
  Description of Artificial Sequence: Synthetic oligonucleotide
  Target: ATXN1; (-) strand; PAM type: YTN; PAM sequence: TTC
taaggctaaatgatgtcatg

SEQ ID NO: 159891 - DNA, 20 bp, Artificial Sequence
  Description of Artificial Sequence: Synthetic oligonucleotide
  Target: ATXN1; (-) strand; PAM type: YTN; PAM sequence: TTT
ctaaggctaaatgatgtcat

SEQ ID NO: 159892 - DNA, 20 bp, Artificial Sequence
  Description of Artificial Sequence: Synthetic oligonucleotide
  Target: ATXN1; (-) strand; PAM type: YTN; PAM sequence: CTG
tttctaaggctaaatgatgt

SEQ ID NO: 159893 - DNA, 20 bp, Artificial Sequence
  Description of Artificial Sequence: Synthetic oligonucleotide
  Target: ATXN1; (-) strand; PAM type: YTN; PAM sequence: TTC
ctgtttctaaggctaaatga

SEQ ID NO: 159894 - DNA, 20 bp, Artificial Sequence
  Description of Artificial Sequence: Synthetic oligonucleotide
  Target: ATXN1; (-) strand; PAM type: YTN; PAM sequence: TTC
ccgccgttcctgtttctaag

SEQ ID NO: 159895 - DNA, 20 bp, Artificial Sequence
  Description of Artificial Sequence: Synthetic oligonucleotide
  Target: ATXN1; (-) strand; PAM type: YTN; PAM sequence: CTT
cccgccgttcctgtttctaa

SEQ ID NO: 159896 - DNA, 20 bp, Artificial Sequence
  Description of Artificial Sequence: Synthetic oligonucleotide
  Target: ATXN1; (-) strand; PAM type: YTN; PAM sequence: CTC
ggggtggaatcccgcgagtg

SEQ ID NO: 159897 - DNA, 20 bp, Artificial Sequence
  Description of Artificial Sequence: Synthetic oligonucleotide
  Target: ATXN1; (-) strand; PAM type: YTN; PAM sequence: CTG
taatcctcggggtggaatcc

SEQ ID NO: 159898 - DNA, 20 bp, Artificial Sequence
  Description of Artificial Sequence: Synthetic oligonucleotide
  Target: ATXN1; (-) strand; PAM type: YTN; PAM sequence: CTG
cctgtaatcctcggggtgga

SEQ ID NO: 159899 - DNA, 20 bp, Artificial Sequence
  Description of Artificial Sequence: Synthetic oligonucleotide
  Target: ATXN1; (-) strand; PAM type: YTN; PAM sequence: TTA
ccctgcctgtaatcctcggg

SEQ ID NO: 159900 - DNA, 20 bp, Artificial Sequence
  Description of Artificial Sequence: Synthetic oligonucleotide
  Target: ATXN1; (-) strand; PAM type: YTN; PAM sequence: TTT
accctgcctgtaatcctcgg

SEQ ID NO: 159901 - DNA, 20 bp, Artificial Sequence
  Description of Artificial Sequence: Synthetic oligonucleotide
  Target: ATXN1; (-) strand; PAM type: YTN; PAM sequence: TTT
taccctgcctgtaatcctcg

SEQ ID NO: 159902 - DNA, 20 bp, Artificial Sequence
  Description of Artificial Sequence: Synthetic oligonucleotide
  Target: ATXN1; (-) strand; PAM type: YTN; PAM sequence: TTT
ttaccctgcctgtaatcctc

SEQ ID NO: 159903 - DNA, 20 bp, Artificial Sequence
  Description of Artificial Sequence: Synthetic oligonucleotide
  Target: ATXN1; (-) strand; PAM type: YTN; PAM sequence: TTC
caatgagcacaataagccat

SEQ ID NO: 159904 - DNA, 20 bp, Artificial Sequence
  Description of Artificial Sequence: Synthetic oligonucleotide
  Target: ATXN1; (-) strand; PAM type: YTN; PAM sequence: TTT
ccaatgagcacaataagcca

SEQ ID NO: 159905 - DNA, 20 bp, Artificial Sequence
  Description of Artificial Sequence: Synthetic oligonucleotide
  Target: ATXN1; (-) strand; PAM type: YTN; PAM sequence: TTT
tccaatgagcacaataagcc

SEQ ID NO: 159906 - DNA, 20 bp, Artificial Sequence
  Description of Artificial Sequence: Synthetic oligonucleotide
  Target: ATXN1; (-) strand; PAM type: YTN; PAM sequence: CTT
ttccaatgagcacaataagc

SEQ ID NO: 159907 - DNA, 20 bp, Artificial Sequence
  Description of Artificial Sequence: Synthetic oligonucleotide
  Target: ATXN1; (-) strand; PAM type: YTN; PAM sequence: CTG
aacttttccaatgagcacaa

SEQ ID NO: 159908 - DNA, 20 bp, Artificial Sequence
  Description of Artificial Sequence: Synthetic oligonucleotide
  Target: ATXN1; (-) strand; PAM type: YTN; PAM sequence: CTA
gaaagaaggctgaacttttc

SEQ ID NO: 159909 - DNA, 20 bp, Artificial Sequence
  Description of Artificial Sequence: Synthetic oligonucleotide
  Target: ATXN1; (-) strand; PAM type: YTN; PAM sequence: CTG
atgaaagtctagaaagaagg

SEQ ID NO: 159910 - DNA, 20 bp, Artificial Sequence
  Description of Artificial Sequence: Synthetic oligonucleotide
  Target: ATXN1; (-) strand; PAM type: YTN; PAM sequence: TTA
tggaaggagaggcagctgat

SEQ ID NO: 159911 - DNA, 20 bp, Artificial Sequence
  Description of Artificial Sequence: Synthetic oligonucleotide
  Target: ATXN1; (-) strand; PAM type: YTN; PAM sequence: TTT
atggaaggagaggcagctga

SEQ ID NO: 159912 - DNA, 20 bp, Artificial Sequence
  Description of Artificial Sequence: Synthetic oligonucleotide
  Target: ATXN1; (-) strand; PAM type: YTN; PAM sequence: CTA
aaaagagtttatggaaggag

SEQ ID NO: 159913 - DNA, 20 bp, Artificial Sequence
  Description of Artificial Sequence: Synthetic oligonucleotide
  Target: ATXN1; (-) strand; PAM type: YTN; PAM sequence: TTC
taaaaagagtttatggaagg

SEQ ID NO: 159914 - DNA, 20 bp, Artificial Sequence
  Description of Artificial Sequence: Synthetic oligonucleotide
  Target: ATXN1; (-) strand; PAM type: YTN; PAM sequence: CTC
gtgttctaaaaagagtttat

SEQ ID NO: 159915 - DNA, 20 bp, Artificial Sequence
  Description of Artificial Sequence: Synthetic oligonucleotide
  Target: ATXN1; (-) strand; PAM type: YTN; PAM sequence: CTG
aaaaataaatcaaaggcctc

SEQ ID NO: 159916 - DNA, 20 bp, Artificial Sequence
  Description of Artificial Sequence: Synthetic oligonucleotide
  Target: ATXN1; (-) strand; PAM type: YTN; PAM sequence: TTC
acagctgaaaaataaatcaa

SEQ ID NO: 159917 - DNA, 20 bp, Artificial Sequence
  Description of Artificial Sequence: Synthetic oligonucleotide
  Target: ATXN1; (-) strand; PAM type: YTN; PAM sequence: CTG
agaaagtgattcacagctga

SEQ ID NO: 159918 - DNA, 20 bp, Artificial Sequence
  Description of Artificial Sequence: Synthetic oligonucleotide
  Target: ATXN1; (-) strand; PAM type: YTN; PAM sequence: CTC
gggccctgagaaagtgattc

SEQ ID NO: 159919 - DNA, 20 bp, Artificial Sequence
  Description of Artificial Sequence: Synthetic oligonucleotide
  Target: ATXN1; (-) strand; PAM type: YTN; PAM sequence: TTA
gatggctcgggccctgagaa

SEQ ID NO: 159920 - DNA, 20 bp, Artificial Sequence
  Description of Artificial Sequence: Synthetic oligonucleotide
  Target: ATXN1; (-) strand; PAM type: YTN; PAM sequence: CTT
agatggctcgggccctgaga

SEQ ID NO: 159921 - DNA, 20 bp, Artificial Sequence
  Description of Artificial Sequence: Synthetic oligonucleotide
  Target: ATXN1; (-) strand; PAM type: YTN; PAM sequence: TTC
aacttagatggctcgggccc

SEQ ID NO: 159922 - DNA, 20 bp, Artificial Sequence
  Description of Artificial Sequence: Synthetic oligonucleotide
  Target: ATXN1; (-) strand; PAM type: YTN; PAM sequence: CTT
caacttagatggctcgggcc

SEQ ID NO: 159923 - DNA, 20 bp, Artificial Sequence
  Description of Artificial Sequence: Synthetic oligonucleotide
  Target: ATXN1; (-) strand; PAM type: YTN; PAM sequence: CTG
cttcaacttagatggctcgg

SEQ ID NO: 159924 - DNA, 20 bp, Artificial Sequence
  Description of Artificial Sequence: Synthetic oligonucleotide
  Target: ATXN1; (-) strand; PAM type: YTN; PAM sequence: TTC
cctgcttcaacttagatggc

SEQ ID NO: 159925 - DNA, 20 bp, Artificial Sequence
  Description of Artificial Sequence: Synthetic oligonucleotide
  Target: ATXN1; (-) strand; PAM type: YTN; PAM sequence: CTT
ccctgcttcaacttagatgg

SEQ ID NO: 159926 - DNA, 20 bp, Artificial Sequence
  Description of Artificial Sequence: Synthetic oligonucleotide
  Target: ATXN1; (-) strand; PAM type: YTN; PAM sequence: TTC
ccttccctgcttcaacttag

SEQ ID NO: 159927 - DNA, 20 bp, Artificial Sequence
  Description of Artificial Sequence: Synthetic oligonucleotide
  Target: ATXN1; (-) strand; PAM type: YTN; PAM sequence: TTT
cccttccctgcttcaactta

SEQ ID NO: 159928 - DNA, 20 bp, Artificial Sequence
  Description of Artificial Sequence: Synthetic oligonucleotide
  Target: ATXN1; (-) strand; PAM type: YTN; PAM sequence: TTT
tcccttccctgcttcaactt

SEQ ID NO: 159929 - DNA, 20 bp, Artificial Sequence
  Description of Artificial Sequence: Synthetic oligonucleotide
  Target: ATXN1; (-) strand; PAM type: YTN; PAM sequence: TTA
gttttcccttccctgcttca

SEQ ID NO: 159930 - DNA, 20 bp, Artificial Sequence
  Description of Artificial Sequence: Synthetic oligonucleotide
  Target: ATXN1; (-) strand; PAM type: YTN; PAM sequence: TTG
tgcaatgttagttttccctt

SEQ ID NO: 159931 - DNA, 20 bp, Artificial Sequence
  Description of Artificial Sequence: Synthetic oligonucleotide
  Target: ATXN1; (-) strand; PAM type: YTN; PAM sequence: CTT
gtgcaatgttagttttccct

SEQ ID NO: 159932 - DNA, 20 bp, Artificial Sequence
  Description of Artificial Sequence: Synthetic oligonucleotide
  Target: ATXN1; (-) strand; PAM type: YTN; PAM sequence: CTG
ggaccttgtgcaatgttagt

SEQ ID NO: 159933 - DNA, 20 bp, Artificial Sequence
  Description of Artificial Sequence: Synthetic oligonucleotide
  Target: ATXN1; (-) strand; PAM type: YTN; PAM sequence: CTC
acccgtcagtagcactggga

SEQ ID NO: 159934 - DNA, 20 bp, Artificial Sequence
  Description of Artificial Sequence: Synthetic oligonucleotide
  Target: ATXN1; (-) strand; PAM type: YTN; PAM sequence: CTG
aacatatccctcacccgtca

SEQ ID NO: 159935 - DNA, 20 bp, Artificial Sequence
  Description of Artificial Sequence: Synthetic oligonucleotide
  Target: ATXN1; (-) strand; PAM type: YTN; PAM sequence: CTG
agtctgaacatatccctcac

SEQ ID NO: 159936 - DNA, 20 bp, Artificial Sequence
  Description of Artificial Sequence: Synthetic oligonucleotide
  Target: ATXN1; (-) strand; PAM type: YTN; PAM sequence: CTG
aagagatctgagtctgaaca

SEQ ID NO: 159937 - DNA, 20 bp, Artificial Sequence
  Description of Artificial Sequence: Synthetic oligonucleotide
  Target: ATXN1; (-) strand; PAM type: YTN; PAM sequence: CTG
gcactgaagagatctgagtc

SEQ ID NO: 159938 - DNA, 20 bp, Artificial Sequence
  Description of Artificial Sequence: Synthetic oligonucleotide
  Target: ATXN1; (-) strand; PAM type: YTN; PAM sequence: TTG
gaaaatgcaggaactggcac

SEQ ID NO: 159939 - DNA, 20 bp, Artificial Sequence
  Description of Artificial Sequence: Synthetic oligonucleotide
  Target: ATXN1; (-) strand; PAM type: YTN; PAM sequence: CTT
ggaaaatgcaggaactggca

SEQ ID NO: 159940 - DNA, 20 bp, Artificial Sequence
  Description of Artificial Sequence: Synthetic oligonucleotide
  Target: ATXN1; (-) strand; PAM type: YTN; PAM sequence: CTG
cttggaaaatgcaggaactg

SEQ ID NO: 159941 - DNA, 20 bp, Artificial Sequence
  Description of Artificial Sequence: Synthetic oligonucleotide
  Target: ATXN1; (-) strand; PAM type: YTN; PAM sequence: TTA
gctgcttggaaaatgcagga

SEQ ID NO: 159942 - DNA, 20 bp, Artificial Sequence
  Description of Artificial Sequence: Synthetic oligonucleotide
  Target: ATXN1; (-) strand; PAM type: YTN; PAM sequence: TTG
ggtaggaagtaggttagctg

SEQ ID NO: 159943 - DNA, 20 bp, Artificial Sequence
  Description of Artificial Sequence: Synthetic oligonucleotide
  Target: ATXN1; (-) strand; PAM type: YTN; PAM sequence: CTT
gggtaggaagtaggttagct

SEQ ID NO: 159944 - DNA, 20 bp, Artificial Sequence
  Description of Artificial Sequence: Synthetic oligonucleotide
  Target: ATXN1; (-) strand; PAM type: YTN; PAM sequence: CTC
cttgggtaggaagtaggtta

SEQ ID NO: 159945 - DNA, 20 bp, Artificial Sequence
  Description of Artificial Sequence: Synthetic oligonucleotide
  Target: ATXN1; (-) strand; PAM type: YTN; PAM sequence: CTC
ctccttgggtaggaagtagg

SEQ ID NO: 159946 - DNA, 20 bp, Artificial Sequence
  Description of Artificial Sequence: Synthetic oligonucleotide
  Target: ATXN1; (-) strand; PAM type: YTN; PAM sequence: TTC
gcacctcctccttgggtagg

SEQ ID NO: 159947 - DNA, 20 bp, Artificial Sequence
  Description of Artificial Sequence: Synthetic oligonucleotide
  Target: ATXN1; (-) strand; PAM type: YTN; PAM sequence: CTT
cgcacctcctccttgggtag

SEQ ID NO: 159948 - DNA, 20 bp, Artificial Sequence
  Description of Artificial Sequence: Synthetic oligonucleotide
  Target: ATXN1; (-) strand; PAM type: YTN; PAM sequence: CTC
aaaagaaggatggggcttcg

SEQ ID NO: 159949 - DNA, 20 bp, Artificial Sequence
  Description of Artificial Sequence: Synthetic oligonucleotide
  Target: ATXN1; (-) strand; PAM type: YTN; PAM sequence: CTG
tggcgcatccagatgcgacc

SEQ ID NO: 159950 - DNA, 20 bp, Artificial Sequence
  Description of Artificial Sequence: Synthetic oligonucleotide
  Target: ATXN1; (-) strand; PAM type: YTN; PAM sequence: TTG
aggccataagtctgtggcgc

SEQ ID NO: 159951 - DNA, 20 bp, Artificial Sequence
  Description of Artificial Sequence: Synthetic oligonucleotide
  Target: ATXN1; (-) strand; PAM type: YTN; PAM sequence: TTT
gaggccataagtctgtggcg

SEQ ID NO: 159952 - DNA, 20 bp, Artificial Sequence
  Description of Artificial Sequence: Synthetic oligonucleotide
  Target: ATXN1; (-) strand; PAM type: YTN; PAM sequence: CTC
caagtttgaggccataagtc

SEQ ID NO: 159953 - DNA, 20 bp, Artificial Sequence
  Description of Artificial Sequence: Synthetic oligonucleotide
  Target: ATXN1; (-) strand; PAM type: YTN; PAM sequence: TTA
atatcctccaagtttgaggc

SEQ ID NO: 159954 - DNA, 20 bp, Artificial Sequence
  Description of Artificial Sequence: Synthetic oligonucleotide
  Target: ATXN1; (-) strand; PAM type: YTN; PAM sequence: CTT
aatatcctccaagtttgagg

SEQ ID NO: 159955 - DNA, 20 bp, Artificial Sequence
  Description of Artificial Sequence: Synthetic oligonucleotide
  Target: ATXN1; (-) strand; PAM type: YTN; PAM sequence: CTG
ccaaatataatccacttaat

SEQ ID NO: 159956 - DNA, 20 bp, Artificial Sequence
  Description of Artificial Sequence: Synthetic oligonucleotide
  Target: ATXN1; (-) strand; PAM type: YTN; PAM sequence: CTC
actgccaaatataatccact

SEQ ID NO: 159957 - DNA, 20 bp, Artificial Sequence
  Description of Artificial Sequence: Synthetic oligonucleotide
  Target: ATXN1; (-) strand; PAM type: YTN; PAM sequence: TTG
ggcctcactgccaaatataa

SEQ ID NO: 159958 - DNA, 20 bp, Artificial Sequence
  Description of Artificial Sequence: Synthetic oligonucleotide
  Target: ATXN1; (-) strand; PAM type: YTN; PAM sequence: CTT
gggcctcactgccaaatata

SEQ ID NO: 159959 - DNA, 20 bp, Artificial Sequence
  Description of Artificial Sequence: Synthetic oligonucleotide
  Target: ATXN1; (-) strand; PAM type: YTN; PAM sequence: TTC
ccttgggcctcactgccaaa

SEQ ID NO: 159960 - DNA, 20 bp, Artificial Sequence
  Description of Artificial Sequence: Synthetic oligonucleotide
  Target: ATXN1; (-) strand; PAM type: YTN; PAM sequence: CTT
cccttgggcctcactgccaa

SEQ ID NO: 159961 - DNA, 20 bp, Artificial Sequence
  Description of Artificial Sequence: Synthetic oligonucleotide
  Target: ATXN1; (-) strand; PAM type: YTN; PAM sequence: TTG
agagtcccaaaggatgacag

SEQ ID NO: 159962 - DNA, 20 bp, Artificial Sequence
  Description of Artificial Sequence: Synthetic oligonucleotide
  Target: ATXN1; (-) strand; PAM type: YTN; PAM sequence: CTG
gttgagagtcccaaaggatg

SEQ ID NO: 159963 - DNA, 20 bp, Artificial Sequence
  Description of Artificial Sequence: Synthetic oligonucleotide
  Target: ATXN1; (-) strand; PAM type: YTN; PAM sequence: TTC
tggttgagagtcccaaagga

SEQ ID NO: 159964 - DNA, 20 bp, Artificial Sequence
  Description of Artificial Sequence: Synthetic oligonucleotide
  Target: ATXN1; (-) strand; PAM type: YTN; PAM sequence: TTG
attctggttgagagtcccaa

SEQ ID NO: 159965 - DNA, 20 bp, Artificial Sequence
  Description of Artificial Sequence: Synthetic oligonucleotide
  Target: ATXN1; (-) strand; PAM type: YTN; PAM sequence: CTT
gattctggttgagagtccca

SEQ ID NO: 159966 - DNA, 20 bp, Artificial Sequence
  Description of Artificial Sequence: Synthetic oligonucleotide
  Target: ATXN1; (-) strand; PAM type: YTN; PAM sequence: TTG
ccatgccttgattctggttg

SEQ ID NO: 159967 - DNA, 20 bp, Artificial Sequence
  Description of Artificial Sequence: Synthetic oligonucleotide
  Target: ATXN1; (-) strand; PAM type: YTN; PAM sequence: TTT
gccatgccttgattctggtt

SEQ ID NO: 159968 - DNA, 20 bp, Artificial Sequence
  Description of Artificial Sequence: Synthetic oligonucleotide
  Target: ATXN1; (-) strand; PAM type: YTN; PAM sequence: CTT
tgccatgccttgattctggt

SEQ ID NO: 159969 - DNA, 20 bp, Artificial Sequence
  Description of Artificial Sequence: Synthetic oligonucleotide
  Target: ATXN1; (-) strand; PAM type: YTN; PAM sequence: CTG
ctttgccatgccttgattct

SEQ ID NO: 159970 - DNA, 20 bp, Artificial Sequence
  Description of Artificial Sequence: Synthetic oligonucleotide
  Target: ATXN1; (-) strand; PAM type: YTN; PAM sequence: TTG
ctgctttgccatgccttgat

SEQ ID NO: 159971 - DNA, 20 bp, Artificial Sequence
  Description of Artificial Sequence: Synthetic oligonucleotide
  Target: ATXN1; (-) strand; PAM type: YTN; PAM sequence: CTG
gaagagagttgctgctttgc

SEQ ID NO: 159972 - DNA, 20 bp, Artificial Sequence
  Description of Artificial Sequence: Synthetic oligonucleotide
  Target: ATXN1; (-) strand; PAM type: YTN; PAM sequence: TTC
cccaccctggaagagagttg

SEQ ID NO: 159973 - DNA, 20 bp, Artificial Sequence
  Description of Artificial Sequence: Synthetic oligonucleotide
  Target: ATXN1; (-) strand; PAM type: YTN; PAM sequence: TTC
agtggagggtgatagcacgt

SEQ ID NO: 159974 - DNA, 20 bp, Artificial Sequence
  Description of Artificial Sequence: Synthetic oligonucleotide
  Target: ATXN1; (-) strand; PAM type: YTN; PAM sequence: CTT
cagtggagggtgatagcacg

SEQ ID NO: 159975 - DNA, 20 bp, Artificial Sequence
  Description of Artificial Sequence: Synthetic oligonucleotide
  Target: ATXN1; (-) strand; PAM type: YTN; PAM sequence: CTC
ttcagtggagggtgatagca

SEQ ID NO: 159976 - DNA, 20 bp, Artificial Sequence
  Description of Artificial Sequence: Synthetic oligonucleotide
  Target: ATXN1; (-) strand; PAM type: YTN; PAM sequence: TTC
ctcttcagtggagggtgata

SEQ ID NO: 159977 - DNA, 20 bp, Artificial Sequence
  Description of Artificial Sequence: Synthetic oligonucleotide
  Target: ATXN1; (-) strand; PAM type: YTN; PAM sequence: CTT
cctcttcagtggagggtgat

SEQ ID NO: 159978 - DNA, 20 bp, Artificial Sequence
  Description of Artificial Sequence: Synthetic oligonucleotide
  Target: ATXN1; (-) strand; PAM type: YTN; PAM sequence: CTC
cttcctcttcagtggagggt

SEQ ID NO: 159979 - DNA, 20 bp, Artificial Sequence
  Description of Artificial Sequence: Synthetic oligonucleotide
  Target: ATXN1; (-) strand; PAM type: YTN; PAM sequence: CTG
cgtgcaccaaaggaagcctc

SEQ ID NO: 159980 - DNA, 20 bp, Artificial Sequence
  Description of Artificial Sequence: Synthetic oligonucleotide
  Target: ATXN1; (-) strand; PAM type: YTN; PAM sequence: TTA
ctgcgtgcaccaaaggaagc

SEQ ID NO: 159981 - DNA, 20 bp, Artificial Sequence
  Description of Artificial Sequence: Synthetic oligonucleotide
  Target: ATXN1; (-) strand; PAM type: YTN; PAM sequence: TTG
ttactgcgtgcaccaaagga

SEQ ID NO: 159982 - DNA, 20 bp, Artificial Sequence
  Description of Artificial Sequence: Synthetic oligonucleotide
  Target: ATXN1; (-) strand; PAM type: YTN; PAM sequence: TTG
tccattgttactgcgtgcac

SEQ ID NO: 159983 - DNA, 20 bp, Artificial Sequence
  Description of Artificial Sequence: Synthetic oligonucleotide
  Target: ATXN1; (-) strand; PAM type: YTN; PAM sequence: CTG
tgggaggaaaggggaatgcc

SEQ ID NO: 159984 - DNA, 20 bp, Artificial Sequence
  Description of Artificial Sequence: Synthetic oligonucleotide
  Target: ATXN1; (-) strand; PAM type: YTN; PAM sequence: CTA
ggtgctgtgggaggaaaggg

SEQ ID NO: 159985 - DNA, 20 bp, Artificial Sequence
  Description of Artificial Sequence: Synthetic oligonucleotide
  Target: ATXN1; (-) strand; PAM type: YTN; PAM sequence: CTA
tgcatcccccaggcccccac

SEQ ID NO: 159986 - DNA, 20 bp, Artificial Sequence
  Description of Artificial Sequence: Synthetic oligonucleotide
  Target: ATXN1; (-) strand; PAM type: YTN; PAM sequence: CTC
gagcaaagcgtctatgcatc

SEQ ID NO: 159987 - DNA, 20 bp, Artificial Sequence
  Description of Artificial Sequence: Synthetic oligonucleotide
  Target: ATXN1; (-) strand; PAM type: YTN; PAM sequence: CTC
cactcgagcaaagcgtctat

SEQ ID NO: 159988 - DNA, 20 bp, Artificial Sequence
  Description of Artificial Sequence: Synthetic oligonucleotide
  Target: ATXN1; (-) strand; PAM type: YTN; PAM sequence: TTC
tccactcgagcaaagcgtct

SEQ ID NO: 159989 - DNA, 20 bp, Artificial Sequence
  Description of Artificial Sequence: Synthetic oligonucleotide
  Target: ATXN1; (-) strand; PAM type: YTN; PAM sequence: TTT
ctccactcgagcaaagcgtc

SEQ ID NO: 159990 - DNA, 20 bp, Artificial Sequence
  Description of Artificial Sequence: Synthetic oligonucleotide
  Target: ATXN1; (-) strand; PAM type: YTN; PAM sequence: TTT
tctccactcgagcaaagcgt

SEQ ID NO: 159991 - DNA, 20 bp, Artificial Sequence
  Description of Artificial Sequence: Synthetic oligonucleotide
  Target: ATXN1; (-) strand; PAM type: YTN; PAM sequence: CTT
ttctccactcgagcaaagcg

SEQ ID NO: 159992 - DNA, 20 bp, Artificial Sequence
  Description of Artificial Sequence: Synthetic oligonucleotide
  Target: ATXN1; (-) strand; PAM type: YTN; PAM sequence: CTG
cccagtacagcttttctcca

SEQ ID NO: 159993 - DNA, 20 bp, Artificial Sequence
  Description of Artificial Sequence: Synthetic oligonucleotide
  Target: ATXN1; (-) strand; PAM type: YTN; PAM sequence: TTG
ccctgcccagtacagctttt

SEQ ID NO: 159994 - DNA, 20 bp, Artificial Sequence
  Description of Artificial Sequence: Synthetic oligonucleotide
  Target: ATXN1; (-) strand; PAM type: YTN; PAM sequence: CTG
tggcattgccctgcccagta

SEQ ID NO: 159995 - DNA, 20 bp, Artificial Sequence
  Description of Artificial Sequence: Synthetic oligonucleotide
  Target: ATXN1; (-) strand; PAM type: YTN; PAM sequence: CTA
tccctgtggcattgccctgc

SEQ ID NO: 159996 - DNA, 20 bp, Artificial Sequence
  Description of Artificial Sequence: Synthetic oligonucleotide
  Target: ATXN1; (-) strand; PAM type: YTN; PAM sequence: TTG
tcactatccctgtggcattg

SEQ ID NO: 159997 - DNA, 20 bp, Artificial Sequence
  Description of Artificial Sequence: Synthetic oligonucleotide
  Target: ATXN1; (-) strand; PAM type: YTN; PAM sequence: TTT
gtcactatccctgtggcatt

SEQ ID NO: 159998 - DNA, 20 bp, Artificial Sequence
  Description of Artificial Sequence: Synthetic oligonucleotide
  Target: ATXN1; (-) strand; PAM type: YTN; PAM sequence: TTC
cgtgtttgtcactatccctg

SEQ ID NO: 159999 - DNA, 20 bp, Artificial Sequence
  Description of Artificial Sequence: Synthetic oligonucleotide
  Target: ATXN1; (-) strand; PAM type: YTN; PAM sequence: TTT
ccgtgtttgtcactatccct

SEQ ID NO: 160000 - DNA, 20 bp, Artificial Sequence
  Description of Artificial Sequence: Synthetic oligonucleotide
  Target: ATXN1; (-) strand; PAM type: YTN; PAM sequence: TTT
tccgtgtttgtcactatccc

SEQ ID NO: 160001 - DNA, 20 bp, Artificial Sequence
  Description of Artificial Sequence: Synthetic oligonucleotide
  Target: ATXN1; (-) strand; PAM type: YTN; PAM sequence: CTT
ttccgtgtttgtcactatcc

SEQ ID NO: 160002 - DNA, 20 bp, Artificial Sequence
  Description of Artificial Sequence: Synthetic oligonucleotide
  Target: ATXN1; (-) strand; PAM type: YTN; PAM sequence: CTC
cagacgaggcaatgtaggag

SEQ ID NO: 160003 - DNA, 20 bp, Artificial Sequence
  Description of Artificial Sequence: Synthetic oligonucleotide
  Target: ATXN1; (-) strand; PAM type: YTN; PAM sequence: CTG
acgctccagacgaggcaatg

SEQ ID NO: 160004 - DNA, 20 bp, Artificial Sequence
  Description of Artificial Sequence: Synthetic oligonucleotide
  Target: ATXN1; (-) strand; PAM type: YTN; PAM sequence: TTG
tcccagctgacgctccagac

SEQ ID NO: 160005 - DNA, 20 bp, Artificial Sequence
  Description of Artificial Sequence: Synthetic oligonucleotide
  Target: ATXN1; (-) strand; PAM type: YTN; PAM sequence: CTG
tggaaagatgcccccagcat

SEQ ID NO: 160006 - DNA, 20 bp, Artificial Sequence
  Description of Artificial Sequence: Synthetic oligonucleotide
  Target: ATXN1; (-) strand; PAM type: YTN; PAM sequence: TTA
agactgtggaaagatgcccc

SEQ ID NO: 160007 - DNA, 20 bp, Artificial Sequence
  Description of Artificial Sequence: Synthetic oligonucleotide
  Target: ATXN1; (-) strand; PAM type: YTN; PAM sequence: CTC
attaagactgtggaaagatg

SEQ ID NO: 160008 - DNA, 20 bp, Artificial Sequence
  Description of Artificial Sequence: Synthetic oligonucleotide
  Target: ATXN1; (-) strand; PAM type: YTN; PAM sequence: TTC
ctcattaagactgtggaaag

SEQ ID NO: 160009 - DNA, 20 bp, Artificial Sequence
  Description of Artificial Sequence: Synthetic oligonucleotide
  Target: ATXN1; (-) strand; PAM type: YTN; PAM sequence: CTG
aattcctcattaagactgtg

SEQ ID NO: 160010 - DNA, 20 bp, Artificial Sequence
  Description of Artificial Sequence: Synthetic oligonucleotide
  Target: ATXN1; (-) strand; PAM type: YTN; PAM sequence: TTA
aggggctgaattcctcatta

SEQ ID NO: 160011 - DNA, 20 bp, Artificial Sequence
  Description of Artificial Sequence: Synthetic oligonucleotide
  Target: ATXN1; (-) strand; PAM type: YTN; PAM sequence: TTT
aaggggctgaattcctcatt

SEQ ID NO: 160012 - DNA, 20 bp, Artificial Sequence
  Description of Artificial Sequence: Synthetic oligonucleotide
  Target: ATXN1; (-) strand; PAM type: YTN; PAM sequence: TTT
taaggggctgaattcctcat

SEQ ID NO: 160013 - DNA, 20 bp, Artificial Sequence
  Description of Artificial Sequence: Synthetic oligonucleotide
  Target: ATXN1; (-) strand; PAM type: YTN; PAM sequence: TTT
ttaaggggctgaattcctca

SEQ ID NO: 160014 - DNA, 20 bp, Artificial Sequence
  Description of Artificial Sequence: Synthetic oligonucleotide
  Target: ATXN1; (-) strand; PAM type: YTN; PAM sequence: TTG
gggatgatttttaaggggct

SEQ ID NO: 160015 - DNA, 20 bp, Artificial Sequence
  Description of Artificial Sequence: Synthetic oligonucleotide
  Target: ATXN1; (-) strand; PAM type: YTN; PAM sequence: TTT
ggggatgatttttaaggggc

SEQ ID NO: 160016 - DNA, 20 bp, Artificial Sequence
  Description of Artificial Sequence: Synthetic oligonucleotide
  Target: ATXN1; (-) strand; PAM type: YTN; PAM sequence: TTA
gtttggggatgatttttaag

SEQ ID NO: 160017 - DNA, 20 bp, Artificial Sequence
  Description of Artificial Sequence: Synthetic oligonucleotide
  Target: ATXN1; (-) strand; PAM type: YTN; PAM sequence: TTT
agtttggggatgatttttaa

SEQ ID NO: 160018 - DNA, 20 bp, Artificial Sequence
  Description of Artificial Sequence: Synthetic oligonucleotide
  Target: ATXN1; (-) strand; PAM type: YTN; PAM sequence: CTG
aggggtgtttagtttgggga

SEQ ID NO: 160019 - DNA, 20 bp, Artificial Sequence
  Description of Artificial Sequence: Synthetic oligonucleotide
  Target: ATXN1; (-) strand; PAM type: YTN; PAM sequence: CTA
aagccatggcatataaaact

SEQ ID NO: 160020 - DNA, 20 bp, Artificial Sequence
  Description of Artificial Sequence: Synthetic oligonucleotide
  Target: ATXN1; (-) strand; PAM type: YTN; PAM sequence: CTC
atgggaactaaagccatggc

SEQ ID NO: 160021 - DNA, 20 bp, Artificial Sequence
  Description of Artificial Sequence: Synthetic oligonucleotide
  Target: ATXN1; (-) strand; PAM type: YTN; PAM sequence: CTA
agcggcacacagacctcatg

SEQ ID NO: 160022 - DNA, 20 bp, Artificial Sequence
  Description of Artificial Sequence: Synthetic oligonucleotide
  Target: ATXN1; (-) strand; PAM type: YTN; PAM sequence: CTC
atgctaagcggcacacagac

SEQ ID NO: 160023 - DNA, 20 bp, Artificial Sequence
  Description of Artificial Sequence: Synthetic oligonucleotide
  Target: ATXN1; (-) strand; PAM type: YTN; PAM sequence: CTG
acctcatgctaagcggcaca

SEQ ID NO: 160024 - DNA, 20 bp, Artificial Sequence
  Description of Artificial Sequence: Synthetic oligonucleotide
  Target: ATXN1; (-) strand; PAM type: YTN; PAM sequence: TTA
agatgaacatgtactgacct

SEQ ID NO: 160025 - DNA, 20 bp, Artificial Sequence
  Description of Artificial Sequence: Synthetic oligonucleotide
  Target: ATXN1; (-) strand; PAM type: YTN; PAM sequence: TTA
acaaaaaaccaagaagagca

SEQ ID NO: 160026 - DNA, 20 bp, Artificial Sequence
  Description of Artificial Sequence: Synthetic oligonucleotide
  Target: ATXN1; (-) strand; PAM type: YTN; PAM sequence: TTA
gcgtcggttaacaaaaaacc

SEQ ID NO: 160027 - DNA, 20 bp, Artificial Sequence
  Description of Artificial Sequence: Synthetic oligonucleotide
  Target: ATXN1; (-) strand; PAM type: YTN; PAM sequence: TTA
ttagcgtcggttaacaaaaa

SEQ ID NO: 160028 - DNA, 20 bp, Artificial Sequence
  Description of Artificial Sequence: Synthetic oligonucleotide
  Target: ATXN1; (-) strand; PAM type: YTN; PAM sequence: TTT
attagcgtcggttaacaaaa

SEQ ID NO: 160029 - DNA, 20 bp, Artificial Sequence
  Description of Artificial Sequence: Synthetic oligonucleotide
  Target: ATXN1; (-) strand; PAM type: YTN; PAM sequence: TTG
taaaaatttattagcgtcgg

SEQ ID NO: 160030 - DNA, 20 bp, Artificial Sequence
  Description of Artificial Sequence: Synthetic oligonucleotide
  Target: ATXN1; (-) strand; PAM type: YTN; PAM sequence: CTT
gtaaaaatttattagcgtcg

SEQ ID NO: 160031 - DNA, 20 bp, Artificial Sequence
  Description of Artificial Sequence: Synthetic oligonucleotide
  Target: ATXN1; (-) strand; PAM type: YTN; PAM sequence: TTC
cagaacagcacagcccttgt

SEQ ID NO: 160032 - DNA, 20 bp, Artificial Sequence
  Description of Artificial Sequence: Synthetic oligonucleotide
  Target: ATXN1; (-) strand; PAM type: YTN; PAM sequence: TTT
ccagaacagcacagcccttg

SEQ ID NO: 160033 - DNA, 20 bp, Artificial Sequence
  Description of Artificial Sequence: Synthetic oligonucleotide
  Target: ATXN1; (-) strand; PAM type: YTN; PAM sequence: CTT
tccagaacagcacagccctt

SEQ ID NO: 160034 - DNA, 20 bp, Artificial Sequence
  Description of Artificial Sequence: Synthetic oligonucleotide
  Target: ATXN1; (-) strand; PAM type: YTN; PAM sequence: TTA
tactttccagaacagcacag

SEQ ID NO: 160035 - DNA, 20 bp, Artificial Sequence
  Description of Artificial Sequence: Synthetic oligonucleotide
  Target: ATXN1; (-) strand; PAM type: YTN; PAM sequence: TTT
atactttccagaacagcaca

SEQ ID NO: 160036 - DNA, 20 bp, Artificial Sequence
  Description of Artificial Sequence: Synthetic oligonucleotide
  Target: ATXN1; (-) strand; PAM type: YTN; PAM sequence: TTT
tatactttccagaacagcac

SEQ ID NO: 160037 - DNA, 20 bp, Artificial Sequence
  Description of Artificial Sequence: Synthetic oligonucleotide
  Target: ATXN1; (-) strand; PAM type: YTN; PAM sequence: CTT
ttatactttccagaacagca

SEQ ID NO: 160038 - DNA, 20 bp, Artificial Sequence
  Description of Artificial Sequence: Synthetic oligonucleotide
  Target: ATXN1; (-) strand; PAM type: YTN; PAM sequence: TTC
acttttatactttccagaac

SEQ ID NO: 160039 - DNA, 20 bp, Artificial Sequence
  Description of Artificial Sequence: Synthetic oligonucleotide
  Target: ATXN1; (-) strand; PAM type: YTN; PAM sequence: CTT
cacttttatactttccagaa

SEQ ID NO: 160040 - DNA, 20 bp, Artificial Sequence
  Description of Artificial Sequence: Synthetic oligonucleotide
  Target: ATXN1; (-) strand; PAM type: YTN; PAM sequence: TTA
atgcttcacttttatacttt

SEQ ID NO: 160041 - DNA, 20 bp, Artificial Sequence
  Description of Artificial Sequence: Synthetic oligonucleotide
  Target: ATXN1; (-) strand; PAM type: YTN; PAM sequence: TTT
aatgcttcacttttatactt

SEQ ID NO: 160042 - DNA, 20 bp, Artificial Sequence
  Description of Artificial Sequence: Synthetic oligonucleotide
  Target: ATXN1; (-) strand; PAM type: YTN; PAM sequence: TTT
taatgcttcacttttatact

SEQ ID NO: 160043 - DNA, 20 bp, Artificial Sequence
  Description of Artificial Sequence: Synthetic oligonucleotide
  Target: ATXN1; (-) strand; PAM type: YTN; PAM sequence: TTT
ttaatgcttcacttttatac

SEQ ID NO: 160044 - DNA, 20 bp, Artificial Sequence
  Description of Artificial Sequence: Synthetic oligonucleotide
  Target: ATXN1; (-) strand; PAM type: YTN; PAM sequence: TTT
tttaatgcttcacttttata

SEQ ID NO: 160045 - DNA, 20 bp, Artificial Sequence
  Description of Artificial Sequence: Synthetic oligonucleotide
  Target: ATXN1; (-) strand; PAM type: YTN; PAM sequence: TTC
cgttttttaatgcttcactt

SEQ ID NO: 160046 - DNA, 20 bp, Artificial Sequence
  Description of Artificial Sequence: Synthetic oligonucleotide
  Target: ATXN1; (-) strand; PAM type: YTN; PAM sequence: TTG
agagggttccgttttttaat

SEQ ID NO: 160047 - DNA, 20 bp, Artificial Sequence
  Description of Artificial Sequence: Synthetic oligonucleotide
  Target: ATXN1; (-) strand; PAM type: YTN; PAM sequence: CTT
gagagggttccgttttttaa

SEQ ID NO: 160048 - DNA, 20 bp, Artificial Sequence
  Description of Artificial Sequence: Synthetic oligonucleotide
  Target: ATXN1; (-) strand; PAM type: YTN; PAM sequence: CTC
ttgagagggttccgtttttt

SEQ ID NO: 160049 - DNA, 20 bp, Artificial Sequence
  Description of Artificial Sequence: Synthetic oligonucleotide
  Target: ATXN1; (-) strand; PAM type: YTN; PAM sequence: TTC
ataggagataatctcttgag

SEQ ID NO: 160050 - DNA, 20 bp, Artificial Sequence
  Description of Artificial Sequence: Synthetic oligonucleotide
  Target: ATXN1; (-) strand; PAM type: YTN; PAM sequence: CTT
cataggagataatctcttga

SEQ ID NO: 160051 - DNA, 20 bp, Artificial Sequence
  Description of Artificial Sequence: Synthetic oligonucleotide
  Target: ATXN1; (-) strand; PAM type: YTN; PAM sequence: TTC
ttcataggagataatctctt

SEQ ID NO: 160052 - DNA, 20 bp, Artificial Sequence
  Description of Artificial Sequence: Synthetic oligonucleotide
  Target: ATXN1; (-) strand; PAM type: YTN; PAM sequence: TTA
taggcgtgagccacggcgcc

SEQ ID NO: 160053 - DNA, 20 bp, Artificial Sequence
  Description of Artificial Sequence: Synthetic oligonucleotide
  Target: ATXN1; (-) strand; PAM type: YTN; PAM sequence: CTG
ggattataggcgtgagccac

SEQ ID NO: 160054 - DNA, 20 bp, Artificial Sequence
  Description of Artificial Sequence: Synthetic oligonucleotide
  Target: ATXN1; (-) strand; PAM type: YTN; PAM sequence: CTC
ccaaaatgctgggattatag

SEQ ID NO: 160055 - DNA, 20 bp, Artificial Sequence
  Description of Artificial Sequence: Synthetic oligonucleotide
  Target: ATXN1; (-) strand; PAM type: YTN; PAM sequence: CTC
ggtctcccaaaatgctggga

SEQ ID NO: 160056 - DNA, 20 bp, Artificial Sequence
  Description of Artificial Sequence: Synthetic oligonucleotide
  Target: ATXN1; (-) strand; PAM type: YTN; PAM sequence: CTC
aagcgatccacccacctcgg

SEQ ID NO: 160057 - DNA, 20 bp, Artificial Sequence
  Description of Artificial Sequence: Synthetic oligonucleotide
  Target: ATXN1; (-) strand; PAM type: YTN; PAM sequence: CTG
ggctcaagcgatccacccac

SEQ ID NO: 160058 - DNA, 20 bp, Artificial Sequence
  Description of Artificial Sequence: Synthetic oligonucleotide
  Target: ATXN1; (-) strand; PAM type: YTN; PAM sequence: CTC
ctgggctcaagcgatccacc

SEQ ID NO: 160059 - DNA, 20 bp, Artificial Sequence
  Description of Artificial Sequence: Synthetic oligonucleotide
  Target: ATXN1; (-) strand; PAM type: YTN; PAM sequence: CTG
gaactcctgggctcaagcga

SEQ ID NO: 160060 - DNA, 20 bp, Artificial Sequence
  Description of Artificial Sequence: Synthetic oligonucleotide
  Target: ATXN1; (-) strand; PAM type: YTN; PAM sequence: CTG
gtctggaactcctgggctca

SEQ ID NO: 160061 - DNA, 20 bp, Artificial Sequence
  Description of Artificial Sequence: Synthetic oligonucleotide
  Target: ATXN1; (-) strand; PAM type: YTN; PAM sequence: TTG
cccgtgctggtctggaactc

SEQ ID NO: 160062 - DNA, 20 bp, Artificial Sequence
  Description of Artificial Sequence: Synthetic oligonucleotide
  Target: ATXN1; (-) strand; PAM type: YTN; PAM sequence: CTT
gcccgtgctggtctggaact

SEQ ID NO: 160063 - DNA, 20 bp, Artificial Sequence
  Description of Artificial Sequence: Synthetic oligonucleotide
  Target: ATXN1; (-) strand; PAM type: YTN; PAM sequence: CTA
tcttgcccgtgctggtctgg

SEQ ID NO: 160064 - DNA, 20 bp, Artificial Sequence
  Description of Artificial Sequence: Synthetic oligonucleotide
  Target: ATXN1; (-) strand; PAM type: YTN; PAM sequence: TTG
ctatcttgcccgtgctggtc

SEQ ID NO: 160065 - DNA, 20 bp, Artificial Sequence
  Description of Artificial Sequence: Synthetic oligonucleotide
  Target: ATXN1; (-) strand; PAM type: YTN; PAM sequence: TTT
gctatcttgcccgtgctggt

SEQ ID NO: 160066 - DNA, 20 bp, Artificial Sequence
  Description of Artificial Sequence: Synthetic oligonucleotide
  Target: ATXN1; (-) strand; PAM type: YTN; PAM sequence: TTT
tgctatcttgcccgtgctgg

SEQ ID NO: 160067 - DNA, 20 bp, Artificial Sequence
  Description of Artificial Sequence: Synthetic oligonucleotide
  Target: ATXN1; (-) strand; PAM type: YTN; PAM sequence: TTG
tagagacagggttttgctat

SEQ ID NO: 160068 - DNA, 20 bp, Artificial Sequence
  Description of Artificial Sequence: Synthetic oligonucleotide
  Target: ATXN1; (-) strand; PAM type: YTN; PAM sequence: TTT
gtagagacagggttttgcta

SEQ ID NO: 160069 - DNA, 20 bp, Artificial Sequence
  Description of Artificial Sequence: Synthetic oligonucleotide
  Target: ATXN1; (-) strand; PAM type: YTN; PAM sequence: TTT
tgtagagacagggttttgct

SEQ ID NO: 160070 - DNA, 20 bp, Artificial Sequence
  Description of Artificial Sequence: Synthetic oligonucleotide
  Target: ATXN1; (-) strand; PAM type: YTN; PAM sequence: TTT
ttgtagagacagggttttgc

SEQ ID NO: 160071 - DNA, 20 bp, Artificial Sequence
  Description of Artificial Sequence: Synthetic oligonucleotide
  Target: ATXN1; (-) strand; PAM type: YTN; PAM sequence: TTT
tttgtagagacagggttttg

SEQ ID NO: 160072 - DNA, 20 bp, Artificial Sequence
  Description of Artificial Sequence: Synthetic oligonucleotide
  Target: ATXN1; (-) strand; PAM type: YTN; PAM sequence: TTT
ttttgtagagacagggtttt

SEQ ID NO: 160073 - DNA, 20 bp, Artificial Sequence
  Description of Artificial Sequence: Synthetic oligonucleotide
  Target: ATXN1; (-) strand; PAM type: YTN; PAM sequence: CTG
tgtttttttgtagagacagg

SEQ ID NO: 160074 - DNA, 20 bp, Artificial Sequence
  Description of Artificial Sequence: Synthetic oligonucleotide
  Target: ATXN1; (-) strand; PAM type: YTN; PAM sequence: TTC
tgtgtttttttgtagagaca

SEQ ID NO: 160075 - DNA, 20 bp, Artificial Sequence
  Description of Artificial Sequence: Synthetic oligonucleotide
  Target: ATXN1; (-) strand; PAM type: YTN; PAM sequence: TTT
ctgtgtttttttgtagagac

SEQ ID NO: 160076 - DNA, 20 bp, Artificial Sequence
  Description of Artificial Sequence: Synthetic oligonucleotide
  Target: ATXN1; (-) strand; PAM type: YTN; PAM sequence: TTT
tctgtgtttttttgtagaga

SEQ ID NO: 160077 - DNA, 20 bp, Artificial Sequence
  Description of Artificial Sequence: Synthetic oligonucleotide
  Target: ATXN1; (-) strand; PAM type: YTN; PAM sequence: CTA
attttctgtgtttttttgta

SEQ ID NO: 160078 - DNA, 20 bp, Artificial Sequence
  Description of Artificial Sequence: Synthetic oligonucleotide
  Target: ATXN1; (-) strand; PAM type: YTN; PAM sequence: CTA
cacccagctaattttctgtg

SEQ ID NO: 160079 - DNA, 20 bp, Artificial Sequence
  Description of Artificial Sequence: Synthetic oligonucleotide
  Target: ATXN1; (-) strand; PAM type: YTN; PAM sequence: CTA
tgggtgtgtaccactacacc

SEQ ID NO: 160080 - DNA, 20 bp, Artificial Sequence
  Description of Artificial Sequence: Synthetic oligonucleotide
  Target: ATXN1; (-) strand; PAM type: YTN; PAM sequence: CTG
ggactatgggtgtgtaccac

SEQ ID NO: 160081 - DNA, 20 bp, Artificial Sequence
  Description of Artificial Sequence: Synthetic oligonucleotide
  Target: ATXN1; (-) strand; PAM type: YTN; PAM sequence: CTC
cccagtagctgggactatgg

SEQ ID NO: 160082 - DNA, 20 bp, Artificial Sequence
  Description of Artificial Sequence: Synthetic oligonucleotide
  Target: ATXN1; (-) strand; PAM type: YTN; PAM sequence: CTC
agcctccccagtagctggga

SEQ ID NO: 160083 - DNA, 20 bp, Artificial Sequence
  Description of Artificial Sequence: Synthetic oligonucleotide
  Target: ATXN1; (-) strand; PAM type: YTN; PAM sequence: CTC
ccacctcagcctccccagta

SEQ ID NO: 160084 - DNA, 20 bp, Artificial Sequence
  Description of Artificial Sequence: Synthetic oligonucleotide
  Target: ATXN1; (-) strand; PAM type: YTN; PAM sequence: TTG
atcctcccacctcagcctcc

SEQ ID NO: 160085 - DNA, 20 bp, Artificial Sequence
  Description of Artificial Sequence: Synthetic oligonucleotide
  Target: ATXN1; (-) strand; PAM type: YTN; PAM sequence: CTC
aattgatcctcccacctcag

SEQ ID NO: 160086 - DNA, 20 bp, Artificial Sequence
  Description of Artificial Sequence: Synthetic oligonucleotide
  Target: ATXN1; (-) strand; PAM type: YTN; PAM sequence: CTG
gactcaattgatcctcccac

SEQ ID NO: 160087 - DNA, 20 bp, Artificial Sequence
  Description of Artificial Sequence: Synthetic oligonucleotide
  Target: ATXN1; (-) strand; PAM type: YTN; PAM sequence: CTC
ctggactcaattgatcctcc

SEQ ID NO: 160088 - DNA, 20 bp, Artificial Sequence
  Description of Artificial Sequence: Synthetic oligonucleotide
  Target: ATXN1; (-) strand; PAM type: YTN; PAM sequence: CTC
aacctcctggactcaattga

SEQ ID NO: 160089 - DNA, 20 bp, Artificial Sequence
  Description of Artificial Sequence: Synthetic oligonucleotide
  Target: ATXN1; (-) strand; PAM type: YTN; PAM sequence: CTG
cagcctcaacctcctggact

SEQ ID NO: 160090 - DNA, 20 bp, Artificial Sequence
  Description of Artificial Sequence: Synthetic oligonucleotide
  Target: ATXN1; (-) strand; PAM type: YTN; PAM sequence: CTC
actgcagcctcaacctcctg

SEQ ID NO: 160091 - DNA, 20 bp, Artificial Sequence
  Description of Artificial Sequence: Synthetic oligonucleotide
  Target: ATXN1; (-) strand; PAM type: YTN; PAM sequence: TTG
gctcactgcagcctcaacct

SEQ ID NO: 160092 - DNA, 20 bp, Artificial Sequence
  Description of Artificial Sequence: Synthetic oligonucleotide
  Target: ATXN1; (-) strand; PAM type: YTN; PAM sequence: CTG
aagtgcagtgatgggatcat

SEQ ID NO: 160093 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctgaagtgcag

SEQ ID NO: 160094 - DNA, 20 bp, Artificial Sequence
  Description of Artificial Sequence: Synthetic oligonucleotide
  Target: ATXN1; (-) strand; PAM type: YTN; PAM sequence: TTG
ccctgtcacccaggctgaag

SEQ ID NO: 160095 - DNA, 20 bp, Artificial Sequence
  Description of Artificial Sequence: Synthetic oligonucleotide
  Target: ATXN1; (-) strand; PAM type: YTN; PAM sequence: CTT
gccctgtcacccaggctgaa

SEQ ID NO: 160096 - DNA, 20 bp, Artificial Sequence
  Description of Artificial Sequence: Synthetic oligonucleotide
  Target: ATXN1; (-) strand; PAM type: YTN; PAM sequence: TTG
agacagggtcttgccctgtc

SEQ ID NO: 160097 - DNA, 20 bp, Artificial Sequence
  Description of Artificial Sequence: Synthetic oligonucleotide
  Target: ATXN1; (-) strand; PAM type: YTN; PAM sequence: TTT
gagacagggtcttgccctgt

SEQ ID NO: 160098 - DNA, 20 bp, Artificial Sequence
  Description of Artificial Sequence: Synthetic oligonucleotide
  Target: ATXN1; (-) strand; PAM type: YTN; PAM sequence: TTT
tgagacagggtcttgccctg

SEQ ID NO: 160099 - DNA, 20 bp, Artificial Sequence
  Description of Artificial Sequence: Synthetic oligonucleotide
  Target: ATXN1; (-) strand; PAM type: YTN; PAM sequence: TTG
ttttgagacagggtcttgcc

SEQ ID NO: 160100 - DNA, 20 bp, Artificial Sequence
  Description of Artificial Sequence: Synthetic oligonucleotide
  Target: ATXN1; (-) strand; PAM type: YTN; PAM sequence: CTT
gttttgagacagggtcttgc

SEQ ID NO: 160101 - DNA, 20 bp, Artificial Sequence
  Description of Artificial Sequence: Synthetic oligonucleotide
  Target: ATXN1; (-) strand; PAM type: YTN; PAM sequence: TTG
cttgttttgagacagggtct

SEQ ID NO: 160102 - DNA, 20 bp, Artificial Sequence
  Description of Artificial Sequence: Synthetic oligonucleotide
  Target: ATXN1; (-) strand; PAM type: YTN; PAM sequence: TTT
gcttgttttgagacagggtc

SEQ ID NO: 160103 - DNA, 20 bp, Artificial Sequence
  Description of Artificial Sequence: Synthetic oligonucleotide
  Target: ATXN1; (-) strand; PAM type: YTN; PAM sequence: TTG
tttgcttgttttgagacagg

SEQ ID NO: 160104 - DNA, 20 bp, Artificial Sequence
  Description of Artificial Sequence: Synthetic oligonucleotide
  Target: ATXN1; (-) strand; PAM type: YTN; PAM sequence: TTT
gtttgcttgttttgagacag

SEQ ID NO: 160105 - DNA, 20 bp, Artificial Sequence
  Description of Artificial Sequence: Synthetic oligonucleotide
  Target: ATXN1; (-) strand; PAM type: YTN; PAM sequence: TTC
gtttgtttgcttgttttgag

SEQ ID NO: 160106 - DNA, 20 bp, Artificial Sequence
  Description of Artificial Sequence: Synthetic oligonucleotide
  Target: ATXN1; (-) strand; PAM type: YTN; PAM sequence: TTG
tgttcgtttgtttgcttgtt

SEQ ID NO: 160107 - DNA, 20 bp, Artificial Sequence
  Description of Artificial Sequence: Synthetic oligonucleotide
  Target: ATXN1; (-) strand; PAM type: YTN; PAM sequence: TTT
gtgttcgtttgtttgcttgt

SEQ ID NO: 160108 - DNA, 20 bp, Artificial Sequence
  Description of Artificial Sequence: Synthetic oligonucleotide
  Target: ATXN1; (-) strand; PAM type: YTN; PAM sequence: TTT
tgtgttcgtttgtttgcttg

SEQ ID NO: 160109 - DNA, 20 bp, Artificial Sequence
  Description of Artificial Sequence: Synthetic oligonucleotide
  Target: ATXN1; (-) strand; PAM type: YTN; PAM sequence: TTT
ttgtgttcgtttgtttgctt

SEQ ID NO: 160110 - DNA, 20 bp, Artificial Sequence
  Description of Artificial Sequence: Synthetic oligonucleotide
  Target: ATXN1; (-) strand; PAM type: YTN; PAM sequence: CTG
tgggtttttgtgttcgtttg

SEQ ID NO: 160111 - DNA, 20 bp, Artificial Sequence
  Description of Artificial Sequence: Synthetic oligonucleotide
  Target: ATXN1; (-) strand; PAM type: YTN; PAM sequence: TTC
tgtgggtttttgtgttcgtt

SEQ ID NO: 160112 - DNA, 20 bp, Artificial Sequence
  Description of Artificial Sequence: Synthetic oligonucleotide
  Target: ATXN1; (-) strand; PAM type: YTN; PAM sequence: TTT
ctgtgggtttttgtgttcgt

SEQ ID NO: 160113 - DNA, 20 bp, Artificial Sequence
  Description of Artificial Sequence: Synthetic oligonucleotide
  Target: ATXN1; (-) strand; PAM type: YTN; PAM sequence: TTT
tctgtgggtttttgtgttcg

SEQ ID NO: 160114 - DNA, 20 bp, Artificial Sequence
  Description of Artificial Sequence: Synthetic oligonucleotide
  Target: ATXN1; (-) strand; PAM type: YTN; PAM sequence: TTT
ttctgtgggtttttgtgttc

SEQ ID NO: 160115 - DNA, 20 bp, Artificial Sequence
  Description of Artificial Sequence: Synthetic oligonucleotide
  Target: ATXN1; (-) strand; PAM type: YTN; PAM sequence: TTG
tttttctgtgggtttttgtg

SEQ ID NO: 160116 - DNA, 20 bp, Artificial Sequence
  Description of Artificial Sequence: Synthetic oligonucleotide
  Target: ATXN1; (-) strand; PAM type: YTN; PAM sequence: TTT
gtttttctgtgggtttttgt

SEQ ID NO: 160117 - DNA, 20 bp, Artificial Sequence
  Description of Artificial Sequence: Synthetic oligonucleotide
  Target: ATXN1; (-) strand; PAM type: YTN; PAM sequence: TTT
tgtttttctgtgggtttttg

SEQ ID NO: 160118 - DNA, 20 bp, Artificial Sequence
  Description of Artificial Sequence: Synthetic oligonucleotide
  Target: ATXN1; (-) strand; PAM type: YTN; PAM sequence: CTA
aaccaggcaaatgagttttg

SEQ ID NO: 160119 - DNA, 20 bp, Artificial Sequence
  Description of Artificial Sequence: Synthetic oligonucleotide
  Target: ATXN1; (-) strand; PAM type: YTN; PAM sequence: CTC
taaaccaggcaaatgagttt

SEQ ID NO: 160120 - DNA, 20 bp, Artificial Sequence
  Description of Artificial Sequence: Synthetic oligonucleotide
  Target: ATXN1; (-) strand; PAM type: YTN; PAM sequence: CTC
tctaaaccaggcaaatgagt

SEQ ID NO: 160121 - DNA, 20 bp, Artificial Sequence
  Description of Artificial Sequence: Synthetic oligonucleotide
  Target: ATXN1; (-) strand; PAM type: YTN; PAM sequence: CTC
ctctctaaaccaggcaaatg

SEQ ID NO: 160122 - DNA, 20 bp, Artificial Sequence
  Description of Artificial Sequence: Synthetic oligonucleotide
  Target: ATXN1; (-) strand; PAM type: YTN; PAM sequence: CTC
tcctctctaaaccaggcaaa

SEQ ID NO: 160123 - DNA, 20 bp, Artificial Sequence
  Description of Artificial Sequence: Synthetic oligonucleotide
  Target: ATXN1; (-) strand; PAM type: YTN; PAM sequence: CTG
cagcactctcctctctaaac

SEQ ID NO: 160124 - DNA, 20 bp, Artificial Sequence
  Description of Artificial Sequence: Synthetic oligonucleotide
  Target: ATXN1; (-) strand; PAM type: YTN; PAM sequence: CTG
agctgcagcactctcctctc

SEQ ID NO: 160125 - DNA, 20 bp, Artificial Sequence
  Description of Artificial Sequence: Synthetic oligonucleotide
  Target: ATXN1; (-) strand; PAM type: YTN; PAM sequence: CTC
tgagctgcagcactctcctc

SEQ ID NO: 160126 - DNA, 20 bp, Artificial Sequence
  Description of Artificial Sequence: Synthetic oligonucleotide
  Target: ATXN1; (-) strand; PAM type: YTN; PAM sequence: CTC
tctgagctgcagcactctcc

SEQ ID NO: 160127 - DNA, 20 bp, Artificial Sequence
  Description of Artificial Sequence: Synthetic oligonucleotide
  Target: ATXN1; (-) strand; PAM type: YTN; PAM sequence: TTC
acctctctgagctgcagcac

SEQ ID NO: 160128 - DNA, 20 bp, Artificial Sequence
  Description of Artificial Sequence: Synthetic oligonucleotide
  Target: ATXN1; (-) strand; PAM type: YTN; PAM sequence: CTT
cacctctctgagctgcagca

SEQ ID NO: 160129 - DNA, 20 bp, Artificial Sequence
  Description of Artificial Sequence: Synthetic oligonucleotide
  Target: ATXN1; (-) strand; PAM type: YTN; PAM sequence: TTA
cttcacctctctgagctgca

SEQ ID NO: 160130 - DNA, 20 bp, Artificial Sequence
  Description of Artificial Sequence: Synthetic oligonucleotide
  Target: ATXN1; (-) strand; PAM type: YTN; PAM sequence: CTG
gcaggacaagttacttcacc

SEQ ID NO: 160131 - DNA, 20 bp, Artificial Sequence
  Description of Artificial Sequence: Synthetic oligonucleotide
  Target: ATXN1; (-) strand; PAM type: YTN; PAM sequence: CTC
tggcaggacaagttacttca

SEQ ID NO: 160132 - DNA, 20 bp, Artificial Sequence
  Description of Artificial Sequence: Synthetic oligonucleotide
  Target: ATXN1; (-) strand; PAM type: YTN; PAM sequence: TTG
ggtctctggcaggacaagtt

SEQ ID NO: 160133 - DNA, 20 bp, Artificial Sequence
  Description of Artificial Sequence: Synthetic oligonucleotide
  Target: ATXN1; (-) strand; PAM type: YTN; PAM sequence: TTT
gggtctctggcaggacaagt

SEQ ID NO: 160134 - DNA, 20 bp, Artificial Sequence
  Description of Artificial Sequence: Synthetic oligonucleotide
  Target: ATXN1; (-) strand; PAM type: YTN; PAM sequence: CTC
ataagacccccccaacatca

SEQ ID NO: 160135 - DNA, 20 bp, Artificial Sequence
  Description of Artificial Sequence: Synthetic oligonucleotide
  Target: ATXN1; (-) strand; PAM type: YTN; PAM sequence: CTG
aactcataagacccccccaa

SEQ ID NO: 160136 - DNA, 20 bp, Artificial Sequence
  Description of Artificial Sequence: Synthetic oligonucleotide
  Target: ATXN1; (-) strand; PAM type: YTN; PAM sequence: TTG
aggatgcctgaactcataag

SEQ ID NO: 160137 - DNA, 20 bp, Artificial Sequence
  Description of Artificial Sequence: Synthetic oligonucleotide
  Target: ATXN1; (-) strand; PAM type: YTN; PAM sequence: CTT
gaggatgcctgaactcataa

SEQ ID NO: 160138 - DNA, 20 bp, Artificial Sequence
  Description of Artificial Sequence: Synthetic oligonucleotide
  Target: ATXN1; (-) strand; PAM type: YTN; PAM sequence: CTC
ttgaggatgcctgaactcat

SEQ ID NO: 160139 - DNA, 20 bp, Artificial Sequence
  Description of Artificial Sequence: Synthetic oligonucleotide
  Target: ATXN1; (-) strand; PAM type: YTN; PAM sequence: CTG
catgaacagactcttgagga

SEQ ID NO: 160140 - DNA, 20 bp, Artificial Sequence
  Description of Artificial Sequence: Synthetic oligonucleotide
  Target: ATXN1; (-) strand; PAM type: YTN; PAM sequence: CTA
ggcagaaatcctgcatgaac

SEQ ID NO: 160141 - DNA, 20 bp, Artificial Sequence
  Description of Artificial Sequence: Synthetic oligonucleotide
  Target: ATXN1; (-) strand; PAM type: YTN; PAM sequence: CTC
taggcagaaatcctgcatga

SEQ ID NO: 160142 - DNA, 20 bp, Artificial Sequence
  Description of Artificial Sequence: Synthetic oligonucleotide
  Target: ATXN1; (-) strand; PAM type: YTN; PAM sequence: TTG
tgactctaggcagaaatcct

SEQ ID NO: 160143 - DNA, 20 bp, Artificial Sequence
  Description of Artificial Sequence: Synthetic oligonucleotide
  Target: ATXN1; (-) strand; PAM type: YTN; PAM sequence: CTC
caaaacagatggcattgtga

SEQ ID NO: 160144 - DNA, 20 bp, Artificial Sequence
  Description of Artificial Sequence: Synthetic oligonucleotide
  Target: ATXN1; (-) strand; PAM type: YTN; PAM sequence: TTC
tccaaaacagatggcattgt

SEQ ID NO: 160145 - DNA, 20 bp, Artificial Sequence
  Description of Artificial Sequence: Synthetic oligonucleotide
  Target: ATXN1; (-) strand; PAM type: YTN; PAM sequence: TTT
ctccaaaacagatggcattg

SEQ ID NO: 160146 - DNA, 20 bp, Artificial Sequence
  Description of Artificial Sequence: Synthetic oligonucleotide
  Target: ATXN1; (-) strand; PAM type: YTN; PAM sequence: TTT
tctccaaaacagatggcatt

SEQ ID NO: 160147 - DNA, 20 bp, Artificial Sequence
  Description of Artificial Sequence: Synthetic oligonucleotide
  Target: ATXN1; (-) strand; PAM type: YTN; PAM sequence: TTG
tggaagaagagatggttttc

SEQ ID NO: 160148 - DNA, 20 bp, Artificial Sequence
  Description of Artificial Sequence: Synthetic oligonucleotide
  Target: ATXN1; (-) strand; PAM type: YTN; PAM sequence: TTG
gggaagttgtggaagaagag

SEQ ID NO: 160149 - DNA, 20 bp, Artificial Sequence
  Description of Artificial Sequence: Synthetic oligonucleotide
  Target: ATXN1; (-) strand; PAM type: YTN; PAM sequence: TTG
attggggaagttgtggaaga

SEQ ID NO: 160150 - DNA, 20 bp, Artificial Sequence
  Description of Artificial Sequence: Synthetic oligonucleotide
  Target: ATXN1; (-) strand; PAM type: YTN; PAM sequence: TTT
gattggggaagttgtggaag

SEQ ID NO: 160151 - DNA, 20 bp, Artificial Sequence
  Description of Artificial Sequence: Synthetic oligonucleotide
  Target: ATXN1; (-) strand; PAM type: YTN; PAM sequence: TTA
ataagcaaaatcacaaattt

SEQ ID NO: 160152 - DNA, 20 bp, Artificial Sequence
  Description of Artificial Sequence: Synthetic oligonucleotide
  Target: ATXN1; (-) strand; PAM type: YTN; PAM sequence: CTT
aataagcaaaatcacaaatt

SEQ ID NO: 160153 - DNA, 20 bp, Artificial Sequence
  Description of Artificial Sequence: Synthetic oligonucleotide
  Target: ATXN1; (-) strand; PAM type: YTN; PAM sequence: TTG
agcttaataagcaaaatcac

SEQ ID NO: 160154 - DNA, 20 bp, Artificial Sequence
  Description of Artificial Sequence: Synthetic oligonucleotide
  Target: ATXN1; (-) strand; PAM type: YTN; PAM sequence: TTG
ttgagcttaataagcaaaat

SEQ ID NO: 160155 - DNA, 20 bp, Artificial Sequence
  Description of Artificial Sequence: Synthetic oligonucleotide
  Target: ATXN1; (-) strand; PAM type: YTN; PAM sequence: TTC
agaaatgtgcaaattgttga

SEQ ID NO: 160156 - DNA, 20 bp, Artificial Sequence
  Description of Artificial Sequence: Synthetic oligonucleotide
  Target: ATXN1; (-) strand; PAM type: YTN; PAM sequence: CTG
cacccacagagaaattcaga

SEQ ID NO: 160157 - DNA, 20 bp, Artificial Sequence
  Description of Artificial Sequence: Synthetic oligonucleotide
  Target: ATXN1; (-) strand; PAM type: YTN; PAM sequence: CTG
acactgcacccacagagaaa

SEQ ID NO: 160158 - DNA, 20 bp, Artificial Sequence
  Description of Artificial Sequence: Synthetic oligonucleotide
  Target: ATXN1; (-) strand; PAM type: YTN; PAM sequence: CTG
ctgacactgcacccacagag

SEQ ID NO: 160159 - DNA, 20 bp, Artificial Sequence
  Description of Artificial Sequence: Synthetic oligonucleotide
  Target: ATXN1; (-) strand; PAM type: YTN; PAM sequence: TTA
ggcactgctgacactgcacc

SEQ ID NO: 160160 - DNA, 20 bp, Artificial Sequence
  Description of Artificial Sequence: Synthetic oligonucleotide
  Target: ATXN1; (-) strand; PAM type: YTN; PAM sequence: CTG
gttaggcactgctgacactg

SEQ ID NO: 160161 - DNA, 20 bp, Artificial Sequence
  Description of Artificial Sequence: Synthetic oligonucleotide
  Target: ATXN1; (-) strand; PAM type: YTN; PAM sequence: CTC
aactggttaggcactgctga

SEQ ID NO: 160162 - DNA, 20 bp, Artificial Sequence
  Description of Artificial Sequence: Synthetic oligonucleotide
  Target: ATXN1; (-) strand; PAM type: YTN; PAM sequence: TTC
tcaactggttaggcactgct

SEQ ID NO: 160163 - DNA, 20 bp, Artificial Sequence
  Description of Artificial Sequence: Synthetic oligonucleotide
  Target: ATXN1; (-) strand; PAM type: YTN; PAM sequence: CTT
ctcaactggttaggcactgc

SEQ ID NO: 160164 - DNA, 20 bp, Artificial Sequence
  Description of Artificial Sequence: Synthetic oligonucleotide
  Target: ATXN1; (-) strand; PAM type: YTN; PAM sequence: CTG
gtcttctcaactggttaggc

SEQ ID NO: 160165 - DNA, 20 bp, Artificial Sequence
  Description of Artificial Sequence: Synthetic oligonucleotide
  Target: ATXN1; (-) strand; PAM type: YTN; PAM sequence: TTC
ctggtcttctcaactggtta

SEQ ID NO: 160166 - DNA, 20 bp, Artificial Sequence
  Description of Artificial Sequence: Synthetic oligonucleotide
  Target: ATXN1; (-) strand; PAM type: YTN; PAM sequence: CTT
cctggtcttctcaactggtt

SEQ ID NO: 160167 - DNA, 20 bp, Artificial Sequence
  Description of Artificial Sequence: Synthetic oligonucleotide
  Target: ATXN1; (-) strand; PAM type: YTN; PAM sequence: CTG
aagaatcttcctggtcttct

SEQ ID NO: 160168 - DNA, 20 bp, Artificial Sequence
  Description of Artificial Sequence: Synthetic oligonucleotide
  Target: ATXN1; (-) strand; PAM type: YTN; PAM sequence: CTA
gcctgaagaatcttcctggt

SEQ ID NO: 160169 - DNA, 20 bp, Artificial Sequence
  Description of Artificial Sequence: Synthetic oligonucleotide
  Target: ATXN1; (-) strand; PAM type: YTN; PAM sequence: CTC
ccctagcctgaagaatcttc

SEQ ID NO: 160170 - DNA, 20 bp, Artificial Sequence
  Description of Artificial Sequence: Synthetic oligonucleotide
  Target: ATXN1; (-) strand; PAM type: YTN; PAM sequence: TTC
tcccctagcctgaagaatct

SEQ ID NO: 160171 - DNA, 20 bp, Artificial Sequence
  Description of Artificial Sequence: Synthetic oligonucleotide
  Target: ATXN1; (-) strand; PAM type: YTN; PAM sequence: TTT
ctcccctagcctgaagaatc

SEQ ID NO: 160172 - DNA, 20 bp, Artificial Sequence
  Description of Artificial Sequence: Synthetic oligonucleotide
  Target: ATXN1; (-) strand; PAM type: YTN; PAM sequence: TTT
tctcccctagcctgaagaat

SEQ ID NO: 160173 - DNA, 20 bp, Artificial Sequence
  Description of Artificial Sequence: Synthetic oligonucleotide
  Target: ATXN1; (-) strand; PAM type: YTN; PAM sequence: CTG
aggggttttctcccctagcc

SEQ ID NO: 160174 - DNA, 20 bp, Artificial Sequence
  Description of Artificial Sequence: Synthetic oligonucleotide
  Target: ATXN1; (-) strand; PAM type: YTN; PAM sequence: TTC
ctgaggggttttctccccta

SEQ ID NO: 160175 - DNA, 20 bp, Artificial Sequence
  Description of Artificial Sequence: Synthetic oligonucleotide
  Target: ATXN1; (-) strand; PAM type: YTN; PAM sequence: CTT
cctgaggggttttctcccct

SEQ ID NO: 160176 - DNA, 20 bp, Artificial Sequence
  Description of Artificial Sequence: Synthetic oligonucleotide
  Target: ATXN1; (-) strand; PAM type: YTN; PAM sequence: CTG
cagtgccttcctgaggggtt

SEQ ID NO: 160177 - DNA, 20 bp, Artificial Sequence
  Description of Artificial Sequence: Synthetic oligonucleotide
  Target: ATXN1; (-) strand; PAM type: YTN; PAM sequence: CTC
tgcagtgccttcctgagggg

SEQ ID NO: 160178 - DNA, 20 bp, Artificial Sequence
  Description of Artificial Sequence: Synthetic oligonucleotide
  Target: ATXN1; (-) strand; PAM type: YTN; PAM sequence: CTC
ccctctgcagtgccttcctg

SEQ ID NO: 160179 - DNA, 20 bp, Artificial Sequence
  Description of Artificial Sequence: Synthetic oligonucleotide
  Target: ATXN1; (-) strand; PAM type: YTN; PAM sequence: TTC
tcccctctgcagtgccttcc

SEQ ID NO: 160180 - DNA, 20 bp, Artificial Sequence
  Description of Artificial Sequence: Synthetic oligonucleotide
  Target: ATXN1; (-) strand; PAM type: YTN; PAM sequence: CTT
ctcccctctgcagtgccttc

SEQ ID NO: 160181 - DNA, 20 bp, Artificial Sequence
  Description of Artificial Sequence: Synthetic oligonucleotide
  Target: ATXN1; (-) strand; PAM type: YTN; PAM sequence: CTA
catccttctcccctctgcag

SEQ ID NO: 160182 - DNA, 20 bp, Artificial Sequence
  Description of Artificial Sequence: Synthetic oligonucleotide
  Target: ATXN1; (-) strand; PAM type: YTN; PAM sequence: TTC
caaaggctacatccttctcc

SEQ ID NO: 160183 - DNA, 20 bp, Artificial Sequence
  Description of Artificial Sequence: Synthetic oligonucleotide
  Target: ATXN1; (-) strand; PAM type: YTN; PAM sequence: TTG
aggttccaaaggctacatcc

SEQ ID NO: 160184 - DNA, 20 bp, Artificial Sequence
  Description of Artificial Sequence: Synthetic oligonucleotide
  Target: ATXN1; (-) strand; PAM type: YTN; PAM sequence: TTA
attgaggttccaaaggctac

SEQ ID NO: 160185 - DNA, 20 bp, Artificial Sequence
  Description of Artificial Sequence: Synthetic oligonucleotide
  Target: ATXN1; (-) strand; PAM type: YTN; PAM sequence: CTT
aattgaggttccaaaggcta

SEQ ID NO: 160186 - DNA, 20 bp, Artificial Sequence
  Description of Artificial Sequence: Synthetic oligonucleotide
  Target: ATXN1; (-) strand; PAM type: YTN; PAM sequence: CTG
gacttaattgaggttccaaa

SEQ ID NO: 160187 - DNA, 20 bp, Artificial Sequence
  Description of Artificial Sequence: Synthetic oligonucleotide
  Target: ATXN1; (-) strand; PAM type: YTN; PAM sequence: CTC
atatctggacttaattgagg

SEQ ID NO: 160188 - DNA, 20 bp, Artificial Sequence
  Description of Artificial Sequence: Synthetic oligonucleotide
  Target: ATXN1; (-) strand; PAM type: YTN; PAM sequence: CTC
agacagagagcatgagaggg

SEQ ID NO: 160189 - DNA, 20 bp, Artificial Sequence
  Description of Artificial Sequence: Synthetic oligonucleotide
  Target: ATXN1; (-) strand; PAM type: YTN; PAM sequence: TTC
agagtcagtggagactcaga

SEQ ID NO: 160190 - DNA, 20 bp, Artificial Sequence
  Description of Artificial Sequence: Synthetic oligonucleotide
  Target: ATXN1; (-) strand; PAM type: YTN; PAM sequence: TTG
ccacaagtgacaggttcaga

SEQ ID NO: 160191 - DNA, 20 bp, Artificial Sequence
  Description of Artificial Sequence: Synthetic oligonucleotide
  Target: ATXN1; (-) strand; PAM type: YTN; PAM sequence: TTT
gccacaagtgacaggttcag

SEQ ID NO: 160192 - DNA, 20 bp, Artificial Sequence
  Description of Artificial Sequence: Synthetic oligonucleotide
  Target: ATXN1; (-) strand; PAM type: YTN; PAM sequence: CTG
tgtttgccacaagtgacagg

SEQ ID NO: 160193 - DNA, 20 bp, Artificial Sequence
  Description of Artificial Sequence: Synthetic oligonucleotide
  Target: ATXN1; (-) strand; PAM type: YTN; PAM sequence: CTC
caccagctgtgtttgccaca

SEQ ID NO: 160194 - DNA, 20 bp, Artificial Sequence
  Description of Artificial Sequence: Synthetic oligonucleotide
  Target: ATXN1; (-) strand; PAM type: YTN; PAM sequence: CTA
aaatactccaccagctgtgt

SEQ ID NO: 160195 - DNA, 20 bp, Artificial Sequence
  Description of Artificial Sequence: Synthetic oligonucleotide
  Target: ATXN1; (-) strand; PAM type: YTN; PAM sequence: CTG
acatcatcacagctaaaata

SEQ ID NO: 160196 - DNA, 20 bp, Artificial Sequence
  Description of Artificial Sequence: Synthetic oligonucleotide
  Target: ATXN1; (-) strand; PAM type: YTN; PAM sequence: CTA
tcagaaatcggctgacatca

SEQ ID NO: 160197 - DNA, 20 bp, Artificial Sequence
  Description of Artificial Sequence: Synthetic oligonucleotide
  Target: ATXN1; (-) strand; PAM type: YTN; PAM sequence: TTA
ccgaggagcctatcagaaat

SEQ ID NO: 160198 - DNA, 20 bp, Artificial Sequence
  Description of Artificial Sequence: Synthetic oligonucleotide
  Target: ATXN1; (-) strand; PAM type: YTN; PAM sequence: TTT
accgaggagcctatcagaaa

SEQ ID NO: 160199 - DNA, 20 bp, Artificial Sequence
  Description of Artificial Sequence: Synthetic oligonucleotide
  Target: ATXN1; (-) strand; PAM type: YTN; PAM sequence: CTT
taccgaggagcctatcagaa

SEQ ID NO: 160200 - DNA, 20 bp, Artificial Sequence
  Description of Artificial Sequence: Synthetic oligonucleotide
  Target: ATXN1; (-) strand; PAM type: YTN; PAM sequence: TTG
tcactttaccgaggagccta

SEQ ID NO: 160201 - DNA, 20 bp, Artificial Sequence
  Description of Artificial Sequence: Synthetic oligonucleotide
  Target: ATXN1; (-) strand; PAM type: YTN; PAM sequence: TTT
gtcactttaccgaggagcct

SEQ ID NO: 160202 - DNA, 20 bp, Artificial Sequence
  Description of Artificial Sequence: Synthetic oligonucleotide
  Target: ATXN1; (-) strand; PAM type: YTN; PAM sequence: CTG
acgcaaccaatgatttgtca

SEQ ID NO: 160203 - DNA, 20 bp, Artificial Sequence
  Description of Artificial Sequence: Synthetic oligonucleotide
  Target: ATXN1; (-) strand; PAM type: YTN; PAM sequence: CTG
tagaaacaaaagtgcaaggc

SEQ ID NO: 160204 - DNA, 20 bp, Artificial Sequence
  Description of Artificial Sequence: Synthetic oligonucleotide
  Target: ATXN1; (-) strand; PAM type: YTN; PAM sequence: TTC
acgctgtagaaacaaaagtg

SEQ ID NO: 160205 - DNA, 20 bp, Artificial Sequence
  Description of Artificial Sequence: Synthetic oligonucleotide
  Target: ATXN1; (-) strand; PAM type: YTN; PAM sequence: CTT
cacgctgtagaaacaaaagt

SEQ ID NO: 160206 - DNA, 20 bp, Artificial Sequence
  Description of Artificial Sequence: Synthetic oligonucleotide
  Target: ATXN1; (-) strand; PAM type: YTN; PAM sequence: CTA
gggcttcacgctgtagaaac

SEQ ID NO: 160207 - DNA, 20 bp, Artificial Sequence
  Description of Artificial Sequence: Synthetic oligonucleotide
  Target: ATXN1; (-) strand; PAM type: YTN; PAM sequence: CTG
aaaaggcagctagggcttca

SEQ ID NO: 160208 - DNA, 20 bp, Artificial Sequence
  Description of Artificial Sequence: Synthetic oligonucleotide
  Target: ATXN1; (-) strand; PAM type: YTN; PAM sequence: CTG
ctgaaaaggcagctagggct

SEQ ID NO: 160209 - DNA, 20 bp, Artificial Sequence
  Description of Artificial Sequence: Synthetic oligonucleotide
  Target: ATXN1; (-) strand; PAM type: YTN; PAM sequence: CTG
agacctgctgaaaaggcagc

SEQ ID NO: 160210 - DNA, 20 bp, Artificial Sequence
  Description of Artificial Sequence: Synthetic oligonucleotide
  Target: ATXN1; (-) strand; PAM type: YTN; PAM sequence: CTC
aaagaaaggcaagtgtgctg

SEQ ID NO: 160211 - DNA, 20 bp, Artificial Sequence
  Description of Artificial Sequence: Synthetic oligonucleotide
  Target: ATXN1; (-) strand; PAM type: YTN; PAM sequence: TTC
ctcaaagaaaggcaagtgtg

SEQ ID NO: 160212 - DNA, 20 bp, Artificial Sequence
  Description of Artificial Sequence: Synthetic oligonucleotide
  Target: ATXN1; (-) strand; PAM type: YTN; PAM sequence: CTT
cctcaaagaaaggcaagtgt

SEQ ID NO: 160213 - DNA, 20 bp, Artificial Sequence
  Description of Artificial Sequence: Synthetic oligonucleotide
  Target: ATXN1; (-) strand; PAM type: YTN; PAM sequence: CTG
catgccgggaagggcttcct

SEQ ID NO: 160214 - DNA, 20 bp, Artificial Sequence
  Description of Artificial Sequence: Synthetic oligonucleotide
  Target: ATXN1; (-) strand; PAM type: YTN; PAM sequence: CTA
tgctgcatgccgggaagggc

SEQ ID NO: 160215 - DNA, 20 bp, Artificial Sequence
  Description of Artificial Sequence: Synthetic oligonucleotide
  Target: ATXN1; (-) strand; PAM type: YTN; PAM sequence: TTG
gcccccgcgtggctatgctg

SEQ ID NO: 160216 - DNA, 20 bp, Artificial Sequence
  Description of Artificial Sequence: Synthetic oligonucleotide
  Target: ATXN1; (-) strand; PAM type: YTN; PAM sequence: CTG
tgaggttggcccccgcgtgg

SEQ ID NO: 160217 - DNA, 20 bp, Artificial Sequence
  Description of Artificial Sequence: Synthetic oligonucleotide
  Target: ATXN1; (-) strand; PAM type: YTN; PAM sequence: TTG
gcaggtctgtgaggttggcc

SEQ ID NO: 160218 - DNA, 20 bp, Artificial Sequence
  Description of Artificial Sequence: Synthetic oligonucleotide
  Target: ATXN1; (-) strand; PAM type: YTN; PAM sequence: CTG
ttggcaggtctgtgaggttg

SEQ ID NO: 160219 - DNA, 20 bp, Artificial Sequence
  Description of Artificial Sequence: Synthetic oligonucleotide
  Target: ATXN1; (-) strand; PAM type: YTN; PAM sequence: TTG
tcagggcctgttggcaggtc

SEQ ID NO: 160220 - DNA, 20 bp, Artificial Sequence
  Description of Artificial Sequence: Synthetic oligonucleotide
  Target: ATXN1; (-) strand; PAM type: YTN; PAM sequence: CTG
acagccagggtgcagacgag

SEQ ID NO: 160221 - DNA, 20 bp, Artificial Sequence
  Description of Artificial Sequence: Synthetic oligonucleotide
  Target: ATXN1; (-) strand; PAM type: YTN; PAM sequence: CTA
ctgacagccagggtgcagac

SEQ ID NO: 160222 - DNA, 20 bp, Artificial Sequence
  Description of Artificial Sequence: Synthetic oligonucleotide
  Target: ATXN1; (-) strand; PAM type: YTN; PAM sequence: CTC
tactgacagccagggtgcag

SEQ ID NO: 160223 - DNA, 20 bp, Artificial Sequence
  Description of Artificial Sequence: Synthetic oligonucleotide
  Target: ATXN1; (-) strand; PAM type: YTN; PAM sequence: CTC
tctactgacagccagggtgc

SEQ ID NO: 160224 - DNA, 20 bp, Artificial Sequence
  Description of Artificial Sequence: Synthetic oligonucleotide
  Target: ATXN1; (-) strand; PAM type: YTN; PAM sequence: CTA
aatctctctactgacagcca

SEQ ID NO: 160225 - DNA, 20 bp, Artificial Sequence
  Description of Artificial Sequence: Synthetic oligonucleotide
  Target: ATXN1; (-) strand; PAM type: YTN; PAM sequence: TTC
ccatagtgagatcactaaat

SEQ ID NO: 160226 - DNA, 20 bp, Artificial Sequence
  Description of Artificial Sequence: Synthetic oligonucleotide
  Target: ATXN1; (-) strand; PAM type: YTN; PAM sequence: TTT
cccatagtgagatcactaaa

SEQ ID NO: 160227 - DNA, 20 bp, Artificial Sequence
  Description of Artificial Sequence: Synthetic oligonucleotide
  Target: ATXN1; (-) strand; PAM type: YTN; PAM sequence: TTT
tcccatagtgagatcactaa

SEQ ID NO: 160228 - DNA, 20 bp, Artificial Sequence
  Description of Artificial Sequence: Synthetic oligonucleotide
  Target: ATXN1; (-) strand; PAM type: YTN; PAM sequence: TTT
ttcccatagtgagatcacta

SEQ ID NO: 160229 - DNA, 20 bp, Artificial Sequence
  Description of Artificial Sequence: Synthetic oligonucleotide
  Target: ATXN1; (-) strand; PAM type: YTN; PAM sequence: TTT
tttcccatagtgagatcact

SEQ ID NO: 160230 - DNA, 20 bp, Artificial Sequence
  Description of Artificial Sequence: Synthetic oligonucleotide
  Target: ATXN1; (-) strand; PAM type: YTN; PAM sequence: CTC
atgttttttcccatagtgag

SEQ ID NO: 160231 - DNA, 20 bp, Artificial Sequence
  Description of Artificial Sequence: Synthetic oligonucleotide
  Target: ATXN1; (-) strand; PAM type: YTN; PAM sequence: TTC
tcatgttttttcccatagtg

SEQ ID NO: 160232 - DNA, 20 bp, Artificial Sequence
  Description of Artificial Sequence: Synthetic oligonucleotide
  Target: ATXN1; (-) strand; PAM type: YTN; PAM sequence: CTG
ttctcatgttttttcccata

SEQ ID NO: 160233 - DNA, 20 bp, Artificial Sequence
  Description of Artificial Sequence: Synthetic oligonucleotide
  Target: ATXN1; (-) strand; PAM type: YTN; PAM sequence: CTG
tgaagtcagagccctgttct

SEQ ID NO: 160234 - DNA, 20 bp, Artificial Sequence
  Description of Artificial Sequence: Synthetic oligonucleotide
  Target: ATXN1; (-) strand; PAM type: YTN; PAM sequence: TTC
cctgtgaagtcagagccctg

SEQ ID NO: 160235 - DNA, 20 bp, Artificial Sequence
  Description of Artificial Sequence: Synthetic oligonucleotide
  Target: ATXN1; (-) strand; PAM type: YTN; PAM sequence: CTT
ccctgtgaagtcagagccct

SEQ ID NO: 160236 - DNA, 20 bp, Artificial Sequence
  Description of Artificial Sequence: Synthetic oligonucleotide
  Target: ATXN1; (-) strand; PAM type: YTN; PAM sequence: TTG
gcttccctgtgaagtcagag

SEQ ID NO: 160237 - DNA, 20 bp, Artificial Sequence
  Description of Artificial Sequence: Synthetic oligonucleotide
  Target: ATXN1; (-) strand; PAM type: YTN; PAM sequence: TTA
aatgaaagagaaattggctt

SEQ ID NO: 160238 - DNA, 20 bp, Artificial Sequence
  Description of Artificial Sequence: Synthetic oligonucleotide
  Target: ATXN1; (-) strand; PAM type: YTN; PAM sequence: TTA
atgattaaatgaaagagaaa

SEQ ID NO: 160239 - DNA, 20 bp, Artificial Sequence
  Description of Artificial Sequence: Synthetic oligonucleotide
  Target: ATXN1; (-) strand; PAM type: YTN; PAM sequence: TTG
caaaattaatgattaaatga

SEQ ID NO: 160240 - DNA, 20 bp, Artificial Sequence
  Description of Artificial Sequence: Synthetic oligonucleotide
  Target: ATXN1; (-) strand; PAM type: YTN; PAM sequence: TTT
gcaaaattaatgattaaatg

SEQ ID NO: 160241 - DNA, 20 bp, Artificial Sequence
  Description of Artificial Sequence: Synthetic oligonucleotide
  Target: ATXN1; (-) strand; PAM type: YTN; PAM sequence: CTT
tgcaaaattaatgattaaat

SEQ ID NO: 160242 - DNA, 20 bp, Artificial Sequence
  Description of Artificial Sequence: Synthetic oligonucleotide
  Target: ATXN1; (-) strand; PAM type: YTN; PAM sequence: CTC
caaactttgcaaaattaatg

SEQ ID NO: 160243 - DNA, 20 bp, Artificial Sequence
  Description of Artificial Sequence: Synthetic oligonucleotide
  Target: ATXN1; (-) strand; PAM type: YTN; PAM sequence: CTA
ctccaaactttgcaaaatta

SEQ ID NO: 160244 - DNA, 20 bp, Artificial Sequence
  Description of Artificial Sequence: Synthetic oligonucleotide
  Target: ATXN1; (-) strand; PAM type: YTN; PAM sequence: TTC
cctactccaaactttgcaaa

SEQ ID NO: 160245 - DNA, 20 bp, Artificial Sequence
  Description of Artificial Sequence: Synthetic oligonucleotide
  Target: ATXN1; (-) strand; PAM type: YTN; PAM sequence: TTT
ccctactccaaactttgcaa

SEQ ID NO: 160246 - DNA, 20 bp, Artificial Sequence
  Description of Artificial Sequence: Synthetic oligonucleotide
  Target: ATXN1; (-) strand; PAM type: YTN; PAM sequence: TTT
tccctactccaaactttgca

SEQ ID NO: 160247 - DNA, 20 bp, Artificial Sequence
  Description of Artificial Sequence: Synthetic oligonucleotide
  Target: ATXN1; (-) strand; PAM type: YTN; PAM sequence: TTT
ttccctactccaaactttgc

SEQ ID NO: 160248 - DNA, 20 bp, Artificial Sequence
  Description of Artificial Sequence: Synthetic oligonucleotide
  Target: ATXN1; (-) strand; PAM type: YTN; PAM sequence: CTA
ggtgtgtttttccctactcc

SEQ ID NO: 160249 - DNA, 20 bp, Artificial Sequence
  Description of Artificial Sequence: Synthetic oligonucleotide
  Target: ATXN1; (-) strand; PAM type: YTN; PAM sequence: TTG
gggaggaagatctaggtgtg

SEQ ID NO: 160250 - DNA, 20 bp, Artificial Sequence
  Description of Artificial Sequence: Synthetic oligonucleotide
  Target: ATXN1; (-) strand; PAM type: YTN; PAM sequence: CTT
ggggaggaagatctaggtgt

SEQ ID NO: 160251 - DNA, 20 bp, Artificial Sequence
  Description of Artificial Sequence: Synthetic oligonucleotide
  Target: ATXN1; (-) strand; PAM type: YTN; PAM sequence: TTC
ttggggaggaagatctaggt

SEQ ID NO: 160252 - DNA, 20 bp, Artificial Sequence
  Description of Artificial Sequence: Synthetic oligonucleotide
  Target: ATXN1; (-) strand; PAM type: YTN; PAM sequence: CTG
ttcttggggaggaagatcta

SEQ ID NO: 160253 - DNA, 20 bp, Artificial Sequence
  Description of Artificial Sequence: Synthetic oligonucleotide
  Target: ATXN1; (-) strand; PAM type: YTN; PAM sequence: TTC
tgttcttggggaggaagatc

SEQ ID NO: 160254 - DNA, 20 bp, Artificial Sequence
  Description of Artificial Sequence: Synthetic oligonucleotide
  Target: ATXN1; (-) strand; PAM type: YTN; PAM sequence: CTT
ctgttcttggggaggaagat

SEQ ID NO: 160255 - DNA, 20 bp, Artificial Sequence
  Description of Artificial Sequence: Synthetic oligonucleotide
  Target: ATXN1; (-) strand; PAM type: YTN; PAM sequence: CTC
ttctgttcttggggaggaag

SEQ ID NO: 160256 - DNA, 20 bp, Artificial Sequence
  Description of Artificial Sequence: Synthetic oligonucleotide
  Target: ATXN1; (-) strand; PAM type: YTN; PAM sequence: TTA
cagccctcttctgttcttgg

SEQ ID NO: 160257 - DNA, 20 bp, Artificial Sequence
  Description of Artificial Sequence: Synthetic oligonucleotide
  Target: ATXN1; (-) strand; PAM type: YTN; PAM sequence: CTT
acagccctcttctgttcttg

SEQ ID NO: 160258 - DNA, 20 bp, Artificial Sequence
  Description of Artificial Sequence: Synthetic oligonucleotide
  Target: ATXN1; (-) strand; PAM type: YTN; PAM sequence: CTG
cgcccagccccttacagccc

SEQ ID NO: 160259 - DNA, 20 bp, Artificial Sequence
  Description of Artificial Sequence: Synthetic oligonucleotide
  Target: ATXN1; (-) strand; PAM type: YTN; PAM sequence: TTG
taggcgtgagccactgcgcc

SEQ ID NO: 160260 - DNA, 20 bp, Artificial Sequence
  Description of Artificial Sequence: Synthetic oligonucleotide
  Target: ATXN1; (-) strand; PAM type: YTN; PAM sequence: CTG
ggattgtaggcgtgagccac

SEQ ID NO: 160261 - DNA, 20 bp, Artificial Sequence
  Description of Artificial Sequence: Synthetic oligonucleotide
  Target: ATXN1; (-) strand; PAM type: YTN; PAM sequence: CTA
aagctgggattgtaggcgtg

SEQ ID NO: 160262 - DNA, 20 bp, Artificial Sequence
  Description of Artificial Sequence: Synthetic oligonucleotide
  Target: ATXN1; (-) strand; PAM type: YTN; PAM sequence: CTC
ctaaagctgggattgtaggc

SEQ ID NO: 160263 - DNA, 20 bp, Artificial Sequence
  Description of Artificial Sequence: Synthetic oligonucleotide
  Target: ATXN1; (-) strand; PAM type: YTN; PAM sequence: CTC
agcctcctaaagctgggatt

SEQ ID NO: 160264 - DNA, 20 bp, Artificial Sequence
  Description of Artificial Sequence: Synthetic oligonucleotide
  Target: ATXN1; (-) strand; PAM type: YTN; PAM sequence: TTC
acccgcctcagcctcctaaa

SEQ ID NO: 160265 - DNA, 20 bp, Artificial Sequence
  Description of Artificial Sequence: Synthetic oligonucleotide
  Target: ATXN1; (-) strand; PAM type: YTN; PAM sequence: CTC
aggtgattcacccgcctcag

SEQ ID NO: 160266 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgattcacccgc

SEQ ID NO: 160267 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgattcacc

SEQ ID NO: 160268 - DNA, 20 bp, Artificial Sequence
  Description of Artificial Sequence: Synthetic oligonucleotide
  Target: ATXN1; (-) strand; PAM type: YTN; PAM sequence: CTC
gaactcctgacctcaggtga

SEQ ID NO: 160269 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctgacctca

SEQ ID NO: 160270 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtctcgaactc

SEQ ID NO: 160271 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggctggt

SEQ ID NO: 160272 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggctgg

SEQ ID NO: 160273 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcacca

SEQ ID NO: 160274 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcacc

SEQ ID NO: 160275 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagggtttcac

SEQ ID NO: 160276 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagggtttca

SEQ ID NO: 160277 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacaggg

SEQ ID NO: 160278 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacagg

SEQ ID NO: 160279 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacag

SEQ ID NO: 160280 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagaca

SEQ ID NO: 160281 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 160282 - DNA, 20 bp, Artificial Sequence
  Description of Artificial Sequence: Synthetic oligonucleotide
  Target: ATXN1; (-) strand; PAM type: YTN; PAM sequence: CTG
ctaatttttgtatttttagt

SEQ ID NO: 160283 - DNA, 20 bp, Artificial Sequence
  Description of Artificial Sequence: Synthetic oligonucleotide
  Target: ATXN1; (-) strand; PAM type: YTN; PAM sequence: CTA
caggcacacgccatcacccc

SEQ ID NO: 160284 - DNA, 20 bp, Artificial Sequence
  Description of Artificial Sequence: Synthetic oligonucleotide
  Target: ATXN1; (-) strand; PAM type: YTN; PAM sequence: CTC
ccaagtagccgagactacag

SEQ ID NO: 160285 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagccgaga

SEQ ID NO: 160286 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagcc

SEQ ID NO: 160287 - DNA, 20 bp, Artificial Sequence
  Description of Artificial Sequence: Synthetic oligonucleotide
  Target: ATXN1; (-) strand; PAM type: YTN; PAM sequence: TTC
tgcctcagcctcccaagtag

SEQ ID NO: 160288 - DNA, 20 bp, Artificial Sequence
  Description of Artificial Sequence: Synthetic oligonucleotide
  Target: ATXN1; (-) strand; PAM type: YTN; PAM sequence: CTT
ctgcctcagcctcccaagta

SEQ ID NO: 160289 - DNA, 20 bp, Artificial Sequence
  Description of Artificial Sequence: Synthetic oligonucleotide
  Target: ATXN1; (-) strand; PAM type: YTN; PAM sequence: TTC
ttctgcctcagcctcccaag

SEQ ID NO: 160290 - DNA, 20 bp, Artificial Sequence
  Description of Artificial Sequence: Synthetic oligonucleotide
  Target: ATXN1; (-) strand; PAM type: YTN; PAM sequence: TTC
aagtgattcttctgcctcag

SEQ ID NO: 160291 - DNA, 20 bp, Artificial Sequence
  Description of Artificial Sequence: Synthetic oligonucleotide
  Target: ATXN1; (-) strand; PAM type: YTN; PAM sequence: TTG
gttcaagtgattcttctgcc

SEQ ID NO: 160292 - DNA, 20 bp, Artificial Sequence
  Description of Artificial Sequence: Synthetic oligonucleotide
  Target: ATXN1; (-) strand; PAM type: YTN; PAM sequence: CTT
ggttcaagtgattcttctgc

SEQ ID NO: 160293 - DNA, 20 bp, Artificial Sequence
  Description of Artificial Sequence: Synthetic oligonucleotide
  Target: ATXN1; (-) strand; PAM type: YTN; PAM sequence: CTC
ttggttcaagtgattcttct

SEQ ID NO: 160294 - DNA, 20 bp, Artificial Sequence
  Description of Artificial Sequence: Synthetic oligonucleotide
  Target: ATXN1; (-) strand; PAM type: YTN; PAM sequence: CTG
cctcttggttcaagtgattc

SEQ ID NO: 160295 - DNA, 20 bp, Artificial Sequence
  Description of Artificial Sequence: Synthetic oligonucleotide
  Target: ATXN1; (-) strand; PAM type: YTN; PAM sequence: CTG
caacatctgcctcttggttc

SEQ ID NO: 160296 - DNA, 20 bp, Artificial Sequence
  Description of Artificial Sequence: Synthetic oligonucleotide
  Target: ATXN1; (-) strand; PAM type: YTN; PAM sequence: CTC
actgcaacatctgcctcttg

SEQ ID NO: 160297 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacatctgcct

SEQ ID NO: 160298 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaacatctgcc

SEQ ID NO: 160299 - DNA, 20 bp, Artificial Sequence
  Description of Artificial Sequence: Synthetic oligonucleotide
  Target: ATXN1; (-) strand; PAM type: YTN; PAM sequence: CTG
gagtgcagagtgcagtgggg

SEQ ID NO: 160300 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggagtgcag

SEQ ID NO: 160301 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctggagtgc

SEQ ID NO: 160302 - DNA, 20 bp, Artificial Sequence
  Description of Artificial Sequence: Synthetic oligonucleotide
  Target: ATXN1; (-) strand; PAM type: YTN; PAM sequence: TTG
ctctgtcacccaggctggag

SEQ ID NO: 160303 - DNA, 20 bp, Artificial Sequence
  Description of Artificial Sequence: Synthetic oligonucleotide
  Target: ATXN1; (-) strand; PAM type: YTN; PAM sequence: CTT
gctctgtcacccaggctgga

SEQ ID NO: 160304 - DNA, 20 bp, Artificial Sequence
  Description of Artificial Sequence: Synthetic oligonucleotide
  Target: ATXN1; (-) strand; PAM type: YTN; PAM sequence: TTG
gagacagagtcttgctctgt

SEQ ID NO: 160305 - DNA, 20 bp, Artificial Sequence
  Description of Artificial Sequence: Synthetic oligonucleotide
  Target: ATXN1; (-) strand; PAM type: YTN; PAM sequence: TTT
ggagacagagtcttgctctg

SEQ ID NO: 160306 - DNA, 20 bp, Artificial Sequence
  Description of Artificial Sequence: Synthetic oligonucleotide
  Target: ATXN1; (-) strand; PAM type: YTN; PAM sequence: TTT
tggagacagagtcttgctct

SEQ ID NO: 160307 - DNA, 20 bp, Artificial Sequence
  Description of Artificial Sequence: Synthetic oligonucleotide
  Target: ATXN1; (-) strand; PAM type: YTN; PAM sequence: TTT
ttggagacagagtcttgctc

SEQ ID NO: 160308 - DNA, 20 bp, Artificial Sequence
  Description of Artificial Sequence: Synthetic oligonucleotide
  Target: ATXN1; (-) strand; PAM type: YTN; PAM sequence: TTT
tttggagacagagtcttgct

SEQ ID NO: 160309 - DNA, 20 bp, Artificial Sequence
  Description of Artificial Sequence: Synthetic oligonucleotide
  Target: ATXN1; (-) strand; PAM type: YTN; PAM sequence: TTT
ttttggagacagagtcttgc

SEQ ID NO: 160310 - DNA, 20 bp, Artificial Sequence
  Description of Artificial Sequence: Synthetic oligonucleotide
  Target: ATXN1; (-) strand; PAM type: YTN; PAM sequence: TTT
tttttggagacagagtcttg

SEQ ID NO: 160311 - DNA, 20 bp, Artificial Sequence
  Description of Artificial Sequence: Synthetic oligonucleotide
  Target: ATXN1; (-) strand; PAM type: YTN; PAM sequence: TTT
ttttttggagacagagtctt

SEQ ID NO: 160312 - DNA, 20 bp, Artificial Sequence
  Description of Artificial Sequence: Synthetic oligonucleotide
  Target: ATXN1; (-) strand; PAM type: YTN; PAM sequence: TTT
tttttttggagacagagtct

SEQ ID NO: 160313 - DNA, 20 bp, Artificial Sequence
  Description of Artificial Sequence: Synthetic oligonucleotide
  Target: ATXN1; (-) strand; PAM type: YTN; PAM sequence: TTT
ttttttttggagacagagtc

SEQ ID NO: 160314 - DNA, 20 bp, Artificial Sequence
  Description of Artificial Sequence: Synthetic oligonucleotide
  Target: ATXN1; (-) strand; PAM type: YTN; PAM sequence: TTT
tttttttttggagacagagt

SEQ ID NO: 160315 - DNA, 20 bp, Artificial Sequence
  Description of Artificial Sequence: Synthetic oligonucleotide
  Target: ATXN1; (-) strand; PAM type: YTN; PAM sequence: TTT
ttttttttttggagacagag

SEQ ID NO: 160316 - DNA, 20 bp, Artificial Sequence
  Description of Artificial Sequence: Synthetic oligonucleotide
  Target: ATXN1; (-) strand; PAM type: YTN; PAM sequence: TTT
tttttttttttggagacaga

SEQ ID NO: 160317 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttggagacag

SEQ ID NO: 160318 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttggagaca

SEQ ID NO: 160319 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttggagac

SEQ ID NO: 160320 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttggaga

SEQ ID NO: 160321 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttggag

SEQ ID NO: 160322 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgga

SEQ ID NO: 160323 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttgg

SEQ ID NO: 160324 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttg

SEQ ID NO: 160325 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 160326 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 160327 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 160328 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 160329 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 160330 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 160331 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 160332 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 160333 - DNA, 20 bp, Artificial Sequence
  Description of Artificial Sequence: Synthetic oligonucleotide
  Target: ATXN1; (-) strand; PAM type: YTN; PAM sequence: CTA
tttttttttttttttttttt

SEQ ID NO: 160334 - DNA, 20 bp, Artificial Sequence
  Description of Artificial Sequence: Synthetic oligonucleotide
  Target: ATXN1; (-) strand; PAM type: YTN; PAM sequence: TTC
tatttttttttttttttttt

SEQ ID NO: 160335 - DNA, 20 bp, Artificial Sequence
  Description of Artificial Sequence: Synthetic oligonucleotide
  Target: ATXN1; (-) strand; PAM type: YTN; PAM sequence: CTT
ctattttttttttttttttt

SEQ ID NO: 160336 - DNA, 20 bp, Artificial Sequence
  Description of Artificial Sequence: Synthetic oligonucleotide
  Target: ATXN1; (-) strand; PAM type: YTN; PAM sequence: CTC
ttctattttttttttttttt

SEQ ID NO: 160337 - DNA, 20 bp, Artificial Sequence
  Description of Artificial Sequence: Synthetic oligonucleotide
  Target: ATXN1; (-) strand; PAM type: YTN; PAM sequence: CTG
cagaaaccagactcttctat

SEQ ID NO: 160338 - DNA, 20 bp, Artificial Sequence
  Description of Artificial Sequence: Synthetic oligonucleotide
  Target: ATXN1; (-) strand; PAM type: YTN; PAM sequence: CTC
tgcagaaaccagactcttct

SEQ ID NO: 160339 - DNA, 20 bp, Artificial Sequence
  Description of Artificial Sequence: Synthetic oligonucleotide
  Target: ATXN1; (-) strand; PAM type: YTN; PAM sequence: CTG
gcagcctctgcagaaaccag

SEQ ID NO: 160340 - DNA, 20 bp, Artificial Sequence
  Description of Artificial Sequence: Synthetic oligonucleotide
  Target: ATXN1; (-) strand; PAM type: YTN; PAM sequence: TTC
ccaggcctggcagcctctgc

SEQ ID NO: 160341 - DNA, 20 bp, Artificial Sequence
  Description of Artificial Sequence: Synthetic oligonucleotide
  Target: ATXN1; (-) strand; PAM type: YTN; PAM sequence: CTT
cccaggcctggcagcctctg

SEQ ID NO: 160342 - DNA, 20 bp, Artificial Sequence
  Description of Artificial Sequence: Synthetic oligonucleotide
  Target: ATXN1; (-) strand; PAM type: YTN; PAM sequence: CTG
tgggccacacttcccaggcc

SEQ ID NO: 160343 - DNA, 20 bp, Artificial Sequence
  Description of Artificial Sequence: Synthetic oligonucleotide
  Target: ATXN1; (-) strand; PAM type: YTN; PAM sequence: TTC
agctgtgggccacacttccc

SEQ ID NO: 160344 - DNA, 20 bp, Artificial Sequence
  Description of Artificial Sequence: Synthetic oligonucleotide
  Target: ATXN1; (-) strand; PAM type: YTN; PAM sequence: CTT
cagctgtgggccacacttcc

SEQ ID NO: 160345 - DNA, 20 bp, Artificial Sequence
  Description of Artificial Sequence: Synthetic oligonucleotide
  Target: ATXN1; (-) strand; PAM type: YTN; PAM sequence: TTG
agaatgaaggcagccacttc

SEQ ID NO: 160346 - DNA, 20 bp, Artificial Sequence
  Description of Artificial Sequence: Synthetic oligonucleotide
  Target: ATXN1; (-) strand; PAM type: YTN; PAM sequence: CTT
gagaatgaaggcagccactt

SEQ ID NO: 160347 - DNA, 20 bp, Artificial Sequence
  Description of Artificial Sequence: Synthetic oligonucleotide
  Target: ATXN1; (-) strand; PAM type: YTN; PAM sequence: TTC
agcttgagaatgaaggcagc

SEQ ID NO: 160348 - DNA, 20 bp, Artificial Sequence
  Description of Artificial Sequence: Synthetic oligonucleotide
  Target: ATXN1; (-) strand; PAM type: YTN; PAM sequence: CTT
cagcttgagaatgaaggcag

SEQ ID NO: 160349 - DNA, 20 bp, Artificial Sequence
  Description of Artificial Sequence: Synthetic oligonucleotide
  Target: ATXN1; (-) strand; PAM type: YTN; PAM sequence: TTG
ccggccagcatcaacttcag

SEQ ID NO: 160350 - DNA, 20 bp, Artificial Sequence
  Description of Artificial Sequence: Synthetic oligonucleotide
  Target: ATXN1; (-) strand; PAM type: YTN; PAM sequence: CTT
gccggccagcatcaacttca

SEQ ID NO: 160351 - DNA, 20 bp, Artificial Sequence
  Description of Artificial Sequence: Synthetic oligonucleotide
  Target: ATXN1; (-) strand; PAM type: YTN; PAM sequence: TTC
cttgccggccagcatcaact

SEQ ID NO: 160352 - DNA, 20 bp, Artificial Sequence
  Description of Artificial Sequence: Synthetic oligonucleotide
  Target: ATXN1; (-) strand; PAM type: YTN; PAM sequence: CTG
gttccttgccggccagcatc

SEQ ID NO: 160353 - DNA, 20 bp, Artificial Sequence
  Description of Artificial Sequence: Synthetic oligonucleotide
  Target: ATXN1; (-) strand; PAM type: YTN; PAM sequence: TTA
gaaatgcgactggttccttg

SEQ ID NO: 160354 - DNA, 20 bp, Artificial Sequence
  Description of Artificial Sequence: Synthetic oligonucleotide
  Target: ATXN1; (-) strand; PAM type: YTN; PAM sequence: TTT
agaaatgcgactggttcctt

SEQ ID NO: 160355 - DNA, 20 bp, Artificial Sequence
  Description of Artificial Sequence: Synthetic oligonucleotide
  Target: ATXN1; (-) strand; PAM type: YTN; PAM sequence: TTG
tttagaaatgcgactggttc

SEQ ID NO: 160356 - DNA, 20 bp, Artificial Sequence
  Description of Artificial Sequence: Synthetic oligonucleotide
  Target: ATXN1; (-) strand; PAM type: YTN; PAM sequence: TTT
gtttagaaatgcgactggtt

SEQ ID NO: 160357 - DNA, 20 bp, Artificial Sequence
  Description of Artificial Sequence: Synthetic oligonucleotide
  Target: ATXN1; (-) strand; PAM type: YTN; PAM sequence: TTT
tgtttagaaatgcgactggt

SEQ ID NO: 160358 - DNA, 20 bp, Artificial Sequence
  Description of Artificial Sequence: Synthetic oligonucleotide
  Target: ATXN1; (-) strand; PAM type: YTN; PAM sequence: TTG
tgaacagaggcaggtgtgaa

SEQ ID NO: 160359 - DNA, 20 bp, Artificial Sequence
  Description of Artificial Sequence: Synthetic oligonucleotide
  Target: ATXN1; (-) strand; PAM type: YTN; PAM sequence: TTT
gtgaacagaggcaggtgtga

SEQ ID NO: 160360 - DNA, 20 bp, Artificial Sequence
  Description of Artificial Sequence: Synthetic oligonucleotide
  Target: ATXN1; (-) strand; PAM type: YTN; PAM sequence: TTT
tgtgaacagaggcaggtgtg

SEQ ID NO: 160361 - DNA, 20 bp, Artificial Sequence
  Description of Artificial Sequence: Synthetic oligonucleotide
  Target: ATXN1; (-) strand; PAM type: YTN; PAM sequence: TTT
ttgtgaacagaggcaggtgt

SEQ ID NO: 160362 - DNA, 20 bp, Artificial Sequence
  Description of Artificial Sequence: Synthetic oligonucleotide
  Target: ATXN1; (-) strand; PAM type: YTN; PAM sequence: TTA
acacatttttgtgaacagag

SEQ ID NO: 160363 - DNA, 20 bp, Artificial Sequence
  Description of Artificial Sequence: Synthetic oligonucleotide
  Target: ATXN1; (-) strand; PAM type: YTN; PAM sequence: CTT
aacacatttttgtgaacaga

SEQ ID NO: 160364 - DNA, 20 bp, Artificial Sequence
  Description of Artificial Sequence: Synthetic oligonucleotide
  Target: ATXN1; (-) strand; PAM type: YTN; PAM sequence: TTA
gaatccttaacacatttttg

SEQ ID NO: 160365 - DNA, 20 bp, Artificial Sequence
  Description of Artificial Sequence: Synthetic oligonucleotide
  Target: ATXN1; (-) strand; PAM type: YTN; PAM sequence: CTT
agaatccttaacacattttt

SEQ ID NO: 160366 - DNA, 20 bp, Artificial Sequence
  Description of Artificial Sequence: Synthetic oligonucleotide
  Target: ATXN1; (-) strand; PAM type: YTN; PAM sequence: TTC
atggtacttagaatccttaa

SEQ ID NO: 160367 - DNA, 20 bp, Artificial Sequence
  Description of Artificial Sequence: Synthetic oligonucleotide
  Target: ATXN1; (-) strand; PAM type: YTN; PAM sequence: TTT
catggtacttagaatcctta

SEQ ID NO: 160368 - DNA, 20 bp, Artificial Sequence
  Description of Artificial Sequence: Synthetic oligonucleotide
  Target: ATXN1; (-) strand; PAM type: YTN; PAM sequence: TTT
tcatggtacttagaatcctt

SEQ ID NO: 160369 - DNA, 20 bp, Artificial Sequence
  Description of Artificial Sequence: Synthetic oligonucleotide
  Target: ATXN1; (-) strand; PAM type: YTN; PAM sequence: CTT
ttcatggtacttagaatcct

SEQ ID NO: 160370 - DNA, 20 bp, Artificial Sequence
  Description of Artificial Sequence: Synthetic oligonucleotide
  Target: ATXN1; (-) strand; PAM type: YTN; PAM sequence: TTG
cttttcatggtacttagaat

SEQ ID NO: 160371 - DNA, 20 bp, Artificial Sequence
  Description of Artificial Sequence: Synthetic oligonucleotide
  Target: ATXN1; (-) strand; PAM type: YTN; PAM sequence: TTC
acagaccccaggtgacacat

SEQ ID NO: 160372 - DNA, 20 bp, Artificial Sequence
  Description of Artificial Sequence: Synthetic oligonucleotide
  Target: ATXN1; (-) strand; PAM type: YTN; PAM sequence: CTT
cacagaccccaggtgacaca

SEQ ID NO: 160373 - DNA, 20 bp, Artificial Sequence
  Description of Artificial Sequence: Synthetic oligonucleotide
  Target: ATXN1; (-) strand; PAM type: YTN; PAM sequence: CTC
ttcacagaccccaggtgaca

SEQ ID NO: 160374 - DNA, 20 bp, Artificial Sequence
  Description of Artificial Sequence: Synthetic oligonucleotide
  Target: ATXN1; (-) strand; PAM type: YTN; PAM sequence: TTG
actcttcacagaccccaggt

SEQ ID NO: 160375 - DNA, 20 bp, Artificial Sequence
  Description of Artificial Sequence: Synthetic oligonucleotide
  Target: ATXN1; (-) strand; PAM type: YTN; PAM sequence: TTG
agcaaagttgactcttcaca

SEQ ID NO: 160376 - DNA, 20 bp, Artificial Sequence
  Description of Artificial Sequence: Synthetic oligonucleotide
  Target: ATXN1; (-) strand; PAM type: YTN; PAM sequence: CTT
gagcaaagttgactcttcac

SEQ ID NO: 160377 - DNA, 20 bp, Artificial Sequence
  Description of Artificial Sequence: Synthetic oligonucleotide
  Target: ATXN1; (-) strand; PAM type: YTN; PAM sequence: CTA
ccttgagcaaagttgactct

SEQ ID NO: 160378 - DNA, 20 bp, Artificial Sequence
  Description of Artificial Sequence: Synthetic oligonucleotide
  Target: ATXN1; (-) strand; PAM type: YTN; PAM sequence: CTA
ggagaaagaaaatgaactac

SEQ ID NO: 160379 - DNA, 20 bp, Artificial Sequence
  Description of Artificial Sequence: Synthetic oligonucleotide
  Target: ATXN1; (-) strand; PAM type: YTN; PAM sequence: TTA
ggggtgggtactaggagaaa

SEQ ID NO: 160380 - DNA, 20 bp, Artificial Sequence
  Description of Artificial Sequence: Synthetic oligonucleotide
  Target: ATXN1; (-) strand; PAM type: YTN; PAM sequence: CTG
catgaattaggggtgggtac

SEQ ID NO: 160381 - DNA, 20 bp, Artificial Sequence
  Description of Artificial Sequence: Synthetic oligonucleotide
  Target: ATXN1; (-) strand; PAM type: YTN; PAM sequence: TTC
ctgcatgaattaggggtggg

SEQ ID NO: 160382 - DNA, 20 bp, Artificial Sequence
  Description of Artificial Sequence: Synthetic oligonucleotide
  Target: ATXN1; (-) strand; PAM type: YTN; PAM sequence: CTT
cctgcatgaattaggggtgg

SEQ ID NO: 160383 - DNA, 20 bp, Artificial Sequence
  Description of Artificial Sequence: Synthetic oligonucleotide
  Target: ATXN1; (-) strand; PAM type: YTN; PAM sequence: TTC
acttcctgcatgaattaggg

SEQ ID NO: 160384 - DNA, 20 bp, Artificial Sequence
  Description of Artificial Sequence: Synthetic oligonucleotide
  Target: ATXN1; (-) strand; PAM type: YTN; PAM sequence: CTG
ttcacttcctgcatgaatta

SEQ ID NO: 160385 - DNA, 20 bp, Artificial Sequence
  Description of Artificial Sequence: Synthetic oligonucleotide
  Target: ATXN1; (-) strand; PAM type: YTN; PAM sequence: CTG
tagtggctgttcacttcctg

SEQ ID NO: 160386 - DNA, 20 bp, Artificial Sequence
  Description of Artificial Sequence: Synthetic oligonucleotide
  Target: ATXN1; (-) strand; PAM type: YTN; PAM sequence: CTC
tgtagtggctgttcacttcc

SEQ ID NO: 160387 - DNA, 20 bp, Artificial Sequence
  Description of Artificial Sequence: Synthetic oligonucleotide
  Target: ATXN1; (-) strand; PAM type: YTN; PAM sequence: CTA
cccctctgtagtggctgttc

SEQ ID NO: 160388 - DNA, 20 bp, Artificial Sequence
  Description of Artificial Sequence: Synthetic oligonucleotide
  Target: ATXN1; (-) strand; PAM type: YTN; PAM sequence: CTC
actacccctctgtagtggct

SEQ ID NO: 160389 - DNA, 20 bp, Artificial Sequence
  Description of Artificial Sequence: Synthetic oligonucleotide
  Target: ATXN1; (-) strand; PAM type: YTN; PAM sequence: TTA
aaataaatggcataataata

SEQ ID NO: 160390 - DNA, 20 bp, Artificial Sequence
  Description of Artificial Sequence: Synthetic oligonucleotide
  Target: ATXN1; (-) strand; PAM type: YTN; PAM sequence: TTT
aaaataaatggcataataat

SEQ ID NO: 160391 - DNA, 20 bp, Artificial Sequence
  Description of Artificial Sequence: Synthetic oligonucleotide
  Target: ATXN1; (-) strand; PAM type: YTN; PAM sequence: TTT
taaaataaatggcataataa

SEQ ID NO: 160392 - DNA, 20 bp, Artificial Sequence
  Description of Artificial Sequence: Synthetic oligonucleotide
  Target: ATXN1; (-) strand; PAM type: YTN; PAM sequence: TTT
ttaaaataaatggcataata

SEQ ID NO: 160393 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaagaaaatcagga

SEQ ID NO: 160394 - DNA, 20 bp, Artificial Sequence
  Description of Artificial Sequence: Synthetic oligonucleotide
  Target: ATXN1; (-) strand; PAM type: YTN; PAM sequence: TTT
aaaaaaaaaagaaaatcagg

SEQ ID NO: 160395 - DNA, 20 bp, Artificial Sequence
  Description of Artificial Sequence: Synthetic oligonucleotide
  Target: ATXN1; (-) strand; PAM type: YTN; PAM sequence: TTA
tttaaaaaaaaaagaaaatc

SEQ ID NO: 160396 - DNA, 20 bp, Artificial Sequence
  Description of Artificial Sequence: Synthetic oligonucleotide
  Target: ATXN1; (-) strand; PAM type: YTN; PAM sequence: CTT
atttaaaaaaaaaagaaaat

SEQ ID NO: 160397 - DNA, 20 bp, Artificial Sequence
  Description of Artificial Sequence: Synthetic oligonucleotide
  Target: ATXN1; (-) strand; PAM type: YTN; PAM sequence: TTC
cccaaagatcttatttaaaa

SEQ ID NO: 160398 - DNA, 20 bp, Artificial Sequence
  Description of Artificial Sequence: Synthetic oligonucleotide
  Target: ATXN1; (-) strand; PAM type: YTN; PAM sequence: TTT
ccccaaagatcttatttaaa

SEQ ID NO: 160399 - DNA, 20 bp, Artificial Sequence
  Description of Artificial Sequence: Synthetic oligonucleotide
  Target: ATXN1; (-) strand; PAM type: YTN; PAM sequence: TTG
gaagggcccaagaaagattt

SEQ ID NO: 160400 - DNA, 20 bp, Artificial Sequence
  Description of Artificial Sequence: Synthetic oligonucleotide
  Target: ATXN1; (-) strand; PAM type: YTN; PAM sequence: TTT
ggaagggcccaagaaagatt

SEQ ID NO: 160401 - DNA, 20 bp, Artificial Sequence
  Description of Artificial Sequence: Synthetic oligonucleotide
  Target: ATXN1; (-) strand; PAM type: YTN; PAM sequence: CTT
tggaagggcccaagaaagat

SEQ ID NO: 160402 - DNA, 20 bp, Artificial Sequence
  Description of Artificial Sequence: Synthetic oligonucleotide
  Target: ATXN1; (-) strand; PAM type: YTN; PAM sequence: TTA
cagtctttggaagggcccaa

SEQ ID NO: 160403 - DNA, 20 bp, Artificial Sequence
  Description of Artificial Sequence: Synthetic oligonucleotide
  Target: ATXN1; (-) strand; PAM type: YTN; PAM sequence: TTT
acagtctttggaagggccca

SEQ ID NO: 160404 - DNA, 20 bp, Artificial Sequence
  Description of Artificial Sequence: Synthetic oligonucleotide
  Target: ATXN1; (-) strand; PAM type: YTN; PAM sequence: CTG
taggtttacagtctttggaa

SEQ ID NO: 160405 - DNA, 20 bp, Artificial Sequence
  Description of Artificial Sequence: Synthetic oligonucleotide
  Target: ATXN1; (-) strand; PAM type: YTN; PAM sequence: TTA
tgagatgtcactgtaggttt

SEQ ID NO: 160406 - DNA, 20 bp, Artificial Sequence
  Description of Artificial Sequence: Synthetic oligonucleotide
  Target: ATXN1; (-) strand; PAM type: YTN; PAM sequence: TTG
tattatgagatgtcactgta

SEQ ID NO: 160407 - DNA, 20 bp, Artificial Sequence
  Description of Artificial Sequence: Synthetic oligonucleotide
  Target: ATXN1; (-) strand; PAM type: YTN; PAM sequence: TTT
gtattatgagatgtcactgt

SEQ ID NO: 160408 - DNA, 20 bp, Artificial Sequence
  Description of Artificial Sequence: Synthetic oligonucleotide
  Target: ATXN1; (-) strand; PAM type: YTN; PAM sequence: CTT
tgtattatgagatgtcactg

SEQ ID NO: 160409 - DNA, 20 bp, Artificial Sequence
  Description of Artificial Sequence: Synthetic oligonucleotide
  Target: ATXN1; (-) strand; PAM type: YTN; PAM sequence: TTC
tttgtattatgagatgtcac

SEQ ID NO: 160410 - DNA, 20 bp, Artificial Sequence
  Description of Artificial Sequence: Synthetic oligonucleotide
  Target: ATXN1; (-) strand; PAM type: YTN; PAM sequence: TTT
ctttgtattatgagatgtca

SEQ ID NO: 160411 - DNA, 20 bp, Artificial Sequence
  Description of Artificial Sequence: Synthetic oligonucleotide
  Target: ATXN1; (-) strand; PAM type: YTN; PAM sequence: TTT
tctttgtattatgagatgtc

SEQ ID NO: 160412 - DNA, 20 bp, Artificial Sequence
  Description of Artificial Sequence: Synthetic oligonucleotide
  Target: ATXN1; (-) strand; PAM type: YTN; PAM sequence: CTT
ttctttgtattatgagatgt

SEQ ID NO: 160413 - DNA, 20 bp, Artificial Sequence
  Description of Artificial Sequence: Synthetic oligonucleotide
  Target: ATXN1; (-) strand; PAM type: YTN; PAM sequence: CTG
aatacttttctttgtattat

SEQ ID NO: 160414 - DNA, 20 bp, Artificial Sequence
  Description of Artificial Sequence: Synthetic oligonucleotide
  Target: ATXN1; (-) strand; PAM type: YTN; PAM sequence: TTA
gccctgaatacttttctttg

SEQ ID NO: 160415 - DNA, 20 bp, Artificial Sequence
  Description of Artificial Sequence: Synthetic oligonucleotide
  Target: ATXN1; (-) strand; PAM type: YTN; PAM sequence: TTT
agccctgaatacttttcttt

SEQ ID NO: 160416 - DNA, 20 bp, Artificial Sequence
  Description of Artificial Sequence: Synthetic oligonucleotide
  Target: ATXN1; (-) strand; PAM type: YTN; PAM sequence: TTT
tagccctgaatacttttctt

SEQ ID NO: 160417 - DNA, 20 bp, Artificial Sequence
  Description of Artificial Sequence: Synthetic oligonucleotide
  Target: ATXN1; (-) strand; PAM type: YTN; PAM sequence: CTT
ttagccctgaatacttttct

SEQ ID NO: 160418 - DNA, 20 bp, Artificial Sequence
  Description of Artificial Sequence: Synthetic oligonucleotide
  Target: ATXN1; (-) strand; PAM type: YTN; PAM sequence: TTG
ccgagagcttttagccctga

SEQ ID NO: 160419 - DNA, 20 bp, Artificial Sequence
  Description of Artificial Sequence: Synthetic oligonucleotide
  Target: ATXN1; (-) strand; PAM type: YTN; PAM sequence: CTG
cattgccgagagcttttagc

SEQ ID NO: 160420 - DNA, 20 bp, Artificial Sequence
  Description of Artificial Sequence: Synthetic oligonucleotide
  Target: ATXN1; (-) strand; PAM type: YTN; PAM sequence: TTG
cacaaagccggggccctgca

SEQ ID NO: 160421 - DNA, 20 bp, Artificial Sequence
  Description of Artificial Sequence: Synthetic oligonucleotide
  Target: ATXN1; (-) strand; PAM type: YTN; PAM sequence: CTT
gcacaaagccggggccctgc

SEQ ID NO: 160422 - DNA, 20 bp, Artificial Sequence
  Description of Artificial Sequence: Synthetic oligonucleotide
  Target: ATXN1; (-) strand; PAM type: YTN; PAM sequence: CTG
gatatgggggcttgcacaaa

SEQ ID NO: 160423 - DNA, 20 bp, Artificial Sequence
  Description of Artificial Sequence: Synthetic oligonucleotide
  Target: ATXN1; (-) strand; PAM type: YTN; PAM sequence: CTC
gtgaatgactggatatgggg

SEQ ID NO: 160424 - DNA, 20 bp, Artificial Sequence
  Description of Artificial Sequence: Synthetic oligonucleotide
  Target: ATXN1; (-) strand; PAM type: YTN; PAM sequence: TTC
cagaaccactcgtgaatgac

SEQ ID NO: 160425 - DNA, 20 bp, Artificial Sequence
  Description of Artificial Sequence: Synthetic oligonucleotide
  Target: ATXN1; (-) strand; PAM type: YTN; PAM sequence: TTT
ccagaaccactcgtgaatga

SEQ ID NO: 160426 - DNA, 20 bp, Artificial Sequence
  Description of Artificial Sequence: Synthetic oligonucleotide
  Target: ATXN1; (-) strand; PAM type: YTN; PAM sequence: TTT
tccagaaccactcgtgaatg

SEQ ID NO: 160427 - DNA, 20 bp, Artificial Sequence
  Description of Artificial Sequence: Synthetic oligonucleotide
  Target: ATXN1; (-) strand; PAM type: YTN; PAM sequence: TTA
aatgcccaagtgaggaaagg

SEQ ID NO: 160428 - DNA, 20 bp, Artificial Sequence
  Description of Artificial Sequence: Synthetic oligonucleotide
  Target: ATXN1; (-) strand; PAM type: YTN; PAM sequence: CTT
aaatgcccaagtgaggaaag

SEQ ID NO: 160429 - DNA, 20 bp, Artificial Sequence
  Description of Artificial Sequence: Synthetic oligonucleotide
  Target: ATXN1; (-) strand; PAM type: YTN; PAM sequence: TTC
ttaaatgcccaagtgaggaa

SEQ ID NO: 160430 - DNA, 20 bp, Artificial Sequence
  Description of Artificial Sequence: Synthetic oligonucleotide
  Target: ATXN1; (-) strand; PAM type: YTN; PAM sequence: TTT
cttaaatgcccaagtgagga

SEQ ID NO: 160431 - DNA, 20 bp, Artificial Sequence
  Description of Artificial Sequence: Synthetic oligonucleotide
  Target: ATXN1; (-) strand; PAM type: YTN; PAM sequence: TTG
agcatttcttaaatgcccaa

SEQ ID NO: 160432 - DNA, 20 bp, Artificial Sequence
  Description of Artificial Sequence: Synthetic oligonucleotide
  Target: ATXN1; (-) strand; PAM type: YTN; PAM sequence: TTT
gagcatttcttaaatgccca

SEQ ID NO: 160433 - DNA, 20 bp, Artificial Sequence
  Description of Artificial Sequence: Synthetic oligonucleotide
  Target: ATXN1; (-) strand; PAM type: YTN; PAM sequence: TTT
tgagcatttcttaaatgccc

SEQ ID NO: 160434 - DNA, 20 bp, Artificial Sequence
  Description of Artificial Sequence: Synthetic oligonucleotide
  Target: ATXN1; (-) strand; PAM type: YTN; PAM sequence: TTT
ttgagcatttcttaaatgcc

SEQ ID NO: 160435 - DNA, 20 bp, Artificial Sequence
  Description of Artificial Sequence: Synthetic oligonucleotide
  Target: ATXN1; (-) strand; PAM type: YTN; PAM sequence: TTT
tttgagcatttcttaaatgc

SEQ ID NO: 160436 - DNA, 20 bp, Artificial Sequence
  Description of Artificial Sequence: Synthetic oligonucleotide
  Target: ATXN1; (-) strand; PAM type: YTN; PAM sequence: CTT
ttttgagcatttcttaaatg

SEQ ID NO: 160437 - DNA, 20 bp, Artificial Sequence
  Description of Artificial Sequence: Synthetic oligonucleotide
  Target: ATXN1; (-) strand; PAM type: YTN; PAM sequence: CTG
gcttttttgagcatttctta

SEQ ID NO: 160438 - DNA, 20 bp, Artificial Sequence
  Description of Artificial Sequence: Synthetic oligonucleotide
  Target: ATXN1; (-) strand; PAM type: YTN; PAM sequence: CTA
tgtctggcttttttgagcat

SEQ ID NO: 160439 - DNA, 20 bp, Artificial Sequence
  Description of Artificial Sequence: Synthetic oligonucleotide
  Target: ATXN1; (-) strand; PAM type: YTN; PAM sequence: TTA
cagacacgagtccctatgtc

SEQ ID NO: 160440 - DNA, 20 bp, Artificial Sequence
  Description of Artificial Sequence: Synthetic oligonucleotide
  Target: ATXN1; (-) strand; PAM type: YTN; PAM sequence: CTG
agattacagacacgagtccc

SEQ ID NO: 160441 - DNA, 20 bp, Artificial Sequence
  Description of Artificial Sequence: Synthetic oligonucleotide
  Target: ATXN1; (-) strand; PAM type: YTN; PAM sequence: CTC
ccaaagccctgagattacag

SEQ ID NO: 160442 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagccctgaga

SEQ ID NO: 160443 - DNA, 20 bp, Artificial Sequence
  Description of Artificial Sequence: Synthetic oligonucleotide
  Target: ATXN1; (-) strand; PAM type: YTN; PAM sequence: TTC
cacctcggcctcccaaagcc

SEQ ID NO: 160444 - DNA, 20 bp, Artificial Sequence
  Description of Artificial Sequence: Synthetic oligonucleotide
  Target: ATXN1; (-) strand; PAM type: YTN; PAM sequence: CTT
ccacctcggcctcccaaagc

SEQ ID NO: 160445 - DNA, 20 bp, Artificial Sequence
  Description of Artificial Sequence: Synthetic oligonucleotide
  Target: ATXN1; (-) strand; PAM type: YTN; PAM sequence: CTC
caagcagtccttccacctcg

SEQ ID NO: 160446 - DNA, 20 bp, Artificial Sequence
  Description of Artificial Sequence: Synthetic oligonucleotide
  Target: ATXN1; (-) strand; PAM type: YTN; PAM sequence: CTG
ggctccaagcagtccttcca

SEQ ID NO: 160447 - DNA, 20 bp, Artificial Sequence
  Description of Artificial Sequence: Synthetic oligonucleotide
  Target: ATXN1; (-) strand; PAM type: YTN; PAM sequence: CTC
ctgggctccaagcagtcctt

SEQ ID NO: 160448 - DNA, 20 bp, Artificial Sequence
  Description of Artificial Sequence: Synthetic oligonucleotide
  Target: ATXN1; (-) strand; PAM type: YTN; PAM sequence: CTC
aaactcctgggctccaagca

SEQ ID NO: 160449 - DNA, 20 bp, Artificial Sequence
  Description of Artificial Sequence: Synthetic oligonucleotide
  Target: ATXN1; (-) strand; PAM type: YTN; PAM sequence: CTG
gtctcaaactcctgggctcc

SEQ ID NO: 160450 - DNA, 20 bp, Artificial Sequence
  Description of Artificial Sequence: Synthetic oligonucleotide
  Target: ATXN1; (-) strand; PAM type: YTN; PAM sequence: CTA
ggctggtctcaaactcctgg

SEQ ID NO: 160451 - DNA, 20 bp, Artificial Sequence
  Description of Artificial Sequence: Synthetic oligonucleotide
  Target: ATXN1; (-) strand; PAM type: YTN; PAM sequence: TTG
cctaggctggtctcaaactc

SEQ ID NO: 160452 - DNA, 20 bp, Artificial Sequence
  Description of Artificial Sequence: Synthetic oligonucleotide
  Target: ATXN1; (-) strand; PAM type: YTN; PAM sequence: CTG
tgttgcctaggctggtctca

SEQ ID NO: 160453 - DNA, 20 bp, Artificial Sequence
  Description of Artificial Sequence: Synthetic oligonucleotide
  Target: ATXN1; (-) strand; PAM type: YTN; PAM sequence: TTG
ctgtgttgcctaggctggtc

SEQ ID NO: 160454 - DNA, 20 bp, Artificial Sequence
  Description of Artificial Sequence: Synthetic oligonucleotide
  Target: ATXN1; (-) strand; PAM type: YTN; PAM sequence: CTT
gctgtgttgcctaggctggt

SEQ ID NO: 160455 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtcttgctg

SEQ ID NO: 160456 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtcttgct

SEQ ID NO: 160457 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtcttgc

SEQ ID NO: 160458 - DNA, 20 bp, Artificial Sequence
  Description of Artificial Sequence: Synthetic oligonucleotide
  Target: ATXN1; (-) strand; PAM type: YTN; PAM sequence: TTA
aaaataaaaaacattttagt

SEQ ID NO: 160459 - DNA, 20 bp, Artificial Sequence
  Description of Artificial Sequence: Synthetic oligonucleotide
  Target: ATXN1; (-) strand; PAM type: YTN; PAM sequence: TTT
aaaaataaaaaacattttag

SEQ ID NO: 160460 - DNA, 20 bp, Artificial Sequence
  Description of Artificial Sequence: Synthetic oligonucleotide
  Target: ATXN1; (-) strand; PAM type: YTN; PAM sequence: CTA
atttaaaaataaaaaacatt

SEQ ID NO: 160461 - DNA, 20 bp, Artificial Sequence
  Description of Artificial Sequence: Synthetic oligonucleotide
  Target: ATXN1; (-) strand; PAM type: YTN; PAM sequence: CTA
ggaccacaggtgcataccac

SEQ ID NO: 160462 - DNA, 20 bp, Artificial Sequence
  Description of Artificial Sequence: Synthetic oligonucleotide
  Target: ATXN1; (-) strand; PAM type: YTN; PAM sequence: CTA
gtagctaggaccacaggtgc

SEQ ID NO: 160463 - DNA, 20 bp, Artificial Sequence
  Description of Artificial Sequence: Synthetic oligonucleotide
  Target: ATXN1; (-) strand; PAM type: YTN; PAM sequence: CTC
cctagtagctaggaccacag

SEQ ID NO: 160464 - DNA, 20 bp, Artificial Sequence
  Description of Artificial Sequence: Synthetic oligonucleotide
  Target: ATXN1; (-) strand; PAM type: YTN; PAM sequence: CTC
ccaccccaacctccctagta

SEQ ID NO: 160465 - DNA, 20 bp, Artificial Sequence
  Description of Artificial Sequence: Synthetic oligonucleotide
  Target: ATXN1; (-) strand; PAM type: YTN; PAM sequence: CTC
cagcgatcctcccaccccaa

SEQ ID NO: 160466 - DNA, 20 bp, Artificial Sequence
  Description of Artificial Sequence: Synthetic oligonucleotide
  Target: ATXN1; (-) strand; PAM type: YTN; PAM sequence: CTA
ggctccagcgatcctcccac

SEQ ID NO: 160467 - DNA, 20 bp, Artificial Sequence
  Description of Artificial Sequence: Synthetic oligonucleotide
  Target: ATXN1; (-) strand; PAM type: YTN; PAM sequence: CTC
ctaggctccagcgatcctcc

SEQ ID NO: 160468 - DNA, 20 bp, Artificial Sequence
  Description of Artificial Sequence: Synthetic oligonucleotide
  Target: ATXN1; (-) strand; PAM type: YTN; PAM sequence: TTG
acctcctaggctccagcgat

SEQ ID NO: 160469 - DNA, 20 bp, Artificial Sequence
  Description of Artificial Sequence: Synthetic oligonucleotide
  Target: ATXN1; (-) strand; PAM type: YTN; PAM sequence: CTT
gacctcctaggctccagcga

SEQ ID NO: 160470 - DNA, 20 bp, Artificial Sequence
  Description of Artificial Sequence: Synthetic oligonucleotide
  Target: ATXN1; (-) strand; PAM type: YTN; PAM sequence: CTG
tggccttgacctcctaggct

SEQ ID NO: 160471 - DNA, 20 bp, Artificial Sequence
  Description of Artificial Sequence: Synthetic oligonucleotide
  Target: ATXN1; (-) strand; PAM type: YTN; PAM sequence: CTC
actgtggccttgacctccta

SEQ ID NO: 160472 - DNA, 20 bp, Artificial Sequence
  Description of Artificial Sequence: Synthetic oligonucleotide
  Target: ATXN1; (-) strand; PAM type: YTN; PAM sequence: CTG
gaatgcagtggtgcaatcat

SEQ ID NO: 160473 - DNA, 20 bp, Artificial Sequence
  Description of Artificial Sequence: Synthetic oligonucleotide
  Target: ATXN1; (-) strand; PAM type: YTN; PAM sequence: CTA
ggctggaatgcagtggtgca

SEQ ID NO: 160474 - DNA, 20 bp, Artificial Sequence
  Description of Artificial Sequence: Synthetic oligonucleotide
  Target: ATXN1; (-) strand; PAM type: YTN; PAM sequence: CTC
ctaggctggaatgcagtggt

SEQ ID NO: 160475 - DNA, 20 bp, Artificial Sequence
  Description of Artificial Sequence: Synthetic oligonucleotide
  Target: ATXN1; (-) strand; PAM type: YTN; PAM sequence: TTG
tctcctaggctggaatgcag

SEQ ID NO: 160476 - DNA, 20 bp, Artificial Sequence
  Description of Artificial Sequence: Synthetic oligonucleotide
  Target: ATXN1; (-) strand; PAM type: YTN; PAM sequence: CTT
gtctcctaggctggaatgca

SEQ ID NO: 160477 - DNA, 20 bp, Artificial Sequence
  Description of Artificial Sequence: Synthetic oligonucleotide
  Target: ATXN1; (-) strand; PAM type: YTN; PAM sequence: TTC
ttgtctcctaggctggaatg

SEQ ID NO: 160478 - DNA, 20 bp, Artificial Sequence
  Description of Artificial Sequence: Synthetic oligonucleotide
  Target: ATXN1; (-) strand; PAM type: YTN; PAM sequence: TTT
cttgtctcctaggctggaat

SEQ ID NO: 160479 - DNA, 20 bp, Artificial Sequence
  Description of Artificial Sequence: Synthetic oligonucleotide
  Target: ATXN1; (-) strand; PAM type: YTN; PAM sequence: TTG
agacagtgtttcttgtctcc

SEQ ID NO: 160480 - DNA, 20 bp, Artificial Sequence
  Description of Artificial Sequence: Synthetic oligonucleotide
  Target: ATXN1; (-) strand; PAM type: YTN; PAM sequence: TTT
gagacagtgtttcttgtctc

SEQ ID NO: 160481 - DNA, 20 bp, Artificial Sequence
  Description of Artificial Sequence: Synthetic oligonucleotide
  Target: ATXN1; (-) strand; PAM type: YTN; PAM sequence: TTT
tgagacagtgtttcttgtct

SEQ ID NO: 160482 - DNA, 20 bp, Artificial Sequence
  Description of Artificial Sequence: Synthetic oligonucleotide
  Target: ATXN1; (-) strand; PAM type: YTN; PAM sequence: TTT
ttgagacagtgtttcttgtc

SEQ ID NO: 160483 - DNA, 20 bp, Artificial Sequence
  Description of Artificial Sequence: Synthetic oligonucleotide
  Target: ATXN1; (-) strand; PAM type: YTN; PAM sequence: TTC
atttttgagacagtgtttct

SEQ ID NO: 160484 - DNA, 20 bp, Artificial Sequence
  Description of Artificial Sequence: Synthetic oligonucleotide
  Target: ATXN1; (-) strand; PAM type: YTN; PAM sequence: TTT
catttttgagacagtgtttc

SEQ ID NO: 160485 - DNA, 20 bp, Artificial Sequence
  Description of Artificial Sequence: Synthetic oligonucleotide
  Target: ATXN1; (-) strand; PAM type: YTN; PAM sequence: TTT
tcatttttgagacagtgttt

SEQ ID NO: 160486 - DNA, 20 bp, Artificial Sequence
  Description of Artificial Sequence: Synthetic oligonucleotide
  Target: ATXN1; (-) strand; PAM type: YTN; PAM sequence: TTT
ttcatttttgagacagtgtt

SEQ ID NO: 160487 - DNA, 20 bp, Artificial Sequence
  Description of Artificial Sequence: Synthetic oligonucleotide
  Target: ATXN1; (-) strand; PAM type: YTN; PAM sequence: TTT
tttcatttttgagacagtgt

SEQ ID NO: 160488 - DNA, 20 bp, Artificial Sequence
  Description of Artificial Sequence: Synthetic oligonucleotide
  Target: ATXN1; (-) strand; PAM type: YTN; PAM sequence: TTT
ttttcatttttgagacagtg

SEQ ID NO: 160489 - DNA, 20 bp, Artificial Sequence
  Description of Artificial Sequence: Synthetic oligonucleotide
  Target: ATXN1; (-) strand; PAM type: YTN; PAM sequence: TTT
tttttcatttttgagacagt

SEQ ID NO: 160490 - DNA, 20 bp, Artificial Sequence
  Description of Artificial Sequence: Synthetic oligonucleotide
  Target: ATXN1; (-) strand; PAM type: YTN; PAM sequence: TTT
ttttttcatttttgagacag

SEQ ID NO: 160491 - DNA, 20 bp, Artificial Sequence
  Description of Artificial Sequence: Synthetic oligonucleotide
  Target: ATXN1; (-) strand; PAM type: YTN; PAM sequence: TTT
tttttttcatttttgagaca

SEQ ID NO: 160492 - DNA, 20 bp, Artificial Sequence
  Description of Artificial Sequence: Synthetic oligonucleotide
  Target: ATXN1; (-) strand; PAM type: YTN; PAM sequence: TTT
ttttttttcatttttgagac

SEQ ID NO: 160493 - DNA, 20 bp, Artificial Sequence
  Description of Artificial Sequence: Synthetic oligonucleotide
  Target: ATXN1; (-) strand; PAM type: YTN; PAM sequence: TTG
ggcatttttttttttcattt

SEQ ID NO: 160494 - DNA, 20 bp, Artificial Sequence
  Description of Artificial Sequence: Synthetic oligonucleotide
  Target: ATXN1; (-) strand; PAM type: YTN; PAM sequence: TTT
gggcatttttttttttcatt

SEQ ID NO: 160495 - DNA, 20 bp, Artificial Sequence
  Description of Artificial Sequence: Synthetic oligonucleotide
  Target: ATXN1; (-) strand; PAM type: YTN; PAM sequence: TTT
tgggcatttttttttttcat

SEQ ID NO: 160496 - DNA, 20 bp, Artificial Sequence
  Description of Artificial Sequence: Synthetic oligonucleotide
  Target: ATXN1; (-) strand; PAM type: YTN; PAM sequence: TTG
ttttgggcattttttttttt

SEQ ID NO: 160497 - DNA, 20 bp, Artificial Sequence
  Description of Artificial Sequence: Synthetic oligonucleotide
  Target: ATXN1; (-) strand; PAM type: YTN; PAM sequence: TTG
aattgttttgggcatttttt

SEQ ID NO: 160498 - DNA, 20 bp, Artificial Sequence
  Description of Artificial Sequence: Synthetic oligonucleotide
  Target: ATXN1; (-) strand; PAM type: YTN; PAM sequence: TTT
gaattgttttgggcattttt

SEQ ID NO: 160499 - DNA, 20 bp, Artificial Sequence
  Description of Artificial Sequence: Synthetic oligonucleotide
  Target: ATXN1; (-) strand; PAM type: YTN; PAM sequence: TTA
atggtttgaattgttttggg

SEQ ID NO: 160500 - DNA, 20 bp, Artificial Sequence
  Description of Artificial Sequence: Synthetic oligonucleotide
  Target: ATXN1; (-) strand; PAM type: YTN; PAM sequence: CTA
attaatggtttgaattgttt

SEQ ID NO: 160501 - DNA, 20 bp, Artificial Sequence
  Description of Artificial Sequence: Synthetic oligonucleotide
  Target: ATXN1; (-) strand; PAM type: YTN; PAM sequence: TTC
agataaaataaaacaagaaa

SEQ ID NO: 160502 - DNA, 20 bp, Artificial Sequence
  Description of Artificial Sequence: Synthetic oligonucleotide
  Target: ATXN1; (-) strand; PAM type: YTN; PAM sequence: TTG
ggacattcagataaaataaa

SEQ ID NO: 160503 - DNA, 20 bp, Artificial Sequence
  Description of Artificial Sequence: Synthetic oligonucleotide
  Target: ATXN1; (-) strand; PAM type: YTN; PAM sequence: TTT
gggacattcagataaaataa

SEQ ID NO: 160504 - DNA, 20 bp, Artificial Sequence
  Description of Artificial Sequence: Synthetic oligonucleotide
  Target: ATXN1; (-) strand; PAM type: YTN; PAM sequence: CTA
tttgggacattcagataaaa

SEQ ID NO: 160505 - DNA, 20 bp, Artificial Sequence
  Description of Artificial Sequence: Synthetic oligonucleotide
  Target: ATXN1; (-) strand; PAM type: YTN; PAM sequence: CTG
ctatttgggacattcagata

SEQ ID NO: 160506 - DNA, 20 bp, Artificial Sequence
  Description of Artificial Sequence: Synthetic oligonucleotide
  Target: ATXN1; (-) strand; PAM type: YTN; PAM sequence: TTG
aaaatagtcatgaaatagct

SEQ ID NO: 160507 - DNA, 20 bp, Artificial Sequence
  Description of Artificial Sequence: Synthetic oligonucleotide
  Target: ATXN1; (-) strand; PAM type: YTN; PAM sequence: TTG
agttgaaaatagtcatgaaa

SEQ ID NO: 160508 - DNA, 20 bp, Artificial Sequence
  Description of Artificial Sequence: Synthetic oligonucleotide
  Target: ATXN1; (-) strand; PAM type: YTN; PAM sequence: CTT
gagttgaaaatagtcatgaa

SEQ ID NO: 160509 - DNA, 20 bp, Artificial Sequence
  Description of Artificial Sequence: Synthetic oligonucleotide
  Target: ATXN1; (-) strand; PAM type: YTN; PAM sequence: TTC
cagcttgagttgaaaatagt

SEQ ID NO: 160510 - DNA, 20 bp, Artificial Sequence
  Description of Artificial Sequence: Synthetic oligonucleotide
  Target: ATXN1; (-) strand; PAM type: YTN; PAM sequence: CTT
ccagcttgagttgaaaatag

SEQ ID NO: 160511 - DNA, 20 bp, Artificial Sequence
  Description of Artificial Sequence: Synthetic oligonucleotide
  Target: ATXN1; (-) strand; PAM type: YTN; PAM sequence: CTC
cttccagcttgagttgaaaa

SEQ ID NO: 160512 - DNA, 20 bp, Artificial Sequence
  Description of Artificial Sequence: Synthetic oligonucleotide
  Target: ATXN1; (-) strand; PAM type: YTN; PAM sequence: TTC
aaatgggacagagcctcctt

SEQ ID NO: 160513 - DNA, 20 bp, Artificial Sequence
  Description of Artificial Sequence: Synthetic oligonucleotide
  Target: ATXN1; (-) strand; PAM type: YTN; PAM sequence: TTG
aaaacattcaaatgggacag

SEQ ID NO: 160514 - DNA, 20 bp, Artificial Sequence
  Description of Artificial Sequence: Synthetic oligonucleotide
  Target: ATXN1; (-) strand; PAM type: YTN; PAM sequence: TTT
gaaaacattcaaatgggaca

SEQ ID NO: 160515 - DNA, 20 bp, Artificial Sequence
  Description of Artificial Sequence: Synthetic oligonucleotide
  Target: ATXN1; (-) strand; PAM type: YTN; PAM sequence: CTA
ggatttgaaaacattcaaat

SEQ ID NO: 160516 - DNA, 20 bp, Artificial Sequence
  Description of Artificial Sequence: Synthetic oligonucleotide
  Target: ATXN1; (-) strand; PAM type: YTN; PAM sequence: TTC
catctaggatttgaaaacat

SEQ ID NO: 160517 - DNA, 20 bp, Artificial Sequence
  Description of Artificial Sequence: Synthetic oligonucleotide
  Target: ATXN1; (-) strand; PAM type: YTN; PAM sequence: TTT
ccatctaggatttgaaaaca

SEQ ID NO: 160518 - DNA, 20 bp, Artificial Sequence
  Description of Artificial Sequence: Synthetic oligonucleotide
  Target: ATXN1; (-) strand; PAM type: YTN; PAM sequence: CTA
caagtgtttccatctaggat

SEQ ID NO: 160519 - DNA, 20 bp, Artificial Sequence
  Description of Artificial Sequence: Synthetic oligonucleotide
  Target: ATXN1; (-) strand; PAM type: YTN; PAM sequence: TTC
tacaagtgtttccatctagg

SEQ ID NO: 160520 - DNA, 20 bp, Artificial Sequence
  Description of Artificial Sequence: Synthetic oligonucleotide
  Target: ATXN1; (-) strand; PAM type: YTN; PAM sequence: TTT
ctacaagtgtttccatctag

SEQ ID NO: 160521 - DNA, 20 bp, Artificial Sequence
  Description of Artificial Sequence: Synthetic oligonucleotide
  Target: ATXN1; (-) strand; PAM type: YTN; PAM sequence: CTT
tctacaagtgtttccatcta

SEQ ID NO: 160522 - DNA, 20 bp, Artificial Sequence
  Description of Artificial Sequence: Synthetic oligonucleotide
  Target: ATXN1; (-) strand; PAM type: YTN; PAM sequence: CTA
tcgagcgtactttctacaag

SEQ ID NO: 160523 - DNA, 20 bp, Artificial Sequence
  Description of Artificial Sequence: Synthetic oligonucleotide
  Target: ATXN1; (-) strand; PAM type: YTN; PAM sequence: CTG
gctatcgagcgtactttcta

SEQ ID NO: 160524 - DNA, 20 bp, Artificial Sequence
  Description of Artificial Sequence: Synthetic oligonucleotide
  Target: ATXN1; (-) strand; PAM type: YTN; PAM sequence: TTC
ctggctatcgagcgtacttt

SEQ ID NO: 160525 - DNA, 20 bp, Artificial Sequence
  Description of Artificial Sequence: Synthetic oligonucleotide
  Target: ATXN1; (-) strand; PAM type: YTN; PAM sequence: TTT
cctggctatcgagcgtactt

SEQ ID NO: 160526 - DNA, 20 bp, Artificial Sequence
  Description of Artificial Sequence: Synthetic oligonucleotide
  Target: ATXN1; (-) strand; PAM type: YTN; PAM sequence: CTT
tcctggctatcgagcgtact

SEQ ID NO: 160527 - DNA, 20 bp, Artificial Sequence
  Description of Artificial Sequence: Synthetic oligonucleotide
  Target: ATXN1; (-) strand; PAM type: YTN; PAM sequence: CTG
agagctttcctggctatcga

SEQ ID NO: 160528 - DNA, 20 bp, Artificial Sequence
  Description of Artificial Sequence: Synthetic oligonucleotide
  Target: ATXN1; (-) strand; PAM type: YTN; PAM sequence: CTG
cagctgagagctttcctggc

SEQ ID NO: 160529 - DNA, 20 bp, Artificial Sequence
  Description of Artificial Sequence: Synthetic oligonucleotide
  Target: ATXN1; (-) strand; PAM type: YTN; PAM sequence: TTC
agcctgcagctgagagcttt

SEQ ID NO: 160530 - DNA, 20 bp, Artificial Sequence
  Description of Artificial Sequence: Synthetic oligonucleotide
  Target: ATXN1; (-) strand; PAM type: YTN; PAM sequence: CTG
ggagtccagcaggttcagcc

SEQ ID NO: 160531 - DNA, 20 bp, Artificial Sequence
  Description of Artificial Sequence: Synthetic oligonucleotide
  Target: ATXN1; (-) strand; PAM type: YTN; PAM sequence: TTG
ctgggagtccagcaggttca

SEQ ID NO: 160532 - DNA, 20 bp, Artificial Sequence
  Description of Artificial Sequence: Synthetic oligonucleotide
  Target: ATXN1; (-) strand; PAM type: YTN; PAM sequence: CTG
cccaagttgctgggagtcca

SEQ ID NO: 160533 - DNA, 20 bp, Artificial Sequence
  Description of Artificial Sequence: Synthetic oligonucleotide
  Target: ATXN1; (-) strand; PAM type: YTN; PAM sequence: TTC
actgcccaagttgctgggag

SEQ ID NO: 160534 - DNA, 20 bp, Artificial Sequence
  Description of Artificial Sequence: Synthetic oligonucleotide
  Target: ATXN1; (-) strand; PAM type: YTN; PAM sequence: TTT
cactgcccaagttgctggga

SEQ ID NO: 160535 - DNA, 20 bp, Artificial Sequence
  Description of Artificial Sequence: Synthetic oligonucleotide
  Target: ATXN1; (-) strand; PAM type: YTN; PAM sequence: CTT
tcactgcccaagttgctggg

SEQ ID NO: 160536 - DNA, 20 bp, Artificial Sequence
  Description of Artificial Sequence: Synthetic oligonucleotide
  Target: ATXN1; (-) strand; PAM type: YTN; PAM sequence: TTC
tttcactgcccaagttgctg

SEQ ID NO: 160537 - DNA, 20 bp, Artificial Sequence
  Description of Artificial Sequence: Synthetic oligonucleotide
  Target: ATXN1; (-) strand; PAM type: YTN; PAM sequence: TTT
ctttcactgcccaagttgct

SEQ ID NO: 160538 - DNA, 20 bp, Artificial Sequence
  Description of Artificial Sequence: Synthetic oligonucleotide
  Target: ATXN1; (-) strand; PAM type: YTN; PAM sequence: TTC
cacagcccatttctttcact

SEQ ID NO: 160539 - DNA, 20 bp, Artificial Sequence
  Description of Artificial Sequence: Synthetic oligonucleotide
  Target: ATXN1; (-) strand; PAM type: YTN; PAM sequence: TTA
ttccacagcccatttctttc

SEQ ID NO: 160540 - DNA, 20 bp, Artificial Sequence
  Description of Artificial Sequence: Synthetic oligonucleotide
  Target: ATXN1; (-) strand; PAM type: YTN; PAM sequence: TTT
attccacagcccatttcttt

SEQ ID NO: 160541 - DNA, 20 bp, Artificial Sequence
  Description of Artificial Sequence: Synthetic oligonucleotide
  Target: ATXN1; (-) strand; PAM type: YTN; PAM sequence: TTA
catgcatttattccacagcc

SEQ ID NO: 160542 - DNA, 20 bp, Artificial Sequence
  Description of Artificial Sequence: Synthetic oligonucleotide
  Target: ATXN1; (-) strand; PAM type: YTN; PAM sequence: TTA
gatcgattacatgcatttat

SEQ ID NO: 160543 - DNA, 20 bp, Artificial Sequence
  Description of Artificial Sequence: Synthetic oligonucleotide
  Target: ATXN1; (-) strand; PAM type: YTN; PAM sequence: CTT
agatcgattacatgcattta

SEQ ID NO: 160544 - DNA, 20 bp, Artificial Sequence
  Description of Artificial Sequence: Synthetic oligonucleotide
  Target: ATXN1; (-) strand; PAM type: YTN; PAM sequence: TTC
ttagatcgattacatgcatt

SEQ ID NO: 160545 - DNA, 20 bp, Artificial Sequence
  Description of Artificial Sequence: Synthetic oligonucleotide
  Target: ATXN1; (-) strand; PAM type: YTN; PAM sequence: TTC
caggttcttagatcgattac

SEQ ID NO: 160546 - DNA, 20 bp, Artificial Sequence
  Description of Artificial Sequence: Synthetic oligonucleotide
  Target: ATXN1; (-) strand; PAM type: YTN; PAM sequence: TTT
ccaggttcttagatcgatta

SEQ ID NO: 160547 - DNA, 20 bp, Artificial Sequence
  Description of Artificial Sequence: Synthetic oligonucleotide
  Target: ATXN1; (-) strand; PAM type: YTN; PAM sequence: TTT
tccaggttcttagatcgatt

SEQ ID NO: 160548 - DNA, 20 bp, Artificial Sequence
  Description of Artificial Sequence: Synthetic oligonucleotide
  Target: ATXN1; (-) strand; PAM type: YTN; PAM sequence: CTT
ttccaggttcttagatcgat

SEQ ID NO: 160549 - DNA, 20 bp, Artificial Sequence
  Description of Artificial Sequence: Synthetic oligonucleotide
  Target: ATXN1; (-) strand; PAM type: YTN; PAM sequence: CTA
cccttttccaggttcttaga

SEQ ID NO: 160550 - DNA, 20 bp, Artificial Sequence
  Description of Artificial Sequence: Synthetic oligonucleotide
  Target: ATXN1; (-) strand; PAM type: YTN; PAM sequence: TTC
aatctacccttttccaggtt

SEQ ID NO: 160551 - DNA, 20 bp, Artificial Sequence
  Description of Artificial Sequence: Synthetic oligonucleotide
  Target: ATXN1; (-) strand; PAM type: YTN; PAM sequence: CTT
caatctacccttttccaggt

SEQ ID NO: 160552 - DNA, 20 bp, Artificial Sequence
  Description of Artificial Sequence: Synthetic oligonucleotide
  Target: ATXN1; (-) strand; PAM type: YTN; PAM sequence: CTC
cttcaatctacccttttcca

SEQ ID NO: 160553 - DNA, 20 bp, Artificial Sequence
  Description of Artificial Sequence: Synthetic oligonucleotide
  Target: ATXN1; (-) strand; PAM type: YTN; PAM sequence: TTC
cacaggctccttcaatctac

SEQ ID NO: 160554 - DNA, 20 bp, Artificial Sequence
  Description of Artificial Sequence: Synthetic oligonucleotide
  Target: ATXN1; (-) strand; PAM type: YTN; PAM sequence: TTT
ccacaggctccttcaatcta

SEQ ID NO: 160555 - DNA, 20 bp, Artificial Sequence
  Description of Artificial Sequence: Synthetic oligonucleotide
  Target: ATXN1; (-) strand; PAM type: YTN; PAM sequence: TTA
atttccacaggctccttcaa

SEQ ID NO: 160556 - DNA, 20 bp, Artificial Sequence
  Description of Artificial Sequence: Synthetic oligonucleotide
  Target: ATXN1; (-) strand; PAM type: YTN; PAM sequence: CTT
aatttccacaggctccttca

SEQ ID NO: 160557 - DNA, 20 bp, Artificial Sequence
  Description of Artificial Sequence: Synthetic oligonucleotide
  Target: ATXN1; (-) strand; PAM type: YTN; PAM sequence: CTC
ttaatttccacaggctcctt

SEQ ID NO: 160558 - DNA, 20 bp, Artificial Sequence
  Description of Artificial Sequence: Synthetic oligonucleotide
  Target: ATXN1; (-) strand; PAM type: YTN; PAM sequence: TTA
acgctcttaatttccacagg

SEQ ID NO: 160559 - DNA, 20 bp, Artificial Sequence
  Description of Artificial Sequence: Synthetic oligonucleotide
  Target: ATXN1; (-) strand; PAM type: YTN; PAM sequence: CTG
gaagtatggttaacgctctt

SEQ ID NO: 160560 - DNA, 20 bp, Artificial Sequence
  Description of Artificial Sequence: Synthetic oligonucleotide
  Target: ATXN1; (-) strand; PAM type: YTN; PAM sequence: CTG
tagccaagatgagtcactgg

SEQ ID NO: 160561 - DNA, 20 bp, Artificial Sequence
  Description of Artificial Sequence: Synthetic oligonucleotide
  Target: ATXN1; (-) strand; PAM type: YTN; PAM sequence: TTG
gggtaaagtcagctgtagcc

SEQ ID NO: 160562 - DNA, 20 bp, Artificial Sequence
  Description of Artificial Sequence: Synthetic oligonucleotide
  Target: ATXN1; (-) strand; PAM type: YTN; PAM sequence: CTT
ggggtaaagtcagctgtagc

SEQ ID NO: 160563 - DNA, 20 bp, Artificial Sequence
  Description of Artificial Sequence: Synthetic oligonucleotide
  Target: ATXN1; (-) strand; PAM type: YTN; PAM sequence: CTG
ggcttggggtaaagtcagct

SEQ ID NO: 160564 - DNA, 20 bp, Artificial Sequence
  Description of Artificial Sequence: Synthetic oligonucleotide
  Target: ATXN1; (-) strand; PAM type: YTN; PAM sequence: CTG
ctgggcttggggtaaagtca

SEQ ID NO: 160565 - DNA, 20 bp, Artificial Sequence
  Description of Artificial Sequence: Synthetic oligonucleotide
  Target: ATXN1; (-) strand; PAM type: YTN; PAM sequence: CTG
tcccaggtgacctgctgggc

SEQ ID NO: 160566 - DNA, 20 bp, Artificial Sequence
  Description of Artificial Sequence: Synthetic oligonucleotide
  Target: ATXN1; (-) strand; PAM type: YTN; PAM sequence: CTG
agaagtcagggctgtcccag

SEQ ID NO: 160567 - DNA, 20 bp, Artificial Sequence
  Description of Artificial Sequence: Synthetic oligonucleotide
  Target: ATXN1; (-) strand; PAM type: YTN; PAM sequence: TTA
atacaatctgagaagtcagg

SEQ ID NO: 160568 - DNA, 20 bp, Artificial Sequence
  Description of Artificial Sequence: Synthetic oligonucleotide
  Target: ATXN1; (-) strand; PAM type: YTN; PAM sequence: CTA
aaatatcaaagcatcagaaa

SEQ ID NO: 160569 - DNA, 20 bp, Artificial Sequence
  Description of Artificial Sequence: Synthetic oligonucleotide
  Target: ATXN1; (-) strand; PAM type: YTN; PAM sequence: CTG
ggatccacaagacactaaaa

SEQ ID NO: 160570 - DNA, 20 bp, Artificial Sequence
  Description of Artificial Sequence: Synthetic oligonucleotide
  Target: ATXN1; (-) strand; PAM type: YTN; PAM sequence: CTC
tgggatccacaagacactaa

SEQ ID NO: 160571 - DNA, 20 bp, Artificial Sequence
  Description of Artificial Sequence: Synthetic oligonucleotide
  Target: ATXN1; (-) strand; PAM type: YTN; PAM sequence: CTA
tacctctgggatccacaaga

SEQ ID NO: 160572 - DNA, 20 bp, Artificial Sequence
  Description of Artificial Sequence: Synthetic oligonucleotide
  Target: ATXN1; (-) strand; PAM type: YTN; PAM sequence: CTA
ggagagactatacctctggg

SEQ ID NO: 160573 - DNA, 20 bp, Artificial Sequence
  Description of Artificial Sequence: Synthetic oligonucleotide
  Target: ATXN1; (-) strand; PAM type: YTN; PAM sequence: CTA
atcctaggagagactatacc

SEQ ID NO: 160574 - DNA, 20 bp, Artificial Sequence
  Description of Artificial Sequence: Synthetic oligonucleotide
  Target: ATXN1; (-) strand; PAM type: YTN; PAM sequence: TTA
gctaatcctaggagagacta

SEQ ID NO: 160575 - DNA, 20 bp, Artificial Sequence
  Description of Artificial Sequence: Synthetic oligonucleotide
  Target: ATXN1; (-) strand; PAM type: YTN; PAM sequence: CTA
ggaattagctaatcctagga

SEQ ID NO: 160576 - DNA, 20 bp, Artificial Sequence
  Description of Artificial Sequence: Synthetic oligonucleotide
  Target: ATXN1; (-) strand; PAM type: YTN; PAM sequence: CTC
taggaattagctaatcctag

SEQ ID NO: 160577 - DNA, 20 bp, Artificial Sequence
  Description of Artificial Sequence: Synthetic oligonucleotide
  Target: ATXN1; (-) strand; PAM type: YTN; PAM sequence: TTG
catataaaagtcaggcctct

SEQ ID NO: 160578 - DNA, 20 bp, Artificial Sequence
  Description of Artificial Sequence: Synthetic oligonucleotide
  Target: ATXN1; (-) strand; PAM type: YTN; PAM sequence: TTT
gcatataaaagtcaggcctc

SEQ ID NO: 160579 - DNA, 20 bp, Artificial Sequence
  Description of Artificial Sequence: Synthetic oligonucleotide
  Target: ATXN1; (-) strand; PAM type: YTN; PAM sequence: TTG
gtttgcatataaaagtcagg

SEQ ID NO: 160580 - DNA, 20 bp, Artificial Sequence
  Description of Artificial Sequence: Synthetic oligonucleotide
  Target: ATXN1; (-) strand; PAM type: YTN; PAM sequence: CTG
gttggtttgcatataaaagt

SEQ ID NO: 160581 - DNA, 20 bp, Artificial Sequence
  Description of Artificial Sequence: Synthetic oligonucleotide
  Target: ATXN1; (-) strand; PAM type: YTN; PAM sequence: CTG
gactggttggtttgcatata

SEQ ID NO: 160582 - DNA, 20 bp, Artificial Sequence
  Description of Artificial Sequence: Synthetic oligonucleotide
  Target: ATXN1; (-) strand; PAM type: YTN; PAM sequence: CTC
tggactggttggtttgcata

SEQ ID NO: 160583 - DNA, 20 bp, Artificial Sequence
  Description of Artificial Sequence: Synthetic oligonucleotide
  Target: ATXN1; (-) strand; PAM type: YTN; PAM sequence: TTA
gctctggactggttggtttg

SEQ ID NO: 160584 - DNA, 20 bp, Artificial Sequence
  Description of Artificial Sequence: Synthetic oligonucleotide
  Target: ATXN1; (-) strand; PAM type: YTN; PAM sequence: CTA
ggaattagctctggactggt

SEQ ID NO: 160585 - DNA, 20 bp, Artificial Sequence
  Description of Artificial Sequence: Synthetic oligonucleotide
  Target: ATXN1; (-) strand; PAM type: YTN; PAM sequence: CTC
ctaggaattagctctggact

SEQ ID NO: 160586 - DNA, 20 bp, Artificial Sequence
  Description of Artificial Sequence: Synthetic oligonucleotide
  Target: ATXN1; (-) strand; PAM type: YTN; PAM sequence: TTG
catatgaaagtcaggctcct

SEQ ID NO: 160587 - DNA, 20 bp, Artificial Sequence
  Description of Artificial Sequence: Synthetic oligonucleotide
  Target: ATXN1; (-) strand; PAM type: YTN; PAM sequence: TTT
gcatatgaaagtcaggctcc

SEQ ID NO: 160588 - DNA, 20 bp, Artificial Sequence
  Description of Artificial Sequence: Synthetic oligonucleotide
  Target: ATXN1; (-) strand; PAM type: YTN; PAM sequence: TTA
gtttgcatatgaaagtcagg

SEQ ID NO: 160589 - DNA, 20 bp, Artificial Sequence
  Description of Artificial Sequence: Synthetic oligonucleotide
  Target: ATXN1; (-) strand; PAM type: YTN; PAM sequence: CTG
gttagtttgcatatgaaagt

SEQ ID NO: 160590 - DNA, 20 bp, Artificial Sequence
  Description of Artificial Sequence: Synthetic oligonucleotide
  Target: ATXN1; (-) strand; PAM type: YTN; PAM sequence: CTG
gactggttagtttgcatatg

SEQ ID NO: 160591 - DNA, 20 bp, Artificial Sequence
  Description of Artificial Sequence: Synthetic oligonucleotide
  Target: ATXN1; (-) strand; PAM type: YTN; PAM sequence: CTC
tggactggttagtttgcata

SEQ ID NO: 160592 - DNA, 20 bp, Artificial Sequence
  Description of Artificial Sequence: Synthetic oligonucleotide
  Target: ATXN1; (-) strand; PAM type: YTN; PAM sequence: CTG
gggagtgggctctggactgg

SEQ ID NO: 160593 - DNA, 20 bp, Artificial Sequence
  Description of Artificial Sequence: Synthetic oligonucleotide
  Target: ATXN1; (-) strand; PAM type: YTN; PAM sequence: CTG
ctggggagtgggctctggac

SEQ ID NO: 160594 - DNA, 20 bp, Artificial Sequence
  Description of Artificial Sequence: Synthetic oligonucleotide
  Target: ATXN1; (-) strand; PAM type: YTN; PAM sequence: CTA
agtgtgatggaccaatatag

SEQ ID NO: 160595 - DNA, 20 bp, Artificial Sequence
  Description of Artificial Sequence: Synthetic oligonucleotide
  Target: ATXN1; (-) strand; PAM type: YTN; PAM sequence: CTC
agacaaaaaaaaaaaaacag

SEQ ID NO: 160596 - DNA, 20 bp, Artificial Sequence
  Description of Artificial Sequence: Synthetic oligonucleotide
  Target: ATXN1; (-) strand; PAM type: YTN; PAM sequence: CTG
tctcagacaaaaaaaaaaaa

SEQ ID NO: 160597 - DNA, 20 bp, Artificial Sequence
  Description of Artificial Sequence: Synthetic oligonucleotide
  Target: ATXN1; (-) strand; PAM type: YTN; PAM sequence: CTC
tgtctcagacaaaaaaaaaa

SEQ ID NO: 160598 - DNA, 20 bp, Artificial Sequence
  Description of Artificial Sequence: Synthetic oligonucleotide
  Target: ATXN1; (-) strand; PAM type: YTN; PAM sequence: TTG
gacacacagcaagactctgt

SEQ ID NO: 160599 - DNA, 20 bp, Artificial Sequence
  Description of Artificial Sequence: Synthetic oligonucleotide
  Target: ATXN1; (-) strand; PAM type: YTN; PAM sequence: CTT
ggacacacagcaagactctg

SEQ ID NO: 160600 - DNA, 20 bp, Artificial Sequence
  Description of Artificial Sequence: Synthetic oligonucleotide
  Target: ATXN1; (-) strand; PAM type: YTN; PAM sequence: CTC
cagccttggacacacagcaa

SEQ ID NO: 160601 - DNA, 20 bp, Artificial Sequence
  Description of Artificial Sequence: Synthetic oligonucleotide
  Target: ATXN1; (-) strand; PAM type: YTN; PAM sequence: CTG
cactccagccttggacacac

SEQ ID NO: 160602 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatcaggcc

SEQ ID NO: 160603 - DNA, 20 bp, Artificial Sequence
  Description of Artificial Sequence: Synthetic oligonucleotide
  Target: ATXN1; (-) strand; PAM type: YTN; PAM sequence: TTG
catgaacccgggaggtgggg

SEQ ID NO: 160604 - DNA, 20 bp, Artificial Sequence
  Description of Artificial Sequence: Synthetic oligonucleotide
  Target: ATXN1; (-) strand; PAM type: YTN; PAM sequence: CTG
aggtaggagaattgcatgaa

SEQ ID NO: 160605 - DNA, 20 bp, Artificial Sequence
  Description of Artificial Sequence: Synthetic oligonucleotide
  Target: ATXN1; (-) strand; PAM type: YTN; PAM sequence: CTC
cagaggctgaggtaggagaa

SEQ ID NO: 160606 - DNA, 20 bp, Artificial Sequence
  Description of Artificial Sequence: Synthetic oligonucleotide
  Target: ATXN1; (-) strand; PAM type: YTN; PAM sequence: CTA
ctccagaggctgaggtagga

SEQ ID NO: 160607 - DNA, 20 bp, Artificial Sequence
  Description of Artificial Sequence: Synthetic oligonucleotide
  Target: ATXN1; (-) strand; PAM type: YTN; PAM sequence: CTG
taatcccagctactccagag

SEQ ID NO: 160608 - DNA, 20 bp, Artificial Sequence
  Description of Artificial Sequence: Synthetic oligonucleotide
  Target: ATXN1; (-) strand; PAM type: YTN; PAM sequence: TTA
gccgggcatggtggtgtgtg

SEQ ID NO: 160609 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattagccgg

SEQ ID NO: 160610 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaattagc

SEQ ID NO: 160611 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaatta

SEQ ID NO: 160612 - DNA, 20 bp, Artificial Sequence
  Description of Artificial Sequence: Synthetic oligonucleotide
  Target: ATXN1; (-) strand; PAM type: YTN; PAM sequence: CTG
tctctactaaaaatacaaaa

SEQ ID NO: 160613 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaaccctg

SEQ ID NO: 160614 - DNA, 20 bp, Artificial Sequence
  Description of Artificial Sequence: Synthetic oligonucleotide
  Target: ATXN1; (-) strand; PAM type: YTN; PAM sequence: TTC
gagaccggcctggccaacat

SEQ ID NO: 160615 - DNA, 20 bp, Artificial Sequence
  Description of Artificial Sequence: Synthetic oligonucleotide
  Target: ATXN1; (-) strand; PAM type: YTN; PAM sequence: CTG
aggcgggtggatcaccagag

SEQ ID NO: 160616 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcgggtggat

SEQ ID NO: 160617 - DNA, 20 bp, Artificial Sequence
  Description of Artificial Sequence: Synthetic oligonucleotide
  Target: ATXN1; (-) strand; PAM type: YTN; PAM sequence: TTT
gggaggctgaggcgggtgga

SEQ ID NO: 160618 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgaggcgggtgg

SEQ ID NO: 160619 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 160620 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatcccagcact

SEQ ID NO: 160621 - DNA, 20 bp, Artificial Sequence
  Description of Artificial Sequence: Synthetic oligonucleotide
  Target: ATXN1; (-) strand; PAM type: YTN; PAM sequence: CTG
ggcacagtggctcacacctg

SEQ ID NO: 160622 - DNA, 20 bp, Artificial Sequence
  Description of Artificial Sequence: Synthetic oligonucleotide
  Target: ATXN1; (-) strand; PAM type: YTN; PAM sequence: CTG
gggtgatcaatacaggtgga

SEQ ID NO: 160623 - DNA, 20 bp, Artificial Sequence
  Description of Artificial Sequence: Synthetic oligonucleotide
  Target: ATXN1; (-) strand; PAM type: YTN; PAM sequence: CTG
gtgctggggtgatcaataca

SEQ ID NO: 160624 - DNA, 20 bp, Artificial Sequence
  Description of Artificial Sequence: Synthetic oligonucleotide
  Target: ATXN1; (-) strand; PAM type: YTN; PAM sequence: CTG
ctggtgctggggtgatcaat

SEQ ID NO: 160625 - DNA, 20 bp, Artificial Sequence
  Description of Artificial Sequence: Synthetic oligonucleotide
  Target: ATXN1; (-) strand; PAM type: YTN; PAM sequence: CTG
gctgctggtgctggggtgat

SEQ ID NO: 160626 - DNA, 20 bp, Artificial Sequence
  Description of Artificial Sequence: Synthetic oligonucleotide
  Target: ATXN1; (-) strand; PAM type: YTN; PAM sequence: TTG
tctggctgctggtgctgggg

SEQ ID NO: 160627 - DNA, 20 bp, Artificial Sequence
  Description of Artificial Sequence: Synthetic oligonucleotide
  Target: ATXN1; (-) strand; PAM type: YTN; PAM sequence: TTA
gttgtctggctgctggtgct

SEQ ID NO: 160628 - DNA, 20 bp, Artificial Sequence
  Description of Artificial Sequence: Synthetic oligonucleotide
  Target: ATXN1; (-) strand; PAM type: YTN; PAM sequence: CTT
agttgtctggctgctggtgc

SEQ ID NO: 160629 - DNA, 20 bp, Artificial Sequence
  Description of Artificial Sequence: Synthetic oligonucleotide
  Target: ATXN1; (-) strand; PAM type: YTN; PAM sequence: CTG
tccttagttgtctggctgct

SEQ ID NO: 160630 - DNA, 20 bp, Artificial Sequence
  Description of Artificial Sequence: Synthetic oligonucleotide
  Target: ATXN1; (-) strand; PAM type: YTN; PAM sequence: CTG
gggtgtaggggctgtcctta

SEQ ID NO: 160631 - DNA, 20 bp, Artificial Sequence
  Description of Artificial Sequence: Synthetic oligonucleotide
  Target: ATXN1; (-) strand; PAM type: YTN; PAM sequence: CTC
tggggtgtaggggctgtcct

SEQ ID NO: 160632 - DNA, 20 bp, Artificial Sequence
  Description of Artificial Sequence: Synthetic oligonucleotide
  Target: ATXN1; (-) strand; PAM type: YTN; PAM sequence: TTC
cagtgtgctctggggtgtag

SEQ ID NO: 160633 - DNA, 20 bp, Artificial Sequence
  Description of Artificial Sequence: Synthetic oligonucleotide
  Target: ATXN1; (-) strand; PAM type: YTN; PAM sequence: TTA
gagtggataattccagtgtg

SEQ ID NO: 160634 - DNA, 20 bp, Artificial Sequence
  Description of Artificial Sequence: Synthetic oligonucleotide
  Target: ATXN1; (-) strand; PAM type: YTN; PAM sequence: TTG
gttagagtggataattccag

SEQ ID NO: 160635 - DNA, 20 bp, Artificial Sequence
  Description of Artificial Sequence: Synthetic oligonucleotide
  Target: ATXN1; (-) strand; PAM type: YTN; PAM sequence: TTA
ggattggttagagtggataa

SEQ ID NO: 160636 - DNA, 20 bp, Artificial Sequence
  Description of Artificial Sequence: Synthetic oligonucleotide
  Target: ATXN1; (-) strand; PAM type: YTN; PAM sequence: TTT
aggattggttagagtggata

SEQ ID NO: 160637 - DNA, 20 bp, Artificial Sequence
  Description of Artificial Sequence: Synthetic oligonucleotide
  Target: ATXN1; (-) strand; PAM type: YTN; PAM sequence: TTC
atgggaggcagggtaaacgg

SEQ ID NO: 160638 - DNA, 20 bp, Artificial Sequence
  Description of Artificial Sequence: Synthetic oligonucleotide
  Target: ATXN1; (-) strand; PAM type: YTN; PAM sequence: TTT
catgggaggcagggtaaacg

SEQ ID NO: 160639 - DNA, 20 bp, Artificial Sequence
  Description of Artificial Sequence: Synthetic oligonucleotide
  Target: ATXN1; (-) strand; PAM type: YTN; PAM sequence: TTG
tggtttcatgggaggcaggg

SEQ ID NO: 160640 - DNA, 20 bp, Artificial Sequence
  Description of Artificial Sequence: Synthetic oligonucleotide
  Target: ATXN1; (-) strand; PAM type: YTN; PAM sequence: TTA
ttgtggtttcatgggaggca

SEQ ID NO: 160641 - DNA, 20 bp, Artificial Sequence
  Description of Artificial Sequence: Synthetic oligonucleotide
  Target: ATXN1; (-) strand; PAM type: YTN; PAM sequence: TTT
attgtggtttcatgggaggc

SEQ ID NO: 160642 - DNA, 20 bp, Artificial Sequence
  Description of Artificial Sequence: Synthetic oligonucleotide
  Target: ATXN1; (-) strand; PAM type: YTN; PAM sequence: CTT
tattgtggtttcatgggagg

SEQ ID NO: 160643 - DNA, 20 bp, Artificial Sequence
  Description of Artificial Sequence: Synthetic oligonucleotide
  Target: ATXN1; (-) strand; PAM type: YTN; PAM sequence: CTG
gggaagccccaggtgggtca

SEQ ID NO: 160644 - DNA, 20 bp, Artificial Sequence
  Description of Artificial Sequence: Synthetic oligonucleotide
  Target: ATXN1; (-) strand; PAM type: YTN; PAM sequence: CTA
caccaagaggtgtagaacac

SEQ ID NO: 160645 - DNA, 20 bp, Artificial Sequence
  Description of Artificial Sequence: Synthetic oligonucleotide
  Target: ATXN1; (-) strand; PAM type: YTN; PAM sequence: CTC
tacaccaagaggtgtagaac

SEQ ID NO: 160646 - DNA, 20 bp, Artificial Sequence
  Description of Artificial Sequence: Synthetic oligonucleotide
  Target: ATXN1; (-) strand; PAM type: YTN; PAM sequence: CTG
atcccaagaggaaagggcac

SEQ ID NO: 160647 - DNA, 20 bp, Artificial Sequence
  Description of Artificial Sequence: Synthetic oligonucleotide
  Target: ATXN1; (-) strand; PAM type: YTN; PAM sequence: CTC
tgatcccaagaggaaagggc

SEQ ID NO: 160648 - DNA, 20 bp, Artificial Sequence
  Description of Artificial Sequence: Synthetic oligonucleotide
  Target: ATXN1; (-) strand; PAM type: YTN; PAM sequence: CTC
tctgatcccaagaggaaagg

SEQ ID NO: 160649 - DNA, 20 bp, Artificial Sequence
  Description of Artificial Sequence: Synthetic oligonucleotide
  Target: ATXN1; (-) strand; PAM type: YTN; PAM sequence: TTA
tactctctgatcccaagagg

SEQ ID NO: 160650 - DNA, 20 bp, Artificial Sequence
  Description of Artificial Sequence: Synthetic oligonucleotide
  Target: ATXN1; (-) strand; PAM type: YTN; PAM sequence: TTT
atactctctgatcccaagag

SEQ ID NO: 160651 - DNA, 20 bp, Artificial Sequence
  Description of Artificial Sequence: Synthetic oligonucleotide
  Target: ATXN1; (-) strand; PAM type: YTN; PAM sequence: TTT
tatactctctgatcccaaga

SEQ ID NO: 160652 - DNA, 20 bp, Artificial Sequence
  Description of Artificial Sequence: Synthetic oligonucleotide
  Target: ATXN1; (-) strand; PAM type: YTN; PAM sequence: TTT
ttatactctctgatcccaag

SEQ ID NO: 160653 - DNA, 20 bp, Artificial Sequence
  Description of Artificial Sequence: Synthetic oligonucleotide
  Target: ATXN1; (-) strand; PAM type: YTN; PAM sequence: TTG
acgagataatttttatactc

SEQ ID NO: 160654 - DNA, 20 bp, Artificial Sequence
  Description of Artificial Sequence: Synthetic oligonucleotide
  Target: ATXN1; (-) strand; PAM type: YTN; PAM sequence: TTT
gacgagataatttttatact

SEQ ID NO: 160655 - DNA, 20 bp, Artificial Sequence
  Description of Artificial Sequence: Synthetic oligonucleotide
  Target: ATXN1; (-) strand; PAM type: YTN; PAM sequence: CTT
tgacgagataatttttatac

SEQ ID NO: 160656 - DNA, 20 bp, Artificial Sequence
  Description of Artificial Sequence: Synthetic oligonucleotide
  Target: ATXN1; (-) strand; PAM type: YTN; PAM sequence: CTC
tttgacgagataatttttat

SEQ ID NO: 160657 - DNA, 20 bp, Artificial Sequence
  Description of Artificial Sequence: Synthetic oligonucleotide
  Target: ATXN1; (-) strand; PAM type: YTN; PAM sequence: CTC
tctttgacgagataattttt

SEQ ID NO: 160658 - DNA, 20 bp, Artificial Sequence
  Description of Artificial Sequence: Synthetic oligonucleotide
  Target: ATXN1; (-) strand; PAM type: YTN; PAM sequence: TTA
ggtatgataaggccaacaga

SEQ ID NO: 160659 - DNA, 20 bp, Artificial Sequence
  Description of Artificial Sequence: Synthetic oligonucleotide
  Target: ATXN1; (-) strand; PAM type: YTN; PAM sequence: TTT
aggtatgataaggccaacag

SEQ ID NO: 160660 - DNA, 20 bp, Artificial Sequence
  Description of Artificial Sequence: Synthetic oligonucleotide
  Target: ATXN1; (-) strand; PAM type: YTN; PAM sequence: TTA
tttaggtatgataaggccaa

SEQ ID NO: 160661 - DNA, 20 bp, Artificial Sequence
  Description of Artificial Sequence: Synthetic oligonucleotide
  Target: ATXN1; (-) strand; PAM type: YTN; PAM sequence: TTA
ttatttaggtatgataaggc

SEQ ID NO: 160662 - DNA, 20 bp, Artificial Sequence
  Description of Artificial Sequence: Synthetic oligonucleotide
  Target: ATXN1; (-) strand; PAM type: YTN; PAM sequence: CTT
attatttaggtatgataagg

SEQ ID NO: 160663 - DNA, 20 bp, Artificial Sequence
  Description of Artificial Sequence: Synthetic oligonucleotide
  Target: ATXN1; (-) strand; PAM type: YTN; PAM sequence: CTC
caacatatatataatgtctt

SEQ ID NO: 160664 - DNA, 20 bp, Artificial Sequence
  Description of Artificial Sequence: Synthetic oligonucleotide
  Target: ATXN1; (-) strand; PAM type: YTN; PAM sequence: CTG
ggcaacatagcaaggcccgg

SEQ ID NO: 160665 - DNA, 20 bp, Artificial Sequence
  Description of Artificial Sequence: Synthetic oligonucleotide
  Target: ATXN1; (-) strand; PAM type: YTN; PAM sequence: CTC
aagcctgggcaacatagcaa

SEQ ID NO: 160666 - DNA, 20 bp, Artificial Sequence
  Description of Artificial Sequence: Synthetic oligonucleotide
  Target: ATXN1; (-) strand; PAM type: YTN; PAM sequence: CTG
cactcaagcctgggcaacat

SEQ ID NO: 160667 - DNA, 20 bp, Artificial Sequence
  Description of Artificial Sequence: Synthetic oligonucleotide
  Target: ATXN1; (-) strand; PAM type: YTN; PAM sequence: CTA
tcactgcactcaagcctggg

SEQ ID NO: 160668 - DNA, 20 bp, Artificial Sequence
  Description of Artificial Sequence: Synthetic oligonucleotide
  Target: ATXN1; (-) strand; PAM type: YTN; PAM sequence: CTG
tgactatcactgcactcaag

SEQ ID NO: 160669 - DNA, 20 bp, Artificial Sequence
  Description of Artificial Sequence: Synthetic oligonucleotide
  Target: ATXN1; (-) strand; PAM type: YTN; PAM sequence: CTG
aacctgtgactatcactgca

SEQ ID NO: 160670 - DNA, 20 bp, Artificial Sequence
  Description of Artificial Sequence: Synthetic oligonucleotide
  Target: ATXN1; (-) strand; PAM type: YTN; PAM sequence: CTA
tggctgaacctgtgactatc

SEQ ID NO: 160671 - DNA, 20 bp, Artificial Sequence
  Description of Artificial Sequence: Synthetic oligonucleotide
  Target: ATXN1; (-) strand; PAM type: YTN; PAM sequence: CTG
tagtgagctatggctgaacc

SEQ ID NO: 160672 - DNA, 20 bp, Artificial Sequence
  Description of Artificial Sequence: Synthetic oligonucleotide
  Target: ATXN1; (-) strand; PAM type: YTN; PAM sequence: TTC
gaggctgtagtgagctatgg

SEQ ID NO: 160673 - DNA, 20 bp, Artificial Sequence
  Description of Artificial Sequence: Synthetic oligonucleotide
  Target: ATXN1; (-) strand; PAM type: YTN; PAM sequence: TTG
agcccaggagttcgaggctg

SEQ ID NO: 160674 - DNA, 20 bp, Artificial Sequence
  Description of Artificial Sequence: Synthetic oligonucleotide
  Target: ATXN1; (-) strand; PAM type: YTN; PAM sequence: CTT
gagcccaggagttcgaggct

SEQ ID NO: 160675 - DNA, 20 bp, Artificial Sequence
  Description of Artificial Sequence: Synthetic oligonucleotide
  Target: ATXN1; (-) strand; PAM type: YTN; PAM sequence: CTG
aggcaggaggatcacttgag

SEQ ID NO: 160676 - DNA, 20 bp, Artificial Sequence
  Description of Artificial Sequence: Synthetic oligonucleotide
  Target: ATXN1; (-) strand; PAM type: YTN; PAM sequence: CTC
cagagactgaggcaggagga

SEQ ID NO: 160677 - DNA, 20 bp, Artificial Sequence
  Description of Artificial Sequence: Synthetic oligonucleotide
  Target: ATXN1; (-) strand; PAM type: YTN; PAM sequence: CTA
ctccagagactgaggcagga

SEQ ID NO: 160678 - DNA, 20 bp, Artificial Sequence
  Description of Artificial Sequence: Synthetic oligonucleotide
  Target: ATXN1; (-) strand; PAM type: YTN; PAM sequence: TTC
ggtcccagctactccagaga

SEQ ID NO: 160679 - DNA, 20 bp, Artificial Sequence
  Description of Artificial Sequence: Synthetic oligonucleotide
  Target: ATXN1; (-) strand; PAM type: YTN; PAM sequence: CTT
cggtcccagctactccagag

SEQ ID NO: 160680 - DNA, 20 bp, Artificial Sequence
  Description of Artificial Sequence: Synthetic oligonucleotide
  Target: ATXN1; (-) strand; PAM type: YTN; PAM sequence: CTG
ggtacagtggtatatgcctt

SEQ ID NO: 160681 - DNA, 20 bp, Artificial Sequence
  Description of Artificial Sequence: Synthetic oligonucleotide
  Target: ATXN1; (-) strand; PAM type: YTN; PAM sequence: TTA
gctgggtacagtggtatatg

SEQ ID NO: 160682 - DNA, 20 bp, Artificial Sequence
  Description of Artificial Sequence: Synthetic oligonucleotide
  Target: ATXN1; (-) strand; PAM type: YTN; PAM sequence: TTA
ttagctgggtacagtggtat

SEQ ID NO: 160683 - DNA, 20 bp, Artificial Sequence
  Description of Artificial Sequence: Synthetic oligonucleotide
  Target: ATXN1; (-) strand; PAM type: YTN; PAM sequence: CTT
attagctgggtacagtggta

SEQ ID NO: 160684 - DNA, 20 bp, Artificial Sequence
  Description of Artificial Sequence: Synthetic oligonucleotide
  Target: ATXN1; (-) strand; PAM type: YTN; PAM sequence: TTA
aaatatgtcttattagctgg

SEQ ID NO: 160685 - DNA, 20 bp, Artificial Sequence
  Description of Artificial Sequence: Synthetic oligonucleotide
  Target: ATXN1; (-) strand; PAM type: YTN; PAM sequence: TTT
aaaatatgtcttattagctg

SEQ ID NO: 160686 - DNA, 20 bp, Artificial Sequence
  Description of Artificial Sequence: Synthetic oligonucleotide
  Target: ATXN1; (-) strand; PAM type: YTN; PAM sequence: TTT
taaaatatgtcttattagct

SEQ ID NO: 160687 - DNA, 20 bp, Artificial Sequence
  Description of Artificial Sequence: Synthetic oligonucleotide
  Target: ATXN1; (-) strand; PAM type: YTN; PAM sequence: TTG
caacatccatgttttaaaat

SEQ ID NO: 160688 - DNA, 20 bp, Artificial Sequence
  Description of Artificial Sequence: Synthetic oligonucleotide
  Target: ATXN1; (-) strand; PAM type: YTN; PAM sequence: CTA
aagcaatcatatcccattgc

SEQ ID NO: 160689 - DNA, 20 bp, Artificial Sequence
  Description of Artificial Sequence: Synthetic oligonucleotide
  Target: ATXN1; (-) strand; PAM type: YTN; PAM sequence: TTA
gatgctaaagcaatcatatc

SEQ ID NO: 160690 - DNA, 20 bp, Artificial Sequence
  Description of Artificial Sequence: Synthetic oligonucleotide
  Target: ATXN1; (-) strand; PAM type: YTN; PAM sequence: TTG
gagtgaggggattagatgct

SEQ ID NO: 160691 - DNA, 20 bp, Artificial Sequence
  Description of Artificial Sequence: Synthetic oligonucleotide
  Target: ATXN1; (-) strand; PAM type: YTN; PAM sequence: TTA
ccaggaaaagacagaggatg

SEQ ID NO: 160692 - DNA, 20 bp, Artificial Sequence
  Description of Artificial Sequence: Synthetic oligonucleotide
  Target: ATXN1; (-) strand; PAM type: YTN; PAM sequence: CTT
accaggaaaagacagaggat

SEQ ID NO: 160693 - DNA, 20 bp, Artificial Sequence
  Description of Artificial Sequence: Synthetic oligonucleotide
  Target: ATXN1; (-) strand; PAM type: YTN; PAM sequence: TTC
ttaccaggaaaagacagagg

SEQ ID NO: 160694 - DNA, 20 bp, Artificial Sequence
  Description of Artificial Sequence: Synthetic oligonucleotide
  Target: ATXN1; (-) strand; PAM type: YTN; PAM sequence: TTT
cttaccaggaaaagacagag

SEQ ID NO: 160695 - DNA, 20 bp, Artificial Sequence
  Description of Artificial Sequence: Synthetic oligonucleotide
  Target: ATXN1; (-) strand; PAM type: YTN; PAM sequence: TTT
tcttaccaggaaaagacaga

SEQ ID NO: 160696 - DNA, 20 bp, Artificial Sequence
  Description of Artificial Sequence: Synthetic oligonucleotide
  Target: ATXN1; (-) strand; PAM type: YTN; PAM sequence: TTT
ttcttaccaggaaaagacag

SEQ ID NO: 160697 - DNA, 20 bp, Artificial Sequence
  Description of Artificial Sequence: Synthetic oligonucleotide
  Target: ATXN1; (-) strand; PAM type: YTN; PAM sequence: CTT
tttcttaccaggaaaagaca

SEQ ID NO: 160698 - DNA, 20 bp, Artificial Sequence
  Description of Artificial Sequence: Synthetic oligonucleotide
  Target: ATXN1; (-) strand; PAM type: YTN; PAM sequence: TTC
ggcactttttcttaccagga

SEQ ID NO: 160699 - DNA, 20 bp, Artificial Sequence
  Description of Artificial Sequence: Synthetic oligonucleotide
  Target: ATXN1; (-) strand; PAM type: YTN; PAM sequence: CTA
gtggtcattcggcacttttt

SEQ ID NO: 160700 - DNA, 20 bp, Artificial Sequence
  Description of Artificial Sequence: Synthetic oligonucleotide
  Target: ATXN1; (-) strand; PAM type: YTN; PAM sequence: TTC
tagtggtcattcggcacttt

SEQ ID NO: 160701 - DNA, 20 bp, Artificial Sequence
  Description of Artificial Sequence: Synthetic oligonucleotide
  Target: ATXN1; (-) strand; PAM type: YTN; PAM sequence: CTT
ctagtggtcattcggcactt

SEQ ID NO: 160702 - DNA, 20 bp, Artificial Sequence
  Description of Artificial Sequence: Synthetic oligonucleotide
  Target: ATXN1; (-) strand; PAM type: YTN; PAM sequence: TTC
aggtccttctagtggtcatt

SEQ ID NO: 160703 - DNA, 20 bp, Artificial Sequence
  Description of Artificial Sequence: Synthetic oligonucleotide
  Target: ATXN1; (-) strand; PAM type: YTN; PAM sequence: CTT
caggtccttctagtggtcat

SEQ ID NO: 160704 - DNA, 20 bp, Artificial Sequence
  Description of Artificial Sequence: Synthetic oligonucleotide
  Target: ATXN1; (-) strand; PAM type: YTN; PAM sequence: CTG
gacttcaggtccttctagtg

SEQ ID NO: 160705 - DNA, 20 bp, Artificial Sequence
  Description of Artificial Sequence: Synthetic oligonucleotide
  Target: ATXN1; (-) strand; PAM type: YTN; PAM sequence: CTG
ctggacttcaggtccttcta

SEQ ID NO: 160706 - DNA, 20 bp, Artificial Sequence
  Description of Artificial Sequence: Synthetic oligonucleotide
  Target: ATXN1; (-) strand; PAM type: YTN; PAM sequence: TTA
ggaaacgctgctggacttca

SEQ ID NO: 160707 - DNA, 20 bp, Artificial Sequence
  Description of Artificial Sequence: Synthetic oligonucleotide
  Target: ATXN1; (-) strand; PAM type: YTN; PAM sequence: CTG
attaggaaacgctgctggac

SEQ ID NO: 160708 - DNA, 20 bp, Artificial Sequence
  Description of Artificial Sequence: Synthetic oligonucleotide
  Target: ATXN1; (-) strand; PAM type: YTN; PAM sequence: TTA
agatgaggaaccctgattag

SEQ ID NO: 160709 - DNA, 20 bp, Artificial Sequence
  Description of Artificial Sequence: Synthetic oligonucleotide
  Target: ATXN1; (-) strand; PAM type: YTN; PAM sequence: CTG
tgattaagatgaggaaccct

SEQ ID NO: 160710 - DNA, 20 bp, Artificial Sequence
  Description of Artificial Sequence: Synthetic oligonucleotide
  Target: ATXN1; (-) strand; PAM type: YTN; PAM sequence: TTC
tgtgattaagatgaggaacc

SEQ ID NO: 160711 - DNA, 20 bp, Artificial Sequence
  Description of Artificial Sequence: Synthetic oligonucleotide
  Target: ATXN1; (-) strand; PAM type: YTN; PAM sequence: TTG
aattctgtgattaagatgag

SEQ ID NO: 160712 - DNA, 20 bp, Artificial Sequence
  Description of Artificial Sequence: Synthetic oligonucleotide
  Target: ATXN1; (-) strand; PAM type: YTN; PAM sequence: TTT
gaattctgtgattaagatga

SEQ ID NO: 160713 - DNA, 20 bp, Artificial Sequence
  Description of Artificial Sequence: Synthetic oligonucleotide
  Target: ATXN1; (-) strand; PAM type: YTN; PAM sequence: TTT
tgaattctgtgattaagatg

SEQ ID NO: 160714 - DNA, 20 bp, Artificial Sequence
  Description of Artificial Sequence: Synthetic oligonucleotide
  Target: ATXN1; (-) strand; PAM type: YTN; PAM sequence: TTT
ttgaattctgtgattaagat

SEQ ID NO: 160715 - DNA, 20 bp, Artificial Sequence
  Description of Artificial Sequence: Synthetic oligonucleotide
  Target: ATXN1; (-) strand; PAM type: YTN; PAM sequence: TTT
tttgaattctgtgattaaga

SEQ ID NO: 160716 - DNA, 20 bp, Artificial Sequence
  Description of Artificial Sequence: Synthetic oligonucleotide
  Target: ATXN1; (-) strand; PAM type: YTN; PAM sequence: TTA
ttttttgaattctgtgatta

SEQ ID NO: 160717 - DNA, 20 bp, Artificial Sequence
  Description of Artificial Sequence: Synthetic oligonucleotide
  Target: ATXN1; (-) strand; PAM type: YTN; PAM sequence: CTA
gttattttttgaattctgtg

SEQ ID NO: 160718 - DNA, 20 bp, Artificial Sequence
  Description of Artificial Sequence: Synthetic oligonucleotide
  Target: ATXN1; (-) strand; PAM type: YTN; PAM sequence: CTC
tagttattttttgaattctg

SEQ ID NO: 160719 - DNA, 20 bp, Artificial Sequence
  Description of Artificial Sequence: Synthetic oligonucleotide
  Target: ATXN1; (-) strand; PAM type: YTN; PAM sequence: CTC
accactctagttattttttg

SEQ ID NO: 160720 - DNA, 20 bp, Artificial Sequence
  Description of Artificial Sequence: Synthetic oligonucleotide
  Target: ATXN1; (-) strand; PAM type: YTN; PAM sequence: TTG
agacaatccagaaactcacc

SEQ ID NO: 160721 - DNA, 20 bp, Artificial Sequence
  Description of Artificial Sequence: Synthetic oligonucleotide
  Target: ATXN1; (-) strand; PAM type: YTN; PAM sequence: CTT
gagacaatccagaaactcac

SEQ ID NO: 160722 - DNA, 20 bp, Artificial Sequence
  Description of Artificial Sequence: Synthetic oligonucleotide
  Target: ATXN1; (-) strand; PAM type: YTN; PAM sequence: TTA
tggagtccttgagacaatcc

SEQ ID NO: 160723 - DNA, 20 bp, Artificial Sequence
  Description of Artificial Sequence: Synthetic oligonucleotide
  Target: ATXN1; (-) strand; PAM type: YTN; PAM sequence: CTA
gttatggagtccttgagaca

SEQ ID NO: 160724 - DNA, 20 bp, Artificial Sequence
  Description of Artificial Sequence: Synthetic oligonucleotide
  Target: ATXN1; (-) strand; PAM type: YTN; PAM sequence: CTC
catgcatggagagtggggct

SEQ ID NO: 160725 - DNA, 20 bp, Artificial Sequence
  Description of Artificial Sequence: Synthetic oligonucleotide
  Target: ATXN1; (-) strand; PAM type: YTN; PAM sequence: TTA
acctccatgcatggagagtg

SEQ ID NO: 160726 - DNA, 20 bp, Artificial Sequence
  Description of Artificial Sequence: Synthetic oligonucleotide
  Target: ATXN1; (-) strand; PAM type: YTN; PAM sequence: CTG
tgtgtaatgaattaacctcc

SEQ ID NO: 160727 - DNA, 20 bp, Artificial Sequence
  Description of Artificial Sequence: Synthetic oligonucleotide
  Target: ATXN1; (-) strand; PAM type: YTN; PAM sequence: CTG
ctgtgtgtaatgaattaacc

SEQ ID NO: 160728 - DNA, 20 bp, Artificial Sequence
  Description of Artificial Sequence: Synthetic oligonucleotide
  Target: ATXN1; (-) strand; PAM type: YTN; PAM sequence: CTC
tgctgtgtgtaatgaattaa

SEQ ID NO: 160729 - DNA, 20 bp, Artificial Sequence
  Description of Artificial Sequence: Synthetic oligonucleotide
  Target: ATXN1; (-) strand; PAM type: YTN; PAM sequence: TTC
cccgtgatctctgctgtgtg

SEQ ID NO: 160730 - DNA, 20 bp, Artificial Sequence
  Description of Artificial Sequence: Synthetic oligonucleotide
  Target: ATXN1; (-) strand; PAM type: YTN; PAM sequence: TTT
ccccgtgatctctgctgtgt

SEQ ID NO: 160731 - DNA, 20 bp, Artificial Sequence
  Description of Artificial Sequence: Synthetic oligonucleotide
  Target: ATXN1; (-) strand; PAM type: YTN; PAM sequence: CTA
gaaaaaataagccccatttc

SEQ ID NO: 160732 - DNA, 20 bp, Artificial Sequence
  Description of Artificial Sequence: Synthetic oligonucleotide
  Target: ATXN1; (-) strand; PAM type: YTN; PAM sequence: CTC
tagaaaaaataagccccatt

SEQ ID NO: 160733 - DNA, 20 bp, Artificial Sequence
  Description of Artificial Sequence: Synthetic oligonucleotide
  Target: ATXN1; (-) strand; PAM type: YTN; PAM sequence: TTC
tctagaaaaaataagcccca

SEQ ID NO: 160734 - DNA, 20 bp, Artificial Sequence
  Description of Artificial Sequence: Synthetic oligonucleotide
  Target: ATXN1; (-) strand; PAM type: YTN; PAM sequence: CTG
cgttctctagaaaaaataag

SEQ ID NO: 160735 - DNA, 20 bp, Artificial Sequence
  Description of Artificial Sequence: Synthetic oligonucleotide
  Target: ATXN1; (-) strand; PAM type: YTN; PAM sequence: TTC
ccaactgcgttctctagaaa

SEQ ID NO: 160736 - DNA, 20 bp, Artificial Sequence
  Description of Artificial Sequence: Synthetic oligonucleotide
  Target: ATXN1; (-) strand; PAM type: YTN; PAM sequence: TTT
cccaactgcgttctctagaa

SEQ ID NO: 160737 - DNA, 20 bp, Artificial Sequence
  Description of Artificial Sequence: Synthetic oligonucleotide
  Target: ATXN1; (-) strand; PAM type: YTN; PAM sequence: CTT
tcccaactgcgttctctaga

SEQ ID NO: 160738 - DNA, 20 bp, Artificial Sequence
  Description of Artificial Sequence: Synthetic oligonucleotide
  Target: ATXN1; (-) strand; PAM type: YTN; PAM sequence: CTC
ggcctttcccaactgcgttc

SEQ ID NO: 160739 - DNA, 20 bp, Artificial Sequence
  Description of Artificial Sequence: Synthetic oligonucleotide
  Target: ATXN1; (-) strand; PAM type: YTN; PAM sequence: TTA
gactcggcctttcccaactg

SEQ ID NO: 160740 - DNA, 20 bp, Artificial Sequence
  Description of Artificial Sequence: Synthetic oligonucleotide
  Target: ATXN1; (-) strand; PAM type: YTN; PAM sequence: CTT
agactcggcctttcccaact

SEQ ID NO: 160741 - DNA, 20 bp, Artificial Sequence
  Description of Artificial Sequence: Synthetic oligonucleotide
  Target: ATXN1; (-) strand; PAM type: YTN; PAM sequence: CTA
gaccttagactcggcctttc

SEQ ID NO: 160742 - DNA, 20 bp, Artificial Sequence
  Description of Artificial Sequence: Synthetic oligonucleotide
  Target: ATXN1; (-) strand; PAM type: YTN; PAM sequence: CTC
gggtacacctagaccttaga

SEQ ID NO: 160743 - DNA, 20 bp, Artificial Sequence
  Description of Artificial Sequence: Synthetic oligonucleotide
  Target: ATXN1; (-) strand; PAM type: YTN; PAM sequence: TTC
tcgggtacacctagacctta

SEQ ID NO: 160744 - DNA, 20 bp, Artificial Sequence
  Description of Artificial Sequence: Synthetic oligonucleotide
  Target: ATXN1; (-) strand; PAM type: YTN; PAM sequence: TTA
agggttctcgggtacaccta

SEQ ID NO: 160745 - DNA, 20 bp, Artificial Sequence
  Description of Artificial Sequence: Synthetic oligonucleotide
  Target: ATXN1; (-) strand; PAM type: YTN; PAM sequence: CTA
tgaggcaggattaagggttc

SEQ ID NO: 160746 - DNA, 20 bp, Artificial Sequence
  Description of Artificial Sequence: Synthetic oligonucleotide
  Target: ATXN1; (-) strand; PAM type: YTN; PAM sequence: TTC
tatgaggcaggattaagggt

SEQ ID NO: 160747 - DNA, 20 bp, Artificial Sequence
  Description of Artificial Sequence: Synthetic oligonucleotide
  Target: ATXN1; (-) strand; PAM type: YTN; PAM sequence: CTT
ctatgaggcaggattaaggg

SEQ ID NO: 160748 - DNA, 20 bp, Artificial Sequence
  Description of Artificial Sequence: Synthetic oligonucleotide
  Target: ATXN1; (-) strand; PAM type: YTN; PAM sequence: TTG
cttctatgaggcaggattaa

SEQ ID NO: 160749 - DNA, 20 bp, Artificial Sequence
  Description of Artificial Sequence: Synthetic oligonucleotide
  Target: ATXN1; (-) strand; PAM type: YTN; PAM sequence: CTG
gcaagacgaattgcttctat

SEQ ID NO: 160750 - DNA, 20 bp, Artificial Sequence
  Description of Artificial Sequence: Synthetic oligonucleotide
  Target: ATXN1; (-) strand; PAM type: YTN; PAM sequence: CTC
ctggcaagacgaattgcttc

SEQ ID NO: 160751 - DNA, 20 bp, Artificial Sequence
  Description of Artificial Sequence: Synthetic oligonucleotide
  Target: ATXN1; (-) strand; PAM type: YTN; PAM sequence: TTA
gccagggtggcacagggatg

SEQ ID NO: 160752 - DNA, 20 bp, Artificial Sequence
  Description of Artificial Sequence: Synthetic oligonucleotide
  Target: ATXN1; (-) strand; PAM type: YTN; PAM sequence: TTC
gccgtcggggagcaccgagc

SEQ ID NO: 160753 - DNA, 20 bp, Artificial Sequence
  Description of Artificial Sequence: Synthetic oligonucleotide
  Target: ATXN1; (-) strand; PAM type: YTN; PAM sequence: TTG
aagacagccatagcccgggc

SEQ ID NO: 160754 - DNA, 20 bp, Artificial Sequence
  Description of Artificial Sequence: Synthetic oligonucleotide
  Target: ATXN1; (-) strand; PAM type: YTN; PAM sequence: CTC
cagcaccgtagagaggattg

SEQ ID NO: 160755 - DNA, 20 bp, Artificial Sequence
  Description of Artificial Sequence: Synthetic oligonucleotide
  Target: ATXN1; (-) strand; PAM type: YTN; PAM sequence: CTG
aagatcgactccagcaccgt

SEQ ID NO: 160756 - DNA, 20 bp, Artificial Sequence
  Description of Artificial Sequence: Synthetic oligonucleotide
  Target: ATXN1; (-) strand; PAM type: YTN; PAM sequence: TTC
atccagagtgcagagataag

SEQ ID NO: 160757 - DNA, 20 bp, Artificial Sequence
  Description of Artificial Sequence: Synthetic oligonucleotide
  Target: ATXN1; (-) strand; PAM type: YTN; PAM sequence: TTT
catccagagtgcagagataa

SEQ ID NO: 160758 - DNA, 20 bp, Artificial Sequence
  Description of Artificial Sequence: Synthetic oligonucleotide
  Target: ATXN1; (-) strand; PAM type: YTN; PAM sequence: TTA
aaaacagaagatttcatcca

SEQ ID NO: 160759 - DNA, 20 bp, Artificial Sequence
  Description of Artificial Sequence: Synthetic oligonucleotide
  Target: ATXN1; (-) strand; PAM type: YTN; PAM sequence: CTT
aaaaacagaagatttcatcc

SEQ ID NO: 160760 - DNA, 20 bp, Artificial Sequence
  Description of Artificial Sequence: Synthetic oligonucleotide
  Target: ATXN1; (-) strand; PAM type: YTN; PAM sequence: CTA
aagaaggtggaagacttaaa

SEQ ID NO: 160761 - DNA, 20 bp, Artificial Sequence
  Description of Artificial Sequence: Synthetic oligonucleotide
  Target: ATXN1; (-) strand; PAM type: YTN; PAM sequence: TTG
gccaacggggagctaaagaa

SEQ ID NO: 160762 - DNA, 20 bp, Artificial Sequence
  Description of Artificial Sequence: Synthetic oligonucleotide
  Target: ATXN1; (-) strand; PAM type: YTN; PAM sequence: CTC
catcatccagttggccaacg

SEQ ID NO: 160763 - DNA, 20 bp, Artificial Sequence
  Description of Artificial Sequence: Synthetic oligonucleotide
  Target: ATXN1; (-) strand; PAM type: YTN; PAM sequence: TTC
atgaaaggctccatcatcca

SEQ ID NO: 160764 - DNA, 20 bp, Artificial Sequence
  Description of Artificial Sequence: Synthetic oligonucleotide
  Target: ATXN1; (-) strand; PAM type: YTN; PAM sequence: CTT
catgaaaggctccatcatcc

SEQ ID NO: 160765 - DNA, 20 bp, Artificial Sequence
  Description of Artificial Sequence: Synthetic oligonucleotide
  Target: ATXN1; (-) strand; PAM type: YTN; PAM sequence: CTA
cttcatgaaaggctccatca

SEQ ID NO: 160766 - DNA, 20 bp, Artificial Sequence
  Description of Artificial Sequence: Synthetic oligonucleotide
  Target: ATXN1; (-) strand; PAM type: YTN; PAM sequence: CTC
cctacttcatgaaaggctcc

SEQ ID NO: 160767 - DNA, 20 bp, Artificial Sequence
  Description of Artificial Sequence: Synthetic oligonucleotide
  Target: ATXN1; (-) strand; PAM type: YTN; PAM sequence: CTG
cctccctacttcatgaaagg

SEQ ID NO: 160768 - DNA, 20 bp, Artificial Sequence
  Description of Artificial Sequence: Synthetic oligonucleotide
  Target: ATXN1; (-) strand; PAM type: YTN; PAM sequence: CTA
cgctgcctccctacttcatg

SEQ ID NO: 160769 - DNA, 20 bp, Artificial Sequence
  Description of Artificial Sequence: Synthetic oligonucleotide
  Target: ATXN1; (-) strand; PAM type: YTN; PAM sequence: CTC
cccctacgctgcctccctac

SEQ ID NO: 160770 - DNA, 20 bp, Artificial Sequence
  Description of Artificial Sequence: Synthetic oligonucleotide
  Target: ATXN1; (-) strand; PAM type: YTN; PAM sequence: CTC
cccggcggcggctcccccta

SEQ ID NO: 160771 - DNA, 20 bp, Artificial Sequence
  Description of Artificial Sequence: Synthetic oligonucleotide
  Target: ATXN1; (-) strand; PAM type: YTN; PAM sequence: CTG
tggtgcagtccgtggcctcc

SEQ ID NO: 160772 - DNA, 20 bp, Artificial Sequence
  Description of Artificial Sequence: Synthetic oligonucleotide
  Target: ATXN1; (-) strand; PAM type: YTN; PAM sequence: CTG
cctgtggtgcagtccgtggc

SEQ ID NO: 160773 - DNA, 20 bp, Artificial Sequence
  Description of Artificial Sequence: Synthetic oligonucleotide
  Target: ATXN1; (-) strand; PAM type: YTN; PAM sequence: CTA
cccagccatggtgcaggccc

SEQ ID NO: 160774 - DNA, 20 bp, Artificial Sequence
  Description of Artificial Sequence: Synthetic oligonucleotide
  Target: ATXN1; (-) strand; PAM type: YTN; PAM sequence: CTG
gtcacccaggccgcctaccc

SEQ ID NO: 160775 - DNA, 20 bp, Artificial Sequence
  Description of Artificial Sequence: Synthetic oligonucleotide
  Target: ATXN1; (-) strand; PAM type: YTN; PAM sequence: CTG
aggccctggtcacccaggcc

SEQ ID NO: 160776 - DNA, 20 bp, Artificial Sequence
  Description of Artificial Sequence: Synthetic oligonucleotide
  Target: ATXN1; (-) strand; PAM type: YTN; PAM sequence: TTC
aaccctgaggccctggtcac

SEQ ID NO: 160777 - DNA, 20 bp, Artificial Sequence
  Description of Artificial Sequence: Synthetic oligonucleotide
  Target: ATXN1; (-) strand; PAM type: YTN; PAM sequence: CTT
caaccctgaggccctggtca

SEQ ID NO: 160778 - DNA, 20 bp, Artificial Sequence
  Description of Artificial Sequence: Synthetic oligonucleotide
  Target: ATXN1; (-) strand; PAM type: YTN; PAM sequence: TTC
ccaagagcgagaacttcaac

SEQ ID NO: 160779 - DNA, 20 bp, Artificial Sequence
  Description of Artificial Sequence: Synthetic oligonucleotide
  Target: ATXN1; (-) strand; PAM type: YTN; PAM sequence: CTT
cccaagagcgagaacttcaa

SEQ ID NO: 160780 - DNA, 20 bp, Artificial Sequence
  Description of Artificial Sequence: Synthetic oligonucleotide
  Target: ATXN1; (-) strand; PAM type: YTN; PAM sequence: TTC
gtcaccaccgcccttcccaa

SEQ ID NO: 160781 - DNA, 20 bp, Artificial Sequence
  Description of Artificial Sequence: Synthetic oligonucleotide
  Target: ATXN1; (-) strand; PAM type: YTN; PAM sequence: CTC
acacgttcgtcaccaccgcc

SEQ ID NO: 160782 - DNA, 20 bp, Artificial Sequence
  Description of Artificial Sequence: Synthetic oligonucleotide
  Target: ATXN1; (-) strand; PAM type: YTN; PAM sequence: CTG
cagtgcctcacacgttcgtc

SEQ ID NO: 160783 - DNA, 20 bp, Artificial Sequence
  Description of Artificial Sequence: Synthetic oligonucleotide
  Target: ATXN1; (-) strand; PAM type: YTN; PAM sequence: TTG
ctgcagtgcctcacacgttc

SEQ ID NO: 160784 - DNA, 20 bp, Artificial Sequence
  Description of Artificial Sequence: Synthetic oligonucleotide
  Target: ATXN1; (-) strand; PAM type: YTN; PAM sequence: TTT
gctgcagtgcctcacacgtt

SEQ ID NO: 160785 - DNA, 20 bp, Artificial Sequence
  Description of Artificial Sequence: Synthetic oligonucleotide
  Target: ATXN1; (-) strand; PAM type: YTN; PAM sequence: CTG
acatggaagcgtcgggggca

SEQ ID NO: 160786 - DNA, 20 bp, Artificial Sequence
  Description of Artificial Sequence: Synthetic oligonucleotide
  Target: ATXN1; (-) strand; PAM type: YTN; PAM sequence: CTC
atcccggtcggcagcactga

SEQ ID NO: 160787 - DNA, 20 bp, Artificial Sequence
  Description of Artificial Sequence: Synthetic oligonucleotide
  Target: ATXN1; (-) strand; PAM type: YTN; PAM sequence: CTG
ctcatcccggtcggcagcac

SEQ ID NO: 160788 - DNA, 20 bp, Artificial Sequence
  Description of Artificial Sequence: Synthetic oligonucleotide
  Target: ATXN1; (-) strand; PAM type: YTN; PAM sequence: CTG
gtgatccccggcacacagcc

SEQ ID NO: 160789 - DNA, 20 bp, Artificial Sequence
  Description of Artificial Sequence: Synthetic oligonucleotide
  Target: ATXN1; (-) strand; PAM type: YTN; PAM sequence: CTG
ccccagcacctggtgatccc

SEQ ID NO: 160790 - DNA, 20 bp, Artificial Sequence
  Description of Artificial Sequence: Synthetic oligonucleotide
  Target: ATXN1; (-) strand; PAM type: YTN; PAM sequence: CTA
cgccggcagcctgccccagc

SEQ ID NO: 160791 - DNA, 20 bp, Artificial Sequence
  Description of Artificial Sequence: Synthetic oligonucleotide
  Target: ATXN1; (-) strand; PAM type: YTN; PAM sequence: CTG
agcggccagcagcaagcaat

SEQ ID NO: 160792 - DNA, 20 bp, Artificial Sequence
  Description of Artificial Sequence: Synthetic oligonucleotide
  Target: ATXN1; (-) strand; PAM type: YTN; PAM sequence: CTA
cctgagcggccagcagcaag

SEQ ID NO: 160793 - DNA, 20 bp, Artificial Sequence
  Description of Artificial Sequence: Synthetic oligonucleotide
  Target: ATXN1; (-) strand; PAM type: YTN; PAM sequence: CTG
tcatcggctacctgagcggc

SEQ ID NO: 160794 - DNA, 20 bp, Artificial Sequence
  Description of Artificial Sequence: Synthetic oligonucleotide
  Target: ATXN1; (-) strand; PAM type: YTN; PAM sequence: CTC
aaccccctgtcatcggctac

SEQ ID NO: 160795 - DNA, 20 bp, Artificial Sequence
  Description of Artificial Sequence: Synthetic oligonucleotide
  Target: ATXN1; (-) strand; PAM type: YTN; PAM sequence: CTA
cgcagggactcaaccccctg

SEQ ID NO: 160796 - DNA, 20 bp, Artificial Sequence
  Description of Artificial Sequence: Synthetic oligonucleotide
  Target: ATXN1; (-) strand; PAM type: YTN; PAM sequence: TTC
tacgcagggactcaaccccc

SEQ ID NO: 160797 - DNA, 20 bp, Artificial Sequence
  Description of Artificial Sequence: Synthetic oligonucleotide
  Target: ATXN1; (-) strand; PAM type: YTN; PAM sequence: CTT
ctacgcagggactcaacccc

SEQ ID NO: 160798 - DNA, 20 bp, Artificial Sequence
  Description of Artificial Sequence: Synthetic oligonucleotide
  Target: ATXN1; (-) strand; PAM type: YTN; PAM sequence: CTG
ccagccacggccttctacgc

SEQ ID NO: 160799 - DNA, 20 bp, Artificial Sequence
  Description of Artificial Sequence: Synthetic oligonucleotide
  Target: ATXN1; (-) strand; PAM type: YTN; PAM sequence: CTC
ccggtgggactgccagccac

SEQ ID NO: 160800 - DNA, 20 bp, Artificial Sequence
  Description of Artificial Sequence: Synthetic oligonucleotide
  Target: ATXN1; (-) strand; PAM type: YTN; PAM sequence: TTC
agagccactcccggtgggac

SEQ ID NO: 160801 - DNA, 20 bp, Artificial Sequence
  Description of Artificial Sequence: Synthetic oligonucleotide
  Target: ATXN1; (-) strand; PAM type: YTN; PAM sequence: CTT
cagagccactcccggtggga

SEQ ID NO: 160802 - DNA, 20 bp, Artificial Sequence
  Description of Artificial Sequence: Synthetic oligonucleotide
  Target: ATXN1; (-) strand; PAM type: YTN; PAM sequence: TTC
agaccacacacagtgcttca

SEQ ID NO: 160803 - DNA, 20 bp, Artificial Sequence
  Description of Artificial Sequence: Synthetic oligonucleotide
  Target: ATXN1; (-) strand; PAM type: YTN; PAM sequence: CTC
accccacacggtcattcaga

SEQ ID NO: 160804 - DNA, 20 bp, Artificial Sequence
  Description of Artificial Sequence: Synthetic oligonucleotide
  Target: ATXN1; (-) strand; PAM type: YTN; PAM sequence: CTC
tcaccccacacggtcattca

SEQ ID NO: 160805 - DNA, 20 bp, Artificial Sequence
  Description of Artificial Sequence: Synthetic oligonucleotide
  Target: ATXN1; (-) strand; PAM type: YTN; PAM sequence: CTA
cgcgctctcaccccacacgg

SEQ ID NO: 160806 - DNA, 20 bp, Artificial Sequence
  Description of Artificial Sequence: Synthetic oligonucleotide
  Target: ATXN1; (-) strand; PAM type: YTN; PAM sequence: CTG
gccaccggtcctacgcgctc

SEQ ID NO: 160807 - DNA, 20 bp, Artificial Sequence
  Description of Artificial Sequence: Synthetic oligonucleotide
  Target: ATXN1; (-) strand; PAM type: YTN; PAM sequence: TTA
gggaagcctggccaccggtc

SEQ ID NO: 160808 - DNA, 20 bp, Artificial Sequence
  Description of Artificial Sequence: Synthetic oligonucleotide
  Target: ATXN1; (-) strand; PAM type: YTN; PAM sequence: TTT
agggaagcctggccaccggt

SEQ ID NO: 160809 - DNA, 20 bp, Artificial Sequence
  Description of Artificial Sequence: Synthetic oligonucleotide
  Target: ATXN1; (-) strand; PAM type: YTN; PAM sequence: CTG
catttagggaagcctggcca

SEQ ID NO: 160810 - DNA, 20 bp, Artificial Sequence
  Description of Artificial Sequence: Synthetic oligonucleotide
  Target: ATXN1; (-) strand; PAM type: YTN; PAM sequence: CTC
aacgacaaaagtggcctgca

SEQ ID NO: 160811 - DNA, 20 bp, Artificial Sequence
  Description of Artificial Sequence: Synthetic oligonucleotide
  Target: ATXN1; (-) strand; PAM type: YTN; PAM sequence: CTA
ccctcaacgacaaaagtggc

SEQ ID NO: 160812 - DNA, 20 bp, Artificial Sequence
  Description of Artificial Sequence: Synthetic oligonucleotide
  Target: ATXN1; (-) strand; PAM type: YTN; PAM sequence: TTC
taccctcaacgacaaaagtg

SEQ ID NO: 160813 - DNA, 20 bp, Artificial Sequence
  Description of Artificial Sequence: Synthetic oligonucleotide
  Target: ATXN1; (-) strand; PAM type: YTN; PAM sequence: CTT
ctaccctcaacgacaaaagt

SEQ ID NO: 160814 - DNA, 20 bp, Artificial Sequence
  Description of Artificial Sequence: Synthetic oligonucleotide
  Target: ATXN1; (-) strand; PAM type: YTN; PAM sequence: CTC
cccttctaccctcaacgaca

SEQ ID NO: 160815 - DNA, 20 bp, Artificial Sequence
  Description of Artificial Sequence: Synthetic oligonucleotide
  Target: ATXN1; (-) strand; PAM type: YTN; PAM sequence: CTC
atcgtgaagcctccccttct

SEQ ID NO: 160816 - DNA, 20 bp, Artificial Sequence
  Description of Artificial Sequence: Synthetic oligonucleotide
  Target: ATXN1; (-) strand; PAM type: YTN; PAM sequence: CTG
gaggtgcaacaggccactca

SEQ ID NO: 160817 - DNA, 20 bp, Artificial Sequence
  Description of Artificial Sequence: Synthetic oligonucleotide
  Target: ATXN1; (-) strand; PAM type: YTN; PAM sequence: CTG
acctggaggtgcaacaggcc

SEQ ID NO: 160818 - DNA, 20 bp, Artificial Sequence
  Description of Artificial Sequence: Synthetic oligonucleotide
  Target: ATXN1; (-) strand; PAM type: YTN; PAM sequence: CTG
cccaacagcaacacgcccgc

SEQ ID NO: 160819 - DNA, 20 bp, Artificial Sequence
  Description of Artificial Sequence: Synthetic oligonucleotide
  Target: ATXN1; (-) strand; PAM type: YTN; PAM sequence: CTG
tgatggtcctgcccaacagc

SEQ ID NO: 160820 - DNA, 20 bp, Artificial Sequence
  Description of Artificial Sequence: Synthetic oligonucleotide
  Target: ATXN1; (-) strand; PAM type: YTN; PAM sequence: CTC
tgtgatggtcctgcccaaca

SEQ ID NO: 160821 - DNA, 20 bp, Artificial Sequence
  Description of Artificial Sequence: Synthetic oligonucleotide
  Target: ATXN1; (-) strand; PAM type: YTN; PAM sequence: TTC
gggggtccgggcctctgtga

SEQ ID NO: 160822 - DNA, 20 bp, Artificial Sequence
  Description of Artificial Sequence: Synthetic oligonucleotide
  Target: ATXN1; (-) strand; PAM type: YTN; PAM sequence: CTT
cgggggtccgggcctctgtg

SEQ ID NO: 160823 - DNA, 20 bp, Artificial Sequence
  Description of Artificial Sequence: Synthetic oligonucleotide
  Target: ATXN1; (-) strand; PAM type: YTN; PAM sequence: CTA
cagcagtcgtgatccttcgg

SEQ ID NO: 160824 - DNA, 20 bp, Artificial Sequence
  Description of Artificial Sequence: Synthetic oligonucleotide
  Target: ATXN1; (-) strand; PAM type: YTN; PAM sequence: CTC
agactacagcagtcgtgatc

SEQ ID NO: 160825 - DNA, 20 bp, Artificial Sequence
  Description of Artificial Sequence: Synthetic oligonucleotide
  Target: ATXN1; (-) strand; PAM type: YTN; PAM sequence: CTC
acccgtacgagtccaggcac

SEQ ID NO: 160826 - DNA, 20 bp, Artificial Sequence
  Description of Artificial Sequence: Synthetic oligonucleotide
  Target: ATXN1; (-) strand; PAM type: YTN; PAM sequence: TTC
ctcacccgtacgagtccagg

SEQ ID NO: 160827 - DNA, 20 bp, Artificial Sequence
  Description of Artificial Sequence: Synthetic oligonucleotide
  Target: ATXN1; (-) strand; PAM type: YTN; PAM sequence: CTG
ggcaaggcaggcggcaagtc

SEQ ID NO: 160828 - DNA, 20 bp, Artificial Sequence
  Description of Artificial Sequence: Synthetic oligonucleotide
  Target: ATXN1; (-) strand; PAM type: YTN; PAM sequence: CTG
ggcctgggcaaggcaggcgg

SEQ ID NO: 160829 - DNA, 20 bp, Artificial Sequence
  Description of Artificial Sequence: Synthetic oligonucleotide
  Target: ATXN1; (-) strand; PAM type: YTN; PAM sequence: CTC
agccgacctgggcctgggca

SEQ ID NO: 160830 - DNA, 20 bp, Artificial Sequence
  Description of Artificial Sequence: Synthetic oligonucleotide
  Target: ATXN1; (-) strand; PAM type: YTN; PAM sequence: CTG
aacggtgagatggagaagag

SEQ ID NO: 160831 - DNA, 20 bp, Artificial Sequence
  Description of Artificial Sequence: Synthetic oligonucleotide
  Target: ATXN1; (-) strand; PAM type: YTN; PAM sequence: CTG
cagcaggccatccaggccaa

SEQ ID NO: 160832 - DNA, 20 bp, Artificial Sequence
  Description of Artificial Sequence: Synthetic oligonucleotide
  Target: ATXN1; (-) strand; PAM type: YTN; PAM sequence: CTG
agagcagccggctgcagcag

SEQ ID NO: 160833 - DNA, 20 bp, Artificial Sequence
  Description of Artificial Sequence: Synthetic oligonucleotide
  Target: ATXN1; (-) strand; PAM type: YTN; PAM sequence: CTC
gggaggccaccaagaaagct

SEQ ID NO: 160834 - DNA, 20 bp, Artificial Sequence
  Description of Artificial Sequence: Synthetic oligonucleotide
  Target: ATXN1; (-) strand; PAM type: YTN; PAM sequence: TTG
tccctcgggaggccaccaag

SEQ ID NO: 160835 - DNA, 20 bp, Artificial Sequence
  Description of Artificial Sequence: Synthetic oligonucleotide
  Target: ATXN1; (-) strand; PAM type: YTN; PAM sequence: TTT
gtccctcgggaggccaccaa

SEQ ID NO: 160836 - DNA, 20 bp, Artificial Sequence
  Description of Artificial Sequence: Synthetic oligonucleotide
  Target: ATXN1; (-) strand; PAM type: YTN; PAM sequence: CTT
tgtccctcgggaggccacca

SEQ ID NO: 160837 - DNA, 20 bp, Artificial Sequence
  Description of Artificial Sequence: Synthetic oligonucleotide
  Target: ATXN1; (-) strand; PAM type: YTN; PAM sequence: CTC
cggcagccactttgtccctc

SEQ ID NO: 160838 - DNA, 20 bp, Artificial Sequence
  Description of Artificial Sequence: Synthetic oligonucleotide
  Target: ATXN1; (-) strand; PAM type: YTN; PAM sequence: CTC
ccaggtcgtcatgcaatacg

SEQ ID NO: 160839 - DNA, 20 bp, Artificial Sequence
  Description of Artificial Sequence: Synthetic oligonucleotide
  Target: ATXN1; (-) strand; PAM type: YTN; PAM sequence: CTG
gggcccccctcccaggtcgt

SEQ ID NO: 160840 - DNA, 20 bp, Artificial Sequence
  Description of Artificial Sequence: Synthetic oligonucleotide
  Target: ATXN1; (-) strand; PAM type: YTN; PAM sequence: CTC
accctggggcccccctccca

SEQ ID NO: 160841 - DNA, 20 bp, Artificial Sequence
  Description of Artificial Sequence: Synthetic oligonucleotide
  Target: ATXN1; (-) strand; PAM type: YTN; PAM sequence: CTC
cacccccaccagacgatgat

SEQ ID NO: 160842 - DNA, 20 bp, Artificial Sequence
  Description of Artificial Sequence: Synthetic oligonucleotide
  Target: ATXN1; (-) strand; PAM type: YTN; PAM sequence: CTC
cggccatccccgtccacctc

SEQ ID NO: 160843 - DNA, 20 bp, Artificial Sequence
  Description of Artificial Sequence: Synthetic oligonucleotide
  Target: ATXN1; (-) strand; PAM type: YTN; PAM sequence: CTC
ctccggccatccccgtccac

SEQ ID NO: 160844 - DNA, 20 bp, Artificial Sequence
  Description of Artificial Sequence: Synthetic oligonucleotide
  Target: ATXN1; (-) strand; PAM type: YTN; PAM sequence: CTC
tcctccggccatccccgtcc

SEQ ID NO: 160845 - DNA, 20 bp, Artificial Sequence
  Description of Artificial Sequence: Synthetic oligonucleotide
  Target: ATXN1; (-) strand; PAM type: YTN; PAM sequence: CTC
cgcagaacaccggccgcacc

SEQ ID NO: 160846 - DNA, 20 bp, Artificial Sequence
  Description of Artificial Sequence: Synthetic oligonucleotide
  Target: ATXN1; (-) strand; PAM type: YTN; PAM sequence: TTC
tccgcagaacaccggccgca

SEQ ID NO: 160847 - DNA, 20 bp, Artificial Sequence
  Description of Artificial Sequence: Synthetic oligonucleotide
  Target: ATXN1; (-) strand; PAM type: YTN; PAM sequence: TTC
cagttctccgcagaacaccg

SEQ ID NO: 160848 - DNA, 20 bp, Artificial Sequence
  Description of Artificial Sequence: Synthetic oligonucleotide
  Target: ATXN1; (-) strand; PAM type: YTN; PAM sequence: TTT
ccagttctccgcagaacacc

SEQ ID NO: 160849 - DNA, 20 bp, Artificial Sequence
  Description of Artificial Sequence: Synthetic oligonucleotide
  Target: ATXN1; (-) strand; PAM type: YTN; PAM sequence: CTC
atcaccccggggtccccccc

SEQ ID NO: 160850 - DNA, 20 bp, Artificial Sequence
  Description of Artificial Sequence: Synthetic oligonucleotide
  Target: ATXN1; (-) strand; PAM type: YTN; PAM sequence: CTC
cggggctcatcaccccgggg

SEQ ID NO: 160851 - DNA, 20 bp, Artificial Sequence
  Description of Artificial Sequence: Synthetic oligonucleotide
  Target: ATXN1; (-) strand; PAM type: YTN; PAM sequence: CTC
agcagggctccggggctcat

SEQ ID NO: 160852 - DNA, 20 bp, Artificial Sequence
  Description of Artificial Sequence: Synthetic oligonucleotide
  Target: ATXN1; (-) strand; PAM type: YTN; PAM sequence: CTG
agcagcagcagcagcagcag

SEQ ID NO: 160853 - DNA, 20 bp, Artificial Sequence
  Description of Artificial Sequence: Synthetic oligonucleotide
  Target: ATXN1; (-) strand; PAM type: YTN; PAM sequence: CTG
agccagacgccgggacacaa

SEQ ID NO: 160854 - DNA, 20 bp, Artificial Sequence
  Description of Artificial Sequence: Synthetic oligonucleotide
  Target: ATXN1; (-) strand; PAM type: YTN; PAM sequence: CTG
gccaacatgggcagtctgag

SEQ ID NO: 160855 - DNA, 20 bp, Artificial Sequence
  Description of Artificial Sequence: Synthetic oligonucleotide
  Target: ATXN1; (-) strand; PAM type: YTN; PAM sequence: CTG
ctggccaacatgggcagtct

SEQ ID NO: 160856 - DNA, 20 bp, Artificial Sequence
  Description of Artificial Sequence: Synthetic oligonucleotide
  Target: ATXN1; (-) strand; PAM type: YTN; PAM sequence: CTC
tgctggccaacatgggcagt

SEQ ID NO: 160857 - DNA, 20 bp, Artificial Sequence
  Description of Artificial Sequence: Synthetic oligonucleotide
  Target: ATXN1; (-) strand; PAM type: YTN; PAM sequence: TTC
cactctgctggccaacatgg

SEQ ID NO: 160858 - DNA, 20 bp, Artificial Sequence
  Description of Artificial Sequence: Synthetic oligonucleotide
  Target: ATXN1; (-) strand; PAM type: YTN; PAM sequence: CTA
ttccactctgctggccaaca

SEQ ID NO: 160859 - DNA, 20 bp, Artificial Sequence
  Description of Artificial Sequence: Synthetic oligonucleotide
  Target: ATXN1; (-) strand; PAM type: YTN; PAM sequence: CTG
gaggcctattccactctgct

SEQ ID NO: 160860 - DNA, 20 bp, Artificial Sequence
  Description of Artificial Sequence: Synthetic oligonucleotide
  Target: ATXN1; (-) strand; PAM type: YTN; PAM sequence: CTC
ccagctggaggcctattcca

SEQ ID NO: 160861 - DNA, 20 bp, Artificial Sequence
  Description of Artificial Sequence: Synthetic oligonucleotide
  Target: ATXN1; (-) strand; PAM type: YTN; PAM sequence: CTC
catcccagcgctcccagctg

SEQ ID NO: 160862 - DNA, 20 bp, Artificial Sequence
  Description of Artificial Sequence: Synthetic oligonucleotide
  Target: ATXN1; (-) strand; PAM type: YTN; PAM sequence: CTC
ggccgcaggggccaccactc

SEQ ID NO: 160863 - DNA, 20 bp, Artificial Sequence
  Description of Artificial Sequence: Synthetic oligonucleotide
  Target: ATXN1; (-) strand; PAM type: YTN; PAM sequence: CTG
atccccccaaccgccaaccc

SEQ ID NO: 160864 - DNA, 20 bp, Artificial Sequence
  Description of Artificial Sequence: Synthetic oligonucleotide
  Target: ATXN1; (-) strand; PAM type: YTN; PAM sequence: TTC
atcccatcacagctgatccc

SEQ ID NO: 160865 - DNA, 20 bp, Artificial Sequence
  Description of Artificial Sequence: Synthetic oligonucleotide
  Target: ATXN1; (-) strand; PAM type: YTN; PAM sequence: CTT
catcccatcacagctgatcc

SEQ ID NO: 160866 - DNA, 20 bp, Artificial Sequence
  Description of Artificial Sequence: Synthetic oligonucleotide
  Target: ATXN1; (-) strand; PAM type: YTN; PAM sequence: CTA
tgccagcttcatcccatcac

SEQ ID NO: 160867 - DNA, 20 bp, Artificial Sequence
  Description of Artificial Sequence: Synthetic oligonucleotide
  Target: ATXN1; (-) strand; PAM type: YTN; PAM sequence: CTC
ccaatacagtggaacctatg

SEQ ID NO: 160868 - DNA, 20 bp, Artificial Sequence
  Description of Artificial Sequence: Synthetic oligonucleotide
  Target: ATXN1; (-) strand; PAM type: YTN; PAM sequence: TTG
ggtcctcccaatacagtgga

SEQ ID NO: 160869 - DNA, 20 bp, Artificial Sequence
  Description of Artificial Sequence: Synthetic oligonucleotide
  Target: ATXN1; (-) strand; PAM type: YTN; PAM sequence: TTC
attgggtcctcccaatacag

SEQ ID NO: 160870 - DNA, 20 bp, Artificial Sequence
  Description of Artificial Sequence: Synthetic oligonucleotide
  Target: ATXN1; (-) strand; PAM type: YTN; PAM sequence: TTC
cagttcattgggtcctccca

SEQ ID NO: 160871 - DNA, 20 bp, Artificial Sequence
  Description of Artificial Sequence: Synthetic oligonucleotide
  Target: ATXN1; (-) strand; PAM type: YTN; PAM sequence: CTT
ccagttcattgggtcctccc

SEQ ID NO: 160872 - DNA, 20 bp, Artificial Sequence
  Description of Artificial Sequence: Synthetic oligonucleotide
  Target: ATXN1; (-) strand; PAM type: YTN; PAM sequence: CTG
ccgcacaccttccagttcat

SEQ ID NO: 160873 - DNA, 20 bp, Artificial Sequence
  Description of Artificial Sequence: Synthetic oligonucleotide
  Target: ATXN1; (-) strand; PAM type: YTN; PAM sequence: CTC
acctgccgcacaccttccag

SEQ ID NO: 160874 - DNA, 20 bp, Artificial Sequence
  Description of Artificial Sequence: Synthetic oligonucleotide
  Target: ATXN1; (-) strand; PAM type: YTN; PAM sequence: CTG
ccgcgtacgccaccccgcag

SEQ ID NO: 160875 - DNA, 20 bp, Artificial Sequence
  Description of Artificial Sequence: Synthetic oligonucleotide
  Target: ATXN1; (-) strand; PAM type: YTN; PAM sequence: CTG
cctgccgcgtacgccacccc

SEQ ID NO: 160876 - DNA, 20 bp, Artificial Sequence
  Description of Artificial Sequence: Synthetic oligonucleotide
  Target: ATXN1; (-) strand; PAM type: YTN; PAM sequence: CTG
tccccgtggccaccacgctg

SEQ ID NO: 160877 - DNA, 20 bp, Artificial Sequence
  Description of Artificial Sequence: Synthetic oligonucleotide
  Target: ATXN1; (-) strand; PAM type: YTN; PAM sequence: CTC
ccaggtctgtccccgtggcc

SEQ ID NO: 160878 - DNA, 20 bp, Artificial Sequence
  Description of Artificial Sequence: Synthetic oligonucleotide
  Target: ATXN1; (-) strand; PAM type: YTN; PAM sequence: CTC
cccgcccagcgctcccaggt

SEQ ID NO: 160879 - DNA, 20 bp, Artificial Sequence
  Description of Artificial Sequence: Synthetic oligonucleotide
  Target: ATXN1; (-) strand; PAM type: YTN; PAM sequence: CTA
ctccccgcccagcgctccca

SEQ ID NO: 160880 - DNA, 20 bp, Artificial Sequence
  Description of Artificial Sequence: Synthetic oligonucleotide
  Target: ATXN1; (-) strand; PAM type: YTN; PAM sequence: CTG
gactactccccgcccagcgc

SEQ ID NO: 160881 - DNA, 20 bp, Artificial Sequence
  Description of Artificial Sequence: Synthetic oligonucleotide
  Target: ATXN1; (-) strand; PAM type: YTN; PAM sequence: TTG
tccacagggctggactactc

SEQ ID NO: 160882 - DNA, 20 bp, Artificial Sequence
  Description of Artificial Sequence: Synthetic oligonucleotide
  Target: ATXN1; (-) strand; PAM type: YTN; PAM sequence: TTA
cacaaagcattgtccacagg

SEQ ID NO: 160883 - DNA, 20 bp, Artificial Sequence
  Description of Artificial Sequence: Synthetic oligonucleotide
  Target: ATXN1; (-) strand; PAM type: YTN; PAM sequence: TTT
acacaaagcattgtccacag

SEQ ID NO: 160884 - DNA, 20 bp, Artificial Sequence
  Description of Artificial Sequence: Synthetic oligonucleotide
  Target: ATXN1; (-) strand; PAM type: YTN; PAM sequence: TTA
caacagggaataggtttaca

SEQ ID NO: 160885 - DNA, 20 bp, Artificial Sequence
  Description of Artificial Sequence: Synthetic oligonucleotide
  Target: ATXN1; (-) strand; PAM type: YTN; PAM sequence: TTT
acaacagggaataggtttac

SEQ ID NO: 160886 - DNA, 20 bp, Artificial Sequence
  Description of Artificial Sequence: Synthetic oligonucleotide
  Target: ATXN1; (-) strand; PAM type: YTN; PAM sequence: TTG
gtttacaacagggaataggt

SEQ ID NO: 160887 - DNA, 20 bp, Artificial Sequence
  Description of Artificial Sequence: Synthetic oligonucleotide
  Target: ATXN1; (-) strand; PAM type: YTN; PAM sequence: CTT
ggtttacaacagggaatagg

SEQ ID NO: 160888 - DNA, 20 bp, Artificial Sequence
  Description of Artificial Sequence: Synthetic oligonucleotide
  Target: ATXN1; (-) strand; PAM type: YTN; PAM sequence: CTC
ggtggagcttggtttacaac

SEQ ID NO: 160889 - DNA, 20 bp, Artificial Sequence
  Description of Artificial Sequence: Synthetic oligonucleotide
  Target: ATXN1; (-) strand; PAM type: YTN; PAM sequence: CTG
gtggccggggccacgggggc

SEQ ID NO: 160890 - DNA, 20 bp, Artificial Sequence
  Description of Artificial Sequence: Synthetic oligonucleotide
  Target: ATXN1; (-) strand; PAM type: YTN; PAM sequence: CTC
ccgggcaaccctggtggccg

SEQ ID NO: 160891 - DNA, 20 bp, Artificial Sequence
  Description of Artificial Sequence: Synthetic oligonucleotide
  Target: ATXN1; (-) strand; PAM type: YTN; PAM sequence: CTG
cccagcgacaaccaccgggt

SEQ ID NO: 160892 - DNA, 20 bp, Artificial Sequence
  Description of Artificial Sequence: Synthetic oligonucleotide
  Target: ATXN1; (-) strand; PAM type: YTN; PAM sequence: CTA
ccctgcccagcgacaaccac

SEQ ID NO: 160893 - DNA, 20 bp, Artificial Sequence
  Description of Artificial Sequence: Synthetic oligonucleotide
  Target: ATXN1; (-) strand; PAM type: YTN; PAM sequence: CTC
cgaggagaaggcccctaccc

SEQ ID NO: 160894 - DNA, 20 bp, Artificial Sequence
  Description of Artificial Sequence: Synthetic oligonucleotide
  Target: ATXN1; (-) strand; PAM type: YTN; PAM sequence: CTC
ccaagaagcgcgagatcccc

SEQ ID NO: 160895 - DNA, 20 bp, Artificial Sequence
  Description of Artificial Sequence: Synthetic oligonucleotide
  Target: ATXN1; (-) strand; PAM type: YTN; PAM sequence: CTG
cctcccaagaagcgcgagat

SEQ ID NO: 160896 - DNA, 20 bp, Artificial Sequence
  Description of Artificial Sequence: Synthetic oligonucleotide
  Target: ATXN1; (-) strand; PAM type: YTN; PAM sequence: CTA
aaatcagagccatccagaca

SEQ ID NO: 160897 - DNA, 20 bp, Artificial Sequence
  Description of Artificial Sequence: Synthetic oligonucleotide
  Target: ATXN1; (-) strand; PAM type: YTN; PAM sequence: TTA
tcagactaaaatcagagcca

SEQ ID NO: 160898 - DNA, 20 bp, Artificial Sequence
  Description of Artificial Sequence: Synthetic oligonucleotide
  Target: ATXN1; (-) strand; PAM type: YTN; PAM sequence: TTT
atcagactaaaatcagagcc

SEQ ID NO: 160899 - DNA, 20 bp, Artificial Sequence
  Description of Artificial Sequence: Synthetic oligonucleotide
  Target: ATXN1; (-) strand; PAM type: YTN; PAM sequence: TTC
cgtttatcagactaaaatca

SEQ ID NO: 160900 - DNA, 20 bp, Artificial Sequence
  Description of Artificial Sequence: Synthetic oligonucleotide
  Target: ATXN1; (-) strand; PAM type: YTN; PAM sequence: TTT
ccgtttatcagactaaaatc

SEQ ID NO: 160901 - DNA, 20 bp, Artificial Sequence
  Description of Artificial Sequence: Synthetic oligonucleotide
  Target: ATXN1; (-) strand; PAM type: YTN; PAM sequence: CTT
tccgtttatcagactaaaat

SEQ ID NO: 160902 - DNA, 20 bp, Artificial Sequence
  Description of Artificial Sequence: Synthetic oligonucleotide
  Target: ATXN1; (-) strand; PAM type: YTN; PAM sequence: CTA
cagaaatcaaatgtgacttt

SEQ ID NO: 160903 - DNA, 20 bp, Artificial Sequence
  Description of Artificial Sequence: Synthetic oligonucleotide
  Target: ATXN1; (-) strand; PAM type: YTN; PAM sequence: CTG
gatcccctacagaaatcaaa

SEQ ID NO: 160904 - DNA, 20 bp, Artificial Sequence
  Description of Artificial Sequence: Synthetic oligonucleotide
  Target: ATXN1; (-) strand; PAM type: YTN; PAM sequence: CTC
atgaagagcctggatcccct

SEQ ID NO: 160905 - DNA, 20 bp, Artificial Sequence
  Description of Artificial Sequence: Synthetic oligonucleotide
  Target: ATXN1; (-) strand; PAM type: YTN; PAM sequence: TTC
ctcatgaagagcctggatcc

SEQ ID NO: 160906 - DNA, 20 bp, Artificial Sequence
  Description of Artificial Sequence: Synthetic oligonucleotide
  Target: ATXN1; (-) strand; PAM type: YTN; PAM sequence: TTG
tacccacggggagatgattc

SEQ ID NO: 160907 - DNA, 20 bp, Artificial Sequence
  Description of Artificial Sequence: Synthetic oligonucleotide
  Target: ATXN1; (-) strand; PAM type: YTN; PAM sequence: TTG
gcggattgtacccacgggga

SEQ ID NO: 160908 - DNA, 20 bp, Artificial Sequence
  Description of Artificial Sequence: Synthetic oligonucleotide
  Target: ATXN1; (-) strand; PAM type: YTN; PAM sequence: CTG
ttggcggattgtacccacgg

SEQ ID NO: 160909 - DNA, 20 bp, Artificial Sequence
  Description of Artificial Sequence: Synthetic oligonucleotide
  Target: ATXN1; (-) strand; PAM type: YTN; PAM sequence: CTG
ctgttggcggattgtaccca

SEQ ID NO: 160910 - DNA, 20 bp, Artificial Sequence
  Description of Artificial Sequence: Synthetic oligonucleotide
  Target: ATXN1; (-) strand; PAM type: YTN; PAM sequence: TTC
ccagcatccagagctgctgt

SEQ ID NO: 160911 - DNA, 20 bp, Artificial Sequence
  Description of Artificial Sequence: Synthetic oligonucleotide
  Target: ATXN1; (-) strand; PAM type: YTN; PAM sequence: TTT
cccagcatccagagctgctg

SEQ ID NO: 160912 - DNA, 20 bp, Artificial Sequence
  Description of Artificial Sequence: Synthetic oligonucleotide
  Target: ATXN1; (-) strand; PAM type: YTN; PAM sequence: CTT
tcccagcatccagagctgct

SEQ ID NO: 160913 - DNA, 20 bp, Artificial Sequence
  Description of Artificial Sequence: Synthetic oligonucleotide
  Target: ATXN1; (-) strand; PAM type: YTN; PAM sequence: TTC
cctttcccagcatccagagc

SEQ ID NO: 160914 - DNA, 20 bp, Artificial Sequence
  Description of Artificial Sequence: Synthetic oligonucleotide
  Target: ATXN1; (-) strand; PAM type: YTN; PAM sequence: CTT
ccctttcccagcatccagag

SEQ ID NO: 160915 - DNA, 20 bp, Artificial Sequence
  Description of Artificial Sequence: Synthetic oligonucleotide
  Target: ATXN1; (-) strand; PAM type: YTN; PAM sequence: CTC
ttccctttcccagcatccag

SEQ ID NO: 160916 - DNA, 20 bp, Artificial Sequence
  Description of Artificial Sequence: Synthetic oligonucleotide
  Target: ATXN1; (-) strand; PAM type: YTN; PAM sequence: CTG
ccctcttccctttcccagca

SEQ ID NO: 160917 - DNA, 20 bp, Artificial Sequence
  Description of Artificial Sequence: Synthetic oligonucleotide
  Target: ATXN1; (-) strand; PAM type: YTN; PAM sequence: TTG
tcactgccctcttccctttc

SEQ ID NO: 160918 - DNA, 20 bp, Artificial Sequence
  Description of Artificial Sequence: Synthetic oligonucleotide
  Target: ATXN1; (-) strand; PAM type: YTN; PAM sequence: TTT
gtcactgccctcttcccttt

SEQ ID NO: 160919 - DNA, 20 bp, Artificial Sequence
  Description of Artificial Sequence: Synthetic oligonucleotide
  Target: ATXN1; (-) strand; PAM type: YTN; PAM sequence: CTT
tgtcactgccctcttccctt

SEQ ID NO: 160920 - DNA, 20 bp, Artificial Sequence
  Description of Artificial Sequence: Synthetic oligonucleotide
  Target: ATXN1; (-) strand; PAM type: YTN; PAM sequence: TTC
cctttgtcactgccctcttc

SEQ ID NO: 160921 - DNA, 20 bp, Artificial Sequence
  Description of Artificial Sequence: Synthetic oligonucleotide
  Target: ATXN1; (-) strand; PAM type: YTN; PAM sequence: TTT
ccctttgtcactgccctctt

SEQ ID NO: 160922 - DNA, 20 bp, Artificial Sequence
  Description of Artificial Sequence: Synthetic oligonucleotide
  Target: ATXN1; (-) strand; PAM type: YTN; PAM sequence: TTT
tccctttgtcactgccctct

SEQ ID NO: 160923 - DNA, 20 bp, Artificial Sequence
  Description of Artificial Sequence: Synthetic oligonucleotide
  Target: ATXN1; (-) strand; PAM type: YTN; PAM sequence: CTT
ttccctttgtcactgccctc

SEQ ID NO: 160924 - DNA, 20 bp, Artificial Sequence
  Description of Artificial Sequence: Synthetic oligonucleotide
  Target: ATXN1; (-) strand; PAM type: YTN; PAM sequence: TTC
cttttccctttgtcactgcc

SEQ ID NO: 160925 - DNA, 20 bp, Artificial Sequence
  Description of Artificial Sequence: Synthetic oligonucleotide
  Target: ATXN1; (-) strand; PAM type: YTN; PAM sequence: TTT
ccttttccctttgtcactgc

SEQ ID NO: 160926 - DNA, 20 bp, Artificial Sequence
  Description of Artificial Sequence: Synthetic oligonucleotide
  Target: ATXN1; (-) strand; PAM type: YTN; PAM sequence: CTT
tccttttccctttgtcactg

SEQ ID NO: 160927 - DNA, 20 bp, Artificial Sequence
  Description of Artificial Sequence: Synthetic oligonucleotide
  Target: ATXN1; (-) strand; PAM type: YTN; PAM sequence: CTC
cctttccttttccctttgtc

SEQ ID NO: 160928 - DNA, 20 bp, Artificial Sequence
  Description of Artificial Sequence: Synthetic oligonucleotide
  Target: ATXN1; (-) strand; PAM type: YTN; PAM sequence: CTC
ctccctttccttttcccttt

SEQ ID NO: 160929 - DNA, 20 bp, Artificial Sequence
  Description of Artificial Sequence: Synthetic oligonucleotide
  Target: ATXN1; (-) strand; PAM type: YTN; PAM sequence: TTC
tcctccctttccttttccct

SEQ ID NO: 160930 - DNA, 20 bp, Artificial Sequence
  Description of Artificial Sequence: Synthetic oligonucleotide
  Target: ATXN1; (-) strand; PAM type: YTN; PAM sequence: TTT
ctcctccctttccttttccc

SEQ ID NO: 160931 - DNA, 20 bp, Artificial Sequence
  Description of Artificial Sequence: Synthetic oligonucleotide
  Target: ATXN1; (-) strand; PAM type: YTN; PAM sequence: CTT
tctcctccctttccttttcc

SEQ ID NO: 160932 - DNA, 20 bp, Artificial Sequence
  Description of Artificial Sequence: Synthetic oligonucleotide
  Target: ATXN1; (-) strand; PAM type: YTN; PAM sequence: TTC
cctttctcctccctttcctt

SEQ ID NO: 160933 - DNA, 20 bp, Artificial Sequence
  Description of Artificial Sequence: Synthetic oligonucleotide
  Target: ATXN1; (-) strand; PAM type: YTN; PAM sequence: CTT
ccctttctcctccctttcct

SEQ ID NO: 160934 - DNA, 20 bp, Artificial Sequence
  Description of Artificial Sequence: Synthetic oligonucleotide
  Target: ATXN1; (-) strand; PAM type: YTN; PAM sequence: CTC
cttccctttctcctcccttt

SEQ ID NO: 160935 - DNA, 20 bp, Artificial Sequence
  Description of Artificial Sequence: Synthetic oligonucleotide
  Target: ATXN1; (-) strand; PAM type: YTN; PAM sequence: TTC
cctccttccctttctcctcc

SEQ ID NO: 160936 - DNA, 20 bp, Artificial Sequence
  Description of Artificial Sequence: Synthetic oligonucleotide
  Target: ATXN1; (-) strand; PAM type: YTN; PAM sequence: TTT
ccctccttccctttctcctc

SEQ ID NO: 160937 - DNA, 20 bp, Artificial Sequence
  Description of Artificial Sequence: Synthetic oligonucleotide
  Target: ATXN1; (-) strand; PAM type: YTN; PAM sequence: CTT
tccctccttccctttctcct

SEQ ID NO: 160938 - DNA, 20 bp, Artificial Sequence
  Description of Artificial Sequence: Synthetic oligonucleotide
  Target: ATXN1; (-) strand; PAM type: YTN; PAM sequence: CTG
atgtcctttccctccttccc

SEQ ID NO: 160939 - DNA, 20 bp, Artificial Sequence
  Description of Artificial Sequence: Synthetic oligonucleotide
  Target: ATXN1; (-) strand; PAM type: YTN; PAM sequence: TTC
tgatgtcctttccctccttc

SEQ ID NO: 160940 - DNA, 20 bp, Artificial Sequence
  Description of Artificial Sequence: Synthetic oligonucleotide
  Target: ATXN1; (-) strand; PAM type: YTN; PAM sequence: CTC
atgttctgatgtcctttccc

SEQ ID NO: 160941 - DNA, 20 bp, Artificial Sequence
  Description of Artificial Sequence: Synthetic oligonucleotide
  Target: ATXN1; (-) strand; PAM type: YTN; PAM sequence: TTC
cccggtgctcatgttctgat

SEQ ID NO: 160942 - DNA, 20 bp, Artificial Sequence
  Description of Artificial Sequence: Synthetic oligonucleotide
  Target: ATXN1; (-) strand; PAM type: YTN; PAM sequence: TTT
ccccggtgctcatgttctga

SEQ ID NO: 160943 - DNA, 20 bp, Artificial Sequence
  Description of Artificial Sequence: Synthetic oligonucleotide
  Target: ATXN1; (-) strand; PAM type: YTN; PAM sequence: CTT
tccccggtgctcatgttctg

SEQ ID NO: 160944 - DNA, 20 bp, Artificial Sequence
  Description of Artificial Sequence: Synthetic oligonucleotide
  Target: ATXN1; (-) strand; PAM type: YTN; PAM sequence: TTC
tttccccggtgctcatgttc

SEQ ID NO: 160945 - DNA, 20 bp, Artificial Sequence
  Description of Artificial Sequence: Synthetic oligonucleotide
  Target: ATXN1; (-) strand; PAM type: YTN; PAM sequence: TTG
ccaaagatgttctttccccg

SEQ ID NO: 160946 - DNA, 20 bp, Artificial Sequence
  Description of Artificial Sequence: Synthetic oligonucleotide
  Target: ATXN1; (-) strand; PAM type: YTN; PAM sequence: CTT
gccaaagatgttctttcccc

SEQ ID NO: 160947 - DNA, 20 bp, Artificial Sequence
  Description of Artificial Sequence: Synthetic oligonucleotide
  Target: ATXN1; (-) strand; PAM type: YTN; PAM sequence: TTA
atcttgccaaagatgttctt

SEQ ID NO: 160948 - DNA, 20 bp, Artificial Sequence
  Description of Artificial Sequence: Synthetic oligonucleotide
  Target: ATXN1; (-) strand; PAM type: YTN; PAM sequence: CTT
aatcttgccaaagatgttct

SEQ ID NO: 160949 - DNA, 20 bp, Artificial Sequence
  Description of Artificial Sequence: Synthetic oligonucleotide
  Target: ATXN1; (-) strand; PAM type: YTN; PAM sequence: CTA
gtcttaatcttgccaaagat

SEQ ID NO: 160950 - DNA, 20 bp, Artificial Sequence
  Description of Artificial Sequence: Synthetic oligonucleotide
  Target: ATXN1; (-) strand; PAM type: YTN; PAM sequence: TTC
acaccgagtccagggcctag

SEQ ID NO: 160951 - DNA, 20 bp, Artificial Sequence
  Description of Artificial Sequence: Synthetic oligonucleotide
  Target: ATXN1; (-) strand; PAM type: YTN; PAM sequence: TTA
tgggagttcacaccgagtcc

SEQ ID NO: 160952 - DNA, 20 bp, Artificial Sequence
  Description of Artificial Sequence: Synthetic oligonucleotide
  Target: ATXN1; (-) strand; PAM type: YTN; PAM sequence: TTG
ggttatgggagttcacaccg

SEQ ID NO: 160953 - DNA, 20 bp, Artificial Sequence
  Description of Artificial Sequence: Synthetic oligonucleotide
  Target: ATXN1; (-) strand; PAM type: YTN; PAM sequence: TTG
gggtatgattgggttatggg

SEQ ID NO: 160954 - DNA, 20 bp, Artificial Sequence
  Description of Artificial Sequence: Synthetic oligonucleotide
  Target: ATXN1; (-) strand; PAM type: YTN; PAM sequence: CTT
ggggtatgattgggttatgg

SEQ ID NO: 160955 - DNA, 20 bp, Artificial Sequence
  Description of Artificial Sequence: Synthetic oligonucleotide
  Target: ATXN1; (-) strand; PAM type: YTN; PAM sequence: TTC
agtgcttggggtatgattgg

SEQ ID NO: 160956 - DNA, 20 bp, Artificial Sequence
  Description of Artificial Sequence: Synthetic oligonucleotide
  Target: ATXN1; (-) strand; PAM type: YTN; PAM sequence: CTT
cagtgcttggggtatgattg

SEQ ID NO: 160957 - DNA, 20 bp, Artificial Sequence
  Description of Artificial Sequence: Synthetic oligonucleotide
  Target: ATXN1; (-) strand; PAM type: YTN; PAM sequence: CTG
cttcagtgcttggggtatga

SEQ ID NO: 160958 - DNA, 20 bp, Artificial Sequence
  Description of Artificial Sequence: Synthetic oligonucleotide
  Target: ATXN1; (-) strand; PAM type: YTN; PAM sequence: CTC
tgcttcagtgcttggggtat

SEQ ID NO: 160959 - DNA, 20 bp, Artificial Sequence
  Description of Artificial Sequence: Synthetic oligonucleotide
  Target: ATXN1; (-) strand; PAM type: YTN; PAM sequence: TTC
tctgcttcagtgcttggggt

SEQ ID NO: 160960 - DNA, 20 bp, Artificial Sequence
  Description of Artificial Sequence: Synthetic oligonucleotide
  Target: ATXN1; (-) strand; PAM type: YTN; PAM sequence: TTT
ctctgcttcagtgcttgggg

SEQ ID NO: 160961 - DNA, 20 bp, Artificial Sequence
  Description of Artificial Sequence: Synthetic oligonucleotide
  Target: ATXN1; (-) strand; PAM type: YTN; PAM sequence: TTT
tctctgcttcagtgcttggg

SEQ ID NO: 160962 - DNA, 20 bp, Artificial Sequence
  Description of Artificial Sequence: Synthetic oligonucleotide
  Target: ATXN1; (-) strand; PAM type: YTN; PAM sequence: CTA
gtgttttctctgcttcagtg

SEQ ID NO: 160963 - DNA, 20 bp, Artificial Sequence
  Description of Artificial Sequence: Synthetic oligonucleotide
  Target: ATXN1; (-) strand; PAM type: YTN; PAM sequence: TTG
gctagtgttttctctgcttc

SEQ ID NO: 160964 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgttggctagtgtt

SEQ ID NO: 160965 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgttggct

SEQ ID NO: 160966 - DNA, 20 bp, Artificial Sequence
  Description of Artificial Sequence: Synthetic oligonucleotide
  Target: ATXN1; (-) strand; PAM type: YTN; PAM sequence: CTG
cctcggcctcccaaagtgtt

SEQ ID NO: 160967 - DNA, 20 bp, Artificial Sequence
  Description of Artificial Sequence: Synthetic oligonucleotide
  Target: ATXN1; (-) strand; PAM type: YTN; PAM sequence: CTG
cctgcctcggcctcccaaag

SEQ ID NO: 160968 - DNA, 20 bp, Artificial Sequence
  Description of Artificial Sequence: Synthetic oligonucleotide
  Target: ATXN1; (-) strand; PAM type: YTN; PAM sequence: CTC
gtgatctgcctgcctcggcc

SEQ ID NO: 160969 - DNA, 20 bp, Artificial Sequence
  Description of Artificial Sequence: Synthetic oligonucleotide
  Target: ATXN1; (-) strand; PAM type: YTN; PAM sequence: CTG
acctcgtgatctgcctgcct

SEQ ID NO: 160970 - DNA, 20 bp, Artificial Sequence
  Description of Artificial Sequence: Synthetic oligonucleotide
  Target: ATXN1; (-) strand; PAM type: YTN; PAM sequence: CTC
ctgacctcgtgatctgcctg

SEQ ID NO: 160971 - DNA, 20 bp, Artificial Sequence
  Description of Artificial Sequence: Synthetic oligonucleotide
  Target: ATXN1; (-) strand; PAM type: YTN; PAM sequence: TTA
atctcctgacctcgtgatct

SEQ ID NO: 160972 - DNA, 20 bp, Artificial Sequence
  Description of Artificial Sequence: Synthetic oligonucleotide
  Target: ATXN1; (-) strand; PAM type: YTN; PAM sequence: CTT
aatctcctgacctcgtgatc

SEQ ID NO: 160973 - DNA, 20 bp, Artificial Sequence
  Description of Artificial Sequence: Synthetic oligonucleotide
  Target: ATXN1; (-) strand; PAM type: YTN; PAM sequence: TTA
gccaggatggtcttaatctc

SEQ ID NO: 160974 - DNA, 20 bp, Artificial Sequence
  Description of Artificial Sequence: Synthetic oligonucleotide
  Target: ATXN1; (-) strand; PAM type: YTN; PAM sequence: TTC
accatgttagccaggatggt

SEQ ID NO: 160975 - DNA, 20 bp, Artificial Sequence
  Description of Artificial Sequence: Synthetic oligonucleotide
  Target: ATXN1; (-) strand; PAM type: YTN; PAM sequence: TTT
caccatgttagccaggatgg

SEQ ID NO: 160976 - DNA, 20 bp, Artificial Sequence
  Description of Artificial Sequence: Synthetic oligonucleotide
  Target: ATXN1; (-) strand; PAM type: YTN; PAM sequence: TTG
gtagagacggggtttcacca

SEQ ID NO: 160977 - DNA, 20 bp, Artificial Sequence
  Description of Artificial Sequence: Synthetic oligonucleotide
  Target: ATXN1; (-) strand; PAM type: YTN; PAM sequence: TTT
ggtagagacggggtttcacc

SEQ ID NO: 160978 - DNA, 20 bp, Artificial Sequence
  Description of Artificial Sequence: Synthetic oligonucleotide
  Target: ATXN1; (-) strand; PAM type: YTN; PAM sequence: TTT
tggtagagacggggtttcac

SEQ ID NO: 160979 - DNA, 20 bp, Artificial Sequence
  Description of Artificial Sequence: Synthetic oligonucleotide
  Target: ATXN1; (-) strand; PAM type: YTN; PAM sequence: TTT
ttggtagagacggggtttca

SEQ ID NO: 160980 - DNA, 20 bp, Artificial Sequence
  Description of Artificial Sequence: Synthetic oligonucleotide
  Target: ATXN1; (-) strand; PAM type: YTN; PAM sequence: TTA
tttttggtagagacggggtt

SEQ ID NO: 160981 - DNA, 20 bp, Artificial Sequence
  Description of Artificial Sequence: Synthetic oligonucleotide
  Target: ATXN1; (-) strand; PAM type: YTN; PAM sequence: TTT
atttttggtagagacggggt

SEQ ID NO: 160982 - DNA, 20 bp, Artificial Sequence
  Description of Artificial Sequence: Synthetic oligonucleotide
  Target: ATXN1; (-) strand; PAM type: YTN; PAM sequence: TTT
tatttttggtagagacgggg

SEQ ID NO: 160983 - DNA, 20 bp, Artificial Sequence
  Description of Artificial Sequence: Synthetic oligonucleotide
  Target: ATXN1; (-) strand; PAM type: YTN; PAM sequence: TTT
ttatttttggtagagacggg

SEQ ID NO: 160984 - DNA, 20 bp, Artificial Sequence
  Description of Artificial Sequence: Synthetic oligonucleotide
  Target: ATXN1; (-) strand; PAM type: YTN; PAM sequence: TTT
tttatttttggtagagacgg

SEQ ID NO: 160985 - DNA, 20 bp, Artificial Sequence
  Description of Artificial Sequence: Synthetic oligonucleotide
  Target: ATXN1; (-) strand; PAM type: YTN; PAM sequence: TTA
ttttttatttttggtagaga

SEQ ID NO: 160986 - DNA, 20 bp, Artificial Sequence
  Description of Artificial Sequence: Synthetic oligonucleotide
  Target: ATXN1; (-) strand; PAM type: YTN; PAM sequence: TTT
attttttatttttggtagag

SEQ ID NO: 160987 - DNA, 20 bp, Artificial Sequence
  Description of Artificial Sequence: Synthetic oligonucleotide
  Target: ATXN1; (-) strand; PAM type: YTN; PAM sequence: TTT
tattttttatttttggtaga

SEQ ID NO: 160988 - DNA, 20 bp, Artificial Sequence
  Description of Artificial Sequence: Synthetic oligonucleotide
  Target: ATXN1; (-) strand; PAM type: YTN; PAM sequence: TTT
ttattttttatttttggtag

SEQ ID NO: 160989 - DNA, 20 bp, Artificial Sequence
  Description of Artificial Sequence: Synthetic oligonucleotide
  Target: ATXN1; (-) strand; PAM type: YTN; PAM sequence: TTT
tttattttttatttttggta

SEQ ID NO: 160990 - DNA, 20 bp, Artificial Sequence
  Description of Artificial Sequence: Synthetic oligonucleotide
  Target: ATXN1; (-) strand; PAM type: YTN; PAM sequence: TTG
ttttttattttttatttttg

SEQ ID NO: 160991 - DNA, 20 bp, Artificial Sequence
  Description of Artificial Sequence: Synthetic oligonucleotide
  Target: ATXN1; (-) strand; PAM type: YTN; PAM sequence: TTT
gttttttattttttattttt

SEQ ID NO: 160992 - DNA, 20 bp, Artificial Sequence
  Description of Artificial Sequence: Synthetic oligonucleotide
  Target: ATXN1; (-) strand; PAM type: YTN; PAM sequence: CTA
aatttgttttttatttttta

SEQ ID NO: 160993 - DNA, 20 bp, Artificial Sequence
  Description of Artificial Sequence: Synthetic oligonucleotide
  Target: ATXN1; (-) strand; PAM type: YTN; PAM sequence: TTA
caccaggctaaatttgtttt

SEQ ID NO: 160994 - DNA, 20 bp, Artificial Sequence
  Description of Artificial Sequence: Synthetic oligonucleotide
  Target: ATXN1; (-) strand; PAM type: YTN; PAM sequence: CTA
atgttacaccaggctaaatt

SEQ ID NO: 160995 - DNA, 20 bp, Artificial Sequence
  Description of Artificial Sequence: Synthetic oligonucleotide
  Target: ATXN1; (-) strand; PAM type: YTN; PAM sequence: CTA
cagccgtgtgccagctaatg

SEQ ID NO: 160996 - DNA, 20 bp, Artificial Sequence
  Description of Artificial Sequence: Synthetic oligonucleotide
  Target: ATXN1; (-) strand; PAM type: YTN; PAM sequence: CTG
ggactacagccgtgtgccag

SEQ ID NO: 160997 - DNA, 20 bp, Artificial Sequence
  Description of Artificial Sequence: Synthetic oligonucleotide
  Target: ATXN1; (-) strand; PAM type: YTN; PAM sequence: CTC
aagtagctgggactacagcc

SEQ ID NO: 160998 - DNA, 20 bp, Artificial Sequence
  Description of Artificial Sequence: Synthetic oligonucleotide
  Target: ATXN1; (-) strand; PAM type: YTN; PAM sequence: CTC
tcaagtagctgggactacag

SEQ ID NO: 160999 - DNA, 20 bp, Artificial Sequence
  Description of Artificial Sequence: Synthetic oligonucleotide
  Target: ATXN1; (-) strand; PAM type: YTN; PAM sequence: CTC
agcctctcaagtagctggga

SEQ ID NO: 161000 - DNA, 20 bp, Artificial Sequence
  Description of Artificial Sequence: Synthetic oligonucleotide
  Target: ATXN1; (-) strand; PAM type: YTN; PAM sequence: CTG
cctcagcctctcaagtagct

SEQ ID NO: 161001 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctctcaagta

SEQ ID NO: 161002 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctctcaag

SEQ ID NO: 161003 - DNA, 20 bp, Artificial Sequence
  Description of Artificial Sequence: Synthetic oligonucleotide
  Target: ATXN1; (-) strand; PAM type: YTN; PAM sequence: TTC
aagcaattctcctgcctcag

SEQ ID NO: 161004 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcaattctcctgc

SEQ ID NO: 161005 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagcaattctcc

SEQ ID NO: 161006 - DNA, 20 bp, Artificial Sequence
  Description of Artificial Sequence: Synthetic oligonucleotide
  Target: ATXN1; (-) strand; PAM type: YTN; PAM sequence: CTG
cctcctgggttcaagcaatt

SEQ ID NO: 161007 - DNA, 20 bp, Artificial Sequence
  Description of Artificial Sequence: Synthetic oligonucleotide
  Target: ATXN1; (-) strand; PAM type: YTN; PAM sequence: CTC
tgcctcctgggttcaagcaa

SEQ ID NO: 161008 - DNA, 20 bp, Artificial Sequence
  Description of Artificial Sequence: Synthetic oligonucleotide
  Target: ATXN1; (-) strand; PAM type: YTN; PAM sequence: CTG
caacctctgcctcctgggtt

SEQ ID NO: 161009 - DNA, 20 bp, Artificial Sequence
  Description of Artificial Sequence: Synthetic oligonucleotide
  Target: ATXN1; (-) strand; PAM type: YTN; PAM sequence: CTC
actgcaacctctgcctcctg

SEQ ID NO: 161010 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctctgcc

SEQ ID NO: 161011 - DNA, 20 bp, Artificial Sequence
  Description of Artificial Sequence: Synthetic oligonucleotide
  Target: ATXN1; (-) strand; PAM type: YTN; PAM sequence: CTG
gagtacaatggtgcaatctc

SEQ ID NO: 161012 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtacaatgg

SEQ ID NO: 161013 - DNA, 20 bp, Artificial Sequence
  Description of Artificial Sequence: Synthetic oligonucleotide
  Target: ATXN1; (-) strand; PAM type: YTN; PAM sequence: CTG
ttgcccaggctggagtacaa

SEQ ID NO: 161014 - DNA, 20 bp, Artificial Sequence
  Description of Artificial Sequence: Synthetic oligonucleotide
  Target: ATXN1; (-) strand; PAM type: YTN; PAM sequence: CTC
tgttgcccaggctggagtac

SEQ ID NO: 161015 - DNA, 20 bp, Artificial Sequence
  Description of Artificial Sequence: Synthetic oligonucleotide
  Target: ATXN1; (-) strand; PAM type: YTN; PAM sequence: TTG
gagacagagtgtcgctctgt

SEQ ID NO: 161016 - DNA, 20 bp, Artificial Sequence
  Description of Artificial Sequence: Synthetic oligonucleotide
  Target: ATXN1; (-) strand; PAM type: YTN; PAM sequence: TTT
ggagacagagtgtcgctctg

SEQ ID NO: 161017 - DNA, 20 bp, Artificial Sequence
  Description of Artificial Sequence: Synthetic oligonucleotide
  Target: ATXN1; (-) strand; PAM type: YTN; PAM sequence: TTT
tggagacagagtgtcgctct

SEQ ID NO: 161018 - DNA, 20 bp, Artificial Sequence
  Description of Artificial Sequence: Synthetic oligonucleotide
  Target: ATXN1; (-) strand; PAM type: YTN; PAM sequence: TTT
ttggagacagagtgtcgctc

SEQ ID NO: 161019 - DNA, 20 bp, Artificial Sequence
  Description of Artificial Sequence: Synthetic oligonucleotide
  Target: ATXN1; (-) strand; PAM type: YTN; PAM sequence: TTC
gtttttggagacagagtgtc

SEQ ID NO: 161020 - DNA, 20 bp, Artificial Sequence
  Description of Artificial Sequence: Synthetic oligonucleotide
  Target: ATXN1; (-) strand; PAM type: YTN; PAM sequence: TTT
cgtttttggagacagagtgt

SEQ ID NO: 161021 - DNA, 20 bp, Artificial Sequence
  Description of Artificial Sequence: Synthetic oligonucleotide
  Target: ATXN1; (-) strand; PAM type: YTN; PAM sequence: TTG
tttcgtttttggagacagag

SEQ ID NO: 161022 - DNA, 20 bp, Artificial Sequence
  Description of Artificial Sequence: Synthetic oligonucleotide
  Target: ATXN1; (-) strand; PAM type: YTN; PAM sequence: TTT
gtttcgtttttggagacaga

SEQ ID NO: 161023 - DNA, 20 bp, Artificial Sequence
  Description of Artificial Sequence: Synthetic oligonucleotide
  Target: ATXN1; (-) strand; PAM type: YTN; PAM sequence: TTT
tgtttcgtttttggagacag

SEQ ID NO: 161024 - DNA, 20 bp, Artificial Sequence
  Description of Artificial Sequence: Synthetic oligonucleotide
  Target: ATXN1; (-) strand; PAM type: YTN; PAM sequence: TTG
ttttgtttcgtttttggaga

SEQ ID NO: 161025 - DNA, 20 bp, Artificial Sequence
  Description of Artificial Sequence: Synthetic oligonucleotide
  Target: ATXN1; (-) strand; PAM type: YTN; PAM sequence: TTG
ttgttttgtttcgtttttgg

SEQ ID NO: 161026 - DNA, 20 bp, Artificial Sequence
  Description of Artificial Sequence: Synthetic oligonucleotide
  Target: ATXN1; (-) strand; PAM type: YTN; PAM sequence: TTG
ttgttgttttgtttcgtttt

SEQ ID NO: 161027 - DNA, 20 bp, Artificial Sequence
  Description of Artificial Sequence: Synthetic oligonucleotide
  Target: ATXN1; (-) strand; PAM type: YTN; PAM sequence: TTG
ttgttgttgttttgtttcgt

SEQ ID NO: 161028 - DNA, 20 bp, Artificial Sequence
  Description of Artificial Sequence: Synthetic oligonucleotide
  Target: ATXN1; (-) strand; PAM type: YTN; PAM sequence: TTT
gttgttgttgttttgtttcg

SEQ ID NO: 161029 - DNA, 20 bp, Artificial Sequence
  Description of Artificial Sequence: Synthetic oligonucleotide
  Target: ATXN1; (-) strand; PAM type: YTN; PAM sequence: TTT
tgttgttgttgttttgtttc

SEQ ID NO: 161030 - DNA, 20 bp, Artificial Sequence
  Description of Artificial Sequence: Synthetic oligonucleotide
  Target: ATXN1; (-) strand; PAM type: YTN; PAM sequence: TTT
ttgttgttgttgttttgttt

SEQ ID NO: 161031 - DNA, 20 bp, Artificial Sequence
  Description of Artificial Sequence: Synthetic oligonucleotide
  Target: ATXN1; (-) strand; PAM type: YTN; PAM sequence: TTG
tttttgttgttgttgttttg

SEQ ID NO: 161032 - DNA, 20 bp, Artificial Sequence
  Description of Artificial Sequence: Synthetic oligonucleotide
  Target: ATXN1; (-) strand; PAM type: YTN; PAM sequence: TTT
gtttttgttgttgttgtttt

SEQ ID NO: 161033 - DNA, 20 bp, Artificial Sequence
  Description of Artificial Sequence: Synthetic oligonucleotide
  Target: ATXN1; (-) strand; PAM type: YTN; PAM sequence: TTT
tgtttttgttgttgttgttt

SEQ ID NO: 161034 - DNA, 20 bp, Artificial Sequence
  Description of Artificial Sequence: Synthetic oligonucleotide
  Target: ATXN1; (-) strand; PAM type: YTN; PAM sequence: TTT
ttgtttttgttgttgttgtt

SEQ ID NO: 161035 - DNA, 20 bp, Artificial Sequence
  Description of Artificial Sequence: Synthetic oligonucleotide
  Target: ATXN1; (-) strand; PAM type: YTN; PAM sequence: CTA
gtgtttttgtttttgttgtt

SEQ ID NO: 161036 - DNA, 20 bp, Artificial Sequence
  Description of Artificial Sequence: Synthetic oligonucleotide
  Target: ATXN1; (-) strand; PAM type: YTN; PAM sequence: CTG
ccacggctagtgtttttgtt

SEQ ID NO: 161037 - DNA, 20 bp, Artificial Sequence
  Description of Artificial Sequence: Synthetic oligonucleotide
  Target: ATXN1; (-) strand; PAM type: YTN; PAM sequence: TTA
taatgtgcagctgccacggc

SEQ ID NO: 161038 - DNA, 20 bp, Artificial Sequence
  Description of Artificial Sequence: Synthetic oligonucleotide
  Target: ATXN1; (-) strand; PAM type: YTN; PAM sequence: TTT
ataatgtgcagctgccacgg

SEQ ID NO: 161039 - DNA, 20 bp, Artificial Sequence
  Description of Artificial Sequence: Synthetic oligonucleotide
  Target: ATXN1; (-) strand; PAM type: YTN; PAM sequence: CTT
tataatgtgcagctgccacg

SEQ ID NO: 161040 - DNA, 20 bp, Artificial Sequence
  Description of Artificial Sequence: Synthetic oligonucleotide
  Target: ATXN1; (-) strand; PAM type: YTN; PAM sequence: TTC
ctttataatgtgcagctgcc

SEQ ID NO: 161041 - DNA, 20 bp, Artificial Sequence
  Description of Artificial Sequence: Synthetic oligonucleotide
  Target: ATXN1; (-) strand; PAM type: YTN; PAM sequence: CTT
cctttataatgtgcagctgc

SEQ ID NO: 161042 - DNA, 20 bp, Artificial Sequence
  Description of Artificial Sequence: Synthetic oligonucleotide
  Target: ATXN1; (-) strand; PAM type: YTN; PAM sequence: TTC
ataatcttcctttataatgt

SEQ ID NO: 161043 - DNA, 20 bp, Artificial Sequence
  Description of Artificial Sequence: Synthetic oligonucleotide
  Target: ATXN1; (-) strand; PAM type: YTN; PAM sequence: CTT
cataatcttcctttataatg

SEQ ID NO: 161044 - DNA, 20 bp, Artificial Sequence
  Description of Artificial Sequence: Synthetic oligonucleotide
  Target: ATXN1; (-) strand; PAM type: YTN; PAM sequence: TTG
cccagtgtcttcataatctt

SEQ ID NO: 161045 - DNA, 20 bp, Artificial Sequence
  Description of Artificial Sequence: Synthetic oligonucleotide
  Target: ATXN1; (-) strand; PAM type: YTN; PAM sequence: CTT
gcccagtgtcttcataatct

SEQ ID NO: 161046 - DNA, 20 bp, Artificial Sequence
  Description of Artificial Sequence: Synthetic oligonucleotide
  Target: ATXN1; (-) strand; PAM type: YTN; PAM sequence: TTC
acttgcccagtgtcttcata

SEQ ID NO: 161047 - DNA, 20 bp, Artificial Sequence
  Description of Artificial Sequence: Synthetic oligonucleotide
  Target: ATXN1; (-) strand; PAM type: YTN; PAM sequence: TTA
cagtgttcacttgcccagtg

SEQ ID NO: 161048 - DNA, 20 bp, Artificial Sequence
  Description of Artificial Sequence: Synthetic oligonucleotide
  Target: ATXN1; (-) strand; PAM type: YTN; PAM sequence: TTA
aaaaatatatgtgttacagt

SEQ ID NO: 161049 - DNA, 20 bp, Artificial Sequence
  Description of Artificial Sequence: Synthetic oligonucleotide
  Target: ATXN1; (-) strand; PAM type: YTN; PAM sequence: CTC
cattaaaaaatatatgtgtt

SEQ ID NO: 161050 - DNA, 20 bp, Artificial Sequence
  Description of Artificial Sequence: Synthetic oligonucleotide
  Target: ATXN1; (-) strand; PAM type: YTN; PAM sequence: TTA
actccattaaaaaatatatg

SEQ ID NO: 161051 - DNA, 20 bp, Artificial Sequence
  Description of Artificial Sequence: Synthetic oligonucleotide
  Target: ATXN1; (-) strand; PAM type: YTN; PAM sequence: TTG
ttaactccattaaaaaatat

SEQ ID NO: 161052 - DNA, 20 bp, Artificial Sequence
  Description of Artificial Sequence: Synthetic oligonucleotide
  Target: ATXN1; (-) strand; PAM type: YTN; PAM sequence: TTA
ggggagttgttaactccatt

SEQ ID NO: 161053 - DNA, 20 bp, Artificial Sequence
  Description of Artificial Sequence: Synthetic oligonucleotide
  Target: ATXN1; (-) strand; PAM type: YTN; PAM sequence: CTT
aggggagttgttaactccat

SEQ ID NO: 161054 - DNA, 20 bp, Artificial Sequence
  Description of Artificial Sequence: Synthetic oligonucleotide
  Target: ATXN1; (-) strand; PAM type: YTN; PAM sequence: TTG
agaacatcttaggggagttg

SEQ ID NO: 161055 - DNA, 20 bp, Artificial Sequence
  Description of Artificial Sequence: Synthetic oligonucleotide
  Target: ATXN1; (-) strand; PAM type: YTN; PAM sequence: TTG
aagaagaaaaggagaaaaaa

SEQ ID NO: 161056 - DNA, 20 bp, Artificial Sequence
  Description of Artificial Sequence: Synthetic oligonucleotide
  Target: ATXN1; (-) strand; PAM type: YTN; PAM sequence: CTT
gaagaagaaaaggagaaaaa

SEQ ID NO: 161057 - DNA, 20 bp, Artificial Sequence
  Description of Artificial Sequence: Synthetic oligonucleotide
  Target: ATXN1; (-) strand; PAM type: YTN; PAM sequence: CTG
cccttgaagaagaaaaggag

SEQ ID NO: 161058 - DNA, 20 bp, Artificial Sequence
  Description of Artificial Sequence: Synthetic oligonucleotide
  Target: ATXN1; (-) strand; PAM type: YTN; PAM sequence: CTG
catcatctgcccttgaagaa

SEQ ID NO: 161059 - DNA, 20 bp, Artificial Sequence
  Description of Artificial Sequence: Synthetic oligonucleotide
  Target: ATXN1; (-) strand; PAM type: YTN; PAM sequence: TTA
agaactgcatcatctgccct

SEQ ID NO: 161060 - DNA, 20 bp, Artificial Sequence
  Description of Artificial Sequence: Synthetic oligonucleotide
  Target: ATXN1; (-) strand; PAM type: YTN; PAM sequence: TTT
aagaactgcatcatctgccc

SEQ ID NO: 161061 - DNA, 20 bp, Artificial Sequence
  Description of Artificial Sequence: Synthetic oligonucleotide
  Target: ATXN1; (-) strand; PAM type: YTN; PAM sequence: CTG
aaaaggaaatttaagaactg

SEQ ID NO: 161062 - DNA, 20 bp, Artificial Sequence
  Description of Artificial Sequence: Synthetic oligonucleotide
  Target: ATXN1; (-) strand; PAM type: YTN; PAM sequence: TTC
tgaaaaggaaatttaagaac

SEQ ID NO: 161063 - DNA, 20 bp, Artificial Sequence
  Description of Artificial Sequence: Synthetic oligonucleotide
  Target: ATXN1; (-) strand; PAM type: YTN; PAM sequence: TTT
ctgaaaaggaaatttaagaa

SEQ ID NO: 161064 - DNA, 20 bp, Artificial Sequence
  Description of Artificial Sequence: Synthetic oligonucleotide
  Target: ATXN1; (-) strand; PAM type: YTN; PAM sequence: TTC
cagccaggcaaaggagaggt

SEQ ID NO: 161065 - DNA, 20 bp, Artificial Sequence
  Description of Artificial Sequence: Synthetic oligonucleotide
  Target: ATXN1; (-) strand; PAM type: YTN; PAM sequence: TTA
tgttccagccaggcaaagga

SEQ ID NO: 161066 - DNA, 20 bp, Artificial Sequence
  Description of Artificial Sequence: Synthetic oligonucleotide
  Target: ATXN1; (-) strand; PAM type: YTN; PAM sequence: TTT
atgttccagccaggcaaagg

SEQ ID NO: 161067 - DNA, 20 bp, Artificial Sequence
  Description of Artificial Sequence: Synthetic oligonucleotide
  Target: ATXN1; (-) strand; PAM type: YTN; PAM sequence: TTT
tatgttccagccaggcaaag

SEQ ID NO: 161068 - DNA, 20 bp, Artificial Sequence
  Description of Artificial Sequence: Synthetic oligonucleotide
  Target: ATXN1; (-) strand; PAM type: YTN; PAM sequence: TTC
attttatgttccagccaggc

SEQ ID NO: 161069 - DNA, 20 bp, Artificial Sequence
  Description of Artificial Sequence: Synthetic oligonucleotide
  Target: ATXN1; (-) strand; PAM type: YTN; PAM sequence: CTT
cattttatgttccagccagg

SEQ ID NO: 161070 - DNA, 20 bp, Artificial Sequence
  Description of Artificial Sequence: Synthetic oligonucleotide
  Target: ATXN1; (-) strand; PAM type: YTN; PAM sequence: CTC
caagggcttcattttatgtt

SEQ ID NO: 161071 - DNA, 20 bp, Artificial Sequence
  Description of Artificial Sequence: Synthetic oligonucleotide
  Target: ATXN1; (-) strand; PAM type: YTN; PAM sequence: CTC
tccaagggcttcattttatg

SEQ ID NO: 161072 - DNA, 20 bp, Artificial Sequence
  Description of Artificial Sequence: Synthetic oligonucleotide
  Target: ATXN1; (-) strand; PAM type: YTN; PAM sequence: CTG
gtgtcatgctctccaagggc

SEQ ID NO: 161073 - DNA, 20 bp, Artificial Sequence
  Description of Artificial Sequence: Synthetic oligonucleotide
  Target: ATXN1; (-) strand; PAM type: YTN; PAM sequence: CTG
agggcagggtccagctggtg

SEQ ID NO: 161074 - DNA, 20 bp, Artificial Sequence
  Description of Artificial Sequence: Synthetic oligonucleotide
  Target: ATXN1; (-) strand; PAM type: YTN; PAM sequence: CTC
tgagggcagggtccagctgg

SEQ ID NO: 161075 - DNA, 20 bp, Artificial Sequence
  Description of Artificial Sequence: Synthetic oligonucleotide
  Target: ATXN1; (-) strand; PAM type: YTN; PAM sequence: CTG
gctctgagggcagggtccag

SEQ ID NO: 161076 - DNA, 20 bp, Artificial Sequence
  Description of Artificial Sequence: Synthetic oligonucleotide
  Target: ATXN1; (-) strand; PAM type: YTN; PAM sequence: CTC
agtgcctggctctgagggca

SEQ ID NO: 161077 - DNA, 20 bp, Artificial Sequence
  Description of Artificial Sequence: Synthetic oligonucleotide
  Target: ATXN1; (-) strand; PAM type: YTN; PAM sequence: TTC
tcagtgcctggctctgaggg

SEQ ID NO: 161078 - DNA, 20 bp, Artificial Sequence
  Description of Artificial Sequence: Synthetic oligonucleotide
  Target: ATXN1; (-) strand; PAM type: YTN; PAM sequence: TTT
ctcagtgcctggctctgagg

SEQ ID NO: 161079 - DNA, 20 bp, Artificial Sequence
  Description of Artificial Sequence: Synthetic oligonucleotide
  Target: ATXN1; (-) strand; PAM type: YTN; PAM sequence: TTT
tctcagtgcctggctctgag

SEQ ID NO: 161080 - DNA, 20 bp, Artificial Sequence
  Description of Artificial Sequence: Synthetic oligonucleotide
  Target: ATXN1; (-) strand; PAM type: YTN; PAM sequence: TTT
ttctcagtgcctggctctga

SEQ ID NO: 161081 - DNA, 20 bp, Artificial Sequence
  Description of Artificial Sequence: Synthetic oligonucleotide
  Target: ATXN1; (-) strand; PAM type: YTN; PAM sequence: CTT
tttctcagtgcctggctctg

SEQ ID NO: 161082 - DNA, 20 bp, Artificial Sequence
  Description of Artificial Sequence: Synthetic oligonucleotide
  Target: ATXN1; (-) strand; PAM type: YTN; PAM sequence: CTG
ctttttctcagtgcctggct

SEQ ID NO: 161083 - DNA, 20 bp, Artificial Sequence
  Description of Artificial Sequence: Synthetic oligonucleotide
  Target: ATXN1; (-) strand; PAM type: YTN; PAM sequence: CTA
acctgctttttctcagtgcc

SEQ ID NO: 161084 - DNA, 20 bp, Artificial Sequence
  Description of Artificial Sequence: Synthetic oligonucleotide
  Target: ATXN1; (-) strand; PAM type: YTN; PAM sequence: CTG
ctaacctgctttttctcagt

SEQ ID NO: 161085 - DNA, 20 bp, Artificial Sequence
  Description of Artificial Sequence: Synthetic oligonucleotide
  Target: ATXN1; (-) strand; PAM type: YTN; PAM sequence: TTC
actgctaacctgctttttct

SEQ ID NO: 161086 - DNA, 20 bp, Artificial Sequence
  Description of Artificial Sequence: Synthetic oligonucleotide
  Target: ATXN1; (-) strand; PAM type: YTN; PAM sequence: TTT
cactgctaacctgctttttc

SEQ ID NO: 161087 - DNA, 20 bp, Artificial Sequence
  Description of Artificial Sequence: Synthetic oligonucleotide
  Target: ATXN1; (-) strand; PAM type: YTN; PAM sequence: CTT
tcactgctaacctgcttttt

SEQ ID NO: 161088 - DNA, 20 bp, Artificial Sequence
  Description of Artificial Sequence: Synthetic oligonucleotide
  Target: ATXN1; (-) strand; PAM type: YTN; PAM sequence: CTG
gactttcactgctaacctgc

SEQ ID NO: 161089 - DNA, 20 bp, Artificial Sequence
  Description of Artificial Sequence: Synthetic oligonucleotide
  Target: ATXN1; (-) strand; PAM type: YTN; PAM sequence: TTC
tggactttcactgctaacct

SEQ ID NO: 161090 - DNA, 20 bp, Artificial Sequence
  Description of Artificial Sequence: Synthetic oligonucleotide
  Target: ATXN1; (-) strand; PAM type: YTN; PAM sequence: CTG
ttctggactttcactgctaa

SEQ ID NO: 161091 - DNA, 20 bp, Artificial Sequence
  Description of Artificial Sequence: Synthetic oligonucleotide
  Target: ATXN1; (-) strand; PAM type: YTN; PAM sequence: TTC
agaaatcgagtgcaaggact

SEQ ID NO: 161092 - DNA, 20 bp, Artificial Sequence
  Description of Artificial Sequence: Synthetic oligonucleotide
  Target: ATXN1; (-) strand; PAM type: YTN; PAM sequence: CTG
gcagatgaggattcagaaat

SEQ ID NO: 161093 - DNA, 20 bp, Artificial Sequence
  Description of Artificial Sequence: Synthetic oligonucleotide
  Target: ATXN1; (-) strand; PAM type: YTN; PAM sequence: CTC
tggcagatgaggattcagaa

SEQ ID NO: 161094 - DNA, 20 bp, Artificial Sequence
  Description of Artificial Sequence: Synthetic oligonucleotide
  Target: ATXN1; (-) strand; PAM type: YTN; PAM sequence: TTG
gagagtagtggctctggcag

SEQ ID NO: 161095 - DNA, 20 bp, Artificial Sequence
  Description of Artificial Sequence: Synthetic oligonucleotide
  Target: ATXN1; (-) strand; PAM type: YTN; PAM sequence: CTT
ggagagtagtggctctggca

SEQ ID NO: 161096 - DNA, 20 bp, Artificial Sequence
  Description of Artificial Sequence: Synthetic oligonucleotide
  Target: ATXN1; (-) strand; PAM type: YTN; PAM sequence: CTA
aggggaatcttggagagtag

SEQ ID NO: 161097 - DNA, 20 bp, Artificial Sequence
  Description of Artificial Sequence: Synthetic oligonucleotide
  Target: ATXN1; (-) strand; PAM type: YTN; PAM sequence: TTA
gggagaggaaatcgtaggtc

SEQ ID NO: 161098 - DNA, 20 bp, Artificial Sequence
  Description of Artificial Sequence: Synthetic oligonucleotide
  Target: ATXN1; (-) strand; PAM type: YTN; PAM sequence: TTG
tgtgtgtgtgtattagggag

SEQ ID NO: 161099 - DNA, 20 bp, Artificial Sequence
  Description of Artificial Sequence: Synthetic oligonucleotide
  Target: ATXN1; (-) strand; PAM type: YTN; PAM sequence: TTT
gtgtgtgtgtgtattaggga

SEQ ID NO: 161100 - DNA, 20 bp, Artificial Sequence
  Description of Artificial Sequence: Synthetic oligonucleotide
  Target: ATXN1; (-) strand; PAM type: YTN; PAM sequence: TTG
gcgtgtgtgtgtgtgtttgt

SEQ ID NO: 161101 - DNA, 20 bp, Artificial Sequence
  Description of Artificial Sequence: Synthetic oligonucleotide
  Target: ATXN1; (-) strand; PAM type: YTN; PAM sequence: CTG
agttggcgtgtgtgtgtgtg

SEQ ID NO: 161102 - DNA, 20 bp, Artificial Sequence
  Description of Artificial Sequence: Synthetic oligonucleotide
  Target: ATXN1; (-) strand; PAM type: YTN; PAM sequence: CTG
ctgagttggcgtgtgtgtgt

SEQ ID NO: 161103 - DNA, 20 bp, Artificial Sequence
  Description of Artificial Sequence: Synthetic oligonucleotide
  Target: ATXN1; (-) strand; PAM type: YTN; PAM sequence: CTC
tgctgagttggcgtgtgtgt

SEQ ID NO: 161104 - DNA, 20 bp, Artificial Sequence
  Description of Artificial Sequence: Synthetic oligonucleotide
  Target: ATXN1; (-) strand; PAM type: YTN; PAM sequence: CTG
gcggcctctgctgagttggc

SEQ ID NO: 161105 - DNA, 20 bp, Artificial Sequence
  Description of Artificial Sequence: Synthetic oligonucleotide
  Target: ATXN1; (-) strand; PAM type: YTN; PAM sequence: TTC
tggcggcctctgctgagttg

SEQ ID NO: 161106 - DNA, 20 bp, Artificial Sequence
  Description of Artificial Sequence: Synthetic oligonucleotide
  Target: ATXN1; (-) strand; PAM type: YTN; PAM sequence: TTT
ctggcggcctctgctgagtt

SEQ ID NO: 161107 - DNA, 20 bp, Artificial Sequence
  Description of Artificial Sequence: Synthetic oligonucleotide
  Target: ATXN1; (-) strand; PAM type: YTN; PAM sequence: TTA
tttctggcggcctctgctga

SEQ ID NO: 161108 - DNA, 20 bp, Artificial Sequence
  Description of Artificial Sequence: Synthetic oligonucleotide
  Target: ATXN1; (-) strand; PAM type: YTN; PAM sequence: TTG
cagagaacaggattatttct

SEQ ID NO: 161109 - DNA, 20 bp, Artificial Sequence
  Description of Artificial Sequence: Synthetic oligonucleotide
  Target: ATXN1; (-) strand; PAM type: YTN; PAM sequence: CTT
gcagagaacaggattatttc

SEQ ID NO: 161110 - DNA, 20 bp, Artificial Sequence
  Description of Artificial Sequence: Synthetic oligonucleotide
  Target: ATXN1; (-) strand; PAM type: YTN; PAM sequence: TTG
aaacttgcagagaacaggat

SEQ ID NO: 161111 - DNA, 20 bp, Artificial Sequence
  Description of Artificial Sequence: Synthetic oligonucleotide
  Target: ATXN1; (-) strand; PAM type: YTN; PAM sequence: TTT
gaaacttgcagagaacagga

SEQ ID NO: 161112 - DNA, 20 bp, Artificial Sequence
  Description of Artificial Sequence: Synthetic oligonucleotide
  Target: ATXN1; (-) strand; PAM type: YTN; PAM sequence: TTT
tgaaacttgcagagaacagg

SEQ ID NO: 161113 - DNA, 20 bp, Artificial Sequence
  Description of Artificial Sequence: Synthetic oligonucleotide
  Target: ATXN1; (-) strand; PAM type: YTN; PAM sequence: CTT
ttgaaacttgcagagaacag

SEQ ID NO: 161114 - DNA, 20 bp, Artificial Sequence
  Description of Artificial Sequence: Synthetic oligonucleotide
  Target: ATXN1; (-) strand; PAM type: YTN; PAM sequence: TTC
ttttgaaacttgcagagaac

SEQ ID NO: 161115 - DNA, 20 bp, Artificial Sequence
  Description of Artificial Sequence: Synthetic oligonucleotide
  Target: ATXN1; (-) strand; PAM type: YTN; PAM sequence: CTG
ggaattcttttgaaacttgc

SEQ ID NO: 161116 - DNA, 20 bp, Artificial Sequence
  Description of Artificial Sequence: Synthetic oligonucleotide
  Target: ATXN1; (-) strand; PAM type: YTN; PAM sequence: CTG
tactgggaattcttttgaaa

SEQ ID NO: 161117 - DNA, 20 bp, Artificial Sequence
  Description of Artificial Sequence: Synthetic oligonucleotide
  Target: ATXN1; (-) strand; PAM type: YTN; PAM sequence: CTC
cgtcatcatatgagtggctg

SEQ ID NO: 161118 - DNA, 20 bp, Artificial Sequence
  Description of Artificial Sequence: Synthetic oligonucleotide
  Target: ATXN1; (-) strand; PAM type: YTN; PAM sequence: CTC
actccgtcatcatatgagtg

SEQ ID NO: 161119 - DNA, 20 bp, Artificial Sequence
  Description of Artificial Sequence: Synthetic oligonucleotide
  Target: ATXN1; (-) strand; PAM type: YTN; PAM sequence: TTA
acagtctcactccgtcatca

SEQ ID NO: 161120 - DNA, 20 bp, Artificial Sequence
  Description of Artificial Sequence: Synthetic oligonucleotide
  Target: ATXN1; (-) strand; PAM type: YTN; PAM sequence: TTT
aacagtctcactccgtcatc

SEQ ID NO: 161121 - DNA, 20 bp, Artificial Sequence
  Description of Artificial Sequence: Synthetic oligonucleotide
  Target: ATXN1; (-) strand; PAM type: YTN; PAM sequence: TTT
taacagtctcactccgtcat

SEQ ID NO: 161122 - DNA, 20 bp, Artificial Sequence
  Description of Artificial Sequence: Synthetic oligonucleotide
  Target: ATXN1; (-) strand; PAM type: YTN; PAM sequence: TTT
ttaacagtctcactccgtca

SEQ ID NO: 161123 - DNA, 20 bp, Artificial Sequence
  Description of Artificial Sequence: Synthetic oligonucleotide
  Target: ATXN1; (-) strand; PAM type: YTN; PAM sequence: TTC
ggtttttaacagtctcactc

SEQ ID NO: 161124 - DNA, 20 bp, Artificial Sequence
  Description of Artificial Sequence: Synthetic oligonucleotide
  Target: ATXN1; (-) strand; PAM type: YTN; PAM sequence: TTA
accataatcaaattcggttt

SEQ ID NO: 161125 - DNA, 20 bp, Artificial Sequence
  Description of Artificial Sequence: Synthetic oligonucleotide
  Target: ATXN1; (-) strand; PAM type: YTN; PAM sequence: TTT
aaccataatcaaattcggtt

SEQ ID NO: 161126 - DNA, 20 bp, Artificial Sequence
  Description of Artificial Sequence: Synthetic oligonucleotide
  Target: ATXN1; (-) strand; PAM type: YTN; PAM sequence: TTT
taaccataatcaaattcggt

SEQ ID NO: 161127 - DNA, 20 bp, Artificial Sequence
  Description of Artificial Sequence: Synthetic oligonucleotide
  Target: ATXN1; (-) strand; PAM type: YTN; PAM sequence: TTT
ttaaccataatcaaattcgg

SEQ ID NO: 161128 - DNA, 20 bp, Artificial Sequence
  Description of Artificial Sequence: Synthetic oligonucleotide
  Target: ATXN1; (-) strand; PAM type: YTN; PAM sequence: TTT
tttaaccataatcaaattcg

SEQ ID NO: 161129 - DNA, 20 bp, Artificial Sequence
  Description of Artificial Sequence: Synthetic oligonucleotide
  Target: ATXN1; (-) strand; PAM type: YTN; PAM sequence: TTG
ggttttttaaccataatcaa

SEQ ID NO: 161130 - DNA, 20 bp, Artificial Sequence
  Description of Artificial Sequence: Synthetic oligonucleotide
  Target: ATXN1; (-) strand; PAM type: YTN; PAM sequence: TTT
gggttttttaaccataatca

SEQ ID NO: 161131 - DNA, 20 bp, Artificial Sequence
  Description of Artificial Sequence: Synthetic oligonucleotide
  Target: ATXN1; (-) strand; PAM type: YTN; PAM sequence: TTG
tatggtatttgggtttttta

SEQ ID NO: 161132 - DNA, 20 bp, Artificial Sequence
  Description of Artificial Sequence: Synthetic oligonucleotide
  Target: ATXN1; (-) strand; PAM type: YTN; PAM sequence: TTT
gtatggtatttgggtttttt

SEQ ID NO: 161133 - DNA, 20 bp, Artificial Sequence
  Description of Artificial Sequence: Synthetic oligonucleotide
  Target: ATXN1; (-) strand; PAM type: YTN; PAM sequence: TTT
tgtatggtatttgggttttt

SEQ ID NO: 161134 - DNA, 20 bp, Artificial Sequence
  Description of Artificial Sequence: Synthetic oligonucleotide
  Target: ATXN1; (-) strand; PAM type: YTN; PAM sequence: TTT
ttgtatggtatttgggtttt

SEQ ID NO: 161135 - DNA, 20 bp, Artificial Sequence
  Description of Artificial Sequence: Synthetic oligonucleotide
  Target: ATXN1; (-) strand; PAM type: YTN; PAM sequence: CTA
tttttgtatggtatttgggt

SEQ ID NO: 161136 - DNA, 20 bp, Artificial Sequence
  Description of Artificial Sequence: Synthetic oligonucleotide
  Target: ATXN1; (-) strand; PAM type: YTN; PAM sequence: CTA
gccctatttttgtatggtat

SEQ ID NO: 161137 - DNA, 20 bp, Artificial Sequence
  Description of Artificial Sequence: Synthetic oligonucleotide
  Target: ATXN1; (-) strand; PAM type: YTN; PAM sequence: TTC
agtgcactagccctattttt

SEQ ID NO: 161138 - DNA, 20 bp, Artificial Sequence
  Description of Artificial Sequence: Synthetic oligonucleotide
  Target: ATXN1; (-) strand; PAM type: YTN; PAM sequence: CTG
agaaaacattcagtgcacta

SEQ ID NO: 161139 - DNA, 20 bp, Artificial Sequence
  Description of Artificial Sequence: Synthetic oligonucleotide
  Target: ATXN1; (-) strand; PAM type: YTN; PAM sequence: TTG
aaaaggaagagagagatgga

SEQ ID NO: 161140 - DNA, 20 bp, Artificial Sequence
  Description of Artificial Sequence: Synthetic oligonucleotide
  Target: ATXN1; (-) strand; PAM type: YTN; PAM sequence: CTT
gaaaaggaagagagagatgg

SEQ ID NO: 161141 - DNA, 20 bp, Artificial Sequence
  Description of Artificial Sequence: Synthetic oligonucleotide
  Target: ATXN1; (-) strand; PAM type: YTN; PAM sequence: TTC
aatgacaacttgaaaaggaa

SEQ ID NO: 161142 - DNA, 20 bp, Artificial Sequence
  Description of Artificial Sequence: Synthetic oligonucleotide
  Target: ATXN1; (-) strand; PAM type: YTN; PAM sequence: CTT
caatgacaacttgaaaagga

SEQ ID NO: 161143 - DNA, 20 bp, Artificial Sequence
  Description of Artificial Sequence: Synthetic oligonucleotide
  Target: ATXN1; (-) strand; PAM type: YTN; PAM sequence: TTC
caatgagaaaggggacggtg

SEQ ID NO: 161144 - DNA, 20 bp, Artificial Sequence
  Description of Artificial Sequence: Synthetic oligonucleotide
  Target: ATXN1; (-) strand; PAM type: YTN; PAM sequence: TTT
ccaatgagaaaggggacggt

SEQ ID NO: 161145 - DNA, 20 bp, Artificial Sequence
  Description of Artificial Sequence: Synthetic oligonucleotide
  Target: ATXN1; (-) strand; PAM type: YTN; PAM sequence: CTT
tccaatgagaaaggggacgg

SEQ ID NO: 161146 - DNA, 20 bp, Artificial Sequence
  Description of Artificial Sequence: Synthetic oligonucleotide
  Target: ATXN1; (-) strand; PAM type: YTN; PAM sequence: TTA
ctttccaatgagaaagggga

SEQ ID NO: 161147 - DNA, 20 bp, Artificial Sequence
  Description of Artificial Sequence: Synthetic oligonucleotide
  Target: ATXN1; (-) strand; PAM type: YTN; PAM sequence: TTG
ttactttccaatgagaaagg

SEQ ID NO: 161148 - DNA, 20 bp, Artificial Sequence
  Description of Artificial Sequence: Synthetic oligonucleotide
  Target: ATXN1; (-) strand; PAM type: YTN; PAM sequence: TTA
atggcgagttgttactttcc

SEQ ID NO: 161149 - DNA, 20 bp, Artificial Sequence
  Description of Artificial Sequence: Synthetic oligonucleotide
  Target: ATXN1; (-) strand; PAM type: YTN; PAM sequence: CTA
gtgttaatggcgagttgtta

SEQ ID NO: 161150 - DNA, 20 bp, Artificial Sequence
  Description of Artificial Sequence: Synthetic oligonucleotide
  Target: ATXN1; (-) strand; PAM type: YTN; PAM sequence: CTC
tagtgttaatggcgagttgt

SEQ ID NO: 161151 - DNA, 20 bp, Artificial Sequence
  Description of Artificial Sequence: Synthetic oligonucleotide
  Target: ATXN1; (-) strand; PAM type: YTN; PAM sequence: CTG
tcgtctctagtgttaatggc

SEQ ID NO: 161152 - DNA, 20 bp, Artificial Sequence
  Description of Artificial Sequence: Synthetic oligonucleotide
  Target: ATXN1; (-) strand; PAM type: YTN; PAM sequence: CTG
aaagagctgtcgtctctagt

SEQ ID NO: 161153 - DNA, 20 bp, Artificial Sequence
  Description of Artificial Sequence: Synthetic oligonucleotide
  Target: ATXN1; (-) strand; PAM type: YTN; PAM sequence: TTG
tctgaaagagctgtcgtctc

SEQ ID NO: 161154 - DNA, 20 bp, Artificial Sequence
  Description of Artificial Sequence: Synthetic oligonucleotide
  Target: ATXN1; (-) strand; PAM type: YTN; PAM sequence: TTT
gtctgaaagagctgtcgtct

SEQ ID NO: 161155 - DNA, 20 bp, Artificial Sequence
  Description of Artificial Sequence: Synthetic oligonucleotide
  Target: ATXN1; (-) strand; PAM type: YTN; PAM sequence: CTG
atttgtctgaaagagctgtc

SEQ ID NO: 161156 - DNA, 20 bp, Artificial Sequence
  Description of Artificial Sequence: Synthetic oligonucleotide
  Target: ATXN1; (-) strand; PAM type: YTN; PAM sequence: CTG
atctgatttgtctgaaagag

SEQ ID NO: 161157 - DNA, 20 bp, Artificial Sequence
  Description of Artificial Sequence: Synthetic oligonucleotide
  Target: ATXN1; (-) strand; PAM type: YTN; PAM sequence: TTG
aacacactgatctgatttgt

SEQ ID NO: 161158 - DNA, 20 bp, Artificial Sequence
  Description of Artificial Sequence: Synthetic oligonucleotide
  Target: ATXN1; (-) strand; PAM type: YTN; PAM sequence: TTT
gaacacactgatctgatttg

SEQ ID NO: 161159 - DNA, 20 bp, Artificial Sequence
  Description of Artificial Sequence: Synthetic oligonucleotide
  Target: ATXN1; (-) strand; PAM type: YTN; PAM sequence: TTG
tatgtccaggtttgaacaca

SEQ ID NO: 161160 - DNA, 20 bp, Artificial Sequence
  Description of Artificial Sequence: Synthetic oligonucleotide
  Target: ATXN1; (-) strand; PAM type: YTN; PAM sequence: TTT
gtatgtccaggtttgaacac

SEQ ID NO: 161161 - DNA, 20 bp, Artificial Sequence
  Description of Artificial Sequence: Synthetic oligonucleotide
  Target: ATXN1; (-) strand; PAM type: YTN; PAM sequence: CTC
cagggtcaccatttgtatgt

SEQ ID NO: 161162 - DNA, 20 bp, Artificial Sequence
  Description of Artificial Sequence: Synthetic oligonucleotide
  Target: ATXN1; (-) strand; PAM type: YTN; PAM sequence: CTG
gctccagggtcaccatttgt

SEQ ID NO: 161163 - DNA, 20 bp, Artificial Sequence
  Description of Artificial Sequence: Synthetic oligonucleotide
  Target: ATXN1; (-) strand; PAM type: YTN; PAM sequence: TTG
accataagaactggctccag

SEQ ID NO: 161164 - DNA, 20 bp, Artificial Sequence
  Description of Artificial Sequence: Synthetic oligonucleotide
  Target: ATXN1; (-) strand; PAM type: YTN; PAM sequence: CTT
gaccataagaactggctcca

SEQ ID NO: 161165 - DNA, 20 bp, Artificial Sequence
  Description of Artificial Sequence: Synthetic oligonucleotide
  Target: ATXN1; (-) strand; PAM type: YTN; PAM sequence: CTG
agatacttgaccataagaac

SEQ ID NO: 161166 - DNA, 20 bp, Artificial Sequence
  Description of Artificial Sequence: Synthetic oligonucleotide
  Target: ATXN1; (-) strand; PAM type: YTN; PAM sequence: TTA
gtaagagactgagatacttg

SEQ ID NO: 161167 - DNA, 20 bp, Artificial Sequence
  Description of Artificial Sequence: Synthetic oligonucleotide
  Target: ATXN1; (-) strand; PAM type: YTN; PAM sequence: TTC
agtggttagtaagagactga

SEQ ID NO: 161168 - DNA, 20 bp, Artificial Sequence
  Description of Artificial Sequence: Synthetic oligonucleotide
  Target: ATXN1; (-) strand; PAM type: YTN; PAM sequence: CTT
cagtggttagtaagagactg

SEQ ID NO: 161169 - DNA, 20 bp, Artificial Sequence
  Description of Artificial Sequence: Synthetic oligonucleotide
  Target: ATXN1; (-) strand; PAM type: YTN; PAM sequence: CTC
agacttcagtggttagtaag

SEQ ID NO: 161170 - DNA, 20 bp, Artificial Sequence
  Description of Artificial Sequence: Synthetic oligonucleotide
  Target: ATXN1; (-) strand; PAM type: YTN; PAM sequence: TTG
cccacacagcagcagtaact

SEQ ID NO: 161171 - DNA, 20 bp, Artificial Sequence
  Description of Artificial Sequence: Synthetic oligonucleotide
  Target: ATXN1; (-) strand; PAM type: YTN; PAM sequence: TTT
gcccacacagcagcagtaac

SEQ ID NO: 161172 - DNA, 20 bp, Artificial Sequence
  Description of Artificial Sequence: Synthetic oligonucleotide
  Target: ATXN1; (-) strand; PAM type: YTN; PAM sequence: TTG
gtttgcccacacagcagcag

SEQ ID NO: 161173 - DNA, 20 bp, Artificial Sequence
  Description of Artificial Sequence: Synthetic oligonucleotide
  Target: ATXN1; (-) strand; PAM type: YTN; PAM sequence: TTG
ggcattggtttgcccacaca

SEQ ID NO: 161174 - DNA, 20 bp, Artificial Sequence
  Description of Artificial Sequence: Synthetic oligonucleotide
  Target: ATXN1; (-) strand; PAM type: YTN; PAM sequence: CTG
ttgggcattggtttgcccac

SEQ ID NO: 161175 - DNA, 20 bp, Artificial Sequence
  Description of Artificial Sequence: Synthetic oligonucleotide
  Target: ATXN1; (-) strand; PAM type: YTN; PAM sequence: TTG
tctgttgggcattggtttgc

SEQ ID NO: 161176 - DNA, 20 bp, Artificial Sequence
  Description of Artificial Sequence: Synthetic oligonucleotide
  Target: ATXN1; (-) strand; PAM type: YTN; PAM sequence: CTT
gtctgttgggcattggtttg

SEQ ID NO: 161177 - DNA, 20 bp, Artificial Sequence
  Description of Artificial Sequence: Synthetic oligonucleotide
  Target: ATXN1; (-) strand; PAM type: YTN; PAM sequence: CTC
ttgtctgttgggcattggtt

SEQ ID NO: 161178 - DNA, 20 bp, Artificial Sequence
  Description of Artificial Sequence: Synthetic oligonucleotide
  Target: ATXN1; (-) strand; PAM type: YTN; PAM sequence: TTG
gcctcttgtctgttgggcat

SEQ ID NO: 161179 - DNA, 20 bp, Artificial Sequence
  Description of Artificial Sequence: Synthetic oligonucleotide
  Target: ATXN1; (-) strand; PAM type: YTN; PAM sequence: TTT
ggcctcttgtctgttgggca

SEQ ID NO: 161180 - DNA, 20 bp, Artificial Sequence
  Description of Artificial Sequence: Synthetic oligonucleotide
  Target: ATXN1; (-) strand; PAM type: YTN; PAM sequence: CTG
atatttggcctcttgtctgt

SEQ ID NO: 161181 - DNA, 20 bp, Artificial Sequence
  Description of Artificial Sequence: Synthetic oligonucleotide
  Target: ATXN1; (-) strand; PAM type: YTN; PAM sequence: TTC
cactgatatttggcctcttg

SEQ ID NO: 161182 - DNA, 20 bp, Artificial Sequence
  Description of Artificial Sequence: Synthetic oligonucleotide
  Target: ATXN1; (-) strand; PAM type: YTN; PAM sequence: CTG
ggtcatgtcagttccactga

SEQ ID NO: 161183 - DNA, 20 bp, Artificial Sequence
  Description of Artificial Sequence: Synthetic oligonucleotide
  Target: ATXN1; (-) strand; PAM type: YTN; PAM sequence: CTA
gcctgggtcatgtcagttcc

SEQ ID NO: 161184 - DNA, 20 bp, Artificial Sequence
  Description of Artificial Sequence: Synthetic oligonucleotide
  Target: ATXN1; (-) strand; PAM type: YTN; PAM sequence: TTG
ctagcctgggtcatgtcagt

SEQ ID NO: 161185 - DNA, 20 bp, Artificial Sequence
  Description of Artificial Sequence: Synthetic oligonucleotide
  Target: ATXN1; (-) strand; PAM type: YTN; PAM sequence: CTT
gctagcctgggtcatgtcag

SEQ ID NO: 161186 - DNA, 20 bp, Artificial Sequence
  Description of Artificial Sequence: Synthetic oligonucleotide
  Target: ATXN1; (-) strand; PAM type: YTN; PAM sequence: CTG
cttgctagcctgggtcatgt

SEQ ID NO: 161187 - DNA, 20 bp, Artificial Sequence
  Description of Artificial Sequence: Synthetic oligonucleotide
  Target: ATXN1; (-) strand; PAM type: YTN; PAM sequence: CTG
tggaagcaatcacatccgct

SEQ ID NO: 161188 - DNA, 20 bp, Artificial Sequence
  Description of Artificial Sequence: Synthetic oligonucleotide
  Target: ATXN1; (-) strand; PAM type: YTN; PAM sequence: CTA
cctgtggaagcaatcacatc

SEQ ID NO: 161189 - DNA, 20 bp, Artificial Sequence
  Description of Artificial Sequence: Synthetic oligonucleotide
  Target: ATXN1; (-) strand; PAM type: YTN; PAM sequence: CTG
ctacctgtggaagcaatcac

SEQ ID NO: 161190 - DNA, 20 bp, Artificial Sequence
  Description of Artificial Sequence: Synthetic oligonucleotide
  Target: ATXN1; (-) strand; PAM type: YTN; PAM sequence: CTA
cagctgctacctgtggaagc

SEQ ID NO: 161191 - DNA, 20 bp, Artificial Sequence
  Description of Artificial Sequence: Synthetic oligonucleotide
  Target: ATXN1; (-) strand; PAM type: YTN; PAM sequence: CTG
tgcatacctacagctgctac

SEQ ID NO: 161192 - DNA, 20 bp, Artificial Sequence
  Description of Artificial Sequence: Synthetic oligonucleotide
  Target: ATXN1; (-) strand; PAM type: YTN; PAM sequence: TTG
cactgtgcatacctacagct

SEQ ID NO: 161193 - DNA, 20 bp, Artificial Sequence
  Description of Artificial Sequence: Synthetic oligonucleotide
  Target: ATXN1; (-) strand; PAM type: YTN; PAM sequence: CTC
agaatcacagcatgttgcac

SEQ ID NO: 161194 - DNA, 20 bp, Artificial Sequence
  Description of Artificial Sequence: Synthetic oligonucleotide
  Target: ATXN1; (-) strand; PAM type: YTN; PAM sequence: CTC
tcagaatcacagcatgttgc

SEQ ID NO: 161195 - DNA, 20 bp, Artificial Sequence
  Description of Artificial Sequence: Synthetic oligonucleotide
  Target: ATXN1; (-) strand; PAM type: YTN; PAM sequence: TTC
ccaaagcccaatcccacagc

SEQ ID NO: 161196 - DNA, 20 bp, Artificial Sequence
  Description of Artificial Sequence: Synthetic oligonucleotide
  Target: ATXN1; (-) strand; PAM type: YTN; PAM sequence: CTG
gatgtgagataccaaaaccc

SEQ ID NO: 161197 - DNA, 20 bp, Artificial Sequence
  Description of Artificial Sequence: Synthetic oligonucleotide
  Target: ATXN1; (-) strand; PAM type: YTN; PAM sequence: TTG
aaaagagggtctggatgtga

SEQ ID NO: 161198 - DNA, 20 bp, Artificial Sequence
  Description of Artificial Sequence: Synthetic oligonucleotide
  Target: ATXN1; (-) strand; PAM type: YTN; PAM sequence: CTC
caaagaaagaaagaaagaaa

SEQ ID NO: 161199 - DNA, 20 bp, Artificial Sequence
  Description of Artificial Sequence: Synthetic oligonucleotide
  Target: ATXN1; (-) strand; PAM type: YTN; PAM sequence: CTC
tccaaagaaagaaagaaaga

SEQ ID NO: 161200 - DNA, 20 bp, Artificial Sequence
  Description of Artificial Sequence: Synthetic oligonucleotide
  Target: ATXN1; (-) strand; PAM type: YTN; PAM sequence: TTA
acatagcaagaccccatctc

SEQ ID NO: 161201 - DNA, 20 bp, Artificial Sequence
  Description of Artificial Sequence: Synthetic oligonucleotide
  Target: ATXN1; (-) strand; PAM type: YTN; PAM sequence: CTG
gttaacatagcaagacccca

SEQ ID NO: 161202 - DNA, 20 bp, Artificial Sequence
  Description of Artificial Sequence: Synthetic oligonucleotide
  Target: ATXN1; (-) strand; PAM type: YTN; PAM sequence: TTC
aagaccagcctggttaacat

SEQ ID NO: 161203 - DNA, 20 bp, Artificial Sequence
  Description of Artificial Sequence: Synthetic oligonucleotide
  Target: ATXN1; (-) strand; PAM type: YTN; PAM sequence: TTT
caagaccagcctggttaaca

SEQ ID NO: 161204 - DNA, 20 bp, Artificial Sequence
  Description of Artificial Sequence: Synthetic oligonucleotide
  Target: ATXN1; (-) strand; PAM type: YTN; PAM sequence: TTG
aggccaggatttcaagacca

SEQ ID NO: 161205 - DNA, 20 bp, Artificial Sequence
  Description of Artificial Sequence: Synthetic oligonucleotide
  Target: ATXN1; (-) strand; PAM type: YTN; PAM sequence: CTT
gaggccaggatttcaagacc

SEQ ID NO: 161206 - DNA, 20 bp, Artificial Sequence
  Description of Artificial Sequence: Synthetic oligonucleotide
  Target: ATXN1; (-) strand; PAM type: YTN; PAM sequence: TTC
ttgaggccaggatttcaaga

SEQ ID NO: 161207 - DNA, 20 bp, Artificial Sequence
  Description of Artificial Sequence: Synthetic oligonucleotide
  Target: ATXN1; (-) strand; PAM type: YTN; PAM sequence: TTT
cttgaggccaggatttcaag

SEQ ID NO: 161208 - DNA, 20 bp, Artificial Sequence
  Description of Artificial Sequence: Synthetic oligonucleotide
  Target: ATXN1; (-) strand; PAM type: YTN; PAM sequence: TTG
ggaggccaaggaaggaggat

SEQ ID NO: 161209 - DNA, 20 bp, Artificial Sequence
  Description of Artificial Sequence: Synthetic oligonucleotide
  Target: ATXN1; (-) strand; PAM type: YTN; PAM sequence: TTT
gggaggccaaggaaggagga

SEQ ID NO: 161210 - DNA, 20 bp, Artificial Sequence
  Description of Artificial Sequence: Synthetic oligonucleotide
  Target: ATXN1; (-) strand; PAM type: YTN; PAM sequence: CTT
tgggaggccaaggaaggagg

SEQ ID NO: 161211 - DNA, 20 bp, Artificial Sequence
  Description of Artificial Sequence: Synthetic oligonucleotide
  Target: ATXN1; (-) strand; PAM type: YTN; PAM sequence: CTA
gcactttgggaggccaagga

SEQ ID NO: 161212 - DNA, 20 bp, Artificial Sequence
  Description of Artificial Sequence: Synthetic oligonucleotide
  Target: ATXN1; (-) strand; PAM type: YTN; PAM sequence: CTG
gaatcctagcactttgggag

SEQ ID NO: 161213 - DNA, 20 bp, Artificial Sequence
  Description of Artificial Sequence: Synthetic oligonucleotide
  Target: ATXN1; (-) strand; PAM type: YTN; PAM sequence: CTC
atgcctggaatcctagcact

SEQ ID NO: 161214 - DNA, 20 bp, Artificial Sequence
  Description of Artificial Sequence: Synthetic oligonucleotide
  Target: ATXN1; (-) strand; PAM type: YTN; PAM sequence: CTA
cacacagtggctcatgcctg

SEQ ID NO: 161215 - DNA, 20 bp, Artificial Sequence
  Description of Artificial Sequence: Synthetic oligonucleotide
  Target: ATXN1; (-) strand; PAM type: YTN; PAM sequence: TTG
gctacacacagtggctcatg

SEQ ID NO: 161216 - DNA, 20 bp, Artificial Sequence
  Description of Artificial Sequence: Synthetic oligonucleotide
  Target: ATXN1; (-) strand; PAM type: YTN; PAM sequence: TTA
aaatcggatcattggctaca

SEQ ID NO: 161217 - DNA, 20 bp, Artificial Sequence
  Description of Artificial Sequence: Synthetic oligonucleotide
  Target: ATXN1; (-) strand; PAM type: YTN; PAM sequence: TTT
aaaatcggatcattggctac

SEQ ID NO: 161218 - DNA, 20 bp, Artificial Sequence
  Description of Artificial Sequence: Synthetic oligonucleotide
  Target: ATXN1; (-) strand; PAM type: YTN; PAM sequence: TTT
taaaatcggatcattggcta

SEQ ID NO: 161219 - DNA, 20 bp, Artificial Sequence
  Description of Artificial Sequence: Synthetic oligonucleotide
  Target: ATXN1; (-) strand; PAM type: YTN; PAM sequence: TTG
ttttaaaatcggatcattgg

SEQ ID NO: 161220 - DNA, 20 bp, Artificial Sequence
  Description of Artificial Sequence: Synthetic oligonucleotide
  Target: ATXN1; (-) strand; PAM type: YTN; PAM sequence: TTT
gttttaaaatcggatcattg

SEQ ID NO: 161221 - DNA, 20 bp, Artificial Sequence
  Description of Artificial Sequence: Synthetic oligonucleotide
  Target: ATXN1; (-) strand; PAM type: YTN; PAM sequence: TTG
tgtttgttttaaaatcggat

SEQ ID NO: 161222 - DNA, 20 bp, Artificial Sequence
  Description of Artificial Sequence: Synthetic oligonucleotide
  Target: ATXN1; (-) strand; PAM type: YTN; PAM sequence: TTA
ttgtgtttgttttaaaatcg

SEQ ID NO: 161223 - DNA, 20 bp, Artificial Sequence
  Description of Artificial Sequence: Synthetic oligonucleotide
  Target: ATXN1; (-) strand; PAM type: YTN; PAM sequence: TTT
attgtgtttgttttaaaatc

SEQ ID NO: 161224 - DNA, 20 bp, Artificial Sequence
  Description of Artificial Sequence: Synthetic oligonucleotide
  Target: ATXN1; (-) strand; PAM type: YTN; PAM sequence: CTT
tattgtgtttgttttaaaat

SEQ ID NO: 161225 - DNA, 20 bp, Artificial Sequence
  Description of Artificial Sequence: Synthetic oligonucleotide
  Target: ATXN1; (-) strand; PAM type: YTN; PAM sequence: CTA
ctttattgtgtttgttttaa

SEQ ID NO: 161226 - DNA, 20 bp, Artificial Sequence
  Description of Artificial Sequence: Synthetic oligonucleotide
  Target: ATXN1; (-) strand; PAM type: YTN; PAM sequence: CTG
aaggccgctactttattgtg

SEQ ID NO: 161227 - DNA, 20 bp, Artificial Sequence
  Description of Artificial Sequence: Synthetic oligonucleotide
  Target: ATXN1; (-) strand; PAM type: YTN; PAM sequence: TTG
aatgctgaaggccgctactt

SEQ ID NO: 161228 - DNA, 20 bp, Artificial Sequence
  Description of Artificial Sequence: Synthetic oligonucleotide
  Target: ATXN1; (-) strand; PAM type: YTN; PAM sequence: CTC
caacatggacaaggattgaa

SEQ ID NO: 161229 - DNA, 20 bp, Artificial Sequence
  Description of Artificial Sequence: Synthetic oligonucleotide
  Target: ATXN1; (-) strand; PAM type: YTN; PAM sequence: TTG
ctccaacatggacaaggatt

SEQ ID NO: 161230 - DNA, 20 bp, Artificial Sequence
  Description of Artificial Sequence: Synthetic oligonucleotide
  Target: ATXN1; (-) strand; PAM type: YTN; PAM sequence: TTC
agtgttgctccaacatggac

SEQ ID NO: 161231 - DNA, 20 bp, Artificial Sequence
  Description of Artificial Sequence: Synthetic oligonucleotide
  Target: ATXN1; (-) strand; PAM type: YTN; PAM sequence: TTT
cagtgttgctccaacatgga

SEQ ID NO: 161232 - DNA, 20 bp, Artificial Sequence
  Description of Artificial Sequence: Synthetic oligonucleotide
  Target: ATXN1; (-) strand; PAM type: YTN; PAM sequence: TTC
agtagggatttcagtgttgc

SEQ ID NO: 161233 - DNA, 20 bp, Artificial Sequence
  Description of Artificial Sequence: Synthetic oligonucleotide
  Target: ATXN1; (-) strand; PAM type: YTN; PAM sequence: TTT
cagtagggatttcagtgttg

SEQ ID NO: 161234 - DNA, 20 bp, Artificial Sequence
  Description of Artificial Sequence: Synthetic oligonucleotide
  Target: ATXN1; (-) strand; PAM type: YTN; PAM sequence: TTA
tgtttcagtagggatttcag

SEQ ID NO: 161235 - DNA, 20 bp, Artificial Sequence
  Description of Artificial Sequence: Synthetic oligonucleotide
  Target: ATXN1; (-) strand; PAM type: YTN; PAM sequence: TTA
caaagtagggggcagagtag

SEQ ID NO: 161236 - DNA, 20 bp, Artificial Sequence
  Description of Artificial Sequence: Synthetic oligonucleotide
  Target: ATXN1; (-) strand; PAM type: YTN; PAM sequence: CTA
aaaaatagttacaaagtagg

SEQ ID NO: 161237 - DNA, 20 bp, Artificial Sequence
  Description of Artificial Sequence: Synthetic oligonucleotide
  Target: ATXN1; (-) strand; PAM type: YTN; PAM sequence: CTC
taaaaaatagttacaaagta

SEQ ID NO: 161238 - DNA, 20 bp, Artificial Sequence
  Description of Artificial Sequence: Synthetic oligonucleotide
  Target: ATXN1; (-) strand; PAM type: YTN; PAM sequence: TTG
ccccctctaaaaaatagtta

SEQ ID NO: 161239 - DNA, 20 bp, Artificial Sequence
  Description of Artificial Sequence: Synthetic oligonucleotide
  Target: ATXN1; (-) strand; PAM type: YTN; PAM sequence: TTC
aaaaaaaaaaaaaaaaaaag

SEQ ID NO: 161240 - DNA, 20 bp, Artificial Sequence
  Description of Artificial Sequence: Synthetic oligonucleotide
  Target: ATXN1; (-) strand; PAM type: YTN; PAM sequence: TTT
caaaaaaaaaaaaaaaaaaa

SEQ ID NO: 161241 - DNA, 20 bp, Artificial Sequence
  Description of Artificial Sequence: Synthetic oligonucleotide
  Target: ATXN1; (-) strand; PAM type: YTN; PAM sequence: TTT
tcaaaaaaaaaaaaaaaaaa

SEQ ID NO: 161242 - DNA, 20 bp, Artificial Sequence
  Description of Artificial Sequence: Synthetic oligonucleotide
  Target: ATXN1; (-) strand; PAM type: YTN; PAM sequence: CTT
ttcaaaaaaaaaaaaaaaaa

SEQ ID NO: 161243 - DNA, 20 bp, Artificial Sequence
  Description of Artificial Sequence: Synthetic oligonucleotide
  Target: ATXN1; (-) strand; PAM type: YTN; PAM sequence: CTG
agcaacgaagcaagaccttt

SEQ ID NO: 161244 - DNA, 20 bp, Artificial Sequence
  Description of Artificial Sequence: Synthetic oligonucleotide
  Target: ATXN1; (-) strand; PAM type: YTN; PAM sequence: TTC
agtctgagcaacgaagcaag

SEQ ID NO: 161245 - DNA, 20 bp, Artificial Sequence
  Description of Artificial Sequence: Synthetic oligonucleotide
  Target: ATXN1; (-) strand; PAM type: YTN; PAM sequence: CTT
cagtctgagcaacgaagcaa

SEQ ID NO: 161246 - DNA, 20 bp, Artificial Sequence
  Description of Artificial Sequence: Synthetic oligonucleotide
  Target: ATXN1; (-) strand; PAM type: YTN; PAM sequence: CTG
cacttcagtctgagcaacga

SEQ ID NO: 161247 - DNA, 20 bp, Artificial Sequence
  Description of Artificial Sequence: Synthetic oligonucleotide
  Target: ATXN1; (-) strand; PAM type: YTN; PAM sequence: TTG
cagcaagccgagatcacgcc

SEQ ID NO: 161248 - DNA, 20 bp, Artificial Sequence
  Description of Artificial Sequence: Synthetic oligonucleotide
  Target: ATXN1; (-) strand; PAM type: YTN; PAM sequence: TTG
agcccaggaggcacaggttg

SEQ ID NO: 161249 - DNA, 20 bp, Artificial Sequence
  Description of Artificial Sequence: Synthetic oligonucleotide
  Target: ATXN1; (-) strand; PAM type: YTN; PAM sequence: CTT
gagcccaggaggcacaggtt

SEQ ID NO: 161250 - DNA, 20 bp, Artificial Sequence
  Description of Artificial Sequence: Synthetic oligonucleotide
  Target: ATXN1; (-) strand; PAM type: YTN; PAM sequence: CTG
aggtgggaggatcacttgag

SEQ ID NO: 161251 - DNA, 20 bp, Artificial Sequence
  Description of Artificial Sequence: Synthetic oligonucleotide
  Target: ATXN1; (-) strand; PAM type: YTN; PAM sequence: CTG
ggaggctgaggtgggaggat

SEQ ID NO: 161252 - DNA, 20 bp, Artificial Sequence
  Description of Artificial Sequence: Synthetic oligonucleotide
  Target: ATXN1; (-) strand; PAM type: YTN; PAM sequence: CTA
cctgggaggctgaggtggga

SEQ ID NO: 161253 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctacctgggag

SEQ ID NO: 161254 - DNA, 20 bp, Artificial Sequence
  Description of Artificial Sequence: Synthetic oligonucleotide
  Target: ATXN1; (-) strand; PAM type: YTN; PAM sequence: TTA
gccgggtgtggtggcgtgca

SEQ ID NO: 161255 - DNA, 20 bp, Artificial Sequence
  Description of Artificial Sequence: Synthetic oligonucleotide
  Target: ATXN1; (-) strand; PAM type: YTN; PAM sequence: CTA
caaaaagtacaaaaattagc

SEQ ID NO: 161256 - DNA, 20 bp, Artificial Sequence
  Description of Artificial Sequence: Synthetic oligonucleotide
  Target: ATXN1; (-) strand; PAM type: YTN; PAM sequence: CTC
tacaaaaagtacaaaaatta

SEQ ID NO: 161257 - DNA, 20 bp, Artificial Sequence
  Description of Artificial Sequence: Synthetic oligonucleotide
  Target: ATXN1; (-) strand; PAM type: YTN; PAM sequence: CTG
gccaacatggcaaaacccca

SEQ ID NO: 161258 - DNA, 20 bp, Artificial Sequence
  Description of Artificial Sequence: Synthetic oligonucleotide
  Target: ATXN1; (-) strand; PAM type: YTN; PAM sequence: TTC
aagaccagcctggccaacat

SEQ ID NO: 161259 - DNA, 20 bp, Artificial Sequence
  Description of Artificial Sequence: Synthetic oligonucleotide
  Target: ATXN1; (-) strand; PAM type: YTN; PAM sequence: CTG
ttcaagaccagcctggccaa

SEQ ID NO: 161260 - DNA, 20 bp, Artificial Sequence
  Description of Artificial Sequence: Synthetic oligonucleotide
  Target: ATXN1; (-) strand; PAM type: YTN; PAM sequence: CTG
aggcctgttcaagaccagcc

SEQ ID NO: 161261 - DNA, 20 bp, Artificial Sequence
  Description of Artificial Sequence: Synthetic oligonucleotide
  Target: ATXN1; (-) strand; PAM type: YTN; PAM sequence: CTG
taatcccagcaccgggaggc

SEQ ID NO: 161262 - DNA, 20 bp, Artificial Sequence
  Description of Artificial Sequence: Synthetic oligonucleotide
  Target: ATXN1; (-) strand; PAM type: YTN; PAM sequence: CTC
atgcctgtaatcccagcacc

SEQ ID NO: 161263 - DNA, 20 bp, Artificial Sequence
  Description of Artificial Sequence: Synthetic oligonucleotide
  Target: ATXN1; (-) strand; PAM type: YTN; PAM sequence: CTG
cagtggctcatgcctgtaat

SEQ ID NO: 161264 - DNA, 20 bp, Artificial Sequence
  Description of Artificial Sequence: Synthetic oligonucleotide
  Target: ATXN1; (-) strand; PAM type: YTN; PAM sequence: CTG
gctgcagtggctcatgcctg

SEQ ID NO: 161265 - DNA, 20 bp, Artificial Sequence
  Description of Artificial Sequence: Synthetic oligonucleotide
  Target: ATXN1; (-) strand; PAM type: YTN; PAM sequence: TTC
caagctggctgcagtggctc

SEQ ID NO: 161266 - DNA, 20 bp, Artificial Sequence
  Description of Artificial Sequence: Synthetic oligonucleotide
  Target: ATXN1; (-) strand; PAM type: YTN; PAM sequence: CTT
ccaagctggctgcagtggct

SEQ ID NO: 161267 - DNA, 20 bp, Artificial Sequence
  Description of Artificial Sequence: Synthetic oligonucleotide
  Target: ATXN1; (-) strand; PAM type: YTN; PAM sequence: TTG
ccccttccaagctggctgca

SEQ ID NO: 161268 - DNA, 20 bp, Artificial Sequence
  Description of Artificial Sequence: Synthetic oligonucleotide
  Target: ATXN1; (-) strand; PAM type: YTN; PAM sequence: TTA
aatcattgccccttccaagc

SEQ ID NO: 161269 - DNA, 20 bp, Artificial Sequence
  Description of Artificial Sequence: Synthetic oligonucleotide
  Target: ATXN1; (-) strand; PAM type: YTN; PAM sequence: TTG
gagcaaaaccaataagggcc

SEQ ID NO: 161270 - DNA, 20 bp, Artificial Sequence
  Description of Artificial Sequence: Synthetic oligonucleotide
  Target: ATXN1; (-) strand; PAM type: YTN; PAM sequence: TTG
atgatgttggagcaaaacca

SEQ ID NO: 161271 - DNA, 20 bp, Artificial Sequence
  Description of Artificial Sequence: Synthetic oligonucleotide
  Target: ATXN1; (-) strand; PAM type: YTN; PAM sequence: TTC
attgatgatgttggagcaaa

SEQ ID NO: 161272 - DNA, 20 bp, Artificial Sequence
  Description of Artificial Sequence: Synthetic oligonucleotide
  Target: ATXN1; (-) strand; PAM type: YTN; PAM sequence: TTA
tgatgttcattgatgatgtt

SEQ ID NO: 161273 - DNA, 20 bp, Artificial Sequence
  Description of Artificial Sequence: Synthetic oligonucleotide
  Target: ATXN1; (-) strand; PAM type: YTN; PAM sequence: TTC
attatgatgttcattgatga

SEQ ID NO: 161274 - DNA, 20 bp, Artificial Sequence
  Description of Artificial Sequence: Synthetic oligonucleotide
  Target: ATXN1; (-) strand; PAM type: YTN; PAM sequence: TTT
cattatgatgttcattgatg

SEQ ID NO: 161275 - DNA, 20 bp, Artificial Sequence
  Description of Artificial Sequence: Synthetic oligonucleotide
  Target: ATXN1; (-) strand; PAM type: YTN; PAM sequence: TTG
tcatttcattatgatgttca

SEQ ID NO: 161276 - DNA, 20 bp, Artificial Sequence
  Description of Artificial Sequence: Synthetic oligonucleotide
  Target: ATXN1; (-) strand; PAM type: YTN; PAM sequence: TTT
gtcatttcattatgatgttc

SEQ ID NO: 161277 - DNA, 20 bp, Artificial Sequence
  Description of Artificial Sequence: Synthetic oligonucleotide
  Target: ATXN1; (-) strand; PAM type: YTN; PAM sequence: TTG
tatcatttgtcatttcatta

SEQ ID NO: 161278 - DNA, 20 bp, Artificial Sequence
  Description of Artificial Sequence: Synthetic oligonucleotide
  Target: ATXN1; (-) strand; PAM type: YTN; PAM sequence: CTG
ttgtatcatttgtcatttca

SEQ ID NO: 161279 - DNA, 20 bp, Artificial Sequence
  Description of Artificial Sequence: Synthetic oligonucleotide
  Target: ATXN1; (-) strand; PAM type: YTN; PAM sequence: TTC
tgttgtatcatttgtcattt

SEQ ID NO: 161280 - DNA, 20 bp, Artificial Sequence
  Description of Artificial Sequence: Synthetic oligonucleotide
  Target: ATXN1; (-) strand; PAM type: YTN; PAM sequence: TTT
ctgttgtatcatttgtcatt

SEQ ID NO: 161281 - DNA, 20 bp, Artificial Sequence
  Description of Artificial Sequence: Synthetic oligonucleotide
  Target: ATXN1; (-) strand; PAM type: YTN; PAM sequence: CTT
tctgttgtatcatttgtcat

SEQ ID NO: 161282 - DNA, 20 bp, Artificial Sequence
  Description of Artificial Sequence: Synthetic oligonucleotide
  Target: ATXN1; (-) strand; PAM type: YTN; PAM sequence: TTG
agaactttctgttgtatcat

SEQ ID NO: 161283 - DNA, 20 bp, Artificial Sequence
  Description of Artificial Sequence: Synthetic oligonucleotide
  Target: ATXN1; (-) strand; PAM type: YTN; PAM sequence: TTA
aggattgagaactttctgtt

SEQ ID NO: 161284 - DNA, 20 bp, Artificial Sequence
  Description of Artificial Sequence: Synthetic oligonucleotide
  Target: ATXN1; (-) strand; PAM type: YTN; PAM sequence: CTG
atcaaaatcattaaggattg

SEQ ID NO: 161285 - DNA, 20 bp, Artificial Sequence
  Description of Artificial Sequence: Synthetic oligonucleotide
  Target: ATXN1; (-) strand; PAM type: YTN; PAM sequence: CTA
gatatctgatcaaaatcatt

SEQ ID NO: 161286 - DNA, 20 bp, Artificial Sequence
  Description of Artificial Sequence: Synthetic oligonucleotide
  Target: ATXN1; (-) strand; PAM type: YTN; PAM sequence: TTC
ctagatatctgatcaaaatc

SEQ ID NO: 161287 - DNA, 20 bp, Artificial Sequence
  Description of Artificial Sequence: Synthetic oligonucleotide
  Target: ATXN1; (-) strand; PAM type: YTN; PAM sequence: CTT
cctagatatctgatcaaaat

SEQ ID NO: 161288 - DNA, 20 bp, Artificial Sequence
  Description of Artificial Sequence: Synthetic oligonucleotide
  Target: ATXN1; (-) strand; PAM type: YTN; PAM sequence: CTG
caccttcctagatatctgat

SEQ ID NO: 161289 - DNA, 20 bp, Artificial Sequence
  Description of Artificial Sequence: Synthetic oligonucleotide
  Target: ATXN1; (-) strand; PAM type: YTN; PAM sequence: CTA
aacctgcaccttcctagata

SEQ ID NO: 161290 - DNA, 20 bp, Artificial Sequence
  Description of Artificial Sequence: Synthetic oligonucleotide
  Target: ATXN1; (-) strand; PAM type: YTN; PAM sequence: TTC
taaacctgcaccttcctaga

SEQ ID NO: 161291 - DNA, 20 bp, Artificial Sequence
  Description of Artificial Sequence: Synthetic oligonucleotide
  Target: ATXN1; (-) strand; PAM type: YTN; PAM sequence: TTT
ctaaacctgcaccttcctag

SEQ ID NO: 161292 - DNA, 20 bp, Artificial Sequence
  Description of Artificial Sequence: Synthetic oligonucleotide
  Target: ATXN1; (-) strand; PAM type: YTN; PAM sequence: TTG
atatcgagacaccaaatttc

SEQ ID NO: 161293 - DNA, 20 bp, Artificial Sequence
  Description of Artificial Sequence: Synthetic oligonucleotide
  Target: ATXN1; (-) strand; PAM type: YTN; PAM sequence: TTT
gatatcgagacaccaaattt

SEQ ID NO: 161294 - DNA, 20 bp, Artificial Sequence
  Description of Artificial Sequence: Synthetic oligonucleotide
  Target: ATXN1; (-) strand; PAM type: YTN; PAM sequence: CTT
tgatatcgagacaccaaatt

SEQ ID NO: 161295 - DNA, 20 bp, Artificial Sequence
  Description of Artificial Sequence: Synthetic oligonucleotide
  Target: ATXN1; (-) strand; PAM type: YTN; PAM sequence: CTG
aaatgtcctttgatatcgag

SEQ ID NO: 161296 - DNA, 20 bp, Artificial Sequence
  Description of Artificial Sequence: Synthetic oligonucleotide
  Target: ATXN1; (-) strand; PAM type: YTN; PAM sequence: TTA
ctgaaatgtcctttgatatc

SEQ ID NO: 161297 - DNA, 20 bp, Artificial Sequence
  Description of Artificial Sequence: Synthetic oligonucleotide
  Target: ATXN1; (-) strand; PAM type: YTN; PAM sequence: CTT
actgaaatgtcctttgatat

SEQ ID NO: 161298 - DNA, 20 bp, Artificial Sequence
  Description of Artificial Sequence: Synthetic oligonucleotide
  Target: ATXN1; (-) strand; PAM type: YTN; PAM sequence: TTC
ttactgaaatgtcctttgat

SEQ ID NO: 161299 - DNA, 20 bp, Artificial Sequence
  Description of Artificial Sequence: Synthetic oligonucleotide
  Target: ATXN1; (-) strand; PAM type: YTN; PAM sequence: CTA
ttcttactgaaatgtccttt

SEQ ID NO: 161300 - DNA, 20 bp, Artificial Sequence
  Description of Artificial Sequence: Synthetic oligonucleotide
  Target: ATXN1; (-) strand; PAM type: YTN; PAM sequence: TTC
tattcttactgaaatgtcct

SEQ ID NO: 161301 - DNA, 20 bp, Artificial Sequence
  Description of Artificial Sequence: Synthetic oligonucleotide
  Target: ATXN1; (-) strand; PAM type: YTN; PAM sequence: TTG
tcatatgagaaattctattc

SEQ ID NO: 161302 - DNA, 20 bp, Artificial Sequence
  Description of Artificial Sequence: Synthetic oligonucleotide
  Target: ATXN1; (-) strand; PAM type: YTN; PAM sequence: CTT
gtcatatgagaaattctatt

SEQ ID NO: 161303 - DNA, 20 bp, Artificial Sequence
  Description of Artificial Sequence: Synthetic oligonucleotide
  Target: ATXN1; (-) strand; PAM type: YTN; PAM sequence: CTC
ttgtcatatgagaaattcta

SEQ ID NO: 161304 - DNA, 20 bp, Artificial Sequence
  Description of Artificial Sequence: Synthetic oligonucleotide
  Target: ATXN1; (-) strand; PAM type: YTN; PAM sequence: CTC
tcttgtcatatgagaaattc

SEQ ID NO: 161305 - DNA, 20 bp, Artificial Sequence
  Description of Artificial Sequence: Synthetic oligonucleotide
  Target: ATXN1; (-) strand; PAM type: YTN; PAM sequence: TTA
agcgcctctcttgtcatatg

SEQ ID NO: 161306 - DNA, 20 bp, Artificial Sequence
  Description of Artificial Sequence: Synthetic oligonucleotide
  Target: ATXN1; (-) strand; PAM type: YTN; PAM sequence: TTT
aagcgcctctcttgtcatat

SEQ ID NO: 161307 - DNA, 20 bp, Artificial Sequence
  Description of Artificial Sequence: Synthetic oligonucleotide
  Target: ATXN1; (-) strand; PAM type: YTN; PAM sequence: CTT
taagcgcctctcttgtcata

SEQ ID NO: 161308 - DNA, 20 bp, Artificial Sequence
  Description of Artificial Sequence: Synthetic oligonucleotide
  Target: ATXN1; (-) strand; PAM type: YTN; PAM sequence: TTC
cgtcccagtctttaagcgcc

SEQ ID NO: 161309 - DNA, 20 bp, Artificial Sequence
  Description of Artificial Sequence: Synthetic oligonucleotide
  Target: ATXN1; (-) strand; PAM type: YTN; PAM sequence: TTT
ccgtcccagtctttaagcgc

SEQ ID NO: 161310 - DNA, 20 bp, Artificial Sequence
  Description of Artificial Sequence: Synthetic oligonucleotide
  Target: ATXN1; (-) strand; PAM type: YTN; PAM sequence: TTC
atttccgtcccagtctttaa

SEQ ID NO: 161311 - DNA, 20 bp, Artificial Sequence
  Description of Artificial Sequence: Synthetic oligonucleotide
  Target: ATXN1; (-) strand; PAM type: YTN; PAM sequence: TTT
catttccgtcccagtcttta

SEQ ID NO: 161312 - DNA, 20 bp, Artificial Sequence
  Description of Artificial Sequence: Synthetic oligonucleotide
  Target: ATXN1; (-) strand; PAM type: YTN; PAM sequence: TTT
tcatttccgtcccagtcttt

SEQ ID NO: 161313 - DNA, 20 bp, Artificial Sequence
  Description of Artificial Sequence: Synthetic oligonucleotide
  Target: ATXN1; (-) strand; PAM type: YTN; PAM sequence: TTT
ttcatttccgtcccagtctt

SEQ ID NO: 161314 - DNA, 20 bp, Artificial Sequence
  Description of Artificial Sequence: Synthetic oligonucleotide
  Target: ATXN1; (-) strand; PAM type: YTN; PAM sequence: TTA
tttttcatttccgtcccagt

SEQ ID NO: 161315 - DNA, 20 bp, Artificial Sequence
  Description of Artificial Sequence: Synthetic oligonucleotide
  Target: ATXN1; (-) strand; PAM type: YTN; PAM sequence: CTT
atttttcatttccgtcccag

SEQ ID NO: 161316 - DNA, 20 bp, Artificial Sequence
  Description of Artificial Sequence: Synthetic oligonucleotide
  Target: ATXN1; (-) strand; PAM type: YTN; PAM sequence: TTA
accttatttttcatttccgt

SEQ ID NO: 161317 - DNA, 20 bp, Artificial Sequence
  Description of Artificial Sequence: Synthetic oligonucleotide
  Target: ATXN1; (-) strand; PAM type: YTN; PAM sequence: TTT
aaccttatttttcatttccg

SEQ ID NO: 161318 - DNA, 20 bp, Artificial Sequence
  Description of Artificial Sequence: Synthetic oligonucleotide
  Target: ATXN1; (-) strand; PAM type: YTN; PAM sequence: TTT
taaccttatttttcatttcc

SEQ ID NO: 161319 - DNA, 20 bp, Artificial Sequence
  Description of Artificial Sequence: Synthetic oligonucleotide
  Target: ATXN1; (-) strand; PAM type: YTN; PAM sequence: TTT
ttaaccttatttttcatttc

SEQ ID NO: 161320 - DNA, 20 bp, Artificial Sequence
  Description of Artificial Sequence: Synthetic oligonucleotide
  Target: ATXN1; (-) strand; PAM type: YTN; PAM sequence: TTT
tttaaccttatttttcattt

SEQ ID NO: 161321 - DNA, 20 bp, Artificial Sequence
  Description of Artificial Sequence: Synthetic oligonucleotide
  Target: ATXN1; (-) strand; PAM type: YTN; PAM sequence: TTT
ttttaaccttatttttcatt

SEQ ID NO: 161322 - DNA, 20 bp, Artificial Sequence
  Description of Artificial Sequence: Synthetic oligonucleotide
  Target: ATXN1; (-) strand; PAM type: YTN; PAM sequence: TTA
gggtttttttaaccttattt

SEQ ID NO: 161323 - DNA, 20 bp, Artificial Sequence
  Description of Artificial Sequence: Synthetic oligonucleotide
  Target: ATXN1; (-) strand; PAM type: YTN; PAM sequence: TTT
agggtttttttaaccttatt

SEQ ID NO: 161324 - DNA, 20 bp, Artificial Sequence
  Description of Artificial Sequence: Synthetic oligonucleotide
  Target: ATXN1; (-) strand; PAM type: YTN; PAM sequence: TTT
tagggtttttttaaccttat

SEQ ID NO: 161325 - DNA, 20 bp, Artificial Sequence
  Description of Artificial Sequence: Synthetic oligonucleotide
  Target: ATXN1; (-) strand; PAM type: YTN; PAM sequence: TTC
agcataagtgttttagggtt

SEQ ID NO: 161326 - DNA, 20 bp, Artificial Sequence
  Description of Artificial Sequence: Synthetic oligonucleotide
  Target: ATXN1; (-) strand; PAM type: YTN; PAM sequence: CTT
cagcataagtgttttagggt

SEQ ID NO: 161327 - DNA, 20 bp, Artificial Sequence
  Description of Artificial Sequence: Synthetic oligonucleotide
  Target: ATXN1; (-) strand; PAM type: YTN; PAM sequence: TTC
ttcagcataagtgttttagg

SEQ ID NO: 161328 - DNA, 20 bp, Artificial Sequence
  Description of Artificial Sequence: Synthetic oligonucleotide
  Target: ATXN1; (-) strand; PAM type: YTN; PAM sequence: TTT
cttcagcataagtgttttag

SEQ ID NO: 161329 - DNA, 20 bp, Artificial Sequence
  Description of Artificial Sequence: Synthetic oligonucleotide
  Target: ATXN1; (-) strand; PAM type: YTN; PAM sequence: TTC
atttcttcagcataagtgtt

SEQ ID NO: 161330 - DNA, 20 bp, Artificial Sequence
  Description of Artificial Sequence: Synthetic oligonucleotide
  Target: ATXN1; (-) strand; PAM type: YTN; PAM sequence: CTT
catttcttcagcataagtgt

SEQ ID NO: 161331 - DNA, 20 bp, Artificial Sequence
  Description of Artificial Sequence: Synthetic oligonucleotide
  Target: ATXN1; (-) strand; PAM type: YTN; PAM sequence: TTC
aacacttcatttcttcagca

SEQ ID NO: 161332 - DNA, 20 bp, Artificial Sequence
  Description of Artificial Sequence: Synthetic oligonucleotide
  Target: ATXN1; (-) strand; PAM type: YTN; PAM sequence: CTT
caacacttcatttcttcagc

SEQ ID NO: 161333 - DNA, 20 bp, Artificial Sequence
  Description of Artificial Sequence: Synthetic oligonucleotide
  Target: ATXN1; (-) strand; PAM type: YTN; PAM sequence: CTC
cttcaacacttcatttcttc

SEQ ID NO: 161334 - DNA, 20 bp, Artificial Sequence
  Description of Artificial Sequence: Synthetic oligonucleotide
  Target: ATXN1; (-) strand; PAM type: YTN; PAM sequence: TTA
ctccttcaacacttcatttc

SEQ ID NO: 161335 - DNA, 20 bp, Artificial Sequence
  Description of Artificial Sequence: Synthetic oligonucleotide
  Target: ATXN1; (-) strand; PAM type: YTN; PAM sequence: TTG
cgagagtaaataagtgacat

SEQ ID NO: 161336 - DNA, 20 bp, Artificial Sequence
  Description of Artificial Sequence: Synthetic oligonucleotide
  Target: ATXN1; (-) strand; PAM type: YTN; PAM sequence: CTG
ggttgcgagagtaaataagt

SEQ ID NO: 161337 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaacacctgggtt

SEQ ID NO: 161338 - DNA, 20 bp, Artificial Sequence
  Description of Artificial Sequence: Synthetic oligonucleotide
  Target: ATXN1; (-) strand; PAM type: YTN; PAM sequence: CTC
catctcaaaaaaaaaacacc

SEQ ID NO: 161339 - DNA, 20 bp, Artificial Sequence
  Description of Artificial Sequence: Synthetic oligonucleotide
  Target: ATXN1; (-) strand; PAM type: YTN; PAM sequence: CTG
ggcgacagagtgagactcca

SEQ ID NO: 161340 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcgacagagtga

SEQ ID NO: 161341 - DNA, 20 bp, Artificial Sequence
  Description of Artificial Sequence: Synthetic oligonucleotide
  Target: ATXN1; (-) strand; PAM type: YTN; PAM sequence: TTG
ccctccagcctgggcgacag

SEQ ID NO: 161342 - DNA, 20 bp, Artificial Sequence
  Description of Artificial Sequence: Synthetic oligonucleotide
  Target: ATXN1; (-) strand; PAM type: YTN; PAM sequence: TTG
gcacattgccctccagcctg

SEQ ID NO: 161343 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagattggcac

SEQ ID NO: 161344 - DNA, 20 bp, Artificial Sequence
  Description of Artificial Sequence: Synthetic oligonucleotide
  Target: ATXN1; (-) strand; PAM type: YTN; PAM sequence: TTG
aacccgggaggcggaggttg

SEQ ID NO: 161345 - DNA, 20 bp, Artificial Sequence
  Description of Artificial Sequence: Synthetic oligonucleotide
  Target: ATXN1; (-) strand; PAM type: YTN; PAM sequence: CTT
gaacccgggaggcggaggtt

SEQ ID NO: 161346 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcgcttgaa

SEQ ID NO: 161347 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggcaggagaa

SEQ ID NO: 161348 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgaggcagga

SEQ ID NO: 161349 - DNA, 20 bp, Artificial Sequence
  Description of Artificial Sequence: Synthetic oligonucleotide
  Target: ATXN1; (-) strand; PAM type: YTN; PAM sequence: CTA
taatcccagctactcaggag

SEQ ID NO: 161350 - DNA, 20 bp, Artificial Sequence
  Description of Artificial Sequence: Synthetic oligonucleotide
  Target: ATXN1; (-) strand; PAM type: YTN; PAM sequence: TTA
gccaggcatggcggcagccg

SEQ ID NO: 161351 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattagccag

SEQ ID NO: 161352 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaattagc

SEQ ID NO: 161353 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaatta

SEQ ID NO: 161354 - DNA, 20 bp, Artificial Sequence
  Description of Artificial Sequence: Synthetic oligonucleotide
  Target: ATXN1; (-) strand; PAM type: YTN; PAM sequence: CTC
cgcctctactaaaaatacaa

SEQ ID NO: 161355 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaactccg

SEQ ID NO: 161356 - DNA, 20 bp, Artificial Sequence
  Description of Artificial Sequence: Synthetic oligonucleotide
  Target: ATXN1; (-) strand; PAM type: YTN; PAM sequence: TTC
gagaccagcctggccaacat

SEQ ID NO: 161357 - DNA, 20 bp, Artificial Sequence
  Description of Artificial Sequence: Synthetic oligonucleotide
  Target: ATXN1; (-) strand; PAM type: YTN; PAM sequence: TTG
aggtcaggagttcgagacca

SEQ ID NO: 161358 - DNA, 20 bp, Artificial Sequence
  Description of Artificial Sequence: Synthetic oligonucleotide
  Target: ATXN1; (-) strand; PAM type: YTN; PAM sequence: TTT
gaggtcaggagttcgagacc

SEQ ID NO: 161359 - DNA, 20 bp, Artificial Sequence
  Description of Artificial Sequence: Synthetic oligonucleotide
  Target: ATXN1; (-) strand; PAM type: YTN; PAM sequence: CTG
gtggatcatttgaggtcagg

SEQ ID NO: 161360 - DNA, 20 bp, Artificial Sequence
  Description of Artificial Sequence: Synthetic oligonucleotide
  Target: ATXN1; (-) strand; PAM type: YTN; PAM sequence: TTG
ggaggtagaggctggtggat

SEQ ID NO: 161361 - DNA, 20 bp, Artificial Sequence
  Description of Artificial Sequence: Synthetic oligonucleotide
  Target: ATXN1; (-) strand; PAM type: YTN; PAM sequence: TTT
gggaggtagaggctggtgga

SEQ ID NO: 161362 - DNA, 20 bp, Artificial Sequence
  Description of Artificial Sequence: Synthetic oligonucleotide
  Target: ATXN1; (-) strand; PAM type: YTN; PAM sequence: CTT
tgggaggtagaggctggtgg

SEQ ID NO: 161363 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 161364 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcccagcact

SEQ ID NO: 161365 - DNA, 20 bp, Artificial Sequence
  Description of Artificial Sequence: Synthetic oligonucleotide
  Target: ATXN1; (-) strand; PAM type: YTN; PAM sequence: CTA
ggtgggcagggcgcagtggc

SEQ ID NO: 161366 - DNA, 20 bp, Artificial Sequence
  Description of Artificial Sequence: Synthetic oligonucleotide
  Target: ATXN1; (-) strand; PAM type: YTN; PAM sequence: TTA
caaaaaccctaggtgggcag

SEQ ID NO: 161367 - DNA, 20 bp, Artificial Sequence
  Description of Artificial Sequence: Synthetic oligonucleotide
  Target: ATXN1; (-) strand; PAM type: YTN; PAM sequence: CTT
acaaaaaccctaggtgggca

SEQ ID NO: 161368 - DNA, 20 bp, Artificial Sequence
  Description of Artificial Sequence: Synthetic oligonucleotide
  Target: ATXN1; (-) strand; PAM type: YTN; PAM sequence: TTG
tcacttacaaaaaccctagg

SEQ ID NO: 161369 - DNA, 20 bp, Artificial Sequence
  Description of Artificial Sequence: Synthetic oligonucleotide
  Target: ATXN1; (-) strand; PAM type: YTN; PAM sequence: TTT
gtcacttacaaaaaccctag

SEQ ID NO: 161370 - DNA, 20 bp, Artificial Sequence
  Description of Artificial Sequence: Synthetic oligonucleotide
  Target: ATXN1; (-) strand; PAM type: YTN; PAM sequence: TTA
tttgtcacttacaaaaaccc

SEQ ID NO: 161371 - DNA, 20 bp, Artificial Sequence
  Description of Artificial Sequence: Synthetic oligonucleotide
  Target: ATXN1; (-) strand; PAM type: YTN; PAM sequence: CTG
tacagaacacagttatttgt

SEQ ID NO: 161372 - DNA, 20 bp, Artificial Sequence
  Description of Artificial Sequence: Synthetic oligonucleotide
  Target: ATXN1; (-) strand; PAM type: YTN; PAM sequence: TTA
caagggaaggctgtacagaa

SEQ ID NO: 161373 - DNA, 20 bp, Artificial Sequence
  Description of Artificial Sequence: Synthetic oligonucleotide
  Target: ATXN1; (-) strand; PAM type: YTN; PAM sequence: TTT
acaagggaaggctgtacaga

SEQ ID NO: 161374 - DNA, 20 bp, Artificial Sequence
  Description of Artificial Sequence: Synthetic oligonucleotide
  Target: ATXN1; (-) strand; PAM type: YTN; PAM sequence: TTT
tacaagggaaggctgtacag

SEQ ID NO: 161375 - DNA, 20 bp, Artificial Sequence
  Description of Artificial Sequence: Synthetic oligonucleotide
  Target: ATXN1; (-) strand; PAM type: YTN; PAM sequence: TTT
ttacaagggaaggctgtaca

SEQ ID NO: 161376 - DNA, 20 bp, Artificial Sequence
  Description of Artificial Sequence: Synthetic oligonucleotide
  Target: ATXN1; (-) strand; PAM type: YTN; PAM sequence: CTT
tttacaagggaaggctgtac

SEQ ID NO: 161377 - DNA, 20 bp, Artificial Sequence
  Description of Artificial Sequence: Synthetic oligonucleotide
  Target: ATXN1; (-) strand; PAM type: YTN; PAM sequence: TTC
tttttacaagggaaggctgt

SEQ ID NO: 161378 - DNA, 20 bp, Artificial Sequence
  Description of Artificial Sequence: Synthetic oligonucleotide
  Target: ATXN1; (-) strand; PAM type: YTN; PAM sequence: CTT
ctttttacaagggaaggctg

SEQ ID NO: 161379 - DNA, 20 bp, Artificial Sequence
  Description of Artificial Sequence: Synthetic oligonucleotide
  Target: ATXN1; (-) strand; PAM type: YTN; PAM sequence: TTA
gaacttctttttacaaggga

SEQ ID NO: 161380 - DNA, 20 bp, Artificial Sequence
  Description of Artificial Sequence: Synthetic oligonucleotide
  Target: ATXN1; (-) strand; PAM type: YTN; PAM sequence: TTA
ttagaacttctttttacaag

SEQ ID NO: 161381 - DNA, 20 bp, Artificial Sequence
  Description of Artificial Sequence: Synthetic oligonucleotide
  Target: ATXN1; (-) strand; PAM type: YTN; PAM sequence: TTC
attattagaacttcttttta

SEQ ID NO: 161382 - DNA, 20 bp, Artificial Sequence
  Description of Artificial Sequence: Synthetic oligonucleotide
  Target: ATXN1; (-) strand; PAM type: YTN; PAM sequence: TTA
aagataaaagttcattatta

SEQ ID NO: 161383 - DNA, 20 bp, Artificial Sequence
  Description of Artificial Sequence: Synthetic oligonucleotide
  Target: ATXN1; (-) strand; PAM type: YTN; PAM sequence: TTT
aaagataaaagttcattatt

SEQ ID NO: 161384 - DNA, 20 bp, Artificial Sequence
  Description of Artificial Sequence: Synthetic oligonucleotide
  Target: ATXN1; (-) strand; PAM type: YTN; PAM sequence: TTG
aaatttaaagataaaagttc

SEQ ID NO: 161385 - DNA, 20 bp, Artificial Sequence
  Description of Artificial Sequence: Synthetic oligonucleotide
  Target: ATXN1; (-) strand; PAM type: YTN; PAM sequence: CTT
gaaatttaaagataaaagtt

SEQ ID NO: 161386 - DNA, 20 bp, Artificial Sequence
  Description of Artificial Sequence: Synthetic oligonucleotide
  Target: ATXN1; (-) strand; PAM type: YTN; PAM sequence: TTA
agagtgagtcttgaaattta

SEQ ID NO: 161387 - DNA, 20 bp, Artificial Sequence
  Description of Artificial Sequence: Synthetic oligonucleotide
  Target: ATXN1; (-) strand; PAM type: YTN; PAM sequence: CTT
aagagtgagtcttgaaattt

SEQ ID NO: 161388 - DNA, 20 bp, Artificial Sequence
  Description of Artificial Sequence: Synthetic oligonucleotide
  Target: ATXN1; (-) strand; PAM type: YTN; PAM sequence: TTC
ttaagagtgagtcttgaaat

SEQ ID NO: 161389 - DNA, 20 bp, Artificial Sequence
  Description of Artificial Sequence: Synthetic oligonucleotide
  Target: ATXN1; (-) strand; PAM type: YTN; PAM sequence: TTT
cttaagagtgagtcttgaaa

SEQ ID NO: 161390 - DNA, 20 bp, Artificial Sequence
  Description of Artificial Sequence: Synthetic oligonucleotide
  Target: ATXN1; (-) strand; PAM type: YTN; PAM sequence: CTT
tcttaagagtgagtcttgaa

SEQ ID NO: 161391 - DNA, 20 bp, Artificial Sequence
  Description of Artificial Sequence: Synthetic oligonucleotide
  Target: ATXN1; (-) strand; PAM type: YTN; PAM sequence: TTC
cctttcttaagagtgagtct

SEQ ID NO: 161392 - DNA, 20 bp, Artificial Sequence
  Description of Artificial Sequence: Synthetic oligonucleotide
  Target: ATXN1; (-) strand; PAM type: YTN; PAM sequence: TTG
gcattccctttcttaagagt

SEQ ID NO: 161393 - DNA, 20 bp, Artificial Sequence
  Description of Artificial Sequence: Synthetic oligonucleotide
  Target: ATXN1; (-) strand; PAM type: YTN; PAM sequence: TTT
ggcattccctttcttaagag

SEQ ID NO: 161394 - DNA, 20 bp, Artificial Sequence
  Description of Artificial Sequence: Synthetic oligonucleotide
  Target: ATXN1; (-) strand; PAM type: YTN; PAM sequence: TTG
gtatggaaatgtgggagcgt

SEQ ID NO: 161395 - DNA, 20 bp, Artificial Sequence
  Description of Artificial Sequence: Synthetic oligonucleotide
  Target: ATXN1; (-) strand; PAM type: YTN; PAM sequence: CTC
gttggtatggaaatgtggga

SEQ ID NO: 161396 - DNA, 20 bp, Artificial Sequence
  Description of Artificial Sequence: Synthetic oligonucleotide
  Target: ATXN1; (-) strand; PAM type: YTN; PAM sequence: TTG
ctcgttggtatggaaatgtg

SEQ ID NO: 161397 - DNA, 20 bp, Artificial Sequence
  Description of Artificial Sequence: Synthetic oligonucleotide
  Target: ATXN1; (-) strand; PAM type: YTN; PAM sequence: CTT
gctcgttggtatggaaatgt

SEQ ID NO: 161398 - DNA, 20 bp, Artificial Sequence
  Description of Artificial Sequence: Synthetic oligonucleotide
  Target: ATXN1; (-) strand; PAM type: YTN; PAM sequence: TTC
cttgctcgttggtatggaaa

SEQ ID NO: 161399 - DNA, 20 bp, Artificial Sequence
  Description of Artificial Sequence: Synthetic oligonucleotide
  Target: ATXN1; (-) strand; PAM type: YTN; PAM sequence: TTT
ccttgctcgttggtatggaa

SEQ ID NO: 161400 - DNA, 20 bp, Artificial Sequence
  Description of Artificial Sequence: Synthetic oligonucleotide
  Target: ATXN1; (-) strand; PAM type: YTN; PAM sequence: TTT
tccttgctcgttggtatgga

SEQ ID NO: 161401 - DNA, 20 bp, Artificial Sequence
  Description of Artificial Sequence: Synthetic oligonucleotide
  Target: ATXN1; (-) strand; PAM type: YTN; PAM sequence: CTC
acgcatgagttttccttgct

SEQ ID NO: 161402 - DNA, 20 bp, Artificial Sequence
  Description of Artificial Sequence: Synthetic oligonucleotide
  Target: ATXN1; (-) strand; PAM type: YTN; PAM sequence: CTG
agtaggtctcacgcatgagt

SEQ ID NO: 161403 - DNA, 20 bp, Artificial Sequence
  Description of Artificial Sequence: Synthetic oligonucleotide
  Target: ATXN1; (-) strand; PAM type: YTN; PAM sequence: CTC
tgagtaggtctcacgcatga

SEQ ID NO: 161404 - DNA, 20 bp, Artificial Sequence
  Description of Artificial Sequence: Synthetic oligonucleotide
  Target: ATXN1; (-) strand; PAM type: YTN; PAM sequence: CTC
tctgagtaggtctcacgcat

SEQ ID NO: 161405 - DNA, 20 bp, Artificial Sequence
  Description of Artificial Sequence: Synthetic oligonucleotide
  Target: ATXN1; (-) strand; PAM type: YTN; PAM sequence: TTC
tctctgagtaggtctcacgc

SEQ ID NO: 161406 - DNA, 20 bp, Artificial Sequence
  Description of Artificial Sequence: Synthetic oligonucleotide
  Target: ATXN1; (-) strand; PAM type: YTN; PAM sequence: CTG
gttctctctgagtaggtctc

SEQ ID NO: 161407 - DNA, 20 bp, Artificial Sequence
  Description of Artificial Sequence: Synthetic oligonucleotide
  Target: ATXN1; (-) strand; PAM type: YTN; PAM sequence: CTG
caggagggccagcagggggc

SEQ ID NO: 161408 - DNA, 20 bp, Artificial Sequence
  Description of Artificial Sequence: Synthetic oligonucleotide
  Target: ATXN1; (-) strand; PAM type: YTN; PAM sequence: TTG
gatcagtgctgcaggagggc

SEQ ID NO: 161409 - DNA, 20 bp, Artificial Sequence
  Description of Artificial Sequence: Synthetic oligonucleotide
  Target: ATXN1; (-) strand; PAM type: YTN; PAM sequence: TTA
ttggatcagtgctgcaggag

SEQ ID NO: 161410 - DNA, 20 bp, Artificial Sequence
  Description of Artificial Sequence: Synthetic oligonucleotide
  Target: ATXN1; (-) strand; PAM type: YTN; PAM sequence: TTT
attggatcagtgctgcagga

SEQ ID NO: 161411 - DNA, 20 bp, Artificial Sequence
  Description of Artificial Sequence: Synthetic oligonucleotide
  Target: ATXN1; (-) strand; PAM type: YTN; PAM sequence: TTT
tattggatcagtgctgcagg

SEQ ID NO: 161412 - DNA, 20 bp, Artificial Sequence
  Description of Artificial Sequence: Synthetic oligonucleotide
  Target: ATXN1; (-) strand; PAM type: YTN; PAM sequence: CTG
tggggttttattggatcagt

SEQ ID NO: 161413 - DNA, 20 bp, Artificial Sequence
  Description of Artificial Sequence: Synthetic oligonucleotide
  Target: ATXN1; (-) strand; PAM type: YTN; PAM sequence: CTC
atgaaaccctgtggggtttt

SEQ ID NO: 161414 - DNA, 20 bp, Artificial Sequence
  Description of Artificial Sequence: Synthetic oligonucleotide
  Target: ATXN1; (-) strand; PAM type: YTN; PAM sequence: TTG
cataaatatccctcatgaaa

SEQ ID NO: 161415 - DNA, 20 bp, Artificial Sequence
  Description of Artificial Sequence: Synthetic oligonucleotide
  Target: ATXN1; (-) strand; PAM type: YTN; PAM sequence: CTT
gcataaatatccctcatgaa

SEQ ID NO: 161416 - DNA, 20 bp, Artificial Sequence
  Description of Artificial Sequence: Synthetic oligonucleotide
  Target: ATXN1; (-) strand; PAM type: YTN; PAM sequence: CTC
ttgcataaatatccctcatg

SEQ ID NO: 161417 - DNA, 20 bp, Artificial Sequence
  Description of Artificial Sequence: Synthetic oligonucleotide
  Target: ATXN1; (-) strand; PAM type: YTN; PAM sequence: CTG
acacatcactcttgcataaa

SEQ ID NO: 161418 - DNA, 20 bp, Artificial Sequence
  Description of Artificial Sequence: Synthetic oligonucleotide
  Target: ATXN1; (-) strand; PAM type: YTN; PAM sequence: TTC
tgacacatcactcttgcata

SEQ ID NO: 161419 - DNA, 20 bp, Artificial Sequence
  Description of Artificial Sequence: Synthetic oligonucleotide
  Target: ATXN1; (-) strand; PAM type: YTN; PAM sequence: TTG
cattctgacacatcactctt

SEQ ID NO: 161420 - DNA, 20 bp, Artificial Sequence
  Description of Artificial Sequence: Synthetic oligonucleotide
  Target: ATXN1; (-) strand; PAM type: YTN; PAM sequence: TTT
gcattctgacacatcactct

SEQ ID NO: 161421 - DNA, 20 bp, Artificial Sequence
  Description of Artificial Sequence: Synthetic oligonucleotide
  Target: ATXN1; (-) strand; PAM type: YTN; PAM sequence: TTT
tgcattctgacacatcactc

SEQ ID NO: 161422 - DNA, 20 bp, Artificial Sequence
  Description of Artificial Sequence: Synthetic oligonucleotide
  Target: ATXN1; (-) strand; PAM type: YTN; PAM sequence: CTC
attttgcattctgacacatc

SEQ ID NO: 161423 - DNA, 20 bp, Artificial Sequence
  Description of Artificial Sequence: Synthetic oligonucleotide
  Target: ATXN1; (-) strand; PAM type: YTN; PAM sequence: TTC
tcattttgcattctgacaca

SEQ ID NO: 161424 - DNA, 20 bp, Artificial Sequence
  Description of Artificial Sequence: Synthetic oligonucleotide
  Target: ATXN1; (-) strand; PAM type: YTN; PAM sequence: CTA
tatgcaaatgttctcatttt

SEQ ID NO: 161425 - DNA, 20 bp, Artificial Sequence
  Description of Artificial Sequence: Synthetic oligonucleotide
  Target: ATXN1; (-) strand; PAM type: YTN; PAM sequence: CTA
ctatatgcaaatgttctcat

SEQ ID NO: 161426 - DNA, 20 bp, Artificial Sequence
  Description of Artificial Sequence: Synthetic oligonucleotide
  Target: ATXN1; (-) strand; PAM type: YTN; PAM sequence: CTG
ggcctactatatgcaaatgt

SEQ ID NO: 161427 - DNA, 20 bp, Artificial Sequence
  Description of Artificial Sequence: Synthetic oligonucleotide
  Target: ATXN1; (-) strand; PAM type: YTN; PAM sequence: CTG
gctgggcctactatatgcaa

SEQ ID NO: 161428 - DNA, 20 bp, Artificial Sequence
  Description of Artificial Sequence: Synthetic oligonucleotide
  Target: ATXN1; (-) strand; PAM type: YTN; PAM sequence: TTA
ctggctgggcctactatatg

SEQ ID NO: 161429 - DNA, 20 bp, Artificial Sequence
  Description of Artificial Sequence: Synthetic oligonucleotide
  Target: ATXN1; (-) strand; PAM type: YTN; PAM sequence: CTT
actggctgggcctactatat

SEQ ID NO: 161430 - DNA, 20 bp, Artificial Sequence
  Description of Artificial Sequence: Synthetic oligonucleotide
  Target: ATXN1; (-) strand; PAM type: YTN; PAM sequence: TTC
ccttactggctgggcctact

SEQ ID NO: 161431 - DNA, 20 bp, Artificial Sequence
  Description of Artificial Sequence: Synthetic oligonucleotide
  Target: ATXN1; (-) strand; PAM type: YTN; PAM sequence: CTA
ttcccttactggctgggcct

SEQ ID NO: 161432 - DNA, 20 bp, Artificial Sequence
  Description of Artificial Sequence: Synthetic oligonucleotide
  Target: ATXN1; (-) strand; PAM type: YTN; PAM sequence: TTA
acctattcccttactggctg

SEQ ID NO: 161433 - DNA, 20 bp, Artificial Sequence
  Description of Artificial Sequence: Synthetic oligonucleotide
  Target: ATXN1; (-) strand; PAM type: YTN; PAM sequence: CTA
attaacctattcccttactg

SEQ ID NO: 161434 - DNA, 20 bp, Artificial Sequence
  Description of Artificial Sequence: Synthetic oligonucleotide
  Target: ATXN1; (-) strand; PAM type: YTN; PAM sequence: TTG
ggctaattaacctattccct

SEQ ID NO: 161435 - DNA, 20 bp, Artificial Sequence
  Description of Artificial Sequence: Synthetic oligonucleotide
  Target: ATXN1; (-) strand; PAM type: YTN; PAM sequence: CTT
gggctaattaacctattccc

SEQ ID NO: 161436 - DNA, 20 bp, Artificial Sequence
  Description of Artificial Sequence: Synthetic oligonucleotide
  Target: ATXN1; (-) strand; PAM type: YTN; PAM sequence: CTG
ccttgggctaattaacctat

SEQ ID NO: 161437 - DNA, 20 bp, Artificial Sequence
  Description of Artificial Sequence: Synthetic oligonucleotide
  Target: ATXN1; (-) strand; PAM type: YTN; PAM sequence: CTA
gtgctgccttgggctaatta

SEQ ID NO: 161438 - DNA, 20 bp, Artificial Sequence
  Description of Artificial Sequence: Synthetic oligonucleotide
  Target: ATXN1; (-) strand; PAM type: YTN; PAM sequence: TTC
cctagtgctgccttgggcta

SEQ ID NO: 161439 - DNA, 20 bp, Artificial Sequence
  Description of Artificial Sequence: Synthetic oligonucleotide
  Target: ATXN1; (-) strand; PAM type: YTN; PAM sequence: CTT
ccctagtgctgccttgggct

SEQ ID NO: 161440 - DNA, 20 bp, Artificial Sequence
  Description of Artificial Sequence: Synthetic oligonucleotide
  Target: ATXN1; (-) strand; PAM type: YTN; PAM sequence: TTC
ttccctagtgctgccttggg

SEQ ID NO: 161441 - DNA, 20 bp, Artificial Sequence
  Description of Artificial Sequence: Synthetic oligonucleotide
  Target: ATXN1; (-) strand; PAM type: YTN; PAM sequence: TTT
cttccctagtgctgccttgg

SEQ ID NO: 161442 - DNA, 20 bp, Artificial Sequence
  Description of Artificial Sequence: Synthetic oligonucleotide
  Target: ATXN1; (-) strand; PAM type: YTN; PAM sequence: TTT
tcttccctagtgctgccttg

SEQ ID NO: 161443 - DNA, 20 bp, Artificial Sequence
  Description of Artificial Sequence: Synthetic oligonucleotide
  Target: ATXN1; (-) strand; PAM type: YTN; PAM sequence: TTT
ttcttccctagtgctgcctt

SEQ ID NO: 161444 - DNA, 20 bp, Artificial Sequence
  Description of Artificial Sequence: Synthetic oligonucleotide
  Target: ATXN1; (-) strand; PAM type: YTN; PAM sequence: CTT
tttcttccctagtgctgcct

SEQ ID NO: 161445 - DNA, 20 bp, Artificial Sequence
  Description of Artificial Sequence: Synthetic oligonucleotide
  Target: ATXN1; (-) strand; PAM type: YTN; PAM sequence: CTG
ctttttcttccctagtgctg

SEQ ID NO: 161446 - DNA, 20 bp, Artificial Sequence
  Description of Artificial Sequence: Synthetic oligonucleotide
  Target: ATXN1; (-) strand; PAM type: YTN; PAM sequence: TTA
tgccgctgctttttcttccc

SEQ ID NO: 161447 - DNA, 20 bp, Artificial Sequence
  Description of Artificial Sequence: Synthetic oligonucleotide
  Target: ATXN1; (-) strand; PAM type: YTN; PAM sequence: TTT
atgccgctgctttttcttcc

SEQ ID NO: 161448 - DNA, 20 bp, Artificial Sequence
  Description of Artificial Sequence: Synthetic oligonucleotide
  Target: ATXN1; (-) strand; PAM type: YTN; PAM sequence: TTT
tatgccgctgctttttcttc

SEQ ID NO: 161449 - DNA, 20 bp, Artificial Sequence
  Description of Artificial Sequence: Synthetic oligonucleotide
  Target: ATXN1; (-) strand; PAM type: YTN; PAM sequence: CTT
ttatgccgctgctttttctt

SEQ ID NO: 161450 - DNA, 20 bp, Artificial Sequence
  Description of Artificial Sequence: Synthetic oligonucleotide
  Target: ATXN1; (-) strand; PAM type: YTN; PAM sequence: TTG
aaaggacttttatgccgctg

SEQ ID NO: 161451 - DNA, 20 bp, Artificial Sequence
  Description of Artificial Sequence: Synthetic oligonucleotide
  Target: ATXN1; (-) strand; PAM type: YTN; PAM sequence: TTT
gaaaggacttttatgccgct

SEQ ID NO: 161452 - DNA, 20 bp, Artificial Sequence
  Description of Artificial Sequence: Synthetic oligonucleotide
  Target: ATXN1; (-) strand; PAM type: YTN; PAM sequence: CTT
tgaaaggacttttatgccgc

SEQ ID NO: 161453 - DNA, 20 bp, Artificial Sequence
  Description of Artificial Sequence: Synthetic oligonucleotide
  Target: ATXN1; (-) strand; PAM type: YTN; PAM sequence: TTG
gctttgaaaggacttttatg

SEQ ID NO: 161454 - DNA, 20 bp, Artificial Sequence
  Description of Artificial Sequence: Synthetic oligonucleotide
  Target: ATXN1; (-) strand; PAM type: YTN; PAM sequence: CTT
ggctttgaaaggacttttat

SEQ ID NO: 161455 - DNA, 20 bp, Artificial Sequence
  Description of Artificial Sequence: Synthetic oligonucleotide
  Target: ATXN1; (-) strand; PAM type: YTN; PAM sequence: TTA
cttggctttgaaaggacttt

SEQ ID NO: 161456 - DNA, 20 bp, Artificial Sequence
  Description of Artificial Sequence: Synthetic oligonucleotide
  Target: ATXN1; (-) strand; PAM type: YTN; PAM sequence: TTT
acttggctttgaaaggactt

SEQ ID NO: 161457 - DNA, 20 bp, Artificial Sequence
  Description of Artificial Sequence: Synthetic oligonucleotide
  Target: ATXN1; (-) strand; PAM type: YTN; PAM sequence: TTT
tacttggctttgaaaggact

SEQ ID NO: 161458 - DNA, 20 bp, Artificial Sequence
  Description of Artificial Sequence: Synthetic oligonucleotide
  Target: ATXN1; (-) strand; PAM type: YTN; PAM sequence: TTG
acattttacttggctttgaa

SEQ ID NO: 161459 - DNA, 20 bp, Artificial Sequence
  Description of Artificial Sequence: Synthetic oligonucleotide
  Target: ATXN1; (-) strand; PAM type: YTN; PAM sequence: TTT
gacattttacttggctttga

SEQ ID NO: 161460 - DNA, 20 bp, Artificial Sequence
  Description of Artificial Sequence: Synthetic oligonucleotide
  Target: ATXN1; (-) strand; PAM type: YTN; PAM sequence: CTG
aatgtgtttgacattttact

SEQ ID NO: 161461 - DNA, 20 bp, Artificial Sequence
  Description of Artificial Sequence: Synthetic oligonucleotide
  Target: ATXN1; (-) strand; PAM type: YTN; PAM sequence: TTC
ctgaatgtgtttgacatttt

SEQ ID NO: 161462 - DNA, 20 bp, Artificial Sequence
  Description of Artificial Sequence: Synthetic oligonucleotide
  Target: ATXN1; (-) strand; PAM type: YTN; PAM sequence: CTT
cctgaatgtgtttgacattt

SEQ ID NO: 161463 - DNA, 20 bp, Artificial Sequence
  Description of Artificial Sequence: Synthetic oligonucleotide
  Target: ATXN1; (-) strand; PAM type: YTN; PAM sequence: CTA
atagacccttcctgaatgtg

SEQ ID NO: 161464 - DNA, 20 bp, Artificial Sequence
  Description of Artificial Sequence: Synthetic oligonucleotide
  Target: ATXN1; (-) strand; PAM type: YTN; PAM sequence: TTG
ctaatagacccttcctgaat

SEQ ID NO: 161465 - DNA, 20 bp, Artificial Sequence
  Description of Artificial Sequence: Synthetic oligonucleotide
  Target: ATXN1; (-) strand; PAM type: YTN; PAM sequence: TTG
cattgctaatagacccttcc

SEQ ID NO: 161466 - DNA, 20 bp, Artificial Sequence
  Description of Artificial Sequence: Synthetic oligonucleotide
  Target: ATXN1; (-) strand; PAM type: YTN; PAM sequence: TTT
gcattgctaatagacccttc

SEQ ID NO: 161467 - DNA, 20 bp, Artificial Sequence
  Description of Artificial Sequence: Synthetic oligonucleotide
  Target: ATXN1; (-) strand; PAM type: YTN; PAM sequence: TTA
catttgcattgctaatagac

SEQ ID NO: 161468 - DNA, 20 bp, Artificial Sequence
  Description of Artificial Sequence: Synthetic oligonucleotide
  Target: ATXN1; (-) strand; PAM type: YTN; PAM sequence: TTG
tacaggcaatgttacatttg

SEQ ID NO: 161469 - DNA, 20 bp, Artificial Sequence
  Description of Artificial Sequence: Synthetic oligonucleotide
  Target: ATXN1; (-) strand; PAM type: YTN; PAM sequence: TTC
aattgtacaggcaatgttac

SEQ ID NO: 161470 - DNA, 20 bp, Artificial Sequence
  Description of Artificial Sequence: Synthetic oligonucleotide
  Target: ATXN1; (-) strand; PAM type: YTN; PAM sequence: TTG
tgcattcaattgtacaggca

SEQ ID NO: 161471 - DNA, 20 bp, Artificial Sequence
  Description of Artificial Sequence: Synthetic oligonucleotide
  Target: ATXN1; (-) strand; PAM type: YTN; PAM sequence: TTG
tgtattgtgcattcaattgt

SEQ ID NO: 161472 - DNA, 20 bp, Artificial Sequence
  Description of Artificial Sequence: Synthetic oligonucleotide
  Target: ATXN1; (-) strand; PAM type: YTN; PAM sequence: TTT
gtgtattgtgcattcaattg

SEQ ID NO: 161473 - DNA, 20 bp, Artificial Sequence
  Description of Artificial Sequence: Synthetic oligonucleotide
  Target: ATXN1; (-) strand; PAM type: YTN; PAM sequence: TTT
tgtgtattgtgcattcaatt

SEQ ID NO: 161474 - DNA, 20 bp, Artificial Sequence
  Description of Artificial Sequence: Synthetic oligonucleotide
  Target: ATXN1; (-) strand; PAM type: YTN; PAM sequence: CTA
gttttgtgtattgtgcattc

SEQ ID NO: 161475 - DNA, 20 bp, Artificial Sequence
  Description of Artificial Sequence: Synthetic oligonucleotide
  Target: ATXN1; (-) strand; PAM type: YTN; PAM sequence: TTC
tagttttgtgtattgtgcat

SEQ ID NO: 161476 - DNA, 20 bp, Artificial Sequence
  Description of Artificial Sequence: Synthetic oligonucleotide
  Target: ATXN1; (-) strand; PAM type: YTN; PAM sequence: TTT
ctagttttgtgtattgtgca

SEQ ID NO: 161477 - DNA, 20 bp, Artificial Sequence
  Description of Artificial Sequence: Synthetic oligonucleotide
  Target: ATXN1; (-) strand; PAM type: YTN; PAM sequence: TTT
tctagttttgtgtattgtgc

SEQ ID NO: 161478 - DNA, 20 bp, Artificial Sequence
  Description of Artificial Sequence: Synthetic oligonucleotide
  Target: ATXN1; (-) strand; PAM type: YTN; PAM sequence: TTC
agaggagttttctagttttg

SEQ ID NO: 161479 - DNA, 20 bp, Artificial Sequence
  Description of Artificial Sequence: Synthetic oligonucleotide
  Target: ATXN1; (-) strand; PAM type: YTN; PAM sequence: CTT
cagaggagttttctagtttt

SEQ ID NO: 161480 - DNA, 20 bp, Artificial Sequence
  Description of Artificial Sequence: Synthetic oligonucleotide
  Target: ATXN1; (-) strand; PAM type: YTN; PAM sequence: CTA
aagaagtaccttcagaggag

SEQ ID NO: 161481 - DNA, 20 bp, Artificial Sequence
  Description of Artificial Sequence: Synthetic oligonucleotide
  Target: ATXN1; (-) strand; PAM type: YTN; PAM sequence: TTC
ctaaagaagtaccttcagag

SEQ ID NO: 161482 - DNA, 20 bp, Artificial Sequence
  Description of Artificial Sequence: Synthetic oligonucleotide
  Target: ATXN1; (-) strand; PAM type: YTN; PAM sequence: CTT
cctaaagaagtaccttcaga

SEQ ID NO: 161483 - DNA, 20 bp, Artificial Sequence
  Description of Artificial Sequence: Synthetic oligonucleotide
  Target: ATXN1; (-) strand; PAM type: YTN; PAM sequence: CTG
gcttcctaaagaagtacctt

SEQ ID NO: 161484 - DNA, 20 bp, Artificial Sequence
  Description of Artificial Sequence: Synthetic oligonucleotide
  Target: ATXN1; (-) strand; PAM type: YTN; PAM sequence: TTA
cgaaagctggcttcctaaag

SEQ ID NO: 161485 - DNA, 20 bp, Artificial Sequence
  Description of Artificial Sequence: Synthetic oligonucleotide
  Target: ATXN1; (-) strand; PAM type: YTN; PAM sequence: TTT
acgaaagctggcttcctaaa

SEQ ID NO: 161486 - DNA, 20 bp, Artificial Sequence
  Description of Artificial Sequence: Synthetic oligonucleotide
  Target: ATXN1; (-) strand; PAM type: YTN; PAM sequence: TTC
aaatttacgaaagctggctt

SEQ ID NO: 161487 - DNA, 20 bp, Artificial Sequence
  Description of Artificial Sequence: Synthetic oligonucleotide
  Target: ATXN1; (-) strand; PAM type: YTN; PAM sequence: TTT
caaatttacgaaagctggct

SEQ ID NO: 161488 - DNA, 20 bp, Artificial Sequence
  Description of Artificial Sequence: Synthetic oligonucleotide
  Target: ATXN1; (-) strand; PAM type: YTN; PAM sequence: TTT
tcaaatttacgaaagctggc

SEQ ID NO: 161489 - DNA, 20 bp, Artificial Sequence
  Description of Artificial Sequence: Synthetic oligonucleotide
  Target: ATXN1; (-) strand; PAM type: YTN; PAM sequence: TTT
ttcaaatttacgaaagctgg

SEQ ID NO: 161490 - DNA, 20 bp, Artificial Sequence
  Description of Artificial Sequence: Synthetic oligonucleotide
  Target: ATXN1; (-) strand; PAM type: YTN; PAM sequence: CTT
tttcaaatttacgaaagctg

SEQ ID NO: 161491 - DNA, 20 bp, Artificial Sequence
  Description of Artificial Sequence: Synthetic oligonucleotide
  Target: ATXN1; (-) strand; PAM type: YTN; PAM sequence: TTC
tttttcaaatttacgaaagc

SEQ ID NO: 161492 - DNA, 20 bp, Artificial Sequence
  Description of Artificial Sequence: Synthetic oligonucleotide
  Target: ATXN1; (-) strand; PAM type: YTN; PAM sequence: CTG
agaaccaagtcagcattctt

SEQ ID NO: 161493 - DNA, 20 bp, Artificial Sequence
  Description of Artificial Sequence: Synthetic oligonucleotide
  Target: ATXN1; (-) strand; PAM type: YTN; PAM sequence: CTA
ctgagaaccaagtcagcatt

SEQ ID NO: 161494 - DNA, 20 bp, Artificial Sequence
  Description of Artificial Sequence: Synthetic oligonucleotide
  Target: ATXN1; (-) strand; PAM type: YTN; PAM sequence: CTG
agcactactgagaaccaagt

SEQ ID NO: 161495 - DNA, 20 bp, Artificial Sequence
  Description of Artificial Sequence: Synthetic oligonucleotide
  Target: ATXN1; (-) strand; PAM type: YTN; PAM sequence: TTA
aacctgagcactactgagaa

SEQ ID NO: 161496 - DNA, 20 bp, Artificial Sequence
  Description of Artificial Sequence: Synthetic oligonucleotide
  Target: ATXN1; (-) strand; PAM type: YTN; PAM sequence: CTC
aaataaacagtataattaaa

SEQ ID NO: 161497 - DNA, 20 bp, Artificial Sequence
  Description of Artificial Sequence: Synthetic oligonucleotide
  Target: ATXN1; (-) strand; PAM type: YTN; PAM sequence: CTC
tcaaataaacagtataatta

SEQ ID NO: 161498 - DNA, 20 bp, Artificial Sequence
  Description of Artificial Sequence: Synthetic oligonucleotide
  Target: ATXN1; (-) strand; PAM type: YTN; PAM sequence: CTA
agccgatgtctctcaaataa

SEQ ID NO: 161499 - DNA, 20 bp, Artificial Sequence
  Description of Artificial Sequence: Synthetic oligonucleotide
  Target: ATXN1; (-) strand; PAM type: YTN; PAM sequence: CTG
actaagccgatgtctctcaa

SEQ ID NO: 161500 - DNA, 20 bp, Artificial Sequence
  Description of Artificial Sequence: Synthetic oligonucleotide
  Target: ATXN1; (-) strand; PAM type: YTN; PAM sequence: TTC
agggctgactaagccgatgt

SEQ ID NO: 161501 - DNA, 20 bp, Artificial Sequence
  Description of Artificial Sequence: Synthetic oligonucleotide
  Target: ATXN1; (-) strand; PAM type: YTN; PAM sequence: CTT
cagggctgactaagccgatg

SEQ ID NO: 161502 - DNA, 20 bp, Artificial Sequence
  Description of Artificial Sequence: Synthetic oligonucleotide
  Target: ATXN1; (-) strand; PAM type: YTN; PAM sequence: TTC
gcagaagaccagtccagtga

SEQ ID NO: 161503 - DNA, 20 bp, Artificial Sequence
  Description of Artificial Sequence: Synthetic oligonucleotide
  Target: ATXN1; (-) strand; PAM type: YTN; PAM sequence: TTT
cgcagaagaccagtccagtg

SEQ ID NO: 161504 - DNA, 20 bp, Artificial Sequence
  Description of Artificial Sequence: Synthetic oligonucleotide
  Target: ATXN1; (-) strand; PAM type: YTN; PAM sequence: TTA
gcaatcatttcgcagaagac

SEQ ID NO: 161505 - DNA, 20 bp, Artificial Sequence
  Description of Artificial Sequence: Synthetic oligonucleotide
  Target: ATXN1; (-) strand; PAM type: YTN; PAM sequence: CTT
agcaatcatttcgcagaaga

SEQ ID NO: 161506 - DNA, 20 bp, Artificial Sequence
  Description of Artificial Sequence: Synthetic oligonucleotide
  Target: ATXN1; (-) strand; PAM type: YTN; PAM sequence: TTA
aggccaatatgtcttagcaa

SEQ ID NO: 161507 - DNA, 20 bp, Artificial Sequence
  Description of Artificial Sequence: Synthetic oligonucleotide
  Target: ATXN1; (-) strand; PAM type: YTN; PAM sequence: TTG
tgtgttaaggccaatatgtc

SEQ ID NO: 161508 - DNA, 20 bp, Artificial Sequence
  Description of Artificial Sequence: Synthetic oligonucleotide
  Target: ATXN1; (-) strand; PAM type: YTN; PAM sequence: TTT
gtgtgttaaggccaatatgt

SEQ ID NO: 161509 - DNA, 20 bp, Artificial Sequence
  Description of Artificial Sequence: Synthetic oligonucleotide
  Target: ATXN1; (-) strand; PAM type: YTN; PAM sequence: TTG
gatttgtgtgttaaggccaa

SEQ ID NO: 161510 - DNA, 20 bp, Artificial Sequence
  Description of Artificial Sequence: Synthetic oligonucleotide
  Target: ATXN1; (-) strand; PAM type: YTN; PAM sequence: TTT
ggatttgtgtgttaaggcca

SEQ ID NO: 161511 - DNA, 20 bp, Artificial Sequence
  Description of Artificial Sequence: Synthetic oligonucleotide
  Target: ATXN1; (-) strand; PAM type: YTN; PAM sequence: TTC
agaagaataaatttggattt

SEQ ID NO: 161512 - DNA, 20 bp, Artificial Sequence
  Description of Artificial Sequence: Synthetic oligonucleotide
  Target: ATXN1; (-) strand; PAM type: YTN; PAM sequence: TTT
cagaagaataaatttggatt

SEQ ID NO: 161513 - DNA, 20 bp, Artificial Sequence
  Description of Artificial Sequence: Synthetic oligonucleotide
  Target: ATXN1; (-) strand; PAM type: YTN; PAM sequence: TTT
tcagaagaataaatttggat

SEQ ID NO: 161514 - DNA, 20 bp, Artificial Sequence
  Description of Artificial Sequence: Synthetic oligonucleotide
  Target: ATXN1; (-) strand; PAM type: YTN; PAM sequence: TTA
tcaatggataagttttcaga

SEQ ID NO: 161515 - DNA, 20 bp, Artificial Sequence
  Description of Artificial Sequence: Synthetic oligonucleotide
  Target: ATXN1; (-) strand; PAM type: YTN; PAM sequence: TTT
atcaatggataagttttcag

SEQ ID NO: 161516 - DNA, 20 bp, Artificial Sequence
  Description of Artificial Sequence: Synthetic oligonucleotide
  Target: ATXN1; (-) strand; PAM type: YTN; PAM sequence: CTG
tttatcaatggataagtttt

SEQ ID NO: 161517 - DNA, 20 bp, Artificial Sequence
  Description of Artificial Sequence: Synthetic oligonucleotide
  Target: ATXN1; (-) strand; PAM type: YTN; PAM sequence: CTG
gaaaagatgctgtttatcaa

SEQ ID NO: 161518 - DNA, 20 bp, Artificial Sequence
  Description of Artificial Sequence: Synthetic oligonucleotide
  Target: ATXN1; (-) strand; PAM type: YTN; PAM sequence: CTC
tggaaaagatgctgtttatc

SEQ ID NO: 161519 - DNA, 20 bp, Artificial Sequence
  Description of Artificial Sequence: Synthetic oligonucleotide
  Target: ATXN1; (-) strand; PAM type: YTN; PAM sequence: TTG
gcaatctctggaaaagatgc

SEQ ID NO: 161520 - DNA, 20 bp, Artificial Sequence
  Description of Artificial Sequence: Synthetic oligonucleotide
  Target: ATXN1; (-) strand; PAM type: YTN; PAM sequence: CTC
attggcaatctctggaaaag

SEQ ID NO: 161521 - DNA, 20 bp, Artificial Sequence
  Description of Artificial Sequence: Synthetic oligonucleotide
  Target: ATXN1; (-) strand; PAM type: YTN; PAM sequence: TTC
tcattggcaatctctggaaa

SEQ ID NO: 161522 - DNA, 20 bp, Artificial Sequence
  Description of Artificial Sequence: Synthetic oligonucleotide
  Target: ATXN1; (-) strand; PAM type: YTN; PAM sequence: TTT
ctcattggcaatctctggaa

SEQ ID NO: 161523 - DNA, 20 bp, Artificial Sequence
  Description of Artificial Sequence: Synthetic oligonucleotide
  Target: ATXN1; (-) strand; PAM type: YTN; PAM sequence: TTG
atttctcattggcaatctct

SEQ ID NO: 161524 - DNA, 20 bp, Artificial Sequence
  Description of Artificial Sequence: Synthetic oligonucleotide
  Target: ATXN1; (-) strand; PAM type: YTN; PAM sequence: CTT
gatttctcattggcaatctc

SEQ ID NO: 161525 - DNA, 20 bp, Artificial Sequence
  Description of Artificial Sequence: Synthetic oligonucleotide
  Target: ATXN1; (-) strand; PAM type: YTN; PAM sequence: TTG
tgtccttgatttctcattgg

SEQ ID NO: 161526 - DNA, 20 bp, Artificial Sequence
  Description of Artificial Sequence: Synthetic oligonucleotide
  Target: ATXN1; (-) strand; PAM type: YTN; PAM sequence: TTA
atcattgtgtccttgatttc

SEQ ID NO: 161527 - DNA, 20 bp, Artificial Sequence
  Description of Artificial Sequence: Synthetic oligonucleotide
  Target: ATXN1; (-) strand; PAM type: YTN; PAM sequence: CTT
aatcattgtgtccttgattt

SEQ ID NO: 161528 - DNA, 20 bp, Artificial Sequence
  Description of Artificial Sequence: Synthetic oligonucleotide
  Target: ATXN1; (-) strand; PAM type: YTN; PAM sequence: CTG
tcttaatcattgtgtccttg

SEQ ID NO: 161529 - DNA, 20 bp, Artificial Sequence
  Description of Artificial Sequence: Synthetic oligonucleotide
  Target: ATXN1; (-) strand; PAM type: YTN; PAM sequence: CTG
ctgtcttaatcattgtgtcc

SEQ ID NO: 161530 - DNA, 20 bp, Artificial Sequence
  Description of Artificial Sequence: Synthetic oligonucleotide
  Target: ATXN1; (-) strand; PAM type: YTN; PAM sequence: CTG
caactgctgtcttaatcatt

SEQ ID NO: 161531 - DNA, 20 bp, Artificial Sequence
  Description of Artificial Sequence: Synthetic oligonucleotide
  Target: ATXN1; (-) strand; PAM type: YTN; PAM sequence: CTC
gctgcaactgctgtcttaat

SEQ ID NO: 161532 - DNA, 20 bp, Artificial Sequence
  Description of Artificial Sequence: Synthetic oligonucleotide
  Target: ATXN1; (-) strand; PAM type: YTN; PAM sequence: TTG
gccccagctcgctgcaactg

SEQ ID NO: 161533 - DNA, 20 bp, Artificial Sequence
  Description of Artificial Sequence: Synthetic oligonucleotide
  Target: ATXN1; (-) strand; PAM type: YTN; PAM sequence: TTT
ggccccagctcgctgcaact

SEQ ID NO: 161534 - DNA, 20 bp, Artificial Sequence
  Description of Artificial Sequence: Synthetic oligonucleotide
  Target: ATXN1; (-) strand; PAM type: YTN; PAM sequence: TTA
tcggtttggccccagctcgc

SEQ ID NO: 161535 - DNA, 20 bp, Artificial Sequence
  Description of Artificial Sequence: Synthetic oligonucleotide
  Target: ATXN1; (-) strand; PAM type: YTN; PAM sequence: TTT
atcggtttggccccagctcg

SEQ ID NO: 161536 - DNA, 20 bp, Artificial Sequence
  Description of Artificial Sequence: Synthetic oligonucleotide
  Target: ATXN1; (-) strand; PAM type: YTN; PAM sequence: TTT
tatcggtttggccccagctc

SEQ ID NO: 161537 - DNA, 20 bp, Artificial Sequence
  Description of Artificial Sequence: Synthetic oligonucleotide
  Target: ATXN1; (-) strand; PAM type: YTN; PAM sequence: CTT
ttatcggtttggccccagct

SEQ ID NO: 161538 - DNA, 20 bp, Artificial Sequence
  Description of Artificial Sequence: Synthetic oligonucleotide
  Target: ATXN1; (-) strand; PAM type: YTN; PAM sequence: CTA
aatgtaggaggaggatgggt

SEQ ID NO: 161539 - DNA, 20 bp, Artificial Sequence
  Description of Artificial Sequence: Synthetic oligonucleotide
  Target: ATXN1; (-) strand; PAM type: YTN; PAM sequence: CTG
gtaaatagccctaaatgtag

SEQ ID NO: 161540 - DNA, 20 bp, Artificial Sequence
  Description of Artificial Sequence: Synthetic oligonucleotide
  Target: ATXN1; (-) strand; PAM type: YTN; PAM sequence: CTG
cactggtaaatagccctaaa

SEQ ID NO: 161541 - DNA, 20 bp, Artificial Sequence
  Description of Artificial Sequence: Synthetic oligonucleotide
  Target: ATXN1; (-) strand; PAM type: YTN; PAM sequence: CTC
cgtgctgcactggtaaatag

SEQ ID NO: 161542 - DNA, 20 bp, Artificial Sequence
  Description of Artificial Sequence: Synthetic oligonucleotide
  Target: ATXN1; (-) strand; PAM type: YTN; PAM sequence: CTG
ctccgtgctgcactggtaaa

SEQ ID NO: 161543 - DNA, 20 bp, Artificial Sequence
  Description of Artificial Sequence: Synthetic oligonucleotide
  Target: ATXN1; (-) strand; PAM type: YTN; PAM sequence: CTG
tctgctccgtgctgcactgg

SEQ ID NO: 161544 - DNA, 20 bp, Artificial Sequence
  Description of Artificial Sequence: Synthetic oligonucleotide
  Target: ATXN1; (-) strand; PAM type: YTN; PAM sequence: TTA
gagagccctgtctgctccgt

SEQ ID NO: 161545 - DNA, 20 bp, Artificial Sequence
  Description of Artificial Sequence: Synthetic oligonucleotide
  Target: ATXN1; (-) strand; PAM type: YTN; PAM sequence: CTC
agcgttagagagccctgtct

SEQ ID NO: 161546 - DNA, 20 bp, Artificial Sequence
  Description of Artificial Sequence: Synthetic oligonucleotide
  Target: ATXN1; (-) strand; PAM type: YTN; PAM sequence: TTA
cggggcccagagaagggaca

SEQ ID NO: 161547 - DNA, 20 bp, Artificial Sequence
  Description of Artificial Sequence: Synthetic oligonucleotide
  Target: ATXN1; (-) strand; PAM type: YTN; PAM sequence: CTT
acggggcccagagaagggac

SEQ ID NO: 161548 - DNA, 20 bp, Artificial Sequence
  Description of Artificial Sequence: Synthetic oligonucleotide
  Target: ATXN1; (-) strand; PAM type: YTN; PAM sequence: CTG
aaagcttacggggcccagag

SEQ ID NO: 161549 - DNA, 20 bp, Artificial Sequence
  Description of Artificial Sequence: Synthetic oligonucleotide
  Target: ATXN1; (-) strand; PAM type: YTN; PAM sequence: TTA
tcagtactgaaagcttacgg

SEQ ID NO: 161550 - DNA, 20 bp, Artificial Sequence
  Description of Artificial Sequence: Synthetic oligonucleotide
  Target: ATXN1; (-) strand; PAM type: YTN; PAM sequence: CTT
atcagtactgaaagcttacg

SEQ ID NO: 161551 - DNA, 20 bp, Artificial Sequence
  Description of Artificial Sequence: Synthetic oligonucleotide
  Target: ATXN1; (-) strand; PAM type: YTN; PAM sequence: TTC
cccttatcagtactgaaagc

SEQ ID NO: 161552 - DNA, 20 bp, Artificial Sequence
  Description of Artificial Sequence: Synthetic oligonucleotide
  Target: ATXN1; (-) strand; PAM type: YTN; PAM sequence: TTT
ccccttatcagtactgaaag

SEQ ID NO: 161553 - DNA, 20 bp, Artificial Sequence
  Description of Artificial Sequence: Synthetic oligonucleotide
  Target: ATXN1; (-) strand; PAM type: YTN; PAM sequence: CTA
cccgtgggtttccccttatc

SEQ ID NO: 161554 - DNA, 20 bp, Artificial Sequence
  Description of Artificial Sequence: Synthetic oligonucleotide
  Target: ATXN1; (-) strand; PAM type: YTN; PAM sequence: CTC
tacccgtgggtttcccctta

SEQ ID NO: 161555 - DNA, 20 bp, Artificial Sequence
  Description of Artificial Sequence: Synthetic oligonucleotide
  Target: ATXN1; (-) strand; PAM type: YTN; PAM sequence: TTG
aaaatacagcaagacccaat

SEQ ID NO: 161556 - DNA, 20 bp, Artificial Sequence
  Description of Artificial Sequence: Synthetic oligonucleotide
  Target: ATXN1; (-) strand; PAM type: YTN; PAM sequence: TTC
attgaaaatacagcaagacc

SEQ ID NO: 161557 - DNA, 20 bp, Artificial Sequence
  Description of Artificial Sequence: Synthetic oligonucleotide
  Target: ATXN1; (-) strand; PAM type: YTN; PAM sequence: CTG
gtggttcattgaaaatacag

SEQ ID NO: 161558 - DNA, 20 bp, Artificial Sequence
  Description of Artificial Sequence: Synthetic oligonucleotide
  Target: ATXN1; (-) strand; PAM type: YTN; PAM sequence: CTC
tggtggttcattgaaaatac

SEQ ID NO: 161559 - DNA, 20 bp, Artificial Sequence
  Description of Artificial Sequence: Synthetic oligonucleotide
  Target: ATXN1; (-) strand; PAM type: YTN; PAM sequence: CTG
gggcgccctctggtggttca

SEQ ID NO: 161560 - DNA, 20 bp, Artificial Sequence
  Description of Artificial Sequence: Synthetic oligonucleotide
  Target: ATXN1; (-) strand; PAM type: YTN; PAM sequence: TTA
gtcccatgatcacccgatag

SEQ ID NO: 161561 - DNA, 20 bp, Artificial Sequence
  Description of Artificial Sequence: Synthetic oligonucleotide
  Target: ATXN1; (-) strand; PAM type: YTN; PAM sequence: TTT
agtcccatgatcacccgata

SEQ ID NO: 161562 - DNA, 20 bp, Artificial Sequence
  Description of Artificial Sequence: Synthetic oligonucleotide
  Target: ATXN1; (-) strand; PAM type: YTN; PAM sequence: TTG
tttagtcccatgatcacccg

SEQ ID NO: 161563 - DNA, 20 bp, Artificial Sequence
  Description of Artificial Sequence: Synthetic oligonucleotide
  Target: ATXN1; (-) strand; PAM type: YTN; PAM sequence: TTG
ttgtttagtcccatgatcac

SEQ ID NO: 161564 - DNA, 20 bp, Artificial Sequence
  Description of Artificial Sequence: Synthetic oligonucleotide
  Target: ATXN1; (-) strand; PAM type: YTN; PAM sequence: TTT
gttgtttagtcccatgatca

SEQ ID NO: 161565 - DNA, 20 bp, Artificial Sequence
  Description of Artificial Sequence: Synthetic oligonucleotide
  Target: ATXN1; (-) strand; PAM type: YTN; PAM sequence: CTT
tgttgtttagtcccatgatc

SEQ ID NO: 161566 - DNA, 20 bp, Artificial Sequence
  Description of Artificial Sequence: Synthetic oligonucleotide
  Target: ATXN1; (-) strand; PAM type: YTN; PAM sequence: TTC
tttgttgtttagtcccatga

SEQ ID NO: 161567 - DNA, 20 bp, Artificial Sequence
  Description of Artificial Sequence: Synthetic oligonucleotide
  Target: ATXN1; (-) strand; PAM type: YTN; PAM sequence: CTT
ctttgttgtttagtcccatg

SEQ ID NO: 161568 - DNA, 20 bp, Artificial Sequence
  Description of Artificial Sequence: Synthetic oligonucleotide
  Target: ATXN1; (-) strand; PAM type: YTN; PAM sequence: TTA
cttctttgttgtttagtccc

SEQ ID NO: 161569 - DNA, 20 bp, Artificial Sequence
  Description of Artificial Sequence: Synthetic oligonucleotide
  Target: ATXN1; (-) strand; PAM type: YTN; PAM sequence: TTC
ataagttacttctttgttgt

SEQ ID NO: 161570 - DNA, 20 bp, Artificial Sequence
  Description of Artificial Sequence: Synthetic oligonucleotide
  Target: ATXN1; (-) strand; PAM type: YTN; PAM sequence: CTT
cataagttacttctttgttg

SEQ ID NO: 161571 - DNA, 20 bp, Artificial Sequence
  Description of Artificial Sequence: Synthetic oligonucleotide
  Target: ATXN1; (-) strand; PAM type: YTN; PAM sequence: TTC
caccttcataagttacttct

SEQ ID NO: 161572 - DNA, 20 bp, Artificial Sequence
  Description of Artificial Sequence: Synthetic oligonucleotide
  Target: ATXN1; (-) strand; PAM type: YTN; PAM sequence: TTT
ccaccttcataagttacttc

SEQ ID NO: 161573 - DNA, 20 bp, Artificial Sequence
  Description of Artificial Sequence: Synthetic oligonucleotide
  Target: ATXN1; (-) strand; PAM type: YTN; PAM sequence: TTT
tccaccttcataagttactt

SEQ ID NO: 161574 - DNA, 20 bp, Artificial Sequence
  Description of Artificial Sequence: Synthetic oligonucleotide
  Target: ATXN1; (-) strand; PAM type: YTN; PAM sequence: CTT
ttccaccttcataagttact

SEQ ID NO: 161575 - DNA, 20 bp, Artificial Sequence
  Description of Artificial Sequence: Synthetic oligonucleotide
  Target: ATXN1; (-) strand; PAM type: YTN; PAM sequence: CTA
cttttccaccttcataagtt

SEQ ID NO: 161576 - DNA, 20 bp, Artificial Sequence
  Description of Artificial Sequence: Synthetic oligonucleotide
  Target: ATXN1; (-) strand; PAM type: YTN; PAM sequence: TTC
caaatctacttttccacctt

SEQ ID NO: 161577 - DNA, 20 bp, Artificial Sequence
  Description of Artificial Sequence: Synthetic oligonucleotide
  Target: ATXN1; (-) strand; PAM type: YTN; PAM sequence: TTT
ccaaatctacttttccacct

SEQ ID NO: 161578 - DNA, 20 bp, Artificial Sequence
  Description of Artificial Sequence: Synthetic oligonucleotide
  Target: ATXN1; (-) strand; PAM type: YTN; PAM sequence: TTT
tccaaatctacttttccacc

SEQ ID NO: 161579 - DNA, 20 bp, Artificial Sequence
  Description of Artificial Sequence: Synthetic oligonucleotide
  Target: ATXN1; (-) strand; PAM type: YTN; PAM sequence: TTA
ttttccaaatctacttttcc

SEQ ID NO: 161580 - DNA, 20 bp, Artificial Sequence
  Description of Artificial Sequence: Synthetic oligonucleotide
  Target: ATXN1; (-) strand; PAM type: YTN; PAM sequence: CTT
attttccaaatctacttttc

SEQ ID NO: 161581 - DNA, 20 bp, Artificial Sequence
  Description of Artificial Sequence: Synthetic oligonucleotide
  Target: ATXN1; (-) strand; PAM type: YTN; PAM sequence: TTC
cttattttccaaatctactt

SEQ ID NO: 161582 - DNA, 20 bp, Artificial Sequence
  Description of Artificial Sequence: Synthetic oligonucleotide
  Target: ATXN1; (-) strand; PAM type: YTN; PAM sequence: CTT
ccttattttccaaatctact

SEQ ID NO: 161583 - DNA, 20 bp, Artificial Sequence
  Description of Artificial Sequence: Synthetic oligonucleotide
  Target: ATXN1; (-) strand; PAM type: YTN; PAM sequence: CTC
ttccttattttccaaatcta

SEQ ID NO: 161584 - DNA, 20 bp, Artificial Sequence
  Description of Artificial Sequence: Synthetic oligonucleotide
  Target: ATXN1; (-) strand; PAM type: YTN; PAM sequence: CTC
tcttccttattttccaaatc

SEQ ID NO: 161585 - DNA, 20 bp, Artificial Sequence
  Description of Artificial Sequence: Synthetic oligonucleotide
  Target: ATXN1; (-) strand; PAM type: YTN; PAM sequence: TTC
tctcttccttattttccaaa

SEQ ID NO: 161586 - DNA, 20 bp, Artificial Sequence
  Description of Artificial Sequence: Synthetic oligonucleotide
  Target: ATXN1; (-) strand; PAM type: YTN; PAM sequence: TTT
ctctcttccttattttccaa

SEQ ID NO: 161587 - DNA, 20 bp, Artificial Sequence
  Description of Artificial Sequence: Synthetic oligonucleotide
  Target: ATXN1; (-) strand; PAM type: YTN; PAM sequence: TTT
tctctcttccttattttcca

SEQ ID NO: 161588 - DNA, 20 bp, Artificial Sequence
  Description of Artificial Sequence: Synthetic oligonucleotide
  Target: ATXN1; (-) strand; PAM type: YTN; PAM sequence: TTT
ttctctcttccttattttcc

SEQ ID NO: 161589 - DNA, 20 bp, Artificial Sequence
  Description of Artificial Sequence: Synthetic oligonucleotide
  Target: ATXN1; (-) strand; PAM type: YTN; PAM sequence: CTT
tttctctcttccttattttc

SEQ ID NO: 161590 - DNA, 20 bp, Artificial Sequence
  Description of Artificial Sequence: Synthetic oligonucleotide
  Target: ATXN1; (-) strand; PAM type: YTN; PAM sequence: TTC
tttttctctcttccttattt

SEQ ID NO: 161591 - DNA, 20 bp, Artificial Sequence
  Description of Artificial Sequence: Synthetic oligonucleotide
  Target: ATXN1; (-) strand; PAM type: YTN; PAM sequence: TTT
ctttttctctcttccttatt

SEQ ID NO: 161592 - DNA, 20 bp, Artificial Sequence
  Description of Artificial Sequence: Synthetic oligonucleotide
  Target: ATXN1; (-) strand; PAM type: YTN; PAM sequence: TTC
gtttctttttctctcttcct

SEQ ID NO: 161593 - DNA, 20 bp, Artificial Sequence
  Description of Artificial Sequence: Synthetic oligonucleotide
  Target: ATXN1; (-) strand; PAM type: YTN; PAM sequence: TTT
cgtttctttttctctcttcc

SEQ ID NO: 161594 - DNA, 20 bp, Artificial Sequence
  Description of Artificial Sequence: Synthetic oligonucleotide
  Target: ATXN1; (-) strand; PAM type: YTN; PAM sequence: CTT
tcgtttctttttctctcttc

SEQ ID NO: 161595 - DNA, 20 bp, Artificial Sequence
  Description of Artificial Sequence: Synthetic oligonucleotide
  Target: ATXN1; (-) strand; PAM type: YTN; PAM sequence: TTC
tttcgtttctttttctctct

SEQ ID NO: 161596 - DNA, 20 bp, Artificial Sequence
  Description of Artificial Sequence: Synthetic oligonucleotide
  Target: ATXN1; (-) strand; PAM type: YTN; PAM sequence: CTT
ctttcgtttctttttctctc

SEQ ID NO: 161597 - DNA, 20 bp, Artificial Sequence
  Description of Artificial Sequence: Synthetic oligonucleotide
  Target: ATXN1; (-) strand; PAM type: YTN; PAM sequence: TTC
ttctttcgtttctttttctc

SEQ ID NO: 161598 - DNA, 20 bp, Artificial Sequence
  Description of Artificial Sequence: Synthetic oligonucleotide
  Target: ATXN1; (-) strand; PAM type: YTN; PAM sequence: TTT
cttctttcgtttctttttct

SEQ ID NO: 161599 - DNA, 20 bp, Artificial Sequence
  Description of Artificial Sequence: Synthetic oligonucleotide
  Target: ATXN1; (-) strand; PAM type: YTN; PAM sequence: TTT
tcttctttcgtttctttttc

SEQ ID NO: 161600 - DNA, 20 bp, Artificial Sequence
  Description of Artificial Sequence: Synthetic oligonucleotide
  Target: ATXN1; (-) strand; PAM type: YTN; PAM sequence: TTT
ttcttctttcgtttcttttt

SEQ ID NO: 161601 - DNA, 20 bp, Artificial Sequence
  Description of Artificial Sequence: Synthetic oligonucleotide
  Target: ATXN1; (-) strand; PAM type: YTN; PAM sequence: TTT
tttcttctttcgtttctttt

SEQ ID NO: 161602 - DNA, 20 bp, Artificial Sequence
  Description of Artificial Sequence: Synthetic oligonucleotide
  Target: ATXN1; (-) strand; PAM type: YTN; PAM sequence: CTT
ttttcttctttcgtttcttt

SEQ ID NO: 161603 - DNA, 20 bp, Artificial Sequence
  Description of Artificial Sequence: Synthetic oligonucleotide
  Target: ATXN1; (-) strand; PAM type: YTN; PAM sequence: TTC
ttttttcttctttcgtttct

SEQ ID NO: 161604 - DNA, 20 bp, Artificial Sequence
  Description of Artificial Sequence: Synthetic oligonucleotide
  Target: ATXN1; (-) strand; PAM type: YTN; PAM sequence: TTT
cttttttcttctttcgtttc

SEQ ID NO: 161605 - DNA, 20 bp, Artificial Sequence
  Description of Artificial Sequence: Synthetic oligonucleotide
  Target: ATXN1; (-) strand; PAM type: YTN; PAM sequence: TTT
tcttttttcttctttcgttt

SEQ ID NO: 161606 - DNA, 20 bp, Artificial Sequence
  Description of Artificial Sequence: Synthetic oligonucleotide
  Target: ATXN1; (-) strand; PAM type: YTN; PAM sequence: TTT
ttcttttttcttctttcgtt

SEQ ID NO: 161607 - DNA, 20 bp, Artificial Sequence
  Description of Artificial Sequence: Synthetic oligonucleotide
  Target: ATXN1; (-) strand; PAM type: YTN; PAM sequence: TTT
tttcttttttcttctttcgt

SEQ ID NO: 161608 - DNA, 20 bp, Artificial Sequence
  Description of Artificial Sequence: Synthetic oligonucleotide
  Target: ATXN1; (-) strand; PAM type: YTN; PAM sequence: CTT
ttttcttttttcttctttcg

SEQ ID NO: 161609 - DNA, 20 bp, Artificial Sequence
  Description of Artificial Sequence: Synthetic oligonucleotide
  Target: ATXN1; (-) strand; PAM type: YTN; PAM sequence: CTC
cttttttcttttttcttctt

SEQ ID NO: 161610 - DNA, 20 bp, Artificial Sequence
  Description of Artificial Sequence: Synthetic oligonucleotide
  Target: ATXN1; (-) strand; PAM type: YTN; PAM sequence: CTC
tccttttttcttttttcttc

SEQ ID NO: 161611 - DNA, 20 bp, Artificial Sequence
  Description of Artificial Sequence: Synthetic oligonucleotide
  Target: ATXN1; (-) strand; PAM type: YTN; PAM sequence: CTA
agagcagaaatcccactctc

SEQ ID NO: 161612 - DNA, 20 bp, Artificial Sequence
  Description of Artificial Sequence: Synthetic oligonucleotide
  Target: ATXN1; (-) strand; PAM type: YTN; PAM sequence: CTC
taagagcagaaatcccactc

SEQ ID NO: 161613 - DNA, 20 bp, Artificial Sequence
  Description of Artificial Sequence: Synthetic oligonucleotide
  Target: ATXN1; (-) strand; PAM type: YTN; PAM sequence: CTA
gagactctaagagcagaaat

SEQ ID NO: 161614 - DNA, 20 bp, Artificial Sequence
  Description of Artificial Sequence: Synthetic oligonucleotide
  Target: ATXN1; (-) strand; PAM type: YTN; PAM sequence: CTG
caactagagactctaagagc

SEQ ID NO: 161615 - DNA, 20 bp, Artificial Sequence
  Description of Artificial Sequence: Synthetic oligonucleotide
  Target: ATXN1; (-) strand; PAM type: YTN; PAM sequence: TTG
tctgcaactagagactctaa

SEQ ID NO: 161616 - DNA, 20 bp, Artificial Sequence
  Description of Artificial Sequence: Synthetic oligonucleotide
  Target: ATXN1; (-) strand; PAM type: YTN; PAM sequence: TTC
aggacacagaggccagttgt

SEQ ID NO: 161617 - DNA, 20 bp, Artificial Sequence
  Description of Artificial Sequence: Synthetic oligonucleotide
  Target: ATXN1; (-) strand; PAM type: YTN; PAM sequence: CTG
ggagggcaattcaggacaca

SEQ ID NO: 161618 - DNA, 20 bp, Artificial Sequence
  Description of Artificial Sequence: Synthetic oligonucleotide
  Target: ATXN1; (-) strand; PAM type: YTN; PAM sequence: CTC
gggggtcccctgggagggca

SEQ ID NO: 161619 - DNA, 20 bp, Artificial Sequence
  Description of Artificial Sequence: Synthetic oligonucleotide
  Target: ATXN1; (-) strand; PAM type: YTN; PAM sequence: CTC
ctcgggggtcccctgggagg

SEQ ID NO: 161620 - DNA, 20 bp, Artificial Sequence
  Description of Artificial Sequence: Synthetic oligonucleotide
  Target: ATXN1; (-) strand; PAM type: YTN; PAM sequence: TTC
cagagataaactcctcgggg

SEQ ID NO: 161621 - DNA, 20 bp, Artificial Sequence
  Description of Artificial Sequence: Synthetic oligonucleotide
  Target: ATXN1; (-) strand; PAM type: YTN; PAM sequence: CTT
ccagagataaactcctcggg

SEQ ID NO: 161622 - DNA, 20 bp, Artificial Sequence
  Description of Artificial Sequence: Synthetic oligonucleotide
  Target: ATXN1; (-) strand; PAM type: YTN; PAM sequence: TTG
tggcaggtgcttccagagat

SEQ ID NO: 161623 - DNA, 20 bp, Artificial Sequence
  Description of Artificial Sequence: Synthetic oligonucleotide
  Target: ATXN1; (-) strand; PAM type: YTN; PAM sequence: TTG
ttgtggcaggtgcttccaga

SEQ ID NO: 161624 - DNA, 20 bp, Artificial Sequence
  Description of Artificial Sequence: Synthetic oligonucleotide
  Target: ATXN1; (-) strand; PAM type: YTN; PAM sequence: TTT
gttgtggcaggtgcttccag

SEQ ID NO: 161625 - DNA, 20 bp, Artificial Sequence
  Description of Artificial Sequence: Synthetic oligonucleotide
  Target: ATXN1; (-) strand; PAM type: YTN; PAM sequence: TTT
tgttgtggcaggtgcttcca

SEQ ID NO: 161626 - DNA, 20 bp, Artificial Sequence
  Description of Artificial Sequence: Synthetic oligonucleotide
  Target: ATXN1; (-) strand; PAM type: YTN; PAM sequence: TTT
ttgttgtggcaggtgcttcc

SEQ ID NO: 161627 - DNA, 20 bp, Artificial Sequence
  Description of Artificial Sequence: Synthetic oligonucleotide
  Target: ATXN1; (-) strand; PAM type: YTN; PAM sequence: CTT
tttgttgtggcaggtgcttc

SEQ ID NO: 161628 - DNA, 20 bp, Artificial Sequence
  Description of Artificial Sequence: Synthetic oligonucleotide
  Target: ATXN1; (-) strand; PAM type: YTN; PAM sequence: TTG
gaagaaatctttttgttgtg

SEQ ID NO: 161629 - DNA, 20 bp, Artificial Sequence
  Description of Artificial Sequence: Synthetic oligonucleotide
  Target: ATXN1; (-) strand; PAM type: YTN; PAM sequence: TTT
ggaagaaatctttttgttgt

SEQ ID NO: 161630 - DNA, 20 bp, Artificial Sequence
  Description of Artificial Sequence: Synthetic oligonucleotide
  Target: ATXN1; (-) strand; PAM type: YTN; PAM sequence: TTG
tgcatggccccatgtttgga

SEQ ID NO: 161631 - DNA, 20 bp, Artificial Sequence
  Description of Artificial Sequence: Synthetic oligonucleotide
  Target: ATXN1; (-) strand; PAM type: YTN; PAM sequence: TTG
atataattgtgcatggcccc

SEQ ID NO: 161632 - DNA, 20 bp, Artificial Sequence
  Description of Artificial Sequence: Synthetic oligonucleotide
  Target: ATXN1; (-) strand; PAM type: YTN; PAM sequence: TTG
gcattgatataattgtgcat

SEQ ID NO: 161633 - DNA, 20 bp, Artificial Sequence
  Description of Artificial Sequence: Synthetic oligonucleotide
  Target: ATXN1; (-) strand; PAM type: YTN; PAM sequence: TTT
ggcattgatataattgtgca

SEQ ID NO: 161634 - DNA, 20 bp, Artificial Sequence
  Description of Artificial Sequence: Synthetic oligonucleotide
  Target: ATXN1; (-) strand; PAM type: YTN; PAM sequence: CTG
gtaatttggcattgatataa

SEQ ID NO: 161635 - DNA, 20 bp, Artificial Sequence
  Description of Artificial Sequence: Synthetic oligonucleotide
  Target: ATXN1; (-) strand; PAM type: YTN; PAM sequence: CTC
tggtaatttggcattgatat

SEQ ID NO: 161636 - DNA, 20 bp, Artificial Sequence
  Description of Artificial Sequence: Synthetic oligonucleotide
  Target: ATXN1; (-) strand; PAM type: YTN; PAM sequence: CTC
tctggtaatttggcattgat

SEQ ID NO: 161637 - DNA, 20 bp, Artificial Sequence
  Description of Artificial Sequence: Synthetic oligonucleotide
  Target: ATXN1; (-) strand; PAM type: YTN; PAM sequence: CTG
catatgtggctctctggtaa

SEQ ID NO: 161638 - DNA, 20 bp, Artificial Sequence
  Description of Artificial Sequence: Synthetic oligonucleotide
  Target: ATXN1; (-) strand; PAM type: YTN; PAM sequence: TTA
aacagtgcgatctgcatatg

SEQ ID NO: 161639 - DNA, 20 bp, Artificial Sequence
  Description of Artificial Sequence: Synthetic oligonucleotide
  Target: ATXN1; (-) strand; PAM type: YTN; PAM sequence: TTT
aaacagtgcgatctgcatat

SEQ ID NO: 161640 - DNA, 20 bp, Artificial Sequence
  Description of Artificial Sequence: Synthetic oligonucleotide
  Target: ATXN1; (-) strand; PAM type: YTN; PAM sequence: TTC
caataggaatgtttaaacag

SEQ ID NO: 161641 - DNA, 20 bp, Artificial Sequence
  Description of Artificial Sequence: Synthetic oligonucleotide
  Target: ATXN1; (-) strand; PAM type: YTN; PAM sequence: TTT
ccaataggaatgtttaaaca

SEQ ID NO: 161642 - DNA, 20 bp, Artificial Sequence
  Description of Artificial Sequence: Synthetic oligonucleotide
  Target: ATXN1; (-) strand; PAM type: YTN; PAM sequence: TTT
tccaataggaatgtttaaac

SEQ ID NO: 161643 - DNA, 20 bp, Artificial Sequence
  Description of Artificial Sequence: Synthetic oligonucleotide
  Target: ATXN1; (-) strand; PAM type: YTN; PAM sequence: CTT
ttccaataggaatgtttaaa

SEQ ID NO: 161644 - DNA, 20 bp, Artificial Sequence
  Description of Artificial Sequence: Synthetic oligonucleotide
  Target: ATXN1; (-) strand; PAM type: YTN; PAM sequence: TTC
ccttttccaataggaatgtt

SEQ ID NO: 161645 - DNA, 20 bp, Artificial Sequence
  Description of Artificial Sequence: Synthetic oligonucleotide
  Target: ATXN1; (-) strand; PAM type: YTN; PAM sequence: TTT
cccttttccaataggaatgt

SEQ ID NO: 161646 - DNA, 20 bp, Artificial Sequence
  Description of Artificial Sequence: Synthetic oligonucleotide
  Target: ATXN1; (-) strand; PAM type: YTN; PAM sequence: CTC
caatttcccttttccaatag

SEQ ID NO: 161647 - DNA, 20 bp, Artificial Sequence
  Description of Artificial Sequence: Synthetic oligonucleotide
  Target: ATXN1; (-) strand; PAM type: YTN; PAM sequence: CTC
cctccaatttcccttttcca

SEQ ID NO: 161648 - DNA, 20 bp, Artificial Sequence
  Description of Artificial Sequence: Synthetic oligonucleotide
  Target: ATXN1; (-) strand; PAM type: YTN; PAM sequence: CTC
tccctccaatttcccttttc

SEQ ID NO: 161649 - DNA, 20 bp, Artificial Sequence
  Description of Artificial Sequence: Synthetic oligonucleotide
  Target: ATXN1; (-) strand; PAM type: YTN; PAM sequence: TTA
actctccctccaatttccct

SEQ ID NO: 161650 - DNA, 20 bp, Artificial Sequence
  Description of Artificial Sequence: Synthetic oligonucleotide
  Target: ATXN1; (-) strand; PAM type: YTN; PAM sequence: CTA
ttaactctccctccaatttc

SEQ ID NO: 161651 - DNA, 20 bp, Artificial Sequence
  Description of Artificial Sequence: Synthetic oligonucleotide
  Target: ATXN1; (-) strand; PAM type: YTN; PAM sequence: TTC
atctattaactctccctcca

SEQ ID NO: 161652 - DNA, 20 bp, Artificial Sequence
  Description of Artificial Sequence: Synthetic oligonucleotide
  Target: ATXN1; (-) strand; PAM type: YTN; PAM sequence: TTG
attcatctattaactctccc

SEQ ID NO: 161653 - DNA, 20 bp, Artificial Sequence
  Description of Artificial Sequence: Synthetic oligonucleotide
  Target: ATXN1; (-) strand; PAM type: YTN; PAM sequence: CTT
gattcatctattaactctcc

SEQ ID NO: 161654 - DNA, 20 bp, Artificial Sequence
  Description of Artificial Sequence: Synthetic oligonucleotide
  Target: ATXN1; (-) strand; PAM type: YTN; PAM sequence: TTG
tcttgattcatctattaact

SEQ ID NO: 161655 - DNA, 20 bp, Artificial Sequence
  Description of Artificial Sequence: Synthetic oligonucleotide
  Target: ATXN1; (-) strand; PAM type: YTN; PAM sequence: TTT
gtcttgattcatctattaac

SEQ ID NO: 161656 - DNA, 20 bp, Artificial Sequence
  Description of Artificial Sequence: Synthetic oligonucleotide
  Target: ATXN1; (-) strand; PAM type: YTN; PAM sequence: CTA
aatacatttgtcttgattca

SEQ ID NO: 161657 - DNA, 20 bp, Artificial Sequence
  Description of Artificial Sequence: Synthetic oligonucleotide
  Target: ATXN1; (-) strand; PAM type: YTN; PAM sequence: CTC
taaatacatttgtcttgatt

SEQ ID NO: 161658 - DNA, 20 bp, Artificial Sequence
  Description of Artificial Sequence: Synthetic oligonucleotide
  Target: ATXN1; (-) strand; PAM type: YTN; PAM sequence: TTA
tcaggcaaaccatgggtagc

SEQ ID NO: 161659 - DNA, 20 bp, Artificial Sequence
  Description of Artificial Sequence: Synthetic oligonucleotide
  Target: ATXN1; (-) strand; PAM type: YTN; PAM sequence: TTC
agaacagtgattatcaggca

SEQ ID NO: 161660 - DNA, 20 bp, Artificial Sequence
  Description of Artificial Sequence: Synthetic oligonucleotide
  Target: ATXN1; (-) strand; PAM type: YTN; PAM sequence: TTA
agatgaatgtattcagaaca

SEQ ID NO: 161661 - DNA, 20 bp, Artificial Sequence
  Description of Artificial Sequence: Synthetic oligonucleotide
  Target: ATXN1; (-) strand; PAM type: YTN; PAM sequence: CTT
aagatgaatgtattcagaac

SEQ ID NO: 161662 - DNA, 20 bp, Artificial Sequence
  Description of Artificial Sequence: Synthetic oligonucleotide
  Target: ATXN1; (-) strand; PAM type: YTN; PAM sequence: CTA
aagcggcttaagatgaatgt

SEQ ID NO: 161663 - DNA, 20 bp, Artificial Sequence
  Description of Artificial Sequence: Synthetic oligonucleotide
  Target: ATXN1; (-) strand; PAM type: YTN; PAM sequence: CTC
taaagcggcttaagatgaat

SEQ ID NO: 161664 - DNA, 20 bp, Artificial Sequence
  Description of Artificial Sequence: Synthetic oligonucleotide
  Target: ATXN1; (-) strand; PAM type: YTN; PAM sequence: TTA
atgtagctctaaagcggctt

SEQ ID NO: 161665 - DNA, 20 bp, Artificial Sequence
  Description of Artificial Sequence: Synthetic oligonucleotide
  Target: ATXN1; (-) strand; PAM type: YTN; PAM sequence: TTA
tgatagagagatagttaatg

SEQ ID NO: 161666 - DNA, 20 bp, Artificial Sequence
  Description of Artificial Sequence: Synthetic oligonucleotide
  Target: ATXN1; (-) strand; PAM type: YTN; PAM sequence: TTA
gaaattatgatagagagata

SEQ ID NO: 161667 - DNA, 20 bp, Artificial Sequence
  Description of Artificial Sequence: Synthetic oligonucleotide
  Target: ATXN1; (-) strand; PAM type: YTN; PAM sequence: TTT
agaaattatgatagagagat

SEQ ID NO: 161668 - DNA, 20 bp, Artificial Sequence
  Description of Artificial Sequence: Synthetic oligonucleotide
  Target: ATXN1; (-) strand; PAM type: YTN; PAM sequence: CTA
aatttagaaattatgataga

SEQ ID NO: 161669 - DNA, 20 bp, Artificial Sequence
  Description of Artificial Sequence: Synthetic oligonucleotide
  Target: ATXN1; (-) strand; PAM type: YTN; PAM sequence: CTG
ggctaaatttagaaattatg

SEQ ID NO: 161670 - DNA, 20 bp, Artificial Sequence
  Description of Artificial Sequence: Synthetic oligonucleotide
  Target: ATXN1; (-) strand; PAM type: YTN; PAM sequence: TTA
taccactgggctaaatttag

SEQ ID NO: 161671 - DNA, 20 bp, Artificial Sequence
  Description of Artificial Sequence: Synthetic oligonucleotide
  Target: ATXN1; (-) strand; PAM type: YTN; PAM sequence: CTT
ataccactgggctaaattta

SEQ ID NO: 161672 - DNA, 20 bp, Artificial Sequence
  Description of Artificial Sequence: Synthetic oligonucleotide
  Target: ATXN1; (-) strand; PAM type: YTN; PAM sequence: CTA
gcaaagccttataccactgg

SEQ ID NO: 161673 - DNA, 20 bp, Artificial Sequence
  Description of Artificial Sequence: Synthetic oligonucleotide
  Target: ATXN1; (-) strand; PAM type: YTN; PAM sequence: TTC
gactagcaaagccttatacc

SEQ ID NO: 161674 - DNA, 20 bp, Artificial Sequence
  Description of Artificial Sequence: Synthetic oligonucleotide
  Target: ATXN1; (-) strand; PAM type: YTN; PAM sequence: CTT
cgactagcaaagccttatac

SEQ ID NO: 161675 - DNA, 20 bp, Artificial Sequence
  Description of Artificial Sequence: Synthetic oligonucleotide
  Target: ATXN1; (-) strand; PAM type: YTN; PAM sequence: CTG
atgtcacgggtcggaggacc

SEQ ID NO: 161676 - DNA, 20 bp, Artificial Sequence
  Description of Artificial Sequence: Synthetic oligonucleotide
  Target: ATXN1; (-) strand; PAM type: YTN; PAM sequence: TTG
cagaggatgctgatgtcacg

SEQ ID NO: 161677 - DNA, 20 bp, Artificial Sequence
  Description of Artificial Sequence: Synthetic oligonucleotide
  Target: ATXN1; (-) strand; PAM type: YTN; PAM sequence: CTT
gcagaggatgctgatgtcac

SEQ ID NO: 161678 - DNA, 20 bp, Artificial Sequence
  Description of Artificial Sequence: Synthetic oligonucleotide
  Target: ATXN1; (-) strand; PAM type: YTN; PAM sequence: TTC
cagcaaacttgcagaggatg

SEQ ID NO: 161679 - DNA, 20 bp, Artificial Sequence
  Description of Artificial Sequence: Synthetic oligonucleotide
  Target: ATXN1; (-) strand; PAM type: YTN; PAM sequence: TTT
ccagcaaacttgcagaggat

SEQ ID NO: 161680 - DNA, 20 bp, Artificial Sequence
  Description of Artificial Sequence: Synthetic oligonucleotide
  Target: ATXN1; (-) strand; PAM type: YTN; PAM sequence: CTG
catttccagcaaacttgcag

SEQ ID NO: 161681 - DNA, 20 bp, Artificial Sequence
  Description of Artificial Sequence: Synthetic oligonucleotide
  Target: ATXN1; (-) strand; PAM type: YTN; PAM sequence: CTG
agagtctgcatttccagcaa

SEQ ID NO: 161682 - DNA, 20 bp, Artificial Sequence
  Description of Artificial Sequence: Synthetic oligonucleotide
  Target: ATXN1; (-) strand; PAM type: YTN; PAM sequence: CTG
ggtggggcctgagagtctgc

SEQ ID NO: 161683 - DNA, 20 bp, Artificial Sequence
  Description of Artificial Sequence: Synthetic oligonucleotide
  Target: ATXN1; (-) strand; PAM type: YTN; PAM sequence: TTA
aaatgcaggactgggtgggg

SEQ ID NO: 161684 - DNA, 20 bp, Artificial Sequence
  Description of Artificial Sequence: Synthetic oligonucleotide
  Target: ATXN1; (-) strand; PAM type: YTN; PAM sequence: TTG
ttaaaatgcaggactgggtg

SEQ ID NO: 161685 - DNA, 20 bp, Artificial Sequence
  Description of Artificial Sequence: Synthetic oligonucleotide
  Target: ATXN1; (-) strand; PAM type: YTN; PAM sequence: CTT
gttaaaatgcaggactgggt

SEQ ID NO: 161686 - DNA, 20 bp, Artificial Sequence
  Description of Artificial Sequence: Synthetic oligonucleotide
  Target: ATXN1; (-) strand; PAM type: YTN; PAM sequence: CTG
gatatcttgttaaaatgcag

SEQ ID NO: 161687 - DNA, 20 bp, Artificial Sequence
  Description of Artificial Sequence: Synthetic oligonucleotide
  Target: ATXN1; (-) strand; PAM type: YTN; PAM sequence: CTG
tgcatagaatcatctggata

SEQ ID NO: 161688 - DNA, 20 bp, Artificial Sequence
  Description of Artificial Sequence: Synthetic oligonucleotide
  Target: ATXN1; (-) strand; PAM type: YTN; PAM sequence: TTA
ctgtgcatagaatcatctgg

SEQ ID NO: 161689 - DNA, 20 bp, Artificial Sequence
  Description of Artificial Sequence: Synthetic oligonucleotide
  Target: ATXN1; (-) strand; PAM type: YTN; PAM sequence: CTT
actgtgcatagaatcatctg

SEQ ID NO: 161690 - DNA, 20 bp, Artificial Sequence
  Description of Artificial Sequence: Synthetic oligonucleotide
  Target: ATXN1; (-) strand; PAM type: YTN; PAM sequence: CTC
aaaccttactgtgcatagaa

SEQ ID NO: 161691 - DNA, 20 bp, Artificial Sequence
  Description of Artificial Sequence: Synthetic oligonucleotide
  Target: ATXN1; (-) strand; PAM type: YTN; PAM sequence: TTC
tcaaaccttactgtgcatag

SEQ ID NO: 161692 - DNA, 20 bp, Artificial Sequence
  Description of Artificial Sequence: Synthetic oligonucleotide
  Target: ATXN1; (-) strand; PAM type: YTN; PAM sequence: TTT
ctcaaaccttactgtgcata

SEQ ID NO: 161693 - DNA, 20 bp, Artificial Sequence
  Description of Artificial Sequence: Synthetic oligonucleotide
  Target: ATXN1; (-) strand; PAM type: YTN; PAM sequence: CTA
gggtttctcaaaccttactg

SEQ ID NO: 161694 - DNA, 20 bp, Artificial Sequence
  Description of Artificial Sequence: Synthetic oligonucleotide
  Target: ATXN1; (-) strand; PAM type: YTN; PAM sequence: CTG
ctagggtttctcaaacctta

SEQ ID NO: 161695 - DNA, 20 bp, Artificial Sequence
  Description of Artificial Sequence: Synthetic oligonucleotide
  Target: ATXN1; (-) strand; PAM type: YTN; PAM sequence: TTA
atcggatagctgctagggtt

SEQ ID NO: 161696 - DNA, 20 bp, Artificial Sequence
  Description of Artificial Sequence: Synthetic oligonucleotide
  Target: ATXN1; (-) strand; PAM type: YTN; PAM sequence: TTT
aatcggatagctgctagggt

SEQ ID NO: 161697 - DNA, 20 bp, Artificial Sequence
  Description of Artificial Sequence: Synthetic oligonucleotide
  Target: ATXN1; (-) strand; PAM type: YTN; PAM sequence: TTA
gcagtagaaaatttaatcgg

SEQ ID NO: 161698 - DNA, 20 bp, Artificial Sequence
  Description of Artificial Sequence: Synthetic oligonucleotide
  Target: ATXN1; (-) strand; PAM type: YTN; PAM sequence: TTT
agcagtagaaaatttaatcg

SEQ ID NO: 161699 - DNA, 20 bp, Artificial Sequence
  Description of Artificial Sequence: Synthetic oligonucleotide
  Target: ATXN1; (-) strand; PAM type: YTN; PAM sequence: TTA
agagtttagcagtagaaaat

SEQ ID NO: 161700 - DNA, 20 bp, Artificial Sequence
  Description of Artificial Sequence: Synthetic oligonucleotide
  Target: ATXN1; (-) strand; PAM type: YTN; PAM sequence: CTT
aagagtttagcagtagaaaa

SEQ ID NO: 161701 - DNA, 20 bp, Artificial Sequence
  Description of Artificial Sequence: Synthetic oligonucleotide
  Target: ATXN1; (-) strand; PAM type: YTN; PAM sequence: TTG
cttaagagtttagcagtaga

SEQ ID NO: 161702 - DNA, 20 bp, Artificial Sequence
  Description of Artificial Sequence: Synthetic oligonucleotide
  Target: ATXN1; (-) strand; PAM type: YTN; PAM sequence: TTT
gcttaagagtttagcagtag

SEQ ID NO: 161703 - DNA, 20 bp, Artificial Sequence
  Description of Artificial Sequence: Synthetic oligonucleotide
  Target: ATXN1; (-) strand; PAM type: YTN; PAM sequence: TTA
atttgcttaagagtttagca

SEQ ID NO: 161704 - DNA, 20 bp, Artificial Sequence
  Description of Artificial Sequence: Synthetic oligonucleotide
  Target: ATXN1; (-) strand; PAM type: YTN; PAM sequence: TTT
aatttgcttaagagtttagc

SEQ ID NO: 161705 - DNA, 20 bp, Artificial Sequence
  Description of Artificial Sequence: Synthetic oligonucleotide
  Target: ATXN1; (-) strand; PAM type: YTN; PAM sequence: CTA
gagatgtttaatttgcttaa

SEQ ID NO: 161706 - DNA, 20 bp, Artificial Sequence
  Description of Artificial Sequence: Synthetic oligonucleotide
  Target: ATXN1; (-) strand; PAM type: YTN; PAM sequence: TTA
ggaagaggctagagatgttt

SEQ ID NO: 161707 - DNA, 20 bp, Artificial Sequence
  Description of Artificial Sequence: Synthetic oligonucleotide
  Target: ATXN1; (-) strand; PAM type: YTN; PAM sequence: CTC
cattaggaagaggctagaga

SEQ ID NO: 161708 - DNA, 20 bp, Artificial Sequence
  Description of Artificial Sequence: Synthetic oligonucleotide
  Target: ATXN1; (-) strand; PAM type: YTN; PAM sequence: CTG
ctccattaggaagaggctag

SEQ ID NO: 161709 - DNA, 20 bp, Artificial Sequence
  Description of Artificial Sequence: Synthetic oligonucleotide
  Target: ATXN1; (-) strand; PAM type: YTN; PAM sequence: TTC
ccagtgcctgctccattagg

SEQ ID NO: 161710 - DNA, 20 bp, Artificial Sequence
  Description of Artificial Sequence: Synthetic oligonucleotide
  Target: ATXN1; (-) strand; PAM type: YTN; PAM sequence: TTT
cccagtgcctgctccattag

SEQ ID NO: 161711 - DNA, 20 bp, Artificial Sequence
  Description of Artificial Sequence: Synthetic oligonucleotide
  Target: ATXN1; (-) strand; PAM type: YTN; PAM sequence: TTG
gtttcccagtgcctgctcca

SEQ ID NO: 161712 - DNA, 20 bp, Artificial Sequence
  Description of Artificial Sequence: Synthetic oligonucleotide
  Target: ATXN1; (-) strand; PAM type: YTN; PAM sequence: TTT
ggtttcccagtgcctgctcc

SEQ ID NO: 161713 - DNA, 20 bp, Artificial Sequence
  Description of Artificial Sequence: Synthetic oligonucleotide
  Target: ATXN1; (-) strand; PAM type: YTN; PAM sequence: CTA
gtttggtttcccagtgcctg

SEQ ID NO: 161714 - DNA, 20 bp, Artificial Sequence
  Description of Artificial Sequence: Synthetic oligonucleotide
  Target: ATXN1; (-) strand; PAM type: YTN; PAM sequence: TTA
cgtacaacacctagtttggt

SEQ ID NO: 161715 - DNA, 20 bp, Artificial Sequence
  Description of Artificial Sequence: Synthetic oligonucleotide
  Target: ATXN1; (-) strand; PAM type: YTN; PAM sequence: TTT
acgtacaacacctagtttgg

SEQ ID NO: 161716 - DNA, 20 bp, Artificial Sequence
  Description of Artificial Sequence: Synthetic oligonucleotide
  Target: ATXN1; (-) strand; PAM type: YTN; PAM sequence: CTG
tgtttacgtacaacacctag

SEQ ID NO: 161717 - DNA, 20 bp, Artificial Sequence
  Description of Artificial Sequence: Synthetic oligonucleotide
  Target: ATXN1; (-) strand; PAM type: YTN; PAM sequence: CTC
tgtgtttacgtacaacacct

SEQ ID NO: 161718 - DNA, 20 bp, Artificial Sequence
  Description of Artificial Sequence: Synthetic oligonucleotide
  Target: ATXN1; (-) strand; PAM type: YTN; PAM sequence: CTC
catcaactctgtgtttacgt

SEQ ID NO: 161719 - DNA, 20 bp, Artificial Sequence
  Description of Artificial Sequence: Synthetic oligonucleotide
  Target: ATXN1; (-) strand; PAM type: YTN; PAM sequence: CTC
cgaggctccatcaactctgt

SEQ ID NO: 161720 - DNA, 20 bp, Artificial Sequence
  Description of Artificial Sequence: Synthetic oligonucleotide
  Target: ATXN1; (-) strand; PAM type: YTN; PAM sequence: TTA
tctccgaggctccatcaact

SEQ ID NO: 161721 - DNA, 20 bp, Artificial Sequence
  Description of Artificial Sequence: Synthetic oligonucleotide
  Target: ATXN1; (-) strand; PAM type: YTN; PAM sequence: TTT
atctccgaggctccatcaac

SEQ ID NO: 161722 - DNA, 20 bp, Artificial Sequence
  Description of Artificial Sequence: Synthetic oligonucleotide
  Target: ATXN1; (-) strand; PAM type: YTN; PAM sequence: TTA
gatgtttatctccgaggctc

SEQ ID NO: 161723 - DNA, 20 bp, Artificial Sequence
  Description of Artificial Sequence: Synthetic oligonucleotide
  Target: ATXN1; (-) strand; PAM type: YTN; PAM sequence: CTA
aatattagatgtttatctcc

SEQ ID NO: 161724 - DNA, 20 bp, Artificial Sequence
  Description of Artificial Sequence: Synthetic oligonucleotide
  Target: ATXN1; (-) strand; PAM type: YTN; PAM sequence: TTA
gatgaccccagaggaagcag

SEQ ID NO: 161725 - DNA, 20 bp, Artificial Sequence
  Description of Artificial Sequence: Synthetic oligonucleotide
  Target: ATXN1; (-) strand; PAM type: YTN; PAM sequence: TTT
agatgaccccagaggaagca

SEQ ID NO: 161726 - DNA, 20 bp, Artificial Sequence
  Description of Artificial Sequence: Synthetic oligonucleotide
  Target: ATXN1; (-) strand; PAM type: YTN; PAM sequence: TTA
ggtttagatgaccccagagg

SEQ ID NO: 161727 - DNA, 20 bp, Artificial Sequence
  Description of Artificial Sequence: Synthetic oligonucleotide
  Target: ATXN1; (-) strand; PAM type: YTN; PAM sequence: TTG
cagccgtattaggtttagat

SEQ ID NO: 161728 - DNA, 20 bp, Artificial Sequence
  Description of Artificial Sequence: Synthetic oligonucleotide
  Target: ATXN1; (-) strand; PAM type: YTN; PAM sequence: TTT
gcagccgtattaggtttaga

SEQ ID NO: 161729 - DNA, 20 bp, Artificial Sequence
  Description of Artificial Sequence: Synthetic oligonucleotide
  Target: ATXN1; (-) strand; PAM type: YTN; PAM sequence: TTA
tttgcagccgtattaggttt

SEQ ID NO: 161730 - DNA, 20 bp, Artificial Sequence
  Description of Artificial Sequence: Synthetic oligonucleotide
  Target: ATXN1; (-) strand; PAM type: YTN; PAM sequence: TTG
ttatttgcagccgtattagg

SEQ ID NO: 161731 - DNA, 20 bp, Artificial Sequence
  Description of Artificial Sequence: Synthetic oligonucleotide
  Target: ATXN1; (-) strand; PAM type: YTN; PAM sequence: TTT
gttatttgcagccgtattag

SEQ ID NO: 161732 - DNA, 20 bp, Artificial Sequence
  Description of Artificial Sequence: Synthetic oligonucleotide
  Target: ATXN1; (-) strand; PAM type: YTN; PAM sequence: TTG
tgtaaagaaccagaagaaaa

SEQ ID NO: 161733 - DNA, 20 bp, Artificial Sequence
  Description of Artificial Sequence: Synthetic oligonucleotide
  Target: ATXN1; (-) strand; PAM type: YTN; PAM sequence: CTG
cagttgtgtaaagaaccaga

SEQ ID NO: 161734 - DNA, 20 bp, Artificial Sequence
  Description of Artificial Sequence: Synthetic oligonucleotide
  Target: ATXN1; (-) strand; PAM type: YTN; PAM sequence: CTC
tgcagttgtgtaaagaacca

SEQ ID NO: 161735 - DNA, 20 bp, Artificial Sequence
  Description of Artificial Sequence: Synthetic oligonucleotide
  Target: ATXN1; (-) strand; PAM type: YTN; PAM sequence: TTC
tctgcagttgtgtaaagaac

SEQ ID NO: 161736 - DNA, 20 bp, Artificial Sequence
  Description of Artificial Sequence: Synthetic oligonucleotide
  Target: ATXN1; (-) strand; PAM type: YTN; PAM sequence: TTT
ctctgcagttgtgtaaagaa

SEQ ID NO: 161737 - DNA, 20 bp, Artificial Sequence
  Description of Artificial Sequence: Synthetic oligonucleotide
  Target: ATXN1; (-) strand; PAM type: YTN; PAM sequence: TTA
aagtatatttctctgcagtt

SEQ ID NO: 161738 - DNA, 20 bp, Artificial Sequence
  Description of Artificial Sequence: Synthetic oligonucleotide
  Target: ATXN1; (-) strand; PAM type: YTN; PAM sequence: TTT
aaagtatatttctctgcagt

SEQ ID NO: 161739 - DNA, 20 bp, Artificial Sequence
  Description of Artificial Sequence: Synthetic oligonucleotide
  Target: ATXN1; (-) strand; PAM type: YTN; PAM sequence: TTT
taaagtatatttctctgcag

SEQ ID NO: 161740 - DNA, 20 bp, Artificial Sequence
  Description of Artificial Sequence: Synthetic oligonucleotide
  Target: ATXN1; (-) strand; PAM type: YTN; PAM sequence: TTT
ttaaagtatatttctctgca

SEQ ID NO: 161741 - DNA, 20 bp, Artificial Sequence
  Description of Artificial Sequence: Synthetic oligonucleotide
  Target: ATXN1; (-) strand; PAM type: YTN; PAM sequence: CTT
tttaaagtatatttctctgc

SEQ ID NO: 161742 - DNA, 20 bp, Artificial Sequence
  Description of Artificial Sequence: Synthetic oligonucleotide
  Target: ATXN1; (-) strand; PAM type: YTN; PAM sequence: TTA
tgataatagcctttttaaag

SEQ ID NO: 161743 - DNA, 20 bp, Artificial Sequence
  Description of Artificial Sequence: Synthetic oligonucleotide
  Target: ATXN1; (-) strand; PAM type: YTN; PAM sequence: TTT
atgataatagcctttttaaa

SEQ ID NO: 161744 - DNA, 20 bp, Artificial Sequence
  Description of Artificial Sequence: Synthetic oligonucleotide
  Target: ATXN1; (-) strand; PAM type: YTN; PAM sequence: TTG
tgtataaaatttatgataat

SEQ ID NO: 161745 - DNA, 20 bp, Artificial Sequence
  Description of Artificial Sequence: Synthetic oligonucleotide
  Target: ATXN1; (-) strand; PAM type: YTN; PAM sequence: TTG
agttgtgtataaaatttatg

SEQ ID NO: 161746 - DNA, 20 bp, Artificial Sequence
  Description of Artificial Sequence: Synthetic oligonucleotide
  Target: ATXN1; (-) strand; PAM type: YTN; PAM sequence: CTG
ggaatgattgagttgtgtat

SEQ ID NO: 161747 - DNA, 20 bp, Artificial Sequence
  Description of Artificial Sequence: Synthetic oligonucleotide
  Target: ATXN1; (-) strand; PAM type: YTN; PAM sequence: TTC
ctgggaatgattgagttgtg

SEQ ID NO: 161748 - DNA, 20 bp, Artificial Sequence
  Description of Artificial Sequence: Synthetic oligonucleotide
  Target: ATXN1; (-) strand; PAM type: YTN; PAM sequence: CTT
cctgggaatgattgagttgt

SEQ ID NO: 161749 - DNA, 20 bp, Artificial Sequence
  Description of Artificial Sequence: Synthetic oligonucleotide
  Target: ATXN1; (-) strand; PAM type: YTN; PAM sequence: TTC
ttcctgggaatgattgagtt

SEQ ID NO: 161750 - DNA, 20 bp, Artificial Sequence
  Description of Artificial Sequence: Synthetic oligonucleotide
  Target: ATXN1; (-) strand; PAM type: YTN; PAM sequence: TTT
cttcctgggaatgattgagt

SEQ ID NO: 161751 - DNA, 20 bp, Artificial Sequence
  Description of Artificial Sequence: Synthetic oligonucleotide
  Target: ATXN1; (-) strand; PAM type: YTN; PAM sequence: TTT
tcttcctgggaatgattgag

SEQ ID NO: 161752 - DNA, 20 bp, Artificial Sequence
  Description of Artificial Sequence: Synthetic oligonucleotide
  Target: ATXN1; (-) strand; PAM type: YTN; PAM sequence: TTT
ttcttcctgggaatgattga

SEQ ID NO: 161753 - DNA, 20 bp, Artificial Sequence
  Description of Artificial Sequence: Synthetic oligonucleotide
  Target: ATXN1; (-) strand; PAM type: YTN; PAM sequence: TTC
atttttcttcctgggaatga

SEQ ID NO: 161754 - DNA, 20 bp, Artificial Sequence
  Description of Artificial Sequence: Synthetic oligonucleotide
  Target: ATXN1; (-) strand; PAM type: YTN; PAM sequence: TTT
catttttcttcctgggaatg

SEQ ID NO: 161755 - DNA, 20 bp, Artificial Sequence
  Description of Artificial Sequence: Synthetic oligonucleotide
  Target: ATXN1; (-) strand; PAM type: YTN; PAM sequence: TTA
aatttcatttttcttcctgg

SEQ ID NO: 161756 - DNA, 20 bp, Artificial Sequence
  Description of Artificial Sequence: Synthetic oligonucleotide
  Target: ATXN1; (-) strand; PAM type: YTN; PAM sequence: TTG
ttaaatttcatttttcttcc

SEQ ID NO: 161757 - DNA, 20 bp, Artificial Sequence
  Description of Artificial Sequence: Synthetic oligonucleotide
  Target: ATXN1; (-) strand; PAM type: YTN; PAM sequence: TTT
gttaaatttcatttttcttc

SEQ ID NO: 161758 - DNA, 20 bp, Artificial Sequence
  Description of Artificial Sequence: Synthetic oligonucleotide
  Target: ATXN1; (-) strand; PAM type: YTN; PAM sequence: CTT
tgttaaatttcatttttctt

SEQ ID NO: 161759 - DNA, 20 bp, Artificial Sequence
  Description of Artificial Sequence: Synthetic oligonucleotide
  Target: ATXN1; (-) strand; PAM type: YTN; PAM sequence: TTC
ctttgttaaatttcattttt

SEQ ID NO: 161760 - DNA, 20 bp, Artificial Sequence
  Description of Artificial Sequence: Synthetic oligonucleotide
  Target: ATXN1; (-) strand; PAM type: YTN; PAM sequence: CTT
cctttgttaaatttcatttt

SEQ ID NO: 161761 - DNA, 20 bp, Artificial Sequence
  Description of Artificial Sequence: Synthetic oligonucleotide
  Target: ATXN1; (-) strand; PAM type: YTN; PAM sequence: TTA
tagcaaagaaagaagtgtgg

SEQ ID NO: 161762 - DNA, 20 bp, Artificial Sequence
  Description of Artificial Sequence: Synthetic oligonucleotide
  Target: ATXN1; (-) strand; PAM type: YTN; PAM sequence: CTC
gaaatgaaattatagcaaag

SEQ ID NO: 161763 - DNA, 20 bp, Artificial Sequence
  Description of Artificial Sequence: Synthetic oligonucleotide
  Target: ATXN1; (-) strand; PAM type: YTN; PAM sequence: TTC
tcgaaatgaaattatagcaa

SEQ ID NO: 161764 - DNA, 20 bp, Artificial Sequence
  Description of Artificial Sequence: Synthetic oligonucleotide
  Target: ATXN1; (-) strand; PAM type: YTN; PAM sequence: TTT
ctcgaaatgaaattatagca

SEQ ID NO: 161765 - DNA, 20 bp, Artificial Sequence
  Description of Artificial Sequence: Synthetic oligonucleotide
  Target: ATXN1; (-) strand; PAM type: YTN; PAM sequence: CTG
aatccatggtaatagcaaaa

SEQ ID NO: 161766 - DNA, 20 bp, Artificial Sequence
  Description of Artificial Sequence: Synthetic oligonucleotide
  Target: ATXN1; (-) strand; PAM type: YTN; PAM sequence: TTC
ccaagcagtctgaatccatg

SEQ ID NO: 161767 - DNA, 20 bp, Artificial Sequence
  Description of Artificial Sequence: Synthetic oligonucleotide
  Target: ATXN1; (-) strand; PAM type: YTN; PAM sequence: CTT
cccaagcagtctgaatccat

SEQ ID NO: 161768 - DNA, 20 bp, Artificial Sequence
  Description of Artificial Sequence: Synthetic oligonucleotide
  Target: ATXN1; (-) strand; PAM type: YTN; PAM sequence: CTA
tcacttcccaagcagtctga

SEQ ID NO: 161769 - DNA, 20 bp, Artificial Sequence
  Description of Artificial Sequence: Synthetic oligonucleotide
  Target: ATXN1; (-) strand; PAM type: YTN; PAM sequence: TTC
ctatcacttcccaagcagtc

SEQ ID NO: 161770 - DNA, 20 bp, Artificial Sequence
  Description of Artificial Sequence: Synthetic oligonucleotide
  Target: ATXN1; (-) strand; PAM type: YTN; PAM sequence: TTT
cctatcacttcccaagcagt

SEQ ID NO: 161771 - DNA, 20 bp, Artificial Sequence
  Description of Artificial Sequence: Synthetic oligonucleotide
  Target: ATXN1; (-) strand; PAM type: YTN; PAM sequence: TTT
tcctatcacttcccaagcag

SEQ ID NO: 161772 - DNA, 20 bp, Artificial Sequence
  Description of Artificial Sequence: Synthetic oligonucleotide
  Target: ATXN1; (-) strand; PAM type: YTN; PAM sequence: CTC
attttcctatcacttcccaa

SEQ ID NO: 161773 - DNA, 20 bp, Artificial Sequence
  Description of Artificial Sequence: Synthetic oligonucleotide
  Target: ATXN1; (-) strand; PAM type: YTN; PAM sequence: CTA
gcacagaagcatctcatttt

SEQ ID NO: 161774 - DNA, 20 bp, Artificial Sequence
  Description of Artificial Sequence: Synthetic oligonucleotide
  Target: ATXN1; (-) strand; PAM type: YTN; PAM sequence: TTC
cccacatccctagcacagaa

SEQ ID NO: 161775 - DNA, 20 bp, Artificial Sequence
  Description of Artificial Sequence: Synthetic oligonucleotide
  Target: ATXN1; (-) strand; PAM type: YTN; PAM sequence: TTG
cagtcagtgggcatatattc

SEQ ID NO: 161776 - DNA, 20 bp, Artificial Sequence
  Description of Artificial Sequence: Synthetic oligonucleotide
  Target: ATXN1; (-) strand; PAM type: YTN; PAM sequence: CTT
gcagtcagtgggcatatatt

SEQ ID NO: 161777 - DNA, 20 bp, Artificial Sequence
  Description of Artificial Sequence: Synthetic oligonucleotide
  Target: ATXN1; (-) strand; PAM type: YTN; PAM sequence: CTG
gacttgcagtcagtgggcat

SEQ ID NO: 161778 - DNA, 20 bp, Artificial Sequence
  Description of Artificial Sequence: Synthetic oligonucleotide
  Target: ATXN1; (-) strand; PAM type: YTN; PAM sequence: TTA
ctggacttgcagtcagtggg

SEQ ID NO: 161779 - DNA, 20 bp, Artificial Sequence
  Description of Artificial Sequence: Synthetic oligonucleotide
  Target: ATXN1; (-) strand; PAM type: YTN; PAM sequence: TTT
actggacttgcagtcagtgg

SEQ ID NO: 161780 - DNA, 20 bp, Artificial Sequence
  Description of Artificial Sequence: Synthetic oligonucleotide
  Target: ATXN1; (-) strand; PAM type: YTN; PAM sequence: CTA
tttactggacttgcagtcag

SEQ ID NO: 161781 - DNA, 20 bp, Artificial Sequence
  Description of Artificial Sequence: Synthetic oligonucleotide
  Target: ATXN1; (-) strand; PAM type: YTN; PAM sequence: CTG
ctatttactggacttgcagt

SEQ ID NO: 161782 - DNA, 20 bp, Artificial Sequence
  Description of Artificial Sequence: Synthetic oligonucleotide
  Target: ATXN1; (-) strand; PAM type: YTN; PAM sequence: TTG
gctgctatttactggacttg

SEQ ID NO: 161783 - DNA, 20 bp, Artificial Sequence
  Description of Artificial Sequence: Synthetic oligonucleotide
  Target: ATXN1; (-) strand; PAM type: YTN; PAM sequence: CTG
agcagttggctgctatttac

SEQ ID NO: 161784 - DNA, 20 bp, Artificial Sequence
  Description of Artificial Sequence: Synthetic oligonucleotide
  Target: ATXN1; (-) strand; PAM type: YTN; PAM sequence: TTC
tgagcagttggctgctattt

SEQ ID NO: 161785 - DNA, 20 bp, Artificial Sequence
  Description of Artificial Sequence: Synthetic oligonucleotide
  Target: ATXN1; (-) strand; PAM type: YTN; PAM sequence: TTC
cattctgagcagttggctgc

SEQ ID NO: 161786 - DNA, 20 bp, Artificial Sequence
  Description of Artificial Sequence: Synthetic oligonucleotide
  Target: ATXN1; (-) strand; PAM type: YTN; PAM sequence: CTT
ccattctgagcagttggctg

SEQ ID NO: 161787 - DNA, 20 bp, Artificial Sequence
  Description of Artificial Sequence: Synthetic oligonucleotide
  Target: ATXN1; (-) strand; PAM type: YTN; PAM sequence: CTA
agagcatcttccattctgag

SEQ ID NO: 161788 - DNA, 20 bp, Artificial Sequence
  Description of Artificial Sequence: Synthetic oligonucleotide
  Target: ATXN1; (-) strand; PAM type: YTN; PAM sequence: TTC
taagagcatcttccattctg

SEQ ID NO: 161789 - DNA, 20 bp, Artificial Sequence
  Description of Artificial Sequence: Synthetic oligonucleotide
  Target: ATXN1; (-) strand; PAM type: YTN; PAM sequence: TTA
tatatcaaattctaagagca

SEQ ID NO: 161790 - DNA, 20 bp, Artificial Sequence
  Description of Artificial Sequence: Synthetic oligonucleotide
  Target: ATXN1; (-) strand; PAM type: YTN; PAM sequence: TTT
atatatcaaattctaagagc

SEQ ID NO: 161791 - DNA, 20 bp, Artificial Sequence
  Description of Artificial Sequence: Synthetic oligonucleotide
  Target: ATXN1; (-) strand; PAM type: YTN; PAM sequence: TTA
ggagtttatatatcaaattc

SEQ ID NO: 161792 - DNA, 20 bp, Artificial Sequence
  Description of Artificial Sequence: Synthetic oligonucleotide
  Target: ATXN1; (-) strand; PAM type: YTN; PAM sequence: TTT
aggagtttatatatcaaatt

SEQ ID NO: 161793 - DNA, 20 bp, Artificial Sequence
  Description of Artificial Sequence: Synthetic oligonucleotide
  Target: ATXN1; (-) strand; PAM type: YTN; PAM sequence: TTT
taggagtttatatatcaaat

SEQ ID NO: 161794 - DNA, 20 bp, Artificial Sequence
  Description of Artificial Sequence: Synthetic oligonucleotide
  Target: ATXN1; (-) strand; PAM type: YTN; PAM sequence: TTT
ttaggagtttatatatcaaa

SEQ ID NO: 161795 - DNA, 20 bp, Artificial Sequence
  Description of Artificial Sequence: Synthetic oligonucleotide
  Target: ATXN1; (-) strand; PAM type: YTN; PAM sequence: TTA
agatgtatttttaggagttt

SEQ ID NO: 161796 - DNA, 20 bp, Artificial Sequence
  Description of Artificial Sequence: Synthetic oligonucleotide
  Target: ATXN1; (-) strand; PAM type: YTN; PAM sequence: TTT
aagatgtatttttaggagtt

SEQ ID NO: 161797 - DNA, 20 bp, Artificial Sequence
  Description of Artificial Sequence: Synthetic oligonucleotide
  Target: ATXN1; (-) strand; PAM type: YTN; PAM sequence: CTA
ggtttaagatgtatttttag

SEQ ID NO: 161798 - DNA, 20 bp, Artificial Sequence
  Description of Artificial Sequence: Synthetic oligonucleotide
  Target: ATXN1; (-) strand; PAM type: YTN; PAM sequence: TTG
ccctaggtttaagatgtatt

SEQ ID NO: 161799 - DNA, 20 bp, Artificial Sequence
  Description of Artificial Sequence: Synthetic oligonucleotide
  Target: ATXN1; (-) strand; PAM type: YTN; PAM sequence: CTT
gccctaggtttaagatgtat

SEQ ID NO: 161800 - DNA, 20 bp, Artificial Sequence
  Description of Artificial Sequence: Synthetic oligonucleotide
  Target: ATXN1; (-) strand; PAM type: YTN; PAM sequence: TTC
ttgccctaggtttaagatgt

SEQ ID NO: 161801 - DNA, 20 bp, Artificial Sequence
  Description of Artificial Sequence: Synthetic oligonucleotide
  Target: ATXN1; (-) strand; PAM type: YTN; PAM sequence: TTT
cttgccctaggtttaagatg

SEQ ID NO: 161802 - DNA, 20 bp, Artificial Sequence
  Description of Artificial Sequence: Synthetic oligonucleotide
  Target: ATXN1; (-) strand; PAM type: YTN; PAM sequence: TTT
tcttgccctaggtttaagat

SEQ ID NO: 161803 - DNA, 20 bp, Artificial Sequence
  Description of Artificial Sequence: Synthetic oligonucleotide
  Target: ATXN1; (-) strand; PAM type: YTN; PAM sequence: TTG
ggggtgtaggaaaagcaacc

SEQ ID NO: 161804 - DNA, 20 bp, Artificial Sequence
  Description of Artificial Sequence: Synthetic oligonucleotide
  Target: ATXN1; (-) strand; PAM type: YTN; PAM sequence: CTG
agaagcacaggattgggggt

SEQ ID NO: 161805 - DNA, 20 bp, Artificial Sequence
  Description of Artificial Sequence: Synthetic oligonucleotide
  Target: ATXN1; (-) strand; PAM type: YTN; PAM sequence: TTC
aaactgagaagcacaggatt

SEQ ID NO: 161806 - DNA, 20 bp, Artificial Sequence
  Description of Artificial Sequence: Synthetic oligonucleotide
  Target: ATXN1; (-) strand; PAM type: YTN; PAM sequence: TTC
attcaaactgagaagcacag

SEQ ID NO: 161807 - DNA, 20 bp, Artificial Sequence
  Description of Artificial Sequence: Synthetic oligonucleotide
  Target: ATXN1; (-) strand; PAM type: YTN; PAM sequence: TTG
tccatagatatacaggccag

SEQ ID NO: 161808 - DNA, 20 bp, Artificial Sequence
  Description of Artificial Sequence: Synthetic oligonucleotide
  Target: ATXN1; (-) strand; PAM type: YTN; PAM sequence: TTT
gtccatagatatacaggcca

SEQ ID NO: 161809 - DNA, 20 bp, Artificial Sequence
  Description of Artificial Sequence: Synthetic oligonucleotide
  Target: ATXN1; (-) strand; PAM type: YTN; PAM sequence: CTG
tttgtccatagatatacagg

SEQ ID NO: 161810 - DNA, 20 bp, Artificial Sequence
  Description of Artificial Sequence: Synthetic oligonucleotide
  Target: ATXN1; (-) strand; PAM type: YTN; PAM sequence: CTG
aaaccgtgccctgtttgtcc

SEQ ID NO: 161811 - DNA, 20 bp, Artificial Sequence
  Description of Artificial Sequence: Synthetic oligonucleotide
  Target: ATXN1; (-) strand; PAM type: YTN; PAM sequence: TTA
aagctgaaaccgtgccctgt

SEQ ID NO: 161812 - DNA, 20 bp, Artificial Sequence
  Description of Artificial Sequence: Synthetic oligonucleotide
  Target: ATXN1; (-) strand; PAM type: YTN; PAM sequence: TTT
aaagctgaaaccgtgccctg

SEQ ID NO: 161813 - DNA, 20 bp, Artificial Sequence
  Description of Artificial Sequence: Synthetic oligonucleotide
  Target: ATXN1; (-) strand; PAM type: YTN; PAM sequence: CTT
taaagctgaaaccgtgccct

SEQ ID NO: 161814 - DNA, 20 bp, Artificial Sequence
  Description of Artificial Sequence: Synthetic oligonucleotide
  Target: ATXN1; (-) strand; PAM type: YTN; PAM sequence: TTC
tttaaagctgaaaccgtgcc

SEQ ID NO: 161815 - DNA, 20 bp, Artificial Sequence
  Description of Artificial Sequence: Synthetic oligonucleotide
  Target: ATXN1; (-) strand; PAM type: YTN; PAM sequence: CTT
ctttaaagctgaaaccgtgc

SEQ ID NO: 161816 - DNA, 20 bp, Artificial Sequence
  Description of Artificial Sequence: Synthetic oligonucleotide
  Target: ATXN1; (-) strand; PAM type: YTN; PAM sequence: CTC
ttctttaaagctgaaaccgt

SEQ ID NO: 161817 - DNA, 20 bp, Artificial Sequence
  Description of Artificial Sequence: Synthetic oligonucleotide
  Target: ATXN1; (-) strand; PAM type: YTN; PAM sequence: TTC
ctcttctttaaagctgaaac

SEQ ID NO: 161818 - DNA, 20 bp, Artificial Sequence
  Description of Artificial Sequence: Synthetic oligonucleotide
  Target: ATXN1; (-) strand; PAM type: YTN; PAM sequence: CTT
cctcttctttaaagctgaaa

SEQ ID NO: 161819 - DNA, 20 bp, Artificial Sequence
  Description of Artificial Sequence: Synthetic oligonucleotide
  Target: ATXN1; (-) strand; PAM type: YTN; PAM sequence: CTC
ttcctcttctttaaagctga

SEQ ID NO: 161820 - DNA, 20 bp, Artificial Sequence
  Description of Artificial Sequence: Synthetic oligonucleotide
  Target: ATXN1; (-) strand; PAM type: YTN; PAM sequence: CTG
ctcttcctcttctttaaagc

SEQ ID NO: 161821 - DNA, 20 bp, Artificial Sequence
  Description of Artificial Sequence: Synthetic oligonucleotide
  Target: ATXN1; (-) strand; PAM type: YTN; PAM sequence: CTC
atcagcctgctcttcctctt

SEQ ID NO: 161822 - DNA, 20 bp, Artificial Sequence
  Description of Artificial Sequence: Synthetic oligonucleotide
  Target: ATXN1; (-) strand; PAM type: YTN; PAM sequence: CTG
gcacaagctcatcagcctgc

SEQ ID NO: 161823 - DNA, 20 bp, Artificial Sequence
  Description of Artificial Sequence: Synthetic oligonucleotide
  Target: ATXN1; (-) strand; PAM type: YTN; PAM sequence: TTC
cagtcctggcacaagctcat

SEQ ID NO: 161824 - DNA, 20 bp, Artificial Sequence
  Description of Artificial Sequence: Synthetic oligonucleotide
  Target: ATXN1; (-) strand; PAM type: YTN; PAM sequence: TTT
ccagtcctggcacaagctca

SEQ ID NO: 161825 - DNA, 20 bp, Artificial Sequence
  Description of Artificial Sequence: Synthetic oligonucleotide
  Target: ATXN1; (-) strand; PAM type: YTN; PAM sequence: TTT
tccagtcctggcacaagctc

SEQ ID NO: 161826 - DNA, 20 bp, Artificial Sequence
  Description of Artificial Sequence: Synthetic oligonucleotide
  Target: ATXN1; (-) strand; PAM type: YTN; PAM sequence: TTT
ttccagtcctggcacaagct

SEQ ID NO: 161827 - DNA, 20 bp, Artificial Sequence
  Description of Artificial Sequence: Synthetic oligonucleotide
  Target: ATXN1; (-) strand; PAM type: YTN; PAM sequence: TTG
catacgtagtttttccagtc

SEQ ID NO: 161828 - DNA, 20 bp, Artificial Sequence
  Description of Artificial Sequence: Synthetic oligonucleotide
  Target: ATXN1; (-) strand; PAM type: YTN; PAM sequence: TTT
gcatacgtagtttttccagt

SEQ ID NO: 161829 - DNA, 20 bp, Artificial Sequence
  Description of Artificial Sequence: Synthetic oligonucleotide
  Target: ATXN1; (-) strand; PAM type: YTN; PAM sequence: TTC
agtgtttgcatacgtagttt

SEQ ID NO: 161830 - DNA, 20 bp, Artificial Sequence
  Description of Artificial Sequence: Synthetic oligonucleotide
  Target: ATXN1; (-) strand; PAM type: YTN; PAM sequence: CTT
cagtgtttgcatacgtagtt

SEQ ID NO: 161831 - DNA, 20 bp, Artificial Sequence
  Description of Artificial Sequence: Synthetic oligonucleotide
  Target: ATXN1; (-) strand; PAM type: YTN; PAM sequence: CTC
ttcagtgtttgcatacgtag

SEQ ID NO: 161832 - DNA, 20 bp, Artificial Sequence
  Description of Artificial Sequence: Synthetic oligonucleotide
  Target: ATXN1; (-) strand; PAM type: YTN; PAM sequence: CTG
ccctcttcagtgtttgcata

SEQ ID NO: 161833 - DNA, 20 bp, Artificial Sequence
  Description of Artificial Sequence: Synthetic oligonucleotide
  Target: ATXN1; (-) strand; PAM type: YTN; PAM sequence: TTC
tgccctcttcagtgtttgca

SEQ ID NO: 161834 - DNA, 20 bp, Artificial Sequence
  Description of Artificial Sequence: Synthetic oligonucleotide
  Target: ATXN1; (-) strand; PAM type: YTN; PAM sequence: CTC
acacccaggtattctgccct

SEQ ID NO: 161835 - DNA, 20 bp, Artificial Sequence
  Description of Artificial Sequence: Synthetic oligonucleotide
  Target: ATXN1; (-) strand; PAM type: YTN; PAM sequence: CTG
tcctcacacccaggtattct

SEQ ID NO: 161836 - DNA, 20 bp, Artificial Sequence
  Description of Artificial Sequence: Synthetic oligonucleotide
  Target: ATXN1; (-) strand; PAM type: YTN; PAM sequence: CTC
tgtcctcacacccaggtatt

SEQ ID NO: 161837 - DNA, 20 bp, Artificial Sequence
  Description of Artificial Sequence: Synthetic oligonucleotide
  Target: ATXN1; (-) strand; PAM type: YTN; PAM sequence: TTG
acatgcccaagtaacctctg

SEQ ID NO: 161838 - DNA, 20 bp, Artificial Sequence
  Description of Artificial Sequence: Synthetic oligonucleotide
  Target: ATXN1; (-) strand; PAM type: YTN; PAM sequence: CTT
gacatgcccaagtaacctct

SEQ ID NO: 161839 - DNA, 20 bp, Artificial Sequence
  Description of Artificial Sequence: Synthetic oligonucleotide
  Target: ATXN1; (-) strand; PAM type: YTN; PAM sequence: TTG
agaatccttgacatgcccaa

SEQ ID NO: 161840 - DNA, 20 bp, Artificial Sequence
  Description of Artificial Sequence: Synthetic oligonucleotide
  Target: ATXN1; (-) strand; PAM type: YTN; PAM sequence: TTT
gagaatccttgacatgccca

SEQ ID NO: 161841 - DNA, 20 bp, Artificial Sequence
  Description of Artificial Sequence: Synthetic oligonucleotide
  Target: ATXN1; (-) strand; PAM type: YTN; PAM sequence: CTT
tgagaatccttgacatgccc

SEQ ID NO: 161842 - DNA, 20 bp, Artificial Sequence
  Description of Artificial Sequence: Synthetic oligonucleotide
  Target: ATXN1; (-) strand; PAM type: YTN; PAM sequence: TTG
gtgagtcagcactttgagaa

SEQ ID NO: 161843 - DNA, 20 bp, Artificial Sequence
  Description of Artificial Sequence: Synthetic oligonucleotide
  Target: ATXN1; (-) strand; PAM type: YTN; PAM sequence: CTG
gaaggagattggtgagtcag

SEQ ID NO: 161844 - DNA, 20 bp, Artificial Sequence
  Description of Artificial Sequence: Synthetic oligonucleotide
  Target: ATXN1; (-) strand; PAM type: YTN; PAM sequence: TTA
gtgatgtaataaagctggaa

SEQ ID NO: 161845 - DNA, 20 bp, Artificial Sequence
  Description of Artificial Sequence: Synthetic oligonucleotide
  Target: ATXN1; (-) strand; PAM type: YTN; PAM sequence: TTT
agtgatgtaataaagctgga

SEQ ID NO: 161846 - DNA, 20 bp, Artificial Sequence
  Description of Artificial Sequence: Synthetic oligonucleotide
  Target: ATXN1; (-) strand; PAM type: YTN; PAM sequence: TTC
cagtttagtgatgtaataaa

SEQ ID NO: 161847 - DNA, 20 bp, Artificial Sequence
  Description of Artificial Sequence: Synthetic oligonucleotide
  Target: ATXN1; (-) strand; PAM type: YTN; PAM sequence: CTT
ccagtttagtgatgtaataa

SEQ ID NO: 161848 - DNA, 20 bp, Artificial Sequence
  Description of Artificial Sequence: Synthetic oligonucleotide
  Target: ATXN1; (-) strand; PAM type: YTN; PAM sequence: CTG
ccagtgcaccacacaggcct

SEQ ID NO: 161849 - DNA, 20 bp, Artificial Sequence
  Description of Artificial Sequence: Synthetic oligonucleotide
  Target: ATXN1; (-) strand; PAM type: YTN; PAM sequence: TTC
tgccagtgcaccacacaggc

SEQ ID NO: 161850 - DNA, 20 bp, Artificial Sequence
  Description of Artificial Sequence: Synthetic oligonucleotide
  Target: ATXN1; (-) strand; PAM type: YTN; PAM sequence: TTT
ctgccagtgcaccacacagg

SEQ ID NO: 161851 - DNA, 20 bp, Artificial Sequence
  Description of Artificial Sequence: Synthetic oligonucleotide
  Target: ATXN1; (-) strand; PAM type: YTN; PAM sequence: CTT
tctgccagtgcaccacacag

SEQ ID NO: 161852 - DNA, 20 bp, Artificial Sequence
  Description of Artificial Sequence: Synthetic oligonucleotide
  Target: ATXN1; (-) strand; PAM type: YTN; PAM sequence: TTG
gccaaaatgaagtgctttct

SEQ ID NO: 161853 - DNA, 20 bp, Artificial Sequence
  Description of Artificial Sequence: Synthetic oligonucleotide
  Target: ATXN1; (-) strand; PAM type: YTN; PAM sequence: CTT
ggccaaaatgaagtgctttc

SEQ ID NO: 161854 - DNA, 20 bp, Artificial Sequence
  Description of Artificial Sequence: Synthetic oligonucleotide
  Target: ATXN1; (-) strand; PAM type: YTN; PAM sequence: TTA
atgcttggccaaaatgaagt

SEQ ID NO: 161855 - DNA, 20 bp, Artificial Sequence
  Description of Artificial Sequence: Synthetic oligonucleotide
  Target: ATXN1; (-) strand; PAM type: YTN; PAM sequence: TTT
aatgcttggccaaaatgaag

SEQ ID NO: 161856 - DNA, 20 bp, Artificial Sequence
  Description of Artificial Sequence: Synthetic oligonucleotide
  Target: ATXN1; (-) strand; PAM type: YTN; PAM sequence: TTT
taatgcttggccaaaatgaa

SEQ ID NO: 161857 - DNA, 20 bp, Artificial Sequence
  Description of Artificial Sequence: Synthetic oligonucleotide
  Target: ATXN1; (-) strand; PAM type: YTN; PAM sequence: TTT
ttaatgcttggccaaaatga

SEQ ID NO: 161858 - DNA, 20 bp, Artificial Sequence
  Description of Artificial Sequence: Synthetic oligonucleotide
  Target: ATXN1; (-) strand; PAM type: YTN; PAM sequence: CTG
tttttaatgcttggccaaaa

SEQ ID NO: 161859 - DNA, 20 bp, Artificial Sequence
  Description of Artificial Sequence: Synthetic oligonucleotide
  Target: ATXN1; (-) strand; PAM type: YTN; PAM sequence: TTG
gacctgtttttaatgcttgg

SEQ ID NO: 161860 - DNA, 20 bp, Artificial Sequence
  Description of Artificial Sequence: Synthetic oligonucleotide
  Target: ATXN1; (-) strand; PAM type: YTN; PAM sequence: TTT
ggacctgtttttaatgcttg

SEQ ID NO: 161861 - DNA, 20 bp, Artificial Sequence
  Description of Artificial Sequence: Synthetic oligonucleotide
  Target: ATXN1; (-) strand; PAM type: YTN; PAM sequence: CTC
caagcatgtcgggtttggac

SEQ ID NO: 161862 - DNA, 20 bp, Artificial Sequence
  Description of Artificial Sequence: Synthetic oligonucleotide
  Target: ATXN1; (-) strand; PAM type: YTN; PAM sequence: CTA
gatactccaagcatgtcggg

SEQ ID NO: 161863 - DNA, 20 bp, Artificial Sequence
  Description of Artificial Sequence: Synthetic oligonucleotide
  Target: ATXN1; (-) strand; PAM type: YTN; PAM sequence: TTC
tagatactccaagcatgtcg

SEQ ID NO: 161864 - DNA, 20 bp, Artificial Sequence
  Description of Artificial Sequence: Synthetic oligonucleotide
  Target: ATXN1; (-) strand; PAM type: YTN; PAM sequence: CTC
cattctagatactccaagca

SEQ ID NO: 161865 - DNA, 20 bp, Artificial Sequence
  Description of Artificial Sequence: Synthetic oligonucleotide
  Target: ATXN1; (-) strand; PAM type: YTN; PAM sequence: TTC
tccattctagatactccaag

SEQ ID NO: 161866 - DNA, 20 bp, Artificial Sequence
  Description of Artificial Sequence: Synthetic oligonucleotide
  Target: ATXN1; (-) strand; PAM type: YTN; PAM sequence: TTT
ctccattctagatactccaa

SEQ ID NO: 161867 - DNA, 20 bp, Artificial Sequence
  Description of Artificial Sequence: Synthetic oligonucleotide
  Target: ATXN1; (-) strand; PAM type: YTN; PAM sequence: CTT
tctccattctagatactcca

SEQ ID NO: 161868 - DNA, 20 bp, Artificial Sequence
  Description of Artificial Sequence: Synthetic oligonucleotide
  Target: ATXN1; (-) strand; PAM type: YTN; PAM sequence: CTA
tcatccaatccacctttctc

SEQ ID NO: 161869 - DNA, 20 bp, Artificial Sequence
  Description of Artificial Sequence: Synthetic oligonucleotide
  Target: ATXN1; (-) strand; PAM type: YTN; PAM sequence: TTA
tagctatcatccaatccacc

SEQ ID NO: 161870 - DNA, 20 bp, Artificial Sequence
  Description of Artificial Sequence: Synthetic oligonucleotide
  Target: ATXN1; (-) strand; PAM type: YTN; PAM sequence: CTA
attatagctatcatccaatc

SEQ ID NO: 161871 - DNA, 20 bp, Artificial Sequence
  Description of Artificial Sequence: Synthetic oligonucleotide
  Target: ATXN1; (-) strand; PAM type: YTN; PAM sequence: TTC
agtcaaccataaaggcatct

SEQ ID NO: 161872 - DNA, 20 bp, Artificial Sequence
  Description of Artificial Sequence: Synthetic oligonucleotide
  Target: ATXN1; (-) strand; PAM type: YTN; PAM sequence: CTG
ttcagtcaaccataaaggca

SEQ ID NO: 161873 - DNA, 20 bp, Artificial Sequence
  Description of Artificial Sequence: Synthetic oligonucleotide
  Target: ATXN1; (-) strand; PAM type: YTN; PAM sequence: TTG
ggggcatgcctgttcagtca

SEQ ID NO: 161874 - DNA, 20 bp, Artificial Sequence
  Description of Artificial Sequence: Synthetic oligonucleotide
  Target: ATXN1; (-) strand; PAM type: YTN; PAM sequence: TTT
gggggcatgcctgttcagtc

SEQ ID NO: 161875 - DNA, 20 bp, Artificial Sequence
  Description of Artificial Sequence: Synthetic oligonucleotide
  Target: ATXN1; (-) strand; PAM type: YTN; PAM sequence: CTT
tgggggcatgcctgttcagt

SEQ ID NO: 161876 - DNA, 20 bp, Artificial Sequence
  Description of Artificial Sequence: Synthetic oligonucleotide
  Target: ATXN1; (-) strand; PAM type: YTN; PAM sequence: TTG
atgaatgaatgtgtgatcca

SEQ ID NO: 161877 - DNA, 20 bp, Artificial Sequence
  Description of Artificial Sequence: Synthetic oligonucleotide
  Target: ATXN1; (-) strand; PAM type: YTN; PAM sequence: TTT
gatgaatgaatgtgtgatcc

SEQ ID NO: 161878 - DNA, 20 bp, Artificial Sequence
  Description of Artificial Sequence: Synthetic oligonucleotide
  Target: ATXN1; (-) strand; PAM type: YTN; PAM sequence: CTA
gaaacggaatgagtgtttga

SEQ ID NO: 161879 - DNA, 20 bp, Artificial Sequence
  Description of Artificial Sequence: Synthetic oligonucleotide
  Target: ATXN1; (-) strand; PAM type: YTN; PAM sequence: TTG
aggtccccgtcatacatact

SEQ ID NO: 161880 - DNA, 20 bp, Artificial Sequence
  Description of Artificial Sequence: Synthetic oligonucleotide
  Target: ATXN1; (-) strand; PAM type: YTN; PAM sequence: TTG
aacaattgaggtccccgtca

SEQ ID NO: 161881 - DNA, 20 bp, Artificial Sequence
  Description of Artificial Sequence: Synthetic oligonucleotide
  Target: ATXN1; (-) strand; PAM type: YTN; PAM sequence: CTG
acattgaacaattgaggtcc

SEQ ID NO: 161882 - DNA, 20 bp, Artificial Sequence
  Description of Artificial Sequence: Synthetic oligonucleotide
  Target: ATXN1; (-) strand; PAM type: YTN; PAM sequence: TTC
acactgacattgaacaattg

SEQ ID NO: 161883 - DNA, 20 bp, Artificial Sequence
  Description of Artificial Sequence: Synthetic oligonucleotide
  Target: ATXN1; (-) strand; PAM type: YTN; PAM sequence: CTT
cacactgacattgaacaatt

SEQ ID NO: 161884 - DNA, 20 bp, Artificial Sequence
  Description of Artificial Sequence: Synthetic oligonucleotide
  Target: ATXN1; (-) strand; PAM type: YTN; PAM sequence: TTG
cttcacactgacattgaaca

SEQ ID NO: 161885 - DNA, 20 bp, Artificial Sequence
  Description of Artificial Sequence: Synthetic oligonucleotide
  Target: ATXN1; (-) strand; PAM type: YTN; PAM sequence: TTT
gcttcacactgacattgaac

SEQ ID NO: 161886 - DNA, 20 bp, Artificial Sequence
  Description of Artificial Sequence: Synthetic oligonucleotide
  Target: ATXN1; (-) strand; PAM type: YTN; PAM sequence: CTG
gcataccatttgcttcacac

SEQ ID NO: 161887 - DNA, 20 bp, Artificial Sequence
  Description of Artificial Sequence: Synthetic oligonucleotide
  Target: ATXN1; (-) strand; PAM type: YTN; PAM sequence: TTC
tggcataccatttgcttcac

SEQ ID NO: 161888 - DNA, 20 bp, Artificial Sequence
  Description of Artificial Sequence: Synthetic oligonucleotide
  Target: ATXN1; (-) strand; PAM type: YTN; PAM sequence: CTA
aaaatagagttctggcatac

SEQ ID NO: 161889 - DNA, 20 bp, Artificial Sequence
  Description of Artificial Sequence: Synthetic oligonucleotide
  Target: ATXN1; (-) strand; PAM type: YTN; PAM sequence: TTG
aatagaacagaactaaaaat

SEQ ID NO: 161890 - DNA, 20 bp, Artificial Sequence
  Description of Artificial Sequence: Synthetic oligonucleotide
  Target: ATXN1; (-) strand; PAM type: YTN; PAM sequence: TTA
gtattgaatagaacagaact

SEQ ID NO: 161891 - DNA, 20 bp, Artificial Sequence
  Description of Artificial Sequence: Synthetic oligonucleotide
  Target: ATXN1; (-) strand; PAM type: YTN; PAM sequence: CTG
tattagtattgaatagaaca

SEQ ID NO: 161892 - DNA, 20 bp, Artificial Sequence
  Description of Artificial Sequence: Synthetic oligonucleotide
  Target: ATXN1; (-) strand; PAM type: YTN; PAM sequence: TTC
gaaatatgataaccaaaaca

SEQ ID NO: 161893 - DNA, 20 bp, Artificial Sequence
  Description of Artificial Sequence: Synthetic oligonucleotide
  Target: ATXN1; (-) strand; PAM type: YTN; PAM sequence: CTT
cgaaatatgataaccaaaac

SEQ ID NO: 161894 - DNA, 20 bp, Artificial Sequence
  Description of Artificial Sequence: Synthetic oligonucleotide
  Target: ATXN1; (-) strand; PAM type: YTN; PAM sequence: TTA
cttcgaaatatgataaccaa

SEQ ID NO: 161895 - DNA, 20 bp, Artificial Sequence
  Description of Artificial Sequence: Synthetic oligonucleotide
  Target: ATXN1; (-) strand; PAM type: YTN; PAM sequence: CTG
ttacttcgaaatatgataac

SEQ ID NO: 161896 - DNA, 20 bp, Artificial Sequence
  Description of Artificial Sequence: Synthetic oligonucleotide
  Target: ATXN1; (-) strand; PAM type: YTN; PAM sequence: TTC
tgttacttcgaaatatgata

SEQ ID NO: 161897 - DNA, 20 bp, Artificial Sequence
  Description of Artificial Sequence: Synthetic oligonucleotide
  Target: ATXN1; (-) strand; PAM type: YTN; PAM sequence: CTT
ctgttacttcgaaatatgat

SEQ ID NO: 161898 - DNA, 20 bp, Artificial Sequence
  Description of Artificial Sequence: Synthetic oligonucleotide
  Target: ATXN1; (-) strand; PAM type: YTN; PAM sequence: CTA
gccttctgttacttcgaaat

SEQ ID NO: 161899 - DNA, 20 bp, Artificial Sequence
  Description of Artificial Sequence: Synthetic oligonucleotide
  Target: ATXN1; (-) strand; PAM type: YTN; PAM sequence: TTC
tagccttctgttacttcgaa

SEQ ID NO: 161900 - DNA, 20 bp, Artificial Sequence
  Description of Artificial Sequence: Synthetic oligonucleotide
  Target: ATXN1; (-) strand; PAM type: YTN; PAM sequence: CTT
ctagccttctgttacttcga

SEQ ID NO: 161901 - DNA, 20 bp, Artificial Sequence
  Description of Artificial Sequence: Synthetic oligonucleotide
  Target: ATXN1; (-) strand; PAM type: YTN; PAM sequence: TTC
gcaacatatatcccttctag

SEQ ID NO: 161902 - DNA, 20 bp, Artificial Sequence
  Description of Artificial Sequence: Synthetic oligonucleotide
  Target: ATXN1; (-) strand; PAM type: YTN; PAM sequence: TTA
ttcgcaacatatatcccttc

SEQ ID NO: 161903 - DNA, 20 bp, Artificial Sequence
  Description of Artificial Sequence: Synthetic oligonucleotide
  Target: ATXN1; (-) strand; PAM type: YTN; PAM sequence: CTT
attcgcaacatatatccctt

SEQ ID NO: 161904 - DNA, 20 bp, Artificial Sequence
  Description of Artificial Sequence: Synthetic oligonucleotide
  Target: ATXN1; (-) strand; PAM type: YTN; PAM sequence: TTG
aatcttattcgcaacatata

SEQ ID NO: 161905 - DNA, 20 bp, Artificial Sequence
  Description of Artificial Sequence: Synthetic oligonucleotide
  Target: ATXN1; (-) strand; PAM type: YTN; PAM sequence: TTT
gaatcttattcgcaacatat

SEQ ID NO: 161906 - DNA, 20 bp, Artificial Sequence
  Description of Artificial Sequence: Synthetic oligonucleotide
  Target: ATXN1; (-) strand; PAM type: YTN; PAM sequence: TTA
agatatatttgaatcttatt

SEQ ID NO: 161907 - DNA, 20 bp, Artificial Sequence
  Description of Artificial Sequence: Synthetic oligonucleotide
  Target: ATXN1; (-) strand; PAM type: YTN; PAM sequence: CTT
aagatatatttgaatcttat

SEQ ID NO: 161908 - DNA, 20 bp, Artificial Sequence
  Description of Artificial Sequence: Synthetic oligonucleotide
  Target: ATXN1; (-) strand; PAM type: YTN; PAM sequence: TTC
ttaagatatatttgaatctt

SEQ ID NO: 161909 - DNA, 20 bp, Artificial Sequence
  Description of Artificial Sequence: Synthetic oligonucleotide
  Target: ATXN1; (-) strand; PAM type: YTN; PAM sequence: CTT
cttaagatatatttgaatct

SEQ ID NO: 161910 - DNA, 20 bp, Artificial Sequence
  Description of Artificial Sequence: Synthetic oligonucleotide
  Target: ATXN1; (-) strand; PAM type: YTN; PAM sequence: TTC
cggcttcttaagatatattt

SEQ ID NO: 161911 - DNA, 20 bp, Artificial Sequence
  Description of Artificial Sequence: Synthetic oligonucleotide
  Target: ATXN1; (-) strand; PAM type: YTN; PAM sequence: CTT
ccggcttcttaagatatatt

SEQ ID NO: 161912 - DNA, 20 bp, Artificial Sequence
  Description of Artificial Sequence: Synthetic oligonucleotide
  Target: ATXN1; (-) strand; PAM type: YTN; PAM sequence: TTG
gtaccatcacttccggcttc

SEQ ID NO: 161913 - DNA, 20 bp, Artificial Sequence
  Description of Artificial Sequence: Synthetic oligonucleotide
  Target: ATXN1; (-) strand; PAM type: YTN; PAM sequence: TTT
ggtaccatcacttccggctt

SEQ ID NO: 161914 - DNA, 20 bp, Artificial Sequence
  Description of Artificial Sequence: Synthetic oligonucleotide
  Target: ATXN1; (-) strand; PAM type: YTN; PAM sequence: CTG
gtttggtaccatcacttccg

SEQ ID NO: 161915 - DNA, 20 bp, Artificial Sequence
  Description of Artificial Sequence: Synthetic oligonucleotide
  Target: ATXN1; (-) strand; PAM type: YTN; PAM sequence: TTC
ctggtttggtaccatcactt

SEQ ID NO: 161916 - DNA, 20 bp, Artificial Sequence
  Description of Artificial Sequence: Synthetic oligonucleotide
  Target: ATXN1; (-) strand; PAM type: YTN; PAM sequence: TTT
cctggtttggtaccatcact

SEQ ID NO: 161917 - DNA, 20 bp, Artificial Sequence
  Description of Artificial Sequence: Synthetic oligonucleotide
  Target: ATXN1; (-) strand; PAM type: YTN; PAM sequence: TTT
tcctggtttggtaccatcac

SEQ ID NO: 161918 - DNA, 20 bp, Artificial Sequence
  Description of Artificial Sequence: Synthetic oligonucleotide
  Target: ATXN1; (-) strand; PAM type: YTN; PAM sequence: TTA
attttcctggtttggtacca

SEQ ID NO: 161919 - DNA, 20 bp, Artificial Sequence
  Description of Artificial Sequence: Synthetic oligonucleotide
  Target: ATXN1; (-) strand; PAM type: YTN; PAM sequence: CTT
aattttcctggtttggtacc

SEQ ID NO: 161920 - DNA, 20 bp, Artificial Sequence
  Description of Artificial Sequence: Synthetic oligonucleotide
  Target: ATXN1; (-) strand; PAM type: YTN; PAM sequence: TTG
atcttaattttcctggtttg

SEQ ID NO: 161921 - DNA, 20 bp, Artificial Sequence
  Description of Artificial Sequence: Synthetic oligonucleotide
  Target: ATXN1; (-) strand; PAM type: YTN; PAM sequence: CTC
attgatcttaattttcctgg

SEQ ID NO: 161922 - DNA, 20 bp, Artificial Sequence
  Description of Artificial Sequence: Synthetic oligonucleotide
  Target: ATXN1; (-) strand; PAM type: YTN; PAM sequence: TTC
tcattgatcttaattttcct

SEQ ID NO: 161923 - DNA, 20 bp, Artificial Sequence
  Description of Artificial Sequence: Synthetic oligonucleotide
  Target: ATXN1; (-) strand; PAM type: YTN; PAM sequence: TTA
ttctcattgatcttaatttt

SEQ ID NO: 161924 - DNA, 20 bp, Artificial Sequence
  Description of Artificial Sequence: Synthetic oligonucleotide
  Target: ATXN1; (-) strand; PAM type: YTN; PAM sequence: TTT
attctcattgatcttaattt

SEQ ID NO: 161925 - DNA, 20 bp, Artificial Sequence
  Description of Artificial Sequence: Synthetic oligonucleotide
  Target: ATXN1; (-) strand; PAM type: YTN; PAM sequence: TTA
catttattctcattgatctt

SEQ ID NO: 161926 - DNA, 20 bp, Artificial Sequence
  Description of Artificial Sequence: Synthetic oligonucleotide
  Target: ATXN1; (-) strand; PAM type: YTN; PAM sequence: TTT
acatttattctcattgatct

SEQ ID NO: 161927 - DNA, 20 bp, Artificial Sequence
  Description of Artificial Sequence: Synthetic oligonucleotide
  Target: ATXN1; (-) strand; PAM type: YTN; PAM sequence: TTG
aaaccaagggcaggcattta

SEQ ID NO: 161928 - DNA, 20 bp, Artificial Sequence
  Description of Artificial Sequence: Synthetic oligonucleotide
  Target: ATXN1; (-) strand; PAM type: YTN; PAM sequence: CTG
ttgaaaccaagggcaggcat

SEQ ID NO: 161929 - DNA, 20 bp, Artificial Sequence
  Description of Artificial Sequence: Synthetic oligonucleotide
  Target: ATXN1; (-) strand; PAM type: YTN; PAM sequence: TTG
agctgttgaaaccaagggca

SEQ ID NO: 161930 - DNA, 20 bp, Artificial Sequence
  Description of Artificial Sequence: Synthetic oligonucleotide
  Target: ATXN1; (-) strand; PAM type: YTN; PAM sequence: CTA
attgagctgttgaaaccaag

SEQ ID NO: 161931 - DNA, 20 bp, Artificial Sequence
  Description of Artificial Sequence: Synthetic oligonucleotide
  Target: ATXN1; (-) strand; PAM type: YTN; PAM sequence: CTA
gtaggctaattgagctgttg

SEQ ID NO: 161932 - DNA, 20 bp, Artificial Sequence
  Description of Artificial Sequence: Synthetic oligonucleotide
  Target: ATXN1; (-) strand; PAM type: YTN; PAM sequence: CTG
ctagtaggctaattgagctg

SEQ ID NO: 161933 - DNA, 20 bp, Artificial Sequence
  Description of Artificial Sequence: Synthetic oligonucleotide
  Target: ATXN1; (-) strand; PAM type: YTN; PAM sequence: TTC
aaccctgctagtaggctaat

SEQ ID NO: 161934 - DNA, 20 bp, Artificial Sequence
  Description of Artificial Sequence: Synthetic oligonucleotide
  Target: ATXN1; (-) strand; PAM type: YTN; PAM sequence: CTT
caaccctgctagtaggctaa

SEQ ID NO: 161935 - DNA, 20 bp, Artificial Sequence
  Description of Artificial Sequence: Synthetic oligonucleotide
  Target: ATXN1; (-) strand; PAM type: YTN; PAM sequence: CTC
ttcaaccctgctagtaggct

SEQ ID NO: 161936 - DNA, 20 bp, Artificial Sequence
  Description of Artificial Sequence: Synthetic oligonucleotide
  Target: ATXN1; (-) strand; PAM type: YTN; PAM sequence: TTA
aaccagatctcttcaaccct

SEQ ID NO: 161937 - DNA, 20 bp, Artificial Sequence
  Description of Artificial Sequence: Synthetic oligonucleotide
  Target: ATXN1; (-) strand; PAM type: YTN; PAM sequence: TTA
ttaaaccagatctcttcaac

SEQ ID NO: 161938 - DNA, 20 bp, Artificial Sequence
  Description of Artificial Sequence: Synthetic oligonucleotide
  Target: ATXN1; (-) strand; PAM type: YTN; PAM sequence: TTG
aaaccattattaaaccagat

SEQ ID NO: 161939 - DNA, 20 bp, Artificial Sequence
  Description of Artificial Sequence: Synthetic oligonucleotide
  Target: ATXN1; (-) strand; PAM type: YTN; PAM sequence: TTC
attgaaaccattattaaacc

SEQ ID NO: 161940 - DNA, 20 bp, Artificial Sequence
  Description of Artificial Sequence: Synthetic oligonucleotide
  Target: ATXN1; (-) strand; PAM type: YTN; PAM sequence: TTT
cattgaaaccattattaaac

SEQ ID NO: 161941 - DNA, 20 bp, Artificial Sequence
  Description of Artificial Sequence: Synthetic oligonucleotide
  Target: ATXN1; (-) strand; PAM type: YTN; PAM sequence: CTT
tcattgaaaccattattaaa

SEQ ID NO: 161942 - DNA, 20 bp, Artificial Sequence
  Description of Artificial Sequence: Synthetic oligonucleotide
  Target: ATXN1; (-) strand; PAM type: YTN; PAM sequence: CTC
tttcattgaaaccattatta

SEQ ID NO: 161943 - DNA, 20 bp, Artificial Sequence
  Description of Artificial Sequence: Synthetic oligonucleotide
  Target: ATXN1; (-) strand; PAM type: YTN; PAM sequence: CTG
ggctctttcattgaaaccat

SEQ ID NO: 161944 - DNA, 20 bp, Artificial Sequence
  Description of Artificial Sequence: Synthetic oligonucleotide
  Target: ATXN1; (-) strand; PAM type: YTN; PAM sequence: TTC
tgggctctttcattgaaacc

SEQ ID NO: 161945 - DNA, 20 bp, Artificial Sequence
  Description of Artificial Sequence: Synthetic oligonucleotide
  Target: ATXN1; (-) strand; PAM type: YTN; PAM sequence: TTT
ctgggctctttcattgaaac

SEQ ID NO: 161946 - DNA, 20 bp, Artificial Sequence
  Description of Artificial Sequence: Synthetic oligonucleotide
  Target: ATXN1; (-) strand; PAM type: YTN; PAM sequence: CTT
tctgggctctttcattgaaa

SEQ ID NO: 161947 - DNA, 20 bp, Artificial Sequence
  Description of Artificial Sequence: Synthetic oligonucleotide
  Target: ATXN1; (-) strand; PAM type: YTN; PAM sequence: TTG
agtgtatagtcaaacaaaaa

SEQ ID NO: 161948 - DNA, 20 bp, Artificial Sequence
  Description of Artificial Sequence: Synthetic oligonucleotide
  Target: ATXN1; (-) strand; PAM type: YTN; PAM sequence: TTC
atattgagtgtatagtcaaa

SEQ ID NO: 161949 - DNA, 20 bp, Artificial Sequence
  Description of Artificial Sequence: Synthetic oligonucleotide
  Target: ATXN1; (-) strand; PAM type: YTN; PAM sequence: TTG
ttcatattgagtgtatagtc

SEQ ID NO: 161950 - DNA, 20 bp, Artificial Sequence
  Description of Artificial Sequence: Synthetic oligonucleotide
  Target: ATXN1; (-) strand; PAM type: YTN; PAM sequence: CTA
ccaaatggttgttcatattg

SEQ ID NO: 161951 - DNA, 20 bp, Artificial Sequence
  Description of Artificial Sequence: Synthetic oligonucleotide
  Target: ATXN1; (-) strand; PAM type: YTN; PAM sequence: TTA
agaaccctaccaaatggttg

SEQ ID NO: 161952 - DNA, 20 bp, Artificial Sequence
  Description of Artificial Sequence: Synthetic oligonucleotide
  Target: ATXN1; (-) strand; PAM type: YTN; PAM sequence: TTT
aagaaccctaccaaatggtt

SEQ ID NO: 161953 - DNA, 20 bp, Artificial Sequence
  Description of Artificial Sequence: Synthetic oligonucleotide
  Target: ATXN1; (-) strand; PAM type: YTN; PAM sequence: TTT
taagaaccctaccaaatggt

SEQ ID NO: 161954 - DNA, 20 bp, Artificial Sequence
  Description of Artificial Sequence: Synthetic oligonucleotide
  Target: ATXN1; (-) strand; PAM type: YTN; PAM sequence: TTT
ttaagaaccctaccaaatgg

SEQ ID NO: 161955 - DNA, 20 bp, Artificial Sequence
  Description of Artificial Sequence: Synthetic oligonucleotide
  Target: ATXN1; (-) strand; PAM type: YTN; PAM sequence: CTT
tttaagaaccctaccaaatg

SEQ ID NO: 161956 - DNA, 20 bp, Artificial Sequence
  Description of Artificial Sequence: Synthetic oligonucleotide
  Target: ATXN1; (-) strand; PAM type: YTN; PAM sequence: CTA
tactttttaagaaccctacc

SEQ ID NO: 161957 - DNA, 20 bp, Artificial Sequence
  Description of Artificial Sequence: Synthetic oligonucleotide
  Target: ATXN1; (-) strand; PAM type: YTN; PAM sequence: TTA
ctatactttttaagaaccct

SEQ ID NO: 161958 - DNA, 20 bp, Artificial Sequence
  Description of Artificial Sequence: Synthetic oligonucleotide
  Target: ATXN1; (-) strand; PAM type: YTN; PAM sequence: TTA
taattactatactttttaag

SEQ ID NO: 161959 - DNA, 20 bp, Artificial Sequence
  Description of Artificial Sequence: Synthetic oligonucleotide
  Target: ATXN1; (-) strand; PAM type: YTN; PAM sequence: TTA
atgaaggttataattactat

SEQ ID NO: 161960 - DNA, 20 bp, Artificial Sequence
  Description of Artificial Sequence: Synthetic oligonucleotide
  Target: ATXN1; (-) strand; PAM type: YTN; PAM sequence: TTT
aatgaaggttataattacta

SEQ ID NO: 161961 - DNA, 20 bp, Artificial Sequence
  Description of Artificial Sequence: Synthetic oligonucleotide
  Target: ATXN1; (-) strand; PAM type: YTN; PAM sequence: TTT
taatgaaggttataattact

SEQ ID NO: 161962 - DNA, 20 bp, Artificial Sequence
  Description of Artificial Sequence: Synthetic oligonucleotide
  Target: ATXN1; (-) strand; PAM type: YTN; PAM sequence: TTT
ttaatgaaggttataattac

SEQ ID NO: 161963 - DNA, 20 bp, Artificial Sequence
  Description of Artificial Sequence: Synthetic oligonucleotide
  Target: ATXN1; (-) strand; PAM type: YTN; PAM sequence: TTT
tttaatgaaggttataatta

SEQ ID NO: 161964 - DNA, 20 bp, Artificial Sequence
  Description of Artificial Sequence: Synthetic oligonucleotide
  Target: ATXN1; (-) strand; PAM type: YTN; PAM sequence: TTT
ttttaatgaaggttataatt

SEQ ID NO: 161965 - DNA, 20 bp, Artificial Sequence
  Description of Artificial Sequence: Synthetic oligonucleotide
  Target: ATXN1; (-) strand; PAM type: YTN; PAM sequence: TTT
tttttaatgaaggttataat

SEQ ID NO: 161966 - DNA, 20 bp, Artificial Sequence
  Description of Artificial Sequence: Synthetic oligonucleotide
  Target: ATXN1; (-) strand; PAM type: YTN; PAM sequence: TTA
tattttttttaatgaaggtt

SEQ ID NO: 161967 - DNA, 20 bp, Artificial Sequence
  Description of Artificial Sequence: Synthetic oligonucleotide
  Target: ATXN1; (-) strand; PAM type: YTN; PAM sequence: CTG
aacattatattttttttaat

SEQ ID NO: 161968 - DNA, 20 bp, Artificial Sequence
  Description of Artificial Sequence: Synthetic oligonucleotide
  Target: ATXN1; (-) strand; PAM type: YTN; PAM sequence: CTG
aacccagcctgaacattata

SEQ ID NO: 161969 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccactgaacc

SEQ ID NO: 161970 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgtgagccac

SEQ ID NO: 161971 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 161972 - DNA, 20 bp, Artificial Sequence
  Description of Artificial Sequence: Synthetic oligonucleotide
  Target: ATXN1; (-) strand; PAM type: YTN; PAM sequence: CTG
ggctcccaaagtgctgggat

SEQ ID NO: 161973 - DNA, 20 bp, Artificial Sequence
  Description of Artificial Sequence: Synthetic oligonucleotide
  Target: ATXN1; (-) strand; PAM type: YTN; PAM sequence: CTC
ctgggctcccaaagtgctgg

SEQ ID NO: 161974 - DNA, 20 bp, Artificial Sequence
  Description of Artificial Sequence: Synthetic oligonucleotide
  Target: ATXN1; (-) strand; PAM type: YTN; PAM sequence: TTG
agctcctgggctcccaaagt

SEQ ID NO: 161975 - DNA, 20 bp, Artificial Sequence
  Description of Artificial Sequence: Synthetic oligonucleotide
  Target: ATXN1; (-) strand; PAM type: YTN; PAM sequence: CTT
gagctcctgggctcccaaag

SEQ ID NO: 161976 - DNA, 20 bp, Artificial Sequence
  Description of Artificial Sequence: Synthetic oligonucleotide
  Target: ATXN1; (-) strand; PAM type: YTN; PAM sequence: CTG
gccttgagctcctgggctcc

SEQ ID NO: 161977 - DNA, 20 bp, Artificial Sequence
  Description of Artificial Sequence: Synthetic oligonucleotide
  Target: ATXN1; (-) strand; PAM type: YTN; PAM sequence: TTG
tccaggctggccttgagctc

SEQ ID NO: 161978 - DNA, 20 bp, Artificial Sequence
  Description of Artificial Sequence: Synthetic oligonucleotide
  Target: ATXN1; (-) strand; PAM type: YTN; PAM sequence: CTC
gatatgttgtccaggctggc

SEQ ID NO: 161979 - DNA, 20 bp, Artificial Sequence
  Description of Artificial Sequence: Synthetic oligonucleotide
  Target: ATXN1; (-) strand; PAM type: YTN; PAM sequence: TTG
tagagacaggatctcgatat

SEQ ID NO: 161980 - DNA, 20 bp, Artificial Sequence
  Description of Artificial Sequence: Synthetic oligonucleotide
  Target: ATXN1; (-) strand; PAM type: YTN; PAM sequence: TTT
gtagagacaggatctcgata

SEQ ID NO: 161981 - DNA, 20 bp, Artificial Sequence
  Description of Artificial Sequence: Synthetic oligonucleotide
  Target: ATXN1; (-) strand; PAM type: YTN; PAM sequence: TTT
tgtagagacaggatctcgat

SEQ ID NO: 161982 - DNA, 20 bp, Artificial Sequence
  Description of Artificial Sequence: Synthetic oligonucleotide
  Target: ATXN1; (-) strand; PAM type: YTN; PAM sequence: TTT
ttgtagagacaggatctcga

SEQ ID NO: 161983 - DNA, 20 bp, Artificial Sequence
  Description of Artificial Sequence: Synthetic oligonucleotide
  Target: ATXN1; (-) strand; PAM type: YTN; PAM sequence: TTT
tttgtagagacaggatctcg

SEQ ID NO: 161984 - DNA, 20 bp, Artificial Sequence
  Description of Artificial Sequence: Synthetic oligonucleotide
  Target: ATXN1; (-) strand; PAM type: YTN; PAM sequence: TTA
ttttttgtagagacaggatc

SEQ ID NO: 161985 - DNA, 20 bp, Artificial Sequence
  Description of Artificial Sequence: Synthetic oligonucleotide
  Target: ATXN1; (-) strand; PAM type: YTN; PAM sequence: TTT
attttttgtagagacaggat

SEQ ID NO: 161986 - DNA, 20 bp, Artificial Sequence
  Description of Artificial Sequence: Synthetic oligonucleotide
  Target: ATXN1; (-) strand; PAM type: YTN; PAM sequence: TTT
tattttttgtagagacagga

SEQ ID NO: 161987 - DNA, 20 bp, Artificial Sequence
  Description of Artificial Sequence: Synthetic oligonucleotide
  Target: ATXN1; (-) strand; PAM type: YTN; PAM sequence: TTT
ttattttttgtagagacagg

SEQ ID NO: 161988 - DNA, 20 bp, Artificial Sequence
  Description of Artificial Sequence: Synthetic oligonucleotide
  Target: ATXN1; (-) strand; PAM type: YTN; PAM sequence: TTT
tttattttttgtagagacag

SEQ ID NO: 161989 - DNA, 20 bp, Artificial Sequence
  Description of Artificial Sequence: Synthetic oligonucleotide
  Target: ATXN1; (-) strand; PAM type: YTN; PAM sequence: TTT
ttttattttttgtagagaca

SEQ ID NO: 161990 - DNA, 20 bp, Artificial Sequence
  Description of Artificial Sequence: Synthetic oligonucleotide
  Target: ATXN1; (-) strand; PAM type: YTN; PAM sequence: TTT
tttttattttttgtagagac

SEQ ID NO: 161991 - DNA, 20 bp, Artificial Sequence
  Description of Artificial Sequence: Synthetic oligonucleotide
  Target: ATXN1; (-) strand; PAM type: YTN; PAM sequence: CTA
attttttttattttttgtag

SEQ ID NO: 161992 - DNA, 20 bp, Artificial Sequence
  Description of Artificial Sequence: Synthetic oligonucleotide
  Target: ATXN1; (-) strand; PAM type: YTN; PAM sequence: CTA
gctaattttttttatttttt

SEQ ID NO: 161993 - DNA, 20 bp, Artificial Sequence
  Description of Artificial Sequence: Synthetic oligonucleotide
  Target: ATXN1; (-) strand; PAM type: YTN; PAM sequence: CTA
ggaccacagatgcaaaccac

SEQ ID NO: 161994 - DNA, 20 bp, Artificial Sequence
  Description of Artificial Sequence: Synthetic oligonucleotide
  Target: ATXN1; (-) strand; PAM type: YTN; PAM sequence: CTG
ggtagctaggaccacagatg

SEQ ID NO: 161995 - DNA, 20 bp, Artificial Sequence
  Description of Artificial Sequence: Synthetic oligonucleotide
  Target: ATXN1; (-) strand; PAM type: YTN; PAM sequence: CTC
ctgggtagctaggaccacag

SEQ ID NO: 161996 - DNA, 20 bp, Artificial Sequence
  Description of Artificial Sequence: Synthetic oligonucleotide
  Target: ATXN1; (-) strand; PAM type: YTN; PAM sequence: TTA
gcctcctgggtagctaggac

SEQ ID NO: 161997 - DNA, 20 bp, Artificial Sequence
  Description of Artificial Sequence: Synthetic oligonucleotide
  Target: ATXN1; (-) strand; PAM type: YTN; PAM sequence: CTT
agcctcctgggtagctagga

SEQ ID NO: 161998 - DNA, 20 bp, Artificial Sequence
  Description of Artificial Sequence: Synthetic oligonucleotide
  Target: ATXN1; (-) strand; PAM type: YTN; PAM sequence: CTG
ccttagcctcctgggtagct

SEQ ID NO: 161999 - DNA, 20 bp, Artificial Sequence
  Description of Artificial Sequence: Synthetic oligonucleotide
  Target: ATXN1; (-) strand; PAM type: YTN; PAM sequence: CTC
ctgccttagcctcctgggta

SEQ ID NO: 162000 - DNA, 20 bp, Artificial Sequence
  Description of Artificial Sequence: Synthetic oligonucleotide
  Target: ATXN1; (-) strand; PAM type: YTN; PAM sequence: CTC
aagcaatcctcctgccttag

SEQ ID NO: 162001 - DNA, 20 bp, Artificial Sequence
  Description of Artificial Sequence: Synthetic oligonucleotide
  Target: ATXN1; (-) strand; PAM type: YTN; PAM sequence: CTG
ggctcaagcaatcctcctgc

SEQ ID NO: 162002 - DNA, 20 bp, Artificial Sequence
  Description of Artificial Sequence: Synthetic oligonucleotide
  Target: ATXN1; (-) strand; PAM type: YTN; PAM sequence: CTC
ctgggctcaagcaatcctcc

SEQ ID NO: 162003 - DNA, 20 bp, Artificial Sequence
  Description of Artificial Sequence: Synthetic oligonucleotide
  Target: ATXN1; (-) strand; PAM type: YTN; PAM sequence: CTC
aacctcctgggctcaagcaa

SEQ ID NO: 162004 - DNA, 20 bp, Artificial Sequence
  Description of Artificial Sequence: Synthetic oligonucleotide
  Target: ATXN1; (-) strand; PAM type: YTN; PAM sequence: CTG
cagcctcaacctcctgggct

SEQ ID NO: 162005 - DNA, 20 bp, Artificial Sequence
  Description of Artificial Sequence: Synthetic oligonucleotide
  Target: ATXN1; (-) strand; PAM type: YTN; PAM sequence: CTC
actgcagcctcaacctcctg

SEQ ID NO: 162006 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggagcaatcat

SEQ ID NO: 162007 - DNA, 20 bp, Artificial Sequence
  Description of Artificial Sequence: Synthetic oligonucleotide
  Target: ATXN1; (-) strand; PAM type: YTN; PAM sequence: CTA
ggctggagtgcagtggagca

SEQ ID NO: 162008 - DNA, 20 bp, Artificial Sequence
  Description of Artificial Sequence: Synthetic oligonucleotide
  Target: ATXN1; (-) strand; PAM type: YTN; PAM sequence: TTA
tcacctaggctggagtgcag

SEQ ID NO: 162009 - DNA, 20 bp, Artificial Sequence
  Description of Artificial Sequence: Synthetic oligonucleotide
  Target: ATXN1; (-) strand; PAM type: YTN; PAM sequence: TTT
atcacctaggctggagtgca

SEQ ID NO: 162010 - DNA, 20 bp, Artificial Sequence
  Description of Artificial Sequence: Synthetic oligonucleotide
  Target: ATXN1; (-) strand; PAM type: YTN; PAM sequence: CTT
tatcacctaggctggagtgc

SEQ ID NO: 162011 - DNA, 20 bp, Artificial Sequence
  Description of Artificial Sequence: Synthetic oligonucleotide
  Target: ATXN1; (-) strand; PAM type: YTN; PAM sequence: TTG
ctttatcacctaggctggag

SEQ ID NO: 162012 - DNA, 20 bp, Artificial Sequence
  Description of Artificial Sequence: Synthetic oligonucleotide
  Target: ATXN1; (-) strand; PAM type: YTN; PAM sequence: CTT
gctttatcacctaggctgga

SEQ ID NO: 162013 - DNA, 20 bp, Artificial Sequence
  Description of Artificial Sequence: Synthetic oligonucleotide
  Target: ATXN1; (-) strand; PAM type: YTN; PAM sequence: TTG
agacagggtcttgctttatc

SEQ ID NO: 162014 - DNA, 20 bp, Artificial Sequence
  Description of Artificial Sequence: Synthetic oligonucleotide
  Target: ATXN1; (-) strand; PAM type: YTN; PAM sequence: CTT
gagacagggtcttgctttat

SEQ ID NO: 162015 - DNA, 20 bp, Artificial Sequence
  Description of Artificial Sequence: Synthetic oligonucleotide
  Target: ATXN1; (-) strand; PAM type: YTN; PAM sequence: TTC
ttgagacagggtcttgcttt

SEQ ID NO: 162016 - DNA, 20 bp, Artificial Sequence
  Description of Artificial Sequence: Synthetic oligonucleotide
  Target: ATXN1; (-) strand; PAM type: YTN; PAM sequence: TTT
cttgagacagggtcttgctt

SEQ ID NO: 162017 - DNA, 20 bp, Artificial Sequence
  Description of Artificial Sequence: Synthetic oligonucleotide
  Target: ATXN1; (-) strand; PAM type: YTN; PAM sequence: TTT
tcttgagacagggtcttgct

SEQ ID NO: 162018 - DNA, 20 bp, Artificial Sequence
  Description of Artificial Sequence: Synthetic oligonucleotide
  Target: ATXN1; (-) strand; PAM type: YTN; PAM sequence: CTT
ttcttgagacagggtcttgc

SEQ ID NO: 162019 - DNA, 20 bp, Artificial Sequence
  Description of Artificial Sequence: Synthetic oligonucleotide
  Target: ATXN1; (-) strand; PAM type: YTN; PAM sequence: CTC
ttttcttgagacagggtctt

SEQ ID NO: 162020 - DNA, 20 bp, Artificial Sequence
  Description of Artificial Sequence: Synthetic oligonucleotide
  Target: ATXN1; (-) strand; PAM type: YTN; PAM sequence: TTC
tcttttcttgagacagggtc

SEQ ID NO: 162021 - DNA, 20 bp, Artificial Sequence
  Description of Artificial Sequence: Synthetic oligonucleotide
  Target: ATXN1; (-) strand; PAM type: YTN; PAM sequence: TTT
ctcttttcttgagacagggt

SEQ ID NO: 162022 - DNA, 20 bp, Artificial Sequence
  Description of Artificial Sequence: Synthetic oligonucleotide
  Target: ATXN1; (-) strand; PAM type: YTN; PAM sequence: CTT
tctcttttcttgagacaggg

SEQ ID NO: 162023 - DNA, 20 bp, Artificial Sequence
  Description of Artificial Sequence: Synthetic oligonucleotide
  Target: ATXN1; (-) strand; PAM type: YTN; PAM sequence: TTC
tttctcttttcttgagacag

SEQ ID NO: 162024 - DNA, 20 bp, Artificial Sequence
  Description of Artificial Sequence: Synthetic oligonucleotide
  Target: ATXN1; (-) strand; PAM type: YTN; PAM sequence: TTT
ctttctcttttcttgagaca

SEQ ID NO: 162025 - DNA, 20 bp, Artificial Sequence
  Description of Artificial Sequence: Synthetic oligonucleotide
  Target: ATXN1; (-) strand; PAM type: YTN; PAM sequence: TTT
tctttctcttttcttgagac

SEQ ID NO: 162026 - DNA, 20 bp, Artificial Sequence
  Description of Artificial Sequence: Synthetic oligonucleotide
  Target: ATXN1; (-) strand; PAM type: YTN; PAM sequence: TTG
ttttctttctcttttcttga

SEQ ID NO: 162027 - DNA, 20 bp, Artificial Sequence
  Description of Artificial Sequence: Synthetic oligonucleotide
  Target: ATXN1; (-) strand; PAM type: YTN; PAM sequence: CTG
aacattgttttctttctctt

SEQ ID NO: 162028 - DNA, 20 bp, Artificial Sequence
  Description of Artificial Sequence: Synthetic oligonucleotide
  Target: ATXN1; (-) strand; PAM type: YTN; PAM sequence: TTC
tgaacattgttttctttctc

SEQ ID NO: 162029 - DNA, 20 bp, Artificial Sequence
  Description of Artificial Sequence: Synthetic oligonucleotide
  Target: ATXN1; (-) strand; PAM type: YTN; PAM sequence: TTA
ttctgaacattgttttcttt

SEQ ID NO: 162030 - DNA, 20 bp, Artificial Sequence
  Description of Artificial Sequence: Synthetic oligonucleotide
  Target: ATXN1; (-) strand; PAM type: YTN; PAM sequence: CTT
attctgaacattgttttctt

SEQ ID NO: 162031 - DNA, 20 bp, Artificial Sequence
  Description of Artificial Sequence: Synthetic oligonucleotide
  Target: ATXN1; (-) strand; PAM type: YTN; PAM sequence: TTC
ccttattctgaacattgttt

SEQ ID NO: 162032 - DNA, 20 bp, Artificial Sequence
  Description of Artificial Sequence: Synthetic oligonucleotide
  Target: ATXN1; (-) strand; PAM type: YTN; PAM sequence: TTA
ttcccttattctgaacattg

SEQ ID NO: 162033 - DNA, 20 bp, Artificial Sequence
  Description of Artificial Sequence: Synthetic oligonucleotide
  Target: ATXN1; (-) strand; PAM type: YTN; PAM sequence: TTT
attcccttattctgaacatt

SEQ ID NO: 162034 - DNA, 20 bp, Artificial Sequence
  Description of Artificial Sequence: Synthetic oligonucleotide
  Target: ATXN1; (-) strand; PAM type: YTN; PAM sequence: TTG
cagtatttattcccttattc

SEQ ID NO: 162035 - DNA, 20 bp, Artificial Sequence
  Description of Artificial Sequence: Synthetic oligonucleotide
  Target: ATXN1; (-) strand; PAM type: YTN; PAM sequence: CTA
tggttgcagtatttattccc

SEQ ID NO: 162036 - DNA, 20 bp, Artificial Sequence
  Description of Artificial Sequence: Synthetic oligonucleotide
  Target: ATXN1; (-) strand; PAM type: YTN; PAM sequence: TTA
cccgtgccatctatggttgc

SEQ ID NO: 162037 - DNA, 20 bp, Artificial Sequence
  Description of Artificial Sequence: Synthetic oligonucleotide
  Target: ATXN1; (-) strand; PAM type: YTN; PAM sequence: TTT
acccgtgccatctatggttg

SEQ ID NO: 162038 - DNA, 20 bp, Artificial Sequence
  Description of Artificial Sequence: Synthetic oligonucleotide
  Target: ATXN1; (-) strand; PAM type: YTN; PAM sequence: CTT
tacccgtgccatctatggtt

SEQ ID NO: 162039 - DNA, 20 bp, Artificial Sequence
  Description of Artificial Sequence: Synthetic oligonucleotide
  Target: ATXN1; (-) strand; PAM type: YTN; PAM sequence: CTG
tggctttacccgtgccatct

SEQ ID NO: 162040 - DNA, 20 bp, Artificial Sequence
  Description of Artificial Sequence: Synthetic oligonucleotide
  Target: ATXN1; (-) strand; PAM type: YTN; PAM sequence: TTC
aactgtggctttacccgtgc

SEQ ID NO: 162041 - DNA, 20 bp, Artificial Sequence
  Description of Artificial Sequence: Synthetic oligonucleotide
  Target: ATXN1; (-) strand; PAM type: YTN; PAM sequence: TTT
caactgtggctttacccgtg

SEQ ID NO: 162042 - DNA, 20 bp, Artificial Sequence
  Description of Artificial Sequence: Synthetic oligonucleotide
  Target: ATXN1; (-) strand; PAM type: YTN; PAM sequence: TTG
cagcaggatttcaactgtgg

SEQ ID NO: 162043 - DNA, 20 bp, Artificial Sequence
  Description of Artificial Sequence: Synthetic oligonucleotide
  Target: ATXN1; (-) strand; PAM type: YTN; PAM sequence: TTT
gcagcaggatttcaactgtg

SEQ ID NO: 162044 - DNA, 20 bp, Artificial Sequence
  Description of Artificial Sequence: Synthetic oligonucleotide
  Target: ATXN1; (-) strand; PAM type: YTN; PAM sequence: CTT
tgcagcaggatttcaactgt

SEQ ID NO: 162045 - DNA, 20 bp, Artificial Sequence
  Description of Artificial Sequence: Synthetic oligonucleotide
  Target: ATXN1; (-) strand; PAM type: YTN; PAM sequence: TTC
ccacgtgcctttgcagcagg

SEQ ID NO: 162046 - DNA, 20 bp, Artificial Sequence
  Description of Artificial Sequence: Synthetic oligonucleotide
  Target: ATXN1; (-) strand; PAM type: YTN; PAM sequence: CTT
cccacgtgcctttgcagcag

SEQ ID NO: 162047 - DNA, 20 bp, Artificial Sequence
  Description of Artificial Sequence: Synthetic oligonucleotide
  Target: ATXN1; (-) strand; PAM type: YTN; PAM sequence: CTA
gacatgccccatccttccca

SEQ ID NO: 162048 - DNA, 20 bp, Artificial Sequence
  Description of Artificial Sequence: Synthetic oligonucleotide
  Target: ATXN1; (-) strand; PAM type: YTN; PAM sequence: CTC
cccctagacatgccccatcc

SEQ ID NO: 162049 - DNA, 20 bp, Artificial Sequence
  Description of Artificial Sequence: Synthetic oligonucleotide
  Target: ATXN1; (-) strand; PAM type: YTN; PAM sequence: CTG
atcactccccctagacatgc

SEQ ID NO: 162050 - DNA, 20 bp, Artificial Sequence
  Description of Artificial Sequence: Synthetic oligonucleotide
  Target: ATXN1; (-) strand; PAM type: YTN; PAM sequence: TTG
cgcaactgatcactccccct

SEQ ID NO: 162051 - DNA, 20 bp, Artificial Sequence
  Description of Artificial Sequence: Synthetic oligonucleotide
  Target: ATXN1; (-) strand; PAM type: YTN; PAM sequence: CTT
gcgcaactgatcactccccc

SEQ ID NO: 162052 - DNA, 20 bp, Artificial Sequence
  Description of Artificial Sequence: Synthetic oligonucleotide
  Target: ATXN1; (-) strand; PAM type: YTN; PAM sequence: CTC
ttgcgcaactgatcactccc

SEQ ID NO: 162053 - DNA, 20 bp, Artificial Sequence
  Description of Artificial Sequence: Synthetic oligonucleotide
  Target: ATXN1; (-) strand; PAM type: YTN; PAM sequence: CTC
cagacctcttgcgcaactga

SEQ ID NO: 162054 - DNA, 20 bp, Artificial Sequence
  Description of Artificial Sequence: Synthetic oligonucleotide
  Target: ATXN1; (-) strand; PAM type: YTN; PAM sequence: TTG
cctccagacctcttgcgcaa

SEQ ID NO: 162055 - DNA, 20 bp, Artificial Sequence
  Description of Artificial Sequence: Synthetic oligonucleotide
  Target: ATXN1; (-) strand; PAM type: YTN; PAM sequence: CTT
gcctccagacctcttgcgca

SEQ ID NO: 162056 - DNA, 20 bp, Artificial Sequence
  Description of Artificial Sequence: Synthetic oligonucleotide
  Target: ATXN1; (-) strand; PAM type: YTN; PAM sequence: CTG
cttgcctccagacctcttgc

SEQ ID NO: 162057 - DNA, 20 bp, Artificial Sequence
  Description of Artificial Sequence: Synthetic oligonucleotide
  Target: ATXN1; (-) strand; PAM type: YTN; PAM sequence: CTC
atctgcttgcctccagacct

SEQ ID NO: 162058 - DNA, 20 bp, Artificial Sequence
  Description of Artificial Sequence: Synthetic oligonucleotide
  Target: ATXN1; (-) strand; PAM type: YTN; PAM sequence: TTA
ctcatctgcttgcctccaga

SEQ ID NO: 162059 - DNA, 20 bp, Artificial Sequence
  Description of Artificial Sequence: Synthetic oligonucleotide
  Target: ATXN1; (-) strand; PAM type: YTN; PAM sequence: CTG
ttactcatctgcttgcctcc

SEQ ID NO: 162060 - DNA, 20 bp, Artificial Sequence
  Description of Artificial Sequence: Synthetic oligonucleotide
  Target: ATXN1; (-) strand; PAM type: YTN; PAM sequence: CTC
agctgttactcatctgcttg

SEQ ID NO: 162061 - DNA, 20 bp, Artificial Sequence
  Description of Artificial Sequence: Synthetic oligonucleotide
  Target: ATXN1; (-) strand; PAM type: YTN; PAM sequence: TTG
tctcagctgttactcatctg

SEQ ID NO: 162062 - DNA, 20 bp, Artificial Sequence
  Description of Artificial Sequence: Synthetic oligonucleotide
  Target: ATXN1; (-) strand; PAM type: YTN; PAM sequence: TTC
ccagttgtctcagctgttac

SEQ ID NO: 162063 - DNA, 20 bp, Artificial Sequence
  Description of Artificial Sequence: Synthetic oligonucleotide
  Target: ATXN1; (-) strand; PAM type: YTN; PAM sequence: CTC
attcccagttgtctcagctg

SEQ ID NO: 162064 - DNA, 20 bp, Artificial Sequence
  Description of Artificial Sequence: Synthetic oligonucleotide
  Target: ATXN1; (-) strand; PAM type: YTN; PAM sequence: TTC
cccagggcactcattcccag

SEQ ID NO: 162065 - DNA, 20 bp, Artificial Sequence
  Description of Artificial Sequence: Synthetic oligonucleotide
  Target: ATXN1; (-) strand; PAM type: YTN; PAM sequence: CTT
ccccagggcactcattccca

SEQ ID NO: 162066 - DNA, 20 bp, Artificial Sequence
  Description of Artificial Sequence: Synthetic oligonucleotide
  Target: ATXN1; (-) strand; PAM type: YTN; PAM sequence: TTC
ttccccagggcactcattcc

SEQ ID NO: 162067 - DNA, 20 bp, Artificial Sequence
  Description of Artificial Sequence: Synthetic oligonucleotide
  Target: ATXN1; (-) strand; PAM type: YTN; PAM sequence: CTG
ttcttccccagggcactcat

SEQ ID NO: 162068 - DNA, 20 bp, Artificial Sequence
  Description of Artificial Sequence: Synthetic oligonucleotide
  Target: ATXN1; (-) strand; PAM type: YTN; PAM sequence: TTC
tgttcttccccagggcactc

SEQ ID NO: 162069 - DNA, 20 bp, Artificial Sequence
  Description of Artificial Sequence: Synthetic oligonucleotide
  Target: ATXN1; (-) strand; PAM type: YTN; PAM sequence: TTT
ctgttcttccccagggcact

SEQ ID NO: 162070 - DNA, 20 bp, Artificial Sequence
  Description of Artificial Sequence: Synthetic oligonucleotide
  Target: ATXN1; (-) strand; PAM type: YTN; PAM sequence: TTT
tctgttcttccccagggcac

SEQ ID NO: 162071 - DNA, 20 bp, Artificial Sequence
  Description of Artificial Sequence: Synthetic oligonucleotide
  Target: ATXN1; (-) strand; PAM type: YTN; PAM sequence: TTT
ttctgttcttccccagggca

SEQ ID NO: 162072 - DNA, 20 bp, Artificial Sequence
  Description of Artificial Sequence: Synthetic oligonucleotide
  Target: ATXN1; (-) strand; PAM type: YTN; PAM sequence: CTT
tttctgttcttccccagggc

SEQ ID NO: 162073 - DNA, 20 bp, Artificial Sequence
  Description of Artificial Sequence: Synthetic oligonucleotide
  Target: ATXN1; (-) strand; PAM type: YTN; PAM sequence: CTG
cagctttttctgttcttccc

SEQ ID NO: 162074 - DNA, 20 bp, Artificial Sequence
  Description of Artificial Sequence: Synthetic oligonucleotide
  Target: ATXN1; (-) strand; PAM type: YTN; PAM sequence: CTA
atgctgcagctttttctgtt

SEQ ID NO: 162075 - DNA, 20 bp, Artificial Sequence
  Description of Artificial Sequence: Synthetic oligonucleotide
  Target: ATXN1; (-) strand; PAM type: YTN; PAM sequence: TTC
ctaatgctgcagctttttct

SEQ ID NO: 162076 - DNA, 20 bp, Artificial Sequence
  Description of Artificial Sequence: Synthetic oligonucleotide
  Target: ATXN1; (-) strand; PAM type: YTN; PAM sequence: CTT
cctaatgctgcagctttttc

SEQ ID NO: 162077 - DNA, 20 bp, Artificial Sequence
  Description of Artificial Sequence: Synthetic oligonucleotide
  Target: ATXN1; (-) strand; PAM type: YTN; PAM sequence: TTG
cttcctaatgctgcagcttt

SEQ ID NO: 162078 - DNA, 20 bp, Artificial Sequence
  Description of Artificial Sequence: Synthetic oligonucleotide
  Target: ATXN1; (-) strand; PAM type: YTN; PAM sequence: CTC
attgcttcctaatgctgcag

SEQ ID NO: 162079 - DNA, 20 bp, Artificial Sequence
  Description of Artificial Sequence: Synthetic oligonucleotide
  Target: ATXN1; (-) strand; PAM type: YTN; PAM sequence: TTC
tcattgcttcctaatgctgc

SEQ ID NO: 162080 - DNA, 20 bp, Artificial Sequence
  Description of Artificial Sequence: Synthetic oligonucleotide
  Target: ATXN1; (-) strand; PAM type: YTN; PAM sequence: TTA
accattctcattgcttccta

SEQ ID NO: 162081 - DNA, 20 bp, Artificial Sequence
  Description of Artificial Sequence: Synthetic oligonucleotide
  Target: ATXN1; (-) strand; PAM type: YTN; PAM sequence: TTT
aaccattctcattgcttcct

SEQ ID NO: 162082 - DNA, 20 bp, Artificial Sequence
  Description of Artificial Sequence: Synthetic oligonucleotide
  Target: ATXN1; (-) strand; PAM type: YTN; PAM sequence: TTT
taaccattctcattgcttcc

SEQ ID NO: 162083 - DNA, 20 bp, Artificial Sequence
  Description of Artificial Sequence: Synthetic oligonucleotide
  Target: ATXN1; (-) strand; PAM type: YTN; PAM sequence: TTT
ttaaccattctcattgcttc

SEQ ID NO: 162084 - DNA, 20 bp, Artificial Sequence
  Description of Artificial Sequence: Synthetic oligonucleotide
  Target: ATXN1; (-) strand; PAM type: YTN; PAM sequence: CTC
atgaggcagcccagtccatt

SEQ ID NO: 162085 - DNA, 20 bp, Artificial Sequence
  Description of Artificial Sequence: Synthetic oligonucleotide
  Target: ATXN1; (-) strand; PAM type: YTN; PAM sequence: CTG
actcatgaggcagcccagtc

SEQ ID NO: 162086 - DNA, 20 bp, Artificial Sequence
  Description of Artificial Sequence: Synthetic oligonucleotide
  Target: ATXN1; (-) strand; PAM type: YTN; PAM sequence: TTG
gggtgacccagagatccctg

SEQ ID NO: 162087 - DNA, 20 bp, Artificial Sequence
  Description of Artificial Sequence: Synthetic oligonucleotide
  Target: ATXN1; (-) strand; PAM type: YTN; PAM sequence: CTT
ggggtgacccagagatccct

SEQ ID NO: 162088 - DNA, 20 bp, Artificial Sequence
  Description of Artificial Sequence: Synthetic oligonucleotide
  Target: ATXN1; (-) strand; PAM type: YTN; PAM sequence: CTG
acccttggggtgacccagag

SEQ ID NO: 162089 - DNA, 20 bp, Artificial Sequence
  Description of Artificial Sequence: Synthetic oligonucleotide
  Target: ATXN1; (-) strand; PAM type: YTN; PAM sequence: CTA
tcctgacccttggggtgacc

SEQ ID NO: 162090 - DNA, 20 bp, Artificial Sequence
  Description of Artificial Sequence: Synthetic oligonucleotide
  Target: ATXN1; (-) strand; PAM type: YTN; PAM sequence: TTC
tatcctgacccttggggtga

SEQ ID NO: 162091 - DNA, 20 bp, Artificial Sequence
  Description of Artificial Sequence: Synthetic oligonucleotide
  Target: ATXN1; (-) strand; PAM type: YTN; PAM sequence: TTT
ctatcctgacccttggggtg

SEQ ID NO: 162092 - DNA, 20 bp, Artificial Sequence
  Description of Artificial Sequence: Synthetic oligonucleotide
  Target: ATXN1; (-) strand; PAM type: YTN; PAM sequence: CTG
agtttctatcctgacccttg

SEQ ID NO: 162093 - DNA, 20 bp, Artificial Sequence
  Description of Artificial Sequence: Synthetic oligonucleotide
  Target: ATXN1; (-) strand; PAM type: YTN; PAM sequence: CTA
ccccatatccctgagtttct

SEQ ID NO: 162094 - DNA, 20 bp, Artificial Sequence
  Description of Artificial Sequence: Synthetic oligonucleotide
  Target: ATXN1; (-) strand; PAM type: YTN; PAM sequence: TTC
gaacacccaaccagggcagg

SEQ ID NO: 162095 - DNA, 20 bp, Artificial Sequence
  Description of Artificial Sequence: Synthetic oligonucleotide
  Target: ATXN1; (-) strand; PAM type: YTN; PAM sequence: CTA
atggcaaaaaaatgtagagt

SEQ ID NO: 162096 - DNA, 20 bp, Artificial Sequence
  Description of Artificial Sequence: Synthetic oligonucleotide
  Target: ATXN1; (-) strand; PAM type: YTN; PAM sequence: TTC
ctaatggcaaaaaaatgtag

SEQ ID NO: 162097 - DNA, 20 bp, Artificial Sequence
  Description of Artificial Sequence: Synthetic oligonucleotide
  Target: ATXN1; (-) strand; PAM type: YTN; PAM sequence: CTC
agaatgttcctaatggcaaa

SEQ ID NO: 162098 - DNA, 20 bp, Artificial Sequence
  Description of Artificial Sequence: Synthetic oligonucleotide
  Target: ATXN1; (-) strand; PAM type: YTN; PAM sequence: TTG
acacagagtggaatcacagt

SEQ ID NO: 162099 - DNA, 20 bp, Artificial Sequence
  Description of Artificial Sequence: Synthetic oligonucleotide
  Target: ATXN1; (-) strand; PAM type: YTN; PAM sequence: CTT
gacacagagtggaatcacag

SEQ ID NO: 162100 - DNA, 20 bp, Artificial Sequence
  Description of Artificial Sequence: Synthetic oligonucleotide
  Target: ATXN1; (-) strand; PAM type: YTN; PAM sequence: CTG
ggatgacaagccagccacct

SEQ ID NO: 162101 - DNA, 20 bp, Artificial Sequence
  Description of Artificial Sequence: Synthetic oligonucleotide
  Target: ATXN1; (-) strand; PAM type: YTN; PAM sequence: TTG
tgacagtagactgggatgac

SEQ ID NO: 162102 - DNA, 20 bp, Artificial Sequence
  Description of Artificial Sequence: Synthetic oligonucleotide
  Target: ATXN1; (-) strand; PAM type: YTN; PAM sequence: CTG
aggacacagcaagaagaaat

SEQ ID NO: 162103 - DNA, 20 bp, Artificial Sequence
  Description of Artificial Sequence: Synthetic oligonucleotide
  Target: ATXN1; (-) strand; PAM type: YTN; PAM sequence: TTC
cactgaggacacagcaagaa

SEQ ID NO: 162104 - DNA, 20 bp, Artificial Sequence
  Description of Artificial Sequence: Synthetic oligonucleotide
  Target: ATXN1; (-) strand; PAM type: YTN; PAM sequence: TTT
ccactgaggacacagcaaga

SEQ ID NO: 162105 - DNA, 20 bp, Artificial Sequence
  Description of Artificial Sequence: Synthetic oligonucleotide
  Target: ATXN1; (-) strand; PAM type: YTN; PAM sequence: TTA
gatagacatggaagagaagg

SEQ ID NO: 162106 - DNA, 20 bp, Artificial Sequence
  Description of Artificial Sequence: Synthetic oligonucleotide
  Target: ATXN1; (-) strand; PAM type: YTN; PAM sequence: CTT
agatagacatggaagagaag

SEQ ID NO: 162107 - DNA, 20 bp, Artificial Sequence
  Description of Artificial Sequence: Synthetic oligonucleotide
  Target: ATXN1; (-) strand; PAM type: YTN; PAM sequence: CTC
cacgcttagatagacatgga

SEQ ID NO: 162108 - DNA, 20 bp, Artificial Sequence
  Description of Artificial Sequence: Synthetic oligonucleotide
  Target: ATXN1; (-) strand; PAM type: YTN; PAM sequence: CTG
ccccatgaagctccacgctt

SEQ ID NO: 162109 - DNA, 20 bp, Artificial Sequence
  Description of Artificial Sequence: Synthetic oligonucleotide
  Target: ATXN1; (-) strand; PAM type: YTN; PAM sequence: TTG
ggccaagaggcctgccccat

SEQ ID NO: 162110 - DNA, 20 bp, Artificial Sequence
  Description of Artificial Sequence: Synthetic oligonucleotide
  Target: ATXN1; (-) strand; PAM type: YTN; PAM sequence: TTT
gggccaagaggcctgcccca

SEQ ID NO: 162111 - DNA, 20 bp, Artificial Sequence
  Description of Artificial Sequence: Synthetic oligonucleotide
  Target: ATXN1; (-) strand; PAM type: YTN; PAM sequence: TTT
tgggccaagaggcctgcccc

SEQ ID NO: 162112 - DNA, 20 bp, Artificial Sequence
  Description of Artificial Sequence: Synthetic oligonucleotide
  Target: ATXN1; (-) strand; PAM type: YTN; PAM sequence: CTC
attttgggccaagaggcctg

SEQ ID NO: 162113 - DNA, 20 bp, Artificial Sequence
  Description of Artificial Sequence: Synthetic oligonucleotide
  Target: ATXN1; (-) strand; PAM type: YTN; PAM sequence: CTC
ctcattttgggccaagaggc

SEQ ID NO: 162114 - DNA, 20 bp, Artificial Sequence
  Description of Artificial Sequence: Synthetic oligonucleotide
  Target: ATXN1; (-) strand; PAM type: YTN; PAM sequence: TTC
aggagcctcctcattttggg

SEQ ID NO: 162115 - DNA, 20 bp, Artificial Sequence
  Description of Artificial Sequence: Synthetic oligonucleotide
  Target: ATXN1; (-) strand; PAM type: YTN; PAM sequence: CTT
caggagcctcctcattttgg

SEQ ID NO: 162116 - DNA, 20 bp, Artificial Sequence
  Description of Artificial Sequence: Synthetic oligonucleotide
  Target: ATXN1; (-) strand; PAM type: YTN; PAM sequence: TTC
agtccccttcaggagcctcc

SEQ ID NO: 162117 - DNA, 20 bp, Artificial Sequence
  Description of Artificial Sequence: Synthetic oligonucleotide
  Target: ATXN1; (-) strand; PAM type: YTN; PAM sequence: CTT
cagtccccttcaggagcctc

SEQ ID NO: 162118 - DNA, 20 bp, Artificial Sequence
  Description of Artificial Sequence: Synthetic oligonucleotide
  Target: ATXN1; (-) strand; PAM type: YTN; PAM sequence: CTA
gacagggccttcagtcccct

SEQ ID NO: 162119 - DNA, 20 bp, Artificial Sequence
  Description of Artificial Sequence: Synthetic oligonucleotide
  Target: ATXN1; (-) strand; PAM type: YTN; PAM sequence: CTC
tagacagggccttcagtccc

SEQ ID NO: 162120 - DNA, 20 bp, Artificial Sequence
  Description of Artificial Sequence: Synthetic oligonucleotide
  Target: ATXN1; (-) strand; PAM type: YTN; PAM sequence: CTG
gatgtctctagacagggcct

SEQ ID NO: 162121 - DNA, 20 bp, Artificial Sequence
  Description of Artificial Sequence: Synthetic oligonucleotide
  Target: ATXN1; (-) strand; PAM type: YTN; PAM sequence: CTG
gcctggatgtctctagacag

SEQ ID NO: 162122 - DNA, 20 bp, Artificial Sequence
  Description of Artificial Sequence: Synthetic oligonucleotide
  Target: ATXN1; (-) strand; PAM type: YTN; PAM sequence: TTC
tggcctggatgtctctagac

SEQ ID NO: 162123 - DNA, 20 bp, Artificial Sequence
  Description of Artificial Sequence: Synthetic oligonucleotide
  Target: ATXN1; (-) strand; PAM type: YTN; PAM sequence: TTT
ctggcctggatgtctctaga

SEQ ID NO: 162124 - DNA, 20 bp, Artificial Sequence
  Description of Artificial Sequence: Synthetic oligonucleotide
  Target: ATXN1; (-) strand; PAM type: YTN; PAM sequence: CTG
gtggtttctggcctggatgt

SEQ ID NO: 162125 - DNA, 20 bp, Artificial Sequence
  Description of Artificial Sequence: Synthetic oligonucleotide
  Target: ATXN1; (-) strand; PAM type: YTN; PAM sequence: CTC
tggtggtttctggcctggat

SEQ ID NO: 162126 - DNA, 20 bp, Artificial Sequence
  Description of Artificial Sequence: Synthetic oligonucleotide
  Target: ATXN1; (-) strand; PAM type: YTN; PAM sequence: CTC
tctggtggtttctggcctgg

SEQ ID NO: 162127 - DNA, 20 bp, Artificial Sequence
  Description of Artificial Sequence: Synthetic oligonucleotide
  Target: ATXN1; (-) strand; PAM type: YTN; PAM sequence: CTC
gcctctctggtggtttctgg

SEQ ID NO: 162128 - DNA, 20 bp, Artificial Sequence
  Description of Artificial Sequence: Synthetic oligonucleotide
  Target: ATXN1; (-) strand; PAM type: YTN; PAM sequence: TTG
tgccaggtcccagctcgcct

SEQ ID NO: 162129 - DNA, 20 bp, Artificial Sequence
  Description of Artificial Sequence: Synthetic oligonucleotide
  Target: ATXN1; (-) strand; PAM type: YTN; PAM sequence: CTA
caaagttgtgccaggtccca

SEQ ID NO: 162130 - DNA, 20 bp, Artificial Sequence
  Description of Artificial Sequence: Synthetic oligonucleotide
  Target: ATXN1; (-) strand; PAM type: YTN; PAM sequence: TTC
tacaaagttgtgccaggtcc

SEQ ID NO: 162131 - DNA, 20 bp, Artificial Sequence
  Description of Artificial Sequence: Synthetic oligonucleotide
  Target: ATXN1; (-) strand; PAM type: YTN; PAM sequence: CTT
ctacaaagttgtgccaggtc

SEQ ID NO: 162132 - DNA, 20 bp, Artificial Sequence
  Description of Artificial Sequence: Synthetic oligonucleotide
  Target: ATXN1; (-) strand; PAM type: YTN; PAM sequence: CTC
agacagcatcttctacaaag

SEQ ID NO: 162133 - DNA, 20 bp, Artificial Sequence
  Description of Artificial Sequence: Synthetic oligonucleotide
  Target: ATXN1; (-) strand; PAM type: YTN; PAM sequence: CTC
tcagacagcatcttctacaa

SEQ ID NO: 162134 - DNA, 20 bp, Artificial Sequence
  Description of Artificial Sequence: Synthetic oligonucleotide
  Target: ATXN1; (-) strand; PAM type: YTN; PAM sequence: TTG
gggcgaggctctcagacagc

SEQ ID NO: 162135 - DNA, 20 bp, Artificial Sequence
  Description of Artificial Sequence: Synthetic oligonucleotide
  Target: ATXN1; (-) strand; PAM type: YTN; PAM sequence: TTC
cgtgaagagcaagatcccat

SEQ ID NO: 162136 - DNA, 20 bp, Artificial Sequence
  Description of Artificial Sequence: Synthetic oligonucleotide
  Target: ATXN1; (-) strand; PAM type: YTN; PAM sequence: CTT
ccgtgaagagcaagatccca

SEQ ID NO: 162137 - DNA, 20 bp, Artificial Sequence
  Description of Artificial Sequence: Synthetic oligonucleotide
  Target: ATXN1; (-) strand; PAM type: YTN; PAM sequence: CTA
cacttccgtgaagagcaaga

SEQ ID NO: 162138 - DNA, 20 bp, Artificial Sequence
  Description of Artificial Sequence: Synthetic oligonucleotide
  Target: ATXN1; (-) strand; PAM type: YTN; PAM sequence: CTC
actacacttccgtgaagagc

SEQ ID NO: 162139 - DNA, 20 bp, Artificial Sequence
  Description of Artificial Sequence: Synthetic oligonucleotide
  Target: ATXN1; (-) strand; PAM type: YTN; PAM sequence: CTC
actcactacacttccgtgaa

SEQ ID NO: 162140 - DNA, 20 bp, Artificial Sequence
  Description of Artificial Sequence: Synthetic oligonucleotide
  Target: ATXN1; (-) strand; PAM type: YTN; PAM sequence: TTC
tcactcactacacttccgtg

SEQ ID NO: 162141 - DNA, 20 bp, Artificial Sequence
  Description of Artificial Sequence: Synthetic oligonucleotide
  Target: ATXN1; (-) strand; PAM type: YTN; PAM sequence: CTT
ctcactcactacacttccgt

SEQ ID NO: 162142 - DNA, 20 bp, Artificial Sequence
  Description of Artificial Sequence: Synthetic oligonucleotide
  Target: ATXN1; (-) strand; PAM type: YTN; PAM sequence: CTC
ttctcactcactacacttcc

SEQ ID NO: 162143 - DNA, 20 bp, Artificial Sequence
  Description of Artificial Sequence: Synthetic oligonucleotide
  Target: ATXN1; (-) strand; PAM type: YTN; PAM sequence: TTC
tcttctcactcactacactt

SEQ ID NO: 162144 - DNA, 20 bp, Artificial Sequence
  Description of Artificial Sequence: Synthetic oligonucleotide
  Target: ATXN1; (-) strand; PAM type: YTN; PAM sequence: TTT
ctcttctcactcactacact

SEQ ID NO: 162145 - DNA, 20 bp, Artificial Sequence
  Description of Artificial Sequence: Synthetic oligonucleotide
  Target: ATXN1; (-) strand; PAM type: YTN; PAM sequence: TTT
tctcttctcactcactacac

SEQ ID NO: 162146 - DNA, 20 bp, Artificial Sequence
  Description of Artificial Sequence: Synthetic oligonucleotide
  Target: ATXN1; (-) strand; PAM type: YTN; PAM sequence: TTT
ttctcttctcactcactaca

SEQ ID NO: 162147 - DNA, 20 bp, Artificial Sequence
  Description of Artificial Sequence: Synthetic oligonucleotide
  Target: ATXN1; (-) strand; PAM type: YTN; PAM sequence: CTT
tttctcttctcactcactac

SEQ ID NO: 162148 - DNA, 20 bp, Artificial Sequence
  Description of Artificial Sequence: Synthetic oligonucleotide
  Target: ATXN1; (-) strand; PAM type: YTN; PAM sequence: TTG
ctttttctcttctcactcac

SEQ ID NO: 162149 - DNA, 20 bp, Artificial Sequence
  Description of Artificial Sequence: Synthetic oligonucleotide
  Target: ATXN1; (-) strand; PAM type: YTN; PAM sequence: CTT
gctttttctcttctcactca

SEQ ID NO: 162150 - DNA, 20 bp, Artificial Sequence
  Description of Artificial Sequence: Synthetic oligonucleotide
  Target: ATXN1; (-) strand; PAM type: YTN; PAM sequence: TTC
ttgctttttctcttctcact

SEQ ID NO: 162151 - DNA, 20 bp, Artificial Sequence
  Description of Artificial Sequence: Synthetic oligonucleotide
  Target: ATXN1; (-) strand; PAM type: YTN; PAM sequence: TTT
cttgctttttctcttctcac

SEQ ID NO: 162152 - DNA, 20 bp, Artificial Sequence
  Description of Artificial Sequence: Synthetic oligonucleotide
  Target: ATXN1; (-) strand; PAM type: YTN; PAM sequence: TTC
atttcttgctttttctcttc

SEQ ID NO: 162153 - DNA, 20 bp, Artificial Sequence
  Description of Artificial Sequence: Synthetic oligonucleotide
  Target: ATXN1; (-) strand; PAM type: YTN; PAM sequence: TTT
catttcttgctttttctctt

SEQ ID NO: 162154 - DNA, 20 bp, Artificial Sequence
  Description of Artificial Sequence: Synthetic oligonucleotide
  Target: ATXN1; (-) strand; PAM type: YTN; PAM sequence: CTT
tcatttcttgctttttctct

SEQ ID NO: 162155 - DNA, 20 bp, Artificial Sequence
  Description of Artificial Sequence: Synthetic oligonucleotide
  Target: ATXN1; (-) strand; PAM type: YTN; PAM sequence: TTA
cgagctttcatttcttgctt

SEQ ID NO: 162156 - DNA, 20 bp, Artificial Sequence
  Description of Artificial Sequence: Synthetic oligonucleotide
  Target: ATXN1; (-) strand; PAM type: YTN; PAM sequence: TTG
gattacgagctttcatttct

SEQ ID NO: 162157 - DNA, 20 bp, Artificial Sequence
  Description of Artificial Sequence: Synthetic oligonucleotide
  Target: ATXN1; (-) strand; PAM type: YTN; PAM sequence: CTT
ggattacgagctttcatttc

SEQ ID NO: 162158 - DNA, 20 bp, Artificial Sequence
  Description of Artificial Sequence: Synthetic oligonucleotide
  Target: ATXN1; (-) strand; PAM type: YTN; PAM sequence: CTA
gcttggattacgagctttca

SEQ ID NO: 162159 - DNA, 20 bp, Artificial Sequence
  Description of Artificial Sequence: Synthetic oligonucleotide
  Target: ATXN1; (-) strand; PAM type: YTN; PAM sequence: TTC
tagcttggattacgagcttt

SEQ ID NO: 162160 - DNA, 20 bp, Artificial Sequence
  Description of Artificial Sequence: Synthetic oligonucleotide
  Target: ATXN1; (-) strand; PAM type: YTN; PAM sequence: CTT
ctagcttggattacgagctt

SEQ ID NO: 162161 - DNA, 20 bp, Artificial Sequence
  Description of Artificial Sequence: Synthetic oligonucleotide
  Target: ATXN1; (-) strand; PAM type: YTN; PAM sequence: CTC
cttctagcttggattacgag

SEQ ID NO: 162162 - DNA, 20 bp, Artificial Sequence
  Description of Artificial Sequence: Synthetic oligonucleotide
  Target: ATXN1; (-) strand; PAM type: YTN; PAM sequence: CTC
gtgtggactccttctagctt

SEQ ID NO: 162163 - DNA, 20 bp, Artificial Sequence
  Description of Artificial Sequence: Synthetic oligonucleotide
  Target: ATXN1; (-) strand; PAM type: YTN; PAM sequence: TTA
ggccctcgtgtggactcctt

SEQ ID NO: 162164 - DNA, 20 bp, Artificial Sequence
  Description of Artificial Sequence: Synthetic oligonucleotide
  Target: ATXN1; (-) strand; PAM type: YTN; PAM sequence: CTT
aggccctcgtgtggactcct

SEQ ID NO: 162165 - DNA, 20 bp, Artificial Sequence
  Description of Artificial Sequence: Synthetic oligonucleotide
  Target: ATXN1; (-) strand; PAM type: YTN; PAM sequence: TTA
tgtccttaggccctcgtgtg

SEQ ID NO: 162166 - DNA, 20 bp, Artificial Sequence
  Description of Artificial Sequence: Synthetic oligonucleotide
  Target: ATXN1; (-) strand; PAM type: YTN; PAM sequence: TTT
atgtccttaggccctcgtgt

SEQ ID NO: 162167 - DNA, 20 bp, Artificial Sequence
  Description of Artificial Sequence: Synthetic oligonucleotide
  Target: ATXN1; (-) strand; PAM type: YTN; PAM sequence: TTT
tatgtccttaggccctcgtg

SEQ ID NO: 162168 - DNA, 20 bp, Artificial Sequence
  Description of Artificial Sequence: Synthetic oligonucleotide
  Target: ATXN1; (-) strand; PAM type: YTN; PAM sequence: TTT
ttatgtccttaggccctcgt

SEQ ID NO: 162169 - DNA, 20 bp, Artificial Sequence
  Description of Artificial Sequence: Synthetic oligonucleotide
  Target: ATXN1; (-) strand; PAM type: YTN; PAM sequence: TTT
tttatgtccttaggccctcg

SEQ ID NO: 162170 - DNA, 20 bp, Artificial Sequence
  Description of Artificial Sequence: Synthetic oligonucleotide
  Target: ATXN1; (-) strand; PAM type: YTN; PAM sequence: TTA
ttttttatgtccttaggccc

SEQ ID NO: 162171 - DNA, 20 bp, Artificial Sequence
  Description of Artificial Sequence: Synthetic oligonucleotide
  Target: ATXN1; (-) strand; PAM type: YTN; PAM sequence: TTT
attttttatgtccttaggcc

SEQ ID NO: 162172 - DNA, 20 bp, Artificial Sequence
  Description of Artificial Sequence: Synthetic oligonucleotide
  Target: ATXN1; (-) strand; PAM type: YTN; PAM sequence: TTA
tttattttttatgtccttag

SEQ ID NO: 162173 - DNA, 20 bp, Artificial Sequence
  Description of Artificial Sequence: Synthetic oligonucleotide
  Target: ATXN1; (-) strand; PAM type: YTN; PAM sequence: TTA
agatacataaaattatttat

SEQ ID NO: 162174 - DNA, 20 bp, Artificial Sequence
  Description of Artificial Sequence: Synthetic oligonucleotide
  Target: ATXN1; (-) strand; PAM type: YTN; PAM sequence: TTC
atgataaaaattaagataca

SEQ ID NO: 162175 - DNA, 20 bp, Artificial Sequence
  Description of Artificial Sequence: Synthetic oligonucleotide
  Target: ATXN1; (-) strand; PAM type: YTN; PAM sequence: TTA
ttcatgataaaaattaagat

SEQ ID NO: 162176 - DNA, 20 bp, Artificial Sequence
  Description of Artificial Sequence: Synthetic oligonucleotide
  Target: ATXN1; (-) strand; PAM type: YTN; PAM sequence: CTT
attcatgataaaaattaaga

SEQ ID NO: 162177 - DNA, 20 bp, Artificial Sequence
  Description of Artificial Sequence: Synthetic oligonucleotide
  Target: ATXN1; (-) strand; PAM type: YTN; PAM sequence: TTC
cttattcatgataaaaatta

SEQ ID NO: 162178 - DNA, 20 bp, Artificial Sequence
  Description of Artificial Sequence: Synthetic oligonucleotide
  Target: ATXN1; (-) strand; PAM type: YTN; PAM sequence: CTT
ccttattcatgataaaaatt

SEQ ID NO: 162179 - DNA, 20 bp, Artificial Sequence
  Description of Artificial Sequence: Synthetic oligonucleotide
  Target: ATXN1; (-) strand; PAM type: YTN; PAM sequence: CTG
tccttccttattcatgataa

SEQ ID NO: 162180 - DNA, 20 bp, Artificial Sequence
  Description of Artificial Sequence: Synthetic oligonucleotide
  Target: ATXN1; (-) strand; PAM type: YTN; PAM sequence: TTC
aacccactgtccttccttat

SEQ ID NO: 162181 - DNA, 20 bp, Artificial Sequence
  Description of Artificial Sequence: Synthetic oligonucleotide
  Target: ATXN1; (-) strand; PAM type: YTN; PAM sequence: CTA
ccattcaacccactgtcctt

SEQ ID NO: 162182 - DNA, 20 bp, Artificial Sequence
  Description of Artificial Sequence: Synthetic oligonucleotide
  Target: ATXN1; (-) strand; PAM type: YTN; PAM sequence: TTA
gggatctaccattcaaccca

SEQ ID NO: 162183 - DNA, 20 bp, Artificial Sequence
  Description of Artificial Sequence: Synthetic oligonucleotide
  Target: ATXN1; (-) strand; PAM type: YTN; PAM sequence: TTT
agggatctaccattcaaccc

SEQ ID NO: 162184 - DNA, 20 bp, Artificial Sequence
  Description of Artificial Sequence: Synthetic oligonucleotide
  Target: ATXN1; (-) strand; PAM type: YTN; PAM sequence: TTT
tagggatctaccattcaacc

SEQ ID NO: 162185 - DNA, 20 bp, Artificial Sequence
  Description of Artificial Sequence: Synthetic oligonucleotide
  Target: ATXN1; (-) strand; PAM type: YTN; PAM sequence: CTT
ttagggatctaccattcaac

SEQ ID NO: 162186 - DNA, 20 bp, Artificial Sequence
  Description of Artificial Sequence: Synthetic oligonucleotide
  Target: ATXN1; (-) strand; PAM type: YTN; PAM sequence: CTG
agtgggcataacttttaggg

SEQ ID NO: 162187 - DNA, 20 bp, Artificial Sequence
  Description of Artificial Sequence: Synthetic oligonucleotide
  Target: ATXN1; (-) strand; PAM type: YTN; PAM sequence: TTC
tgagtgggcataacttttag

SEQ ID NO: 162188 - DNA, 20 bp, Artificial Sequence
  Description of Artificial Sequence: Synthetic oligonucleotide
  Target: ATXN1; (-) strand; PAM type: YTN; PAM sequence: TTC
ccaggttctgagtgggcata

SEQ ID NO: 162189 - DNA, 20 bp, Artificial Sequence
  Description of Artificial Sequence: Synthetic oligonucleotide
  Target: ATXN1; (-) strand; PAM type: YTN; PAM sequence: TTC
caaataaagccattcccagg

SEQ ID NO: 162190 - DNA, 20 bp, Artificial Sequence
  Description of Artificial Sequence: Synthetic oligonucleotide
  Target: ATXN1; (-) strand; PAM type: YTN; PAM sequence: TTT
ccaaataaagccattcccag

SEQ ID NO: 162191 - DNA, 20 bp, Artificial Sequence
  Description of Artificial Sequence: Synthetic oligonucleotide
  Target: ATXN1; (-) strand; PAM type: YTN; PAM sequence: TTT
tccaaataaagccattccca

SEQ ID NO: 162192 - DNA, 20 bp, Artificial Sequence
  Description of Artificial Sequence: Synthetic oligonucleotide
  Target: ATXN1; (-) strand; PAM type: YTN; PAM sequence: TTT
ttccaaataaagccattccc

SEQ ID NO: 162193 - DNA, 20 bp, Artificial Sequence
  Description of Artificial Sequence: Synthetic oligonucleotide
  Target: ATXN1; (-) strand; PAM type: YTN; PAM sequence: CTT
tttccaaataaagccattcc

SEQ ID NO: 162194 - DNA, 20 bp, Artificial Sequence
  Description of Artificial Sequence: Synthetic oligonucleotide
  Target: ATXN1; (-) strand; PAM type: YTN; PAM sequence: CTG
caaagaccctttttccaaat

SEQ ID NO: 162195 - DNA, 20 bp, Artificial Sequence
  Description of Artificial Sequence: Synthetic oligonucleotide
  Target: ATXN1; (-) strand; PAM type: YTN; PAM sequence: TTA
catctgcaaagacccttttt

SEQ ID NO: 162196 - DNA, 20 bp, Artificial Sequence
  Description of Artificial Sequence: Synthetic oligonucleotide
  Target: ATXN1; (-) strand; PAM type: YTN; PAM sequence: TTC
caaatccataattacatctg

SEQ ID NO: 162197 - DNA, 20 bp, Artificial Sequence
  Description of Artificial Sequence: Synthetic oligonucleotide
  Target: ATXN1; (-) strand; PAM type: YTN; PAM sequence: TTT
ccaaatccataattacatct

SEQ ID NO: 162198 - DNA, 20 bp, Artificial Sequence
  Description of Artificial Sequence: Synthetic oligonucleotide
  Target: ATXN1; (-) strand; PAM type: YTN; PAM sequence: CTC
atttccaaatccataattac

SEQ ID NO: 162199 - DNA, 20 bp, Artificial Sequence
  Description of Artificial Sequence: Synthetic oligonucleotide
  Target: ATXN1; (-) strand; PAM type: YTN; PAM sequence: CTG
gatcatccagcatgatctca

SEQ ID NO: 162200 - DNA, 20 bp, Artificial Sequence
  Description of Artificial Sequence: Synthetic oligonucleotide
  Target: ATXN1; (-) strand; PAM type: YTN; PAM sequence: TTG
agggcccacctggatcatcc

SEQ ID NO: 162201 - DNA, 20 bp, Artificial Sequence
  Description of Artificial Sequence: Synthetic oligonucleotide
  Target: ATXN1; (-) strand; PAM type: YTN; PAM sequence: TTG
aattgagggcccacctggat

SEQ ID NO: 162202 - DNA, 20 bp, Artificial Sequence
  Description of Artificial Sequence: Synthetic oligonucleotide
  Target: ATXN1; (-) strand; PAM type: YTN; PAM sequence: TTT
gaattgagggcccacctgga

SEQ ID NO: 162203 - DNA, 20 bp, Artificial Sequence
  Description of Artificial Sequence: Synthetic oligonucleotide
  Target: ATXN1; (-) strand; PAM type: YTN; PAM sequence: CTT
tgaattgagggcccacctgg

SEQ ID NO: 162204 - DNA, 20 bp, Artificial Sequence
  Description of Artificial Sequence: Synthetic oligonucleotide
  Target: ATXN1; (-) strand; PAM type: YTN; PAM sequence: TTG
tctttgaattgagggcccac

SEQ ID NO: 162205 - DNA, 20 bp, Artificial Sequence
  Description of Artificial Sequence: Synthetic oligonucleotide
  Target: ATXN1; (-) strand; PAM type: YTN; PAM sequence: TTT
gtctttgaattgagggccca

SEQ ID NO: 162206 - DNA, 20 bp, Artificial Sequence
  Description of Artificial Sequence: Synthetic oligonucleotide
  Target: ATXN1; (-) strand; PAM type: YTN; PAM sequence: TTA
taaggacatttgtctttgaa

SEQ ID NO: 162207 - DNA, 20 bp, Artificial Sequence
  Description of Artificial Sequence: Synthetic oligonucleotide
  Target: ATXN1; (-) strand; PAM type: YTN; PAM sequence: CTT
ataaggacatttgtctttga

SEQ ID NO: 162208 - DNA, 20 bp, Artificial Sequence
  Description of Artificial Sequence: Synthetic oligonucleotide
  Target: ATXN1; (-) strand; PAM type: YTN; PAM sequence: CTC
ttataaggacatttgtcttt

SEQ ID NO: 162209 - DNA, 20 bp, Artificial Sequence
  Description of Artificial Sequence: Synthetic oligonucleotide
  Target: ATXN1; (-) strand; PAM type: YTN; PAM sequence: TTC
tcttataaggacatttgtct

SEQ ID NO: 162210 - DNA, 20 bp, Artificial Sequence
  Description of Artificial Sequence: Synthetic oligonucleotide
  Target: ATXN1; (-) strand; PAM type: YTN; PAM sequence: TTT
ctcttataaggacatttgtc

SEQ ID NO: 162211 - DNA, 20 bp, Artificial Sequence
  Description of Artificial Sequence: Synthetic oligonucleotide
  Target: ATXN1; (-) strand; PAM type: YTN; PAM sequence: CTT
tctcttataaggacatttgt

SEQ ID NO: 162212 - DNA, 20 bp, Artificial Sequence
  Description of Artificial Sequence: Synthetic oligonucleotide
  Target: ATXN1; (-) strand; PAM type: YTN; PAM sequence: CTG
cctttctcttataaggacat

SEQ ID NO: 162213 - DNA, 20 bp, Artificial Sequence
  Description of Artificial Sequence: Synthetic oligonucleotide
  Target: ATXN1; (-) strand; PAM type: YTN; PAM sequence: CTC
tgcctttctcttataaggac

SEQ ID NO: 162214 - DNA, 20 bp, Artificial Sequence
  Description of Artificial Sequence: Synthetic oligonucleotide
  Target: ATXN1; (-) strand; PAM type: YTN; PAM sequence: TTC
tctgcctttctcttataagg

SEQ ID NO: 162215 - DNA, 20 bp, Artificial Sequence
  Description of Artificial Sequence: Synthetic oligonucleotide
  Target: ATXN1; (-) strand; PAM type: YTN; PAM sequence: TTT
ctctgcctttctcttataag

SEQ ID NO: 162216 - DNA, 20 bp, Artificial Sequence
  Description of Artificial Sequence: Synthetic oligonucleotide
  Target: ATXN1; (-) strand; PAM type: YTN; PAM sequence: CTT
tctctgcctttctcttataa

SEQ ID NO: 162217 - DNA, 20 bp, Artificial Sequence
  Description of Artificial Sequence: Synthetic oligonucleotide
  Target: ATXN1; (-) strand; PAM type: YTN; PAM sequence: CTC
acatctttctctgcctttct

SEQ ID NO: 162218 - DNA, 20 bp, Artificial Sequence
  Description of Artificial Sequence: Synthetic oligonucleotide
  Target: ATXN1; (-) strand; PAM type: YTN; PAM sequence: CTG
tacatctcacatctttctct

SEQ ID NO: 162219 - DNA, 20 bp, Artificial Sequence
  Description of Artificial Sequence: Synthetic oligonucleotide
  Target: ATXN1; (-) strand; PAM type: YTN; PAM sequence: CTC
tgtacatctcacatctttct

SEQ ID NO: 162220 - DNA, 20 bp, Artificial Sequence
  Description of Artificial Sequence: Synthetic oligonucleotide
  Target: ATXN1; (-) strand; PAM type: YTN; PAM sequence: TTG
cctctgtacatctcacatct

SEQ ID NO: 162221 - DNA, 20 bp, Artificial Sequence
  Description of Artificial Sequence: Synthetic oligonucleotide
  Target: ATXN1; (-) strand; PAM type: YTN; PAM sequence: TTT
gcctctgtacatctcacatc

SEQ ID NO: 162222 - DNA, 20 bp, Artificial Sequence
  Description of Artificial Sequence: Synthetic oligonucleotide
  Target: ATXN1; (-) strand; PAM type: YTN; PAM sequence: CTT
tgcctctgtacatctcacat

SEQ ID NO: 162223 - DNA, 20 bp, Artificial Sequence
  Description of Artificial Sequence: Synthetic oligonucleotide
  Target: ATXN1; (-) strand; PAM type: YTN; PAM sequence: CTC
cacagggcctttgcctctgt

SEQ ID NO: 162224 - DNA, 20 bp, Artificial Sequence
  Description of Artificial Sequence: Synthetic oligonucleotide
  Target: ATXN1; (-) strand; PAM type: YTN; PAM sequence: CTG
cctccacagggcctttgcct

SEQ ID NO: 162225 - DNA, 20 bp, Artificial Sequence
  Description of Artificial Sequence: Synthetic oligonucleotide
  Target: ATXN1; (-) strand; PAM type: YTN; PAM sequence: CTC
tgcctccacagggcctttgc

SEQ ID NO: 162226 - DNA, 20 bp, Artificial Sequence
  Description of Artificial Sequence: Synthetic oligonucleotide
  Target: ATXN1; (-) strand; PAM type: YTN; PAM sequence: CTG
cctctgcctccacagggcct

SEQ ID NO: 162227 - DNA, 20 bp, Artificial Sequence
  Description of Artificial Sequence: Synthetic oligonucleotide
  Target: ATXN1; (-) strand; PAM type: YTN; PAM sequence: CTC
tgcctctgcctccacagggc

SEQ ID NO: 162228 - DNA, 20 bp, Artificial Sequence
  Description of Artificial Sequence: Synthetic oligonucleotide
  Target: ATXN1; (-) strand; PAM type: YTN; PAM sequence: CTC
tctgcctctgcctccacagg

SEQ ID NO: 162229 - DNA, 20 bp, Artificial Sequence
  Description of Artificial Sequence: Synthetic oligonucleotide
  Target: ATXN1; (-) strand; PAM type: YTN; PAM sequence: TTC
cagtctctctgcctctgcct

SEQ ID NO: 162230 - DNA, 20 bp, Artificial Sequence
  Description of Artificial Sequence: Synthetic oligonucleotide
  Target: ATXN1; (-) strand; PAM type: YTN; PAM sequence: CTG
cgtcattccagtctctctgc

SEQ ID NO: 162231 - DNA, 20 bp, Artificial Sequence
  Description of Artificial Sequence: Synthetic oligonucleotide
  Target: ATXN1; (-) strand; PAM type: YTN; PAM sequence: TTG
ggactgcgtcattccagtct

SEQ ID NO: 162232 - DNA, 20 bp, Artificial Sequence
  Description of Artificial Sequence: Synthetic oligonucleotide
  Target: ATXN1; (-) strand; PAM type: YTN; PAM sequence: CTT
gggactgcgtcattccagtc

SEQ ID NO: 162233 - DNA, 20 bp, Artificial Sequence
  Description of Artificial Sequence: Synthetic oligonucleotide
  Target: ATXN1; (-) strand; PAM type: YTN; PAM sequence: TTG
gcttgggactgcgtcattcc

SEQ ID NO: 162234 - DNA, 20 bp, Artificial Sequence
  Description of Artificial Sequence: Synthetic oligonucleotide
  Target: ATXN1; (-) strand; PAM type: YTN; PAM sequence: CTT
ggcttgggactgcgtcattc

SEQ ID NO: 162235 - DNA, 20 bp, Artificial Sequence
  Description of Artificial Sequence: Synthetic oligonucleotide
  Target: ATXN1; (-) strand; PAM type: YTN; PAM sequence: TTC
gggtgatccttggcttggga

SEQ ID NO: 162236 - DNA, 20 bp, Artificial Sequence
  Description of Artificial Sequence: Synthetic oligonucleotide
  Target: ATXN1; (-) strand; PAM type: YTN; PAM sequence: CTT
cgggtgatccttggcttggg

SEQ ID NO: 162237 - DNA, 20 bp, Artificial Sequence
  Description of Artificial Sequence: Synthetic oligonucleotide
  Target: ATXN1; (-) strand; PAM type: YTN; PAM sequence: CTA
gtagcttcgggtgatccttg

SEQ ID NO: 162238 - DNA, 20 bp, Artificial Sequence
  Description of Artificial Sequence: Synthetic oligonucleotide
  Target: ATXN1; (-) strand; PAM type: YTN; PAM sequence: TTC
tagtagcttcgggtgatcct

SEQ ID NO: 162239 - DNA, 20 bp, Artificial Sequence
  Description of Artificial Sequence: Synthetic oligonucleotide
  Target: ATXN1; (-) strand; PAM type: YTN; PAM sequence: CTT
ctagtagcttcgggtgatcc

SEQ ID NO: 162240 - DNA, 20 bp, Artificial Sequence
  Description of Artificial Sequence: Synthetic oligonucleotide
  Target: ATXN1; (-) strand; PAM type: YTN; PAM sequence: CTG
cttctagtagcttcgggtga

SEQ ID NO: 162241 - DNA, 20 bp, Artificial Sequence
  Description of Artificial Sequence: Synthetic oligonucleotide
  Target: ATXN1; (-) strand; PAM type: YTN; PAM sequence: TTG
ctgcttctagtagcttcggg

SEQ ID NO: 162242 - DNA, 20 bp, Artificial Sequence
  Description of Artificial Sequence: Synthetic oligonucleotide
  Target: ATXN1; (-) strand; PAM type: YTN; PAM sequence: CTT
gctgcttctagtagcttcgg

SEQ ID NO: 162243 - DNA, 20 bp, Artificial Sequence
  Description of Artificial Sequence: Synthetic oligonucleotide
  Target: ATXN1; (-) strand; PAM type: YTN; PAM sequence: TTC
ttgctgcttctagtagcttc

SEQ ID NO: 162244 - DNA, 20 bp, Artificial Sequence
  Description of Artificial Sequence: Synthetic oligonucleotide
  Target: ATXN1; (-) strand; PAM type: YTN; PAM sequence: CTT
cttgctgcttctagtagctt

SEQ ID NO: 162245 - DNA, 20 bp, Artificial Sequence
  Description of Artificial Sequence: Synthetic oligonucleotide
  Target: ATXN1; (-) strand; PAM type: YTN; PAM sequence: TTG
cttcttgctgcttctagtag

SEQ ID NO: 162246 - DNA, 20 bp, Artificial Sequence
  Description of Artificial Sequence: Synthetic oligonucleotide
  Target: ATXN1; (-) strand; PAM type: YTN; PAM sequence: CTT
gcttcttgctgcttctagta

SEQ ID NO: 162247 - DNA, 20 bp, Artificial Sequence
  Description of Artificial Sequence: Synthetic oligonucleotide
  Target: ATXN1; (-) strand; PAM type: YTN; PAM sequence: TTC
cttgcttcttgctgcttcta

SEQ ID NO: 162248 - DNA, 20 bp, Artificial Sequence
  Description of Artificial Sequence: Synthetic oligonucleotide
  Target: ATXN1; (-) strand; PAM type: YTN; PAM sequence: TTT
ccttgcttcttgctgcttct

SEQ ID NO: 162249 - DNA, 20 bp, Artificial Sequence
  Description of Artificial Sequence: Synthetic oligonucleotide
  Target: ATXN1; (-) strand; PAM type: YTN; PAM sequence: CTT
tccttgcttcttgctgcttc

SEQ ID NO: 162250 - DNA, 20 bp, Artificial Sequence
  Description of Artificial Sequence: Synthetic oligonucleotide
  Target: ATXN1; (-) strand; PAM type: YTN; PAM sequence: CTA
ggggataatctttccttgct

SEQ ID NO: 162251 - DNA, 20 bp, Artificial Sequence
  Description of Artificial Sequence: Synthetic oligonucleotide
  Target: ATXN1; (-) strand; PAM type: YTN; PAM sequence: CTC
taggggataatctttccttg

SEQ ID NO: 162252 - DNA, 20 bp, Artificial Sequence
  Description of Artificial Sequence: Synthetic oligonucleotide
  Target: ATXN1; (-) strand; PAM type: YTN; PAM sequence: TTC
ataggctctaggggataatc

SEQ ID NO: 162253 - DNA, 20 bp, Artificial Sequence
  Description of Artificial Sequence: Synthetic oligonucleotide
  Target: ATXN1; (-) strand; PAM type: YTN; PAM sequence: CTT
cataggctctaggggataat

SEQ ID NO: 162254 - DNA, 20 bp, Artificial Sequence
  Description of Artificial Sequence: Synthetic oligonucleotide
  Target: ATXN1; (-) strand; PAM type: YTN; PAM sequence: TTC
ccttcataggctctagggga

SEQ ID NO: 162255 - DNA, 20 bp, Artificial Sequence
  Description of Artificial Sequence: Synthetic oligonucleotide
  Target: ATXN1; (-) strand; PAM type: YTN; PAM sequence: CTG
gtggagccatgttcccttca

SEQ ID NO: 162256 - DNA, 20 bp, Artificial Sequence
  Description of Artificial Sequence: Synthetic oligonucleotide
  Target: ATXN1; (-) strand; PAM type: YTN; PAM sequence: TTA
aggtgctggtggagccatgt

SEQ ID NO: 162257 - DNA, 20 bp, Artificial Sequence
  Description of Artificial Sequence: Synthetic oligonucleotide
  Target: ATXN1; (-) strand; PAM type: YTN; PAM sequence: CTA
aaattaaggtgctggtggag

SEQ ID NO: 162258 - DNA, 20 bp, Artificial Sequence
  Description of Artificial Sequence: Synthetic oligonucleotide
  Target: ATXN1; (-) strand; PAM type: YTN; PAM sequence: TTG
aagtctaaaattaaggtgct

SEQ ID NO: 162259 - DNA, 20 bp, Artificial Sequence
  Description of Artificial Sequence: Synthetic oligonucleotide
  Target: ATXN1; (-) strand; PAM type: YTN; PAM sequence: CTT
gaagtctaaaattaaggtgc

SEQ ID NO: 162260 - DNA, 20 bp, Artificial Sequence
  Description of Artificial Sequence: Synthetic oligonucleotide
  Target: ATXN1; (-) strand; PAM type: YTN; PAM sequence: CTG
gaggcttgaagtctaaaatt

SEQ ID NO: 162261 - DNA, 20 bp, Artificial Sequence
  Description of Artificial Sequence: Synthetic oligonucleotide
  Target: ATXN1; (-) strand; PAM type: YTN; PAM sequence: CTC
ctggaggcttgaagtctaaa

SEQ ID NO: 162262 - DNA, 20 bp, Artificial Sequence
  Description of Artificial Sequence: Synthetic oligonucleotide
  Target: ATXN1; (-) strand; PAM type: YTN; PAM sequence: CTA
acactcctggaggcttgaag

SEQ ID NO: 162263 - DNA, 20 bp, Artificial Sequence
  Description of Artificial Sequence: Synthetic oligonucleotide
  Target: ATXN1; (-) strand; PAM type: YTN; PAM sequence: CTC
taacactcctggaggcttga

SEQ ID NO: 162264 - DNA, 20 bp, Artificial Sequence
  Description of Artificial Sequence: Synthetic oligonucleotide
  Target: ATXN1; (-) strand; PAM type: YTN; PAM sequence: TTC
tctaacactcctggaggctt

SEQ ID NO: 162265 - DNA, 20 bp, Artificial Sequence
  Description of Artificial Sequence: Synthetic oligonucleotide
  Target: ATXN1; (-) strand; PAM type: YTN; PAM sequence: TTA
aaacaacagaaaagtattct

SEQ ID NO: 162266 - DNA, 20 bp, Artificial Sequence
  Description of Artificial Sequence: Synthetic oligonucleotide
  Target: ATXN1; (-) strand; PAM type: YTN; PAM sequence: CTT
aaaacaacagaaaagtattc

SEQ ID NO: 162267 - DNA, 20 bp, Artificial Sequence
  Description of Artificial Sequence: Synthetic oligonucleotide
  Target: ATXN1; (-) strand; PAM type: YTN; PAM sequence: TTA
ccaaaacatatcgtggctta

SEQ ID NO: 162268 - DNA, 20 bp, Artificial Sequence
  Description of Artificial Sequence: Synthetic oligonucleotide
  Target: ATXN1; (-) strand; PAM type: YTN; PAM sequence: CTG
ccataataaattaccaaaac

SEQ ID NO: 162269 - DNA, 20 bp, Artificial Sequence
  Description of Artificial Sequence: Synthetic oligonucleotide
  Target: ATXN1; (-) strand; PAM type: YTN; PAM sequence: TTA
gggctgccataataaattac

SEQ ID NO: 162270 - DNA, 20 bp, Artificial Sequence
  Description of Artificial Sequence: Synthetic oligonucleotide
  Target: ATXN1; (-) strand; PAM type: YTN; PAM sequence: CTT
agggctgccataataaatta

SEQ ID NO: 162271 - DNA, 20 bp, Artificial Sequence
  Description of Artificial Sequence: Synthetic oligonucleotide
  Target: ATXN1; (-) strand; PAM type: YTN; PAM sequence: TTC
ttagggctgccataataaat

SEQ ID NO: 162272 - DNA, 20 bp, Artificial Sequence
  Description of Artificial Sequence: Synthetic oligonucleotide
  Target: ATXN1; (-) strand; PAM type: YTN; PAM sequence: TTT
cttagggctgccataataaa

SEQ ID NO: 162273 - DNA, 20 bp, Artificial Sequence
  Description of Artificial Sequence: Synthetic oligonucleotide
  Target: ATXN1; (-) strand; PAM type: YTN; PAM sequence: TTG
gtttcttagggctgccataa

SEQ ID NO: 162274 - DNA, 20 bp, Artificial Sequence
  Description of Artificial Sequence: Synthetic oligonucleotide
  Target: ATXN1; (-) strand; PAM type: YTN; PAM sequence: TTG
gattggtttcttagggctgc

SEQ ID NO: 162275 - DNA, 20 bp, Artificial Sequence
  Description of Artificial Sequence: Synthetic oligonucleotide
  Target: ATXN1; (-) strand; PAM type: YTN; PAM sequence: TTT
ggattggtttcttagggctg

SEQ ID NO: 162276 - DNA, 20 bp, Artificial Sequence
  Description of Artificial Sequence: Synthetic oligonucleotide
  Target: ATXN1; (-) strand; PAM type: YTN; PAM sequence: TTG
gcatgtataataagtaatca

SEQ ID NO: 162277 - DNA, 20 bp, Artificial Sequence
  Description of Artificial Sequence: Synthetic oligonucleotide
  Target: ATXN1; (-) strand; PAM type: YTN; PAM sequence: CTT
ggcatgtataataagtaatc

SEQ ID NO: 162278 - DNA, 20 bp, Artificial Sequence
  Description of Artificial Sequence: Synthetic oligonucleotide
  Target: ATXN1; (-) strand; PAM type: YTN; PAM sequence: TTC
ttggcatgtataataagtaa

SEQ ID NO: 162279 - DNA, 20 bp, Artificial Sequence
  Description of Artificial Sequence: Synthetic oligonucleotide
  Target: ATXN1; (-) strand; PAM type: YTN; PAM sequence: TTA
agtaaggttcttggcatgta

SEQ ID NO: 162280 - DNA, 20 bp, Artificial Sequence
  Description of Artificial Sequence: Synthetic oligonucleotide
  Target: ATXN1; (-) strand; PAM type: YTN; PAM sequence: TTT
aagtaaggttcttggcatgt

SEQ ID NO: 162281 - DNA, 20 bp, Artificial Sequence
  Description of Artificial Sequence: Synthetic oligonucleotide
  Target: ATXN1; (-) strand; PAM type: YTN; PAM sequence: TTA
tgaagagtaaatgagatatt

SEQ ID NO: 162282 - DNA, 20 bp, Artificial Sequence
  Description of Artificial Sequence: Synthetic oligonucleotide
  Target: ATXN1; (-) strand; PAM type: YTN; PAM sequence: TTG
ttatgaagagtaaatgagat

SEQ ID NO: 162283 - DNA, 20 bp, Artificial Sequence
  Description of Artificial Sequence: Synthetic oligonucleotide
  Target: ATXN1; (-) strand; PAM type: YTN; PAM sequence: TTT
gttatgaagagtaaatgaga

SEQ ID NO: 162284 - DNA, 20 bp, Artificial Sequence
  Description of Artificial Sequence: Synthetic oligonucleotide
  Target: ATXN1; (-) strand; PAM type: YTN; PAM sequence: CTC
acaaatttgttatgaagagt

SEQ ID NO: 162285 - DNA, 20 bp, Artificial Sequence
  Description of Artificial Sequence: Synthetic oligonucleotide
  Target: ATXN1; (-) strand; PAM type: YTN; PAM sequence: CTG
gaaaatggagataataatac

SEQ ID NO: 162286 - DNA, 20 bp, Artificial Sequence
  Description of Artificial Sequence: Synthetic oligonucleotide
  Target: ATXN1; (-) strand; PAM type: YTN; PAM sequence: TTA
tctggaaaatggagataata

SEQ ID NO: 162287 - DNA, 20 bp, Artificial Sequence
  Description of Artificial Sequence: Synthetic oligonucleotide
  Target: ATXN1; (-) strand; PAM type: YTN; PAM sequence: CTT
atctggaaaatggagataat

SEQ ID NO: 162288 - DNA, 20 bp, Artificial Sequence
  Description of Artificial Sequence: Synthetic oligonucleotide
  Target: ATXN1; (-) strand; PAM type: YTN; PAM sequence: CTC
agtgtccttatctggaaaat

SEQ ID NO: 162289 - DNA, 20 bp, Artificial Sequence
  Description of Artificial Sequence: Synthetic oligonucleotide
  Target: ATXN1; (-) strand; PAM type: YTN; PAM sequence: TTG
ggaaaacctcagtgtcctta

SEQ ID NO: 162290 - DNA, 20 bp, Artificial Sequence
  Description of Artificial Sequence: Synthetic oligonucleotide
  Target: ATXN1; (-) strand; PAM type: YTN; PAM sequence: CTT
gggaaaacctcagtgtcctt

SEQ ID NO: 162291 - DNA, 20 bp, Artificial Sequence
  Description of Artificial Sequence: Synthetic oligonucleotide
  Target: ATXN1; (-) strand; PAM type: YTN; PAM sequence: CTG
tatggccttgggaaaacctc

SEQ ID NO: 162292 - DNA, 20 bp, Artificial Sequence
  Description of Artificial Sequence: Synthetic oligonucleotide
  Target: ATXN1; (-) strand; PAM type: YTN; PAM sequence: CTG
actgtatggccttgggaaaa

SEQ ID NO: 162293 - DNA, 20 bp, Artificial Sequence
  Description of Artificial Sequence: Synthetic oligonucleotide
  Target: ATXN1; (-) strand; PAM type: YTN; PAM sequence: CTC
tgactgtatggccttgggaa

SEQ ID NO: 162294 - DNA, 20 bp, Artificial Sequence
  Description of Artificial Sequence: Synthetic oligonucleotide
  Target: ATXN1; (-) strand; PAM type: YTN; PAM sequence: CTA
cctctgactgtatggccttg

SEQ ID NO: 162295 - DNA, 20 bp, Artificial Sequence
  Description of Artificial Sequence: Synthetic oligonucleotide
  Target: ATXN1; (-) strand; PAM type: YTN; PAM sequence: TTC
tacctctgactgtatggcct

SEQ ID NO: 162296 - DNA, 20 bp, Artificial Sequence
  Description of Artificial Sequence: Synthetic oligonucleotide
  Target: ATXN1; (-) strand; PAM type: YTN; PAM sequence: CTA
gttctacctctgactgtatg

SEQ ID NO: 162297 - DNA, 20 bp, Artificial Sequence
  Description of Artificial Sequence: Synthetic oligonucleotide
  Target: ATXN1; (-) strand; PAM type: YTN; PAM sequence: TTC
cagtgctagttctacctctg

SEQ ID NO: 162298 - DNA, 20 bp, Artificial Sequence
  Description of Artificial Sequence: Synthetic oligonucleotide
  Target: ATXN1; (-) strand; PAM type: YTN; PAM sequence: TTT
ccagtgctagttctacctct

SEQ ID NO: 162299 - DNA, 20 bp, Artificial Sequence
  Description of Artificial Sequence: Synthetic oligonucleotide
  Target: ATXN1; (-) strand; PAM type: YTN; PAM sequence: CTA
agaaagtgatttccagtgct

SEQ ID NO: 162300 - DNA, 20 bp, Artificial Sequence
  Description of Artificial Sequence: Synthetic oligonucleotide
  Target: ATXN1; (-) strand; PAM type: YTN; PAM sequence: TTG
ggtagactaagaaagtgatt

SEQ ID NO: 162301 - DNA, 20 bp, Artificial Sequence
  Description of Artificial Sequence: Synthetic oligonucleotide
  Target: ATXN1; (-) strand; PAM type: YTN; PAM sequence: CTG
ccatcgccatagccaggagg

SEQ ID NO: 162302 - DNA, 20 bp, Artificial Sequence
  Description of Artificial Sequence: Synthetic oligonucleotide
  Target: ATXN1; (-) strand; PAM type: YTN; PAM sequence: CTA
tgaggctgccatcgccatag

SEQ ID NO: 162303 - DNA, 20 bp, Artificial Sequence
  Description of Artificial Sequence: Synthetic oligonucleotide
  Target: ATXN1; (-) strand; PAM type: YTN; PAM sequence: TTG
ctatgaggctgccatcgcca

SEQ ID NO: 162304 - DNA, 20 bp, Artificial Sequence
  Description of Artificial Sequence: Synthetic oligonucleotide
  Target: ATXN1; (-) strand; PAM type: YTN; PAM sequence: TTT
gctatgaggctgccatcgcc

SEQ ID NO: 162305 - DNA, 20 bp, Artificial Sequence
  Description of Artificial Sequence: Synthetic oligonucleotide
  Target: ATXN1; (-) strand; PAM type: YTN; PAM sequence: CTA
catgaaaaataaataggcat

SEQ ID NO: 162306 - DNA, 20 bp, Artificial Sequence
  Description of Artificial Sequence: Synthetic oligonucleotide
  Target: ATXN1; (-) strand; PAM type: YTN; PAM sequence: TTC
tacatgaaaaataaataggc

SEQ ID NO: 162307 - DNA, 20 bp, Artificial Sequence
  Description of Artificial Sequence: Synthetic oligonucleotide
  Target: ATXN1; (-) strand; PAM type: YTN; PAM sequence: TTT
ctacatgaaaaataaatagg

SEQ ID NO: 162308 - DNA, 20 bp, Artificial Sequence
  Description of Artificial Sequence: Synthetic oligonucleotide
  Target: ATXN1; (-) strand; PAM type: YTN; PAM sequence: TTT
tctacatgaaaaataaatag

SEQ ID NO: 162309 - DNA, 20 bp, Artificial Sequence
  Description of Artificial Sequence: Synthetic oligonucleotide
  Target: ATXN1; (-) strand; PAM type: YTN; PAM sequence: CTT
ttctacatgaaaaataaata

SEQ ID NO: 162310 - DNA, 20 bp, Artificial Sequence
  Description of Artificial Sequence: Synthetic oligonucleotide
  Target: ATXN1; (-) strand; PAM type: YTN; PAM sequence: CTG
tcccttttctacatgaaaaa

SEQ ID NO: 162311 - DNA, 20 bp, Artificial Sequence
  Description of Artificial Sequence: Synthetic oligonucleotide
  Target: ATXN1; (-) strand; PAM type: YTN; PAM sequence: TTC
tgtcccttttctacatgaaa

SEQ ID NO: 162312 - DNA, 20 bp, Artificial Sequence
  Description of Artificial Sequence: Synthetic oligonucleotide
  Target: ATXN1; (-) strand; PAM type: YTN; PAM sequence: CTG
tgcattctgtcccttttcta

SEQ ID NO: 162313 - DNA, 20 bp, Artificial Sequence
  Description of Artificial Sequence: Synthetic oligonucleotide
  Target: ATXN1; (-) strand; PAM type: YTN; PAM sequence: TTA
tccctgtgcattctgtccct

SEQ ID NO: 162314 - DNA, 20 bp, Artificial Sequence
  Description of Artificial Sequence: Synthetic oligonucleotide
  Target: ATXN1; (-) strand; PAM type: YTN; PAM sequence: CTT
atccctgtgcattctgtccc

SEQ ID NO: 162315 - DNA, 20 bp, Artificial Sequence
  Description of Artificial Sequence: Synthetic oligonucleotide
  Target: ATXN1; (-) strand; PAM type: YTN; PAM sequence: CTA
cttatccctgtgcattctgt

SEQ ID NO: 162316 - DNA, 20 bp, Artificial Sequence
  Description of Artificial Sequence: Synthetic oligonucleotide
  Target: ATXN1; (-) strand; PAM type: YTN; PAM sequence: TTC
ccctacttatccctgtgcat

SEQ ID NO: 162317 - DNA, 20 bp, Artificial Sequence
  Description of Artificial Sequence: Synthetic oligonucleotide
  Target: ATXN1; (-) strand; PAM type: YTN; PAM sequence: TTT
cccctacttatccctgtgca

SEQ ID NO: 162318 - DNA, 20 bp, Artificial Sequence
  Description of Artificial Sequence: Synthetic oligonucleotide
  Target: ATXN1; (-) strand; PAM type: YTN; PAM sequence: TTT
tcccctacttatccctgtgc

SEQ ID NO: 162319 - DNA, 20 bp, Artificial Sequence
  Description of Artificial Sequence: Synthetic oligonucleotide
  Target: ATXN1; (-) strand; PAM type: YTN; PAM sequence: CTT
ttcccctacttatccctgtg

SEQ ID NO: 162320 - DNA, 20 bp, Artificial Sequence
  Description of Artificial Sequence: Synthetic oligonucleotide
  Target: ATXN1; (-) strand; PAM type: YTN; PAM sequence: CTA
gacatcttttcccctactta

SEQ ID NO: 162321 - DNA, 20 bp, Artificial Sequence
  Description of Artificial Sequence: Synthetic oligonucleotide
  Target: ATXN1; (-) strand; PAM type: YTN; PAM sequence: TTA
gtcaacatggtgcagaggtc

SEQ ID NO: 162322 - DNA, 20 bp, Artificial Sequence
  Description of Artificial Sequence: Synthetic oligonucleotide
  Target: ATXN1; (-) strand; PAM type: YTN; PAM sequence: TTG
attagtcaacatggtgcaga

SEQ ID NO: 162323 - DNA, 20 bp, Artificial Sequence
  Description of Artificial Sequence: Synthetic oligonucleotide
  Target: ATXN1; (-) strand; PAM type: YTN; PAM sequence: CTT
gattagtcaacatggtgcag

SEQ ID NO: 162324 - DNA, 20 bp, Artificial Sequence
  Description of Artificial Sequence: Synthetic oligonucleotide
  Target: ATXN1; (-) strand; PAM type: YTN; PAM sequence: TTC
ttgattagtcaacatggtgc

SEQ ID NO: 162325 - DNA, 20 bp, Artificial Sequence
  Description of Artificial Sequence: Synthetic oligonucleotide
  Target: ATXN1; (-) strand; PAM type: YTN; PAM sequence: CTG
cagttcttgattagtcaaca

SEQ ID NO: 162326 - DNA, 20 bp, Artificial Sequence
  Description of Artificial Sequence: Synthetic oligonucleotide
  Target: ATXN1; (-) strand; PAM type: YTN; PAM sequence: CTC
accagctgcagttcttgatt

SEQ ID NO: 162327 - DNA, 20 bp, Artificial Sequence
  Description of Artificial Sequence: Synthetic oligonucleotide
  Target: ATXN1; (-) strand; PAM type: YTN; PAM sequence: CTG
aacgtctcaccagctgcagt

SEQ ID NO: 162328 - DNA, 20 bp, Artificial Sequence
  Description of Artificial Sequence: Synthetic oligonucleotide
  Target: ATXN1; (-) strand; PAM type: YTN; PAM sequence: TTA
ctgaacgtctcaccagctgc

SEQ ID NO: 162329 - DNA, 20 bp, Artificial Sequence
  Description of Artificial Sequence: Synthetic oligonucleotide
  Target: ATXN1; (-) strand; PAM type: YTN; PAM sequence: CTT
actgaacgtctcaccagctg

SEQ ID NO: 162330 - DNA, 20 bp, Artificial Sequence
  Description of Artificial Sequence: Synthetic oligonucleotide
  Target: ATXN1; (-) strand; PAM type: YTN; PAM sequence: TTC
cttactgaacgtctcaccag

SEQ ID NO: 162331 - DNA, 20 bp, Artificial Sequence
  Description of Artificial Sequence: Synthetic oligonucleotide
  Target: ATXN1; (-) strand; PAM type: YTN; PAM sequence: CTT
ccttactgaacgtctcacca

SEQ ID NO: 162332 - DNA, 20 bp, Artificial Sequence
  Description of Artificial Sequence: Synthetic oligonucleotide
  Target: ATXN1; (-) strand; PAM type: YTN; PAM sequence: CTC
ttccttactgaacgtctcac

SEQ ID NO: 162333 - DNA, 20 bp, Artificial Sequence
  Description of Artificial Sequence: Synthetic oligonucleotide
  Target: ATXN1; (-) strand; PAM type: YTN; PAM sequence: CTG
atcagtctcttccttactga

SEQ ID NO: 162334 - DNA, 20 bp, Artificial Sequence
  Description of Artificial Sequence: Synthetic oligonucleotide
  Target: ATXN1; (-) strand; PAM type: YTN; PAM sequence: TTG
gtcactgatcagtctcttcc

SEQ ID NO: 162335 - DNA, 20 bp, Artificial Sequence
  Description of Artificial Sequence: Synthetic oligonucleotide
  Target: ATXN1; (-) strand; PAM type: YTN; PAM sequence: CTT
ggtcactgatcagtctcttc

SEQ ID NO: 162336 - DNA, 20 bp, Artificial Sequence
  Description of Artificial Sequence: Synthetic oligonucleotide
  Target: ATXN1; (-) strand; PAM type: YTN; PAM sequence: TTC
cttggtcactgatcagtctc

SEQ ID NO: 162337 - DNA, 20 bp, Artificial Sequence
  Description of Artificial Sequence: Synthetic oligonucleotide
  Target: ATXN1; (-) strand; PAM type: YTN; PAM sequence: CTT
ccttggtcactgatcagtct

SEQ ID NO: 162338 - DNA, 20 bp, Artificial Sequence
  Description of Artificial Sequence: Synthetic oligonucleotide
  Target: ATXN1; (-) strand; PAM type: YTN; PAM sequence: CTC
ttccttggtcactgatcagt

SEQ ID NO: 162339 - DNA, 20 bp, Artificial Sequence
  Description of Artificial Sequence: Synthetic oligonucleotide
  Target: ATXN1; (-) strand; PAM type: YTN; PAM sequence: CTC
tcttccttggtcactgatca

SEQ ID NO: 162340 - DNA, 20 bp, Artificial Sequence
  Description of Artificial Sequence: Synthetic oligonucleotide
  Target: ATXN1; (-) strand; PAM type: YTN; PAM sequence: CTG
acctctcttccttggtcact

SEQ ID NO: 162341 - DNA, 20 bp, Artificial Sequence
  Description of Artificial Sequence: Synthetic oligonucleotide
  Target: ATXN1; (-) strand; PAM type: YTN; PAM sequence: CTG
ggaaatacaaacatcctgac

SEQ ID NO: 162342 - DNA, 20 bp, Artificial Sequence
  Description of Artificial Sequence: Synthetic oligonucleotide
  Target: ATXN1; (-) strand; PAM type: YTN; PAM sequence: TTG
cctgggaaatacaaacatcc

SEQ ID NO: 162343 - DNA, 20 bp, Artificial Sequence
  Description of Artificial Sequence: Synthetic oligonucleotide
  Target: ATXN1; (-) strand; PAM type: YTN; PAM sequence: CTT
gcctgggaaatacaaacatc

SEQ ID NO: 162344 - DNA, 20 bp, Artificial Sequence
  Description of Artificial Sequence: Synthetic oligonucleotide
  Target: ATXN1; (-) strand; PAM type: YTN; PAM sequence: TTG
cttgcctgggaaatacaaac

SEQ ID NO: 162345 - DNA, 20 bp, Artificial Sequence
  Description of Artificial Sequence: Synthetic oligonucleotide
  Target: ATXN1; (-) strand; PAM type: YTN; PAM sequence: CTT
gcttgcctgggaaatacaaa

SEQ ID NO: 162346 - DNA, 20 bp, Artificial Sequence
  Description of Artificial Sequence: Synthetic oligonucleotide
  Target: ATXN1; (-) strand; PAM type: YTN; PAM sequence: CTG
cttgcttgcctgggaaatac

SEQ ID NO: 162347 - DNA, 20 bp, Artificial Sequence
  Description of Artificial Sequence: Synthetic oligonucleotide
  Target: ATXN1; (-) strand; PAM type: YTN; PAM sequence: CTG
aggtcccctgcttgcttgcc

SEQ ID NO: 162348 - DNA, 20 bp, Artificial Sequence
  Description of Artificial Sequence: Synthetic oligonucleotide
  Target: ATXN1; (-) strand; PAM type: YTN; PAM sequence: CTG
agcctgaggtcccctgcttg

SEQ ID NO: 162349 - DNA, 20 bp, Artificial Sequence
  Description of Artificial Sequence: Synthetic oligonucleotide
  Target: ATXN1; (-) strand; PAM type: YTN; PAM sequence: CTG
ctgagcctgaggtcccctgc

SEQ ID NO: 162350 - DNA, 20 bp, Artificial Sequence
  Description of Artificial Sequence: Synthetic oligonucleotide
  Target: ATXN1; (-) strand; PAM type: YTN; PAM sequence: TTG
gctgctgagcctgaggtccc

SEQ ID NO: 162351 - DNA, 20 bp, Artificial Sequence
  Description of Artificial Sequence: Synthetic oligonucleotide
  Target: ATXN1; (-) strand; PAM type: YTN; PAM sequence: CTT
ggctgctgagcctgaggtcc

SEQ ID NO: 162352 - DNA, 20 bp, Artificial Sequence
  Description of Artificial Sequence: Synthetic oligonucleotide
  Target: ATXN1; (-) strand; PAM type: YTN; PAM sequence: TTG
aacttggctgctgagcctga

SEQ ID NO: 162353 - DNA, 20 bp, Artificial Sequence
  Description of Artificial Sequence: Synthetic oligonucleotide
  Target: ATXN1; (-) strand; PAM type: YTN; PAM sequence: CTT
gaacttggctgctgagcctg

SEQ ID NO: 162354 - DNA, 20 bp, Artificial Sequence
  Description of Artificial Sequence: Synthetic oligonucleotide
  Target: ATXN1; (-) strand; PAM type: YTN; PAM sequence: TTG
ggtgggtggtcttgaacttg

SEQ ID NO: 162355 - DNA, 20 bp, Artificial Sequence
  Description of Artificial Sequence: Synthetic oligonucleotide
  Target: ATXN1; (-) strand; PAM type: YTN; PAM sequence: CTG
gatcacaattgggtgggtgg

SEQ ID NO: 162356 - DNA, 20 bp, Artificial Sequence
  Description of Artificial Sequence: Synthetic oligonucleotide
  Target: ATXN1; (-) strand; PAM type: YTN; PAM sequence: CTA
tggcctggatcacaattggg

SEQ ID NO: 162357 - DNA, 20 bp, Artificial Sequence
  Description of Artificial Sequence: Synthetic oligonucleotide
  Target: ATXN1; (-) strand; PAM type: YTN; PAM sequence: CTC
ctatggcctggatcacaatt

SEQ ID NO: 162358 - DNA, 20 bp, Artificial Sequence
  Description of Artificial Sequence: Synthetic oligonucleotide
  Target: ATXN1; (-) strand; PAM type: YTN; PAM sequence: CTC
accactcctatggcctggat

SEQ ID NO: 162359 - DNA, 20 bp, Artificial Sequence
  Description of Artificial Sequence: Synthetic oligonucleotide
  Target: ATXN1; (-) strand; PAM type: YTN; PAM sequence: CTG
cagtctcaccactcctatgg

SEQ ID NO: 162360 - DNA, 20 bp, Artificial Sequence
  Description of Artificial Sequence: Synthetic oligonucleotide
  Target: ATXN1; (-) strand; PAM type: YTN; PAM sequence: TTC
tgcagtctcaccactcctat

SEQ ID NO: 162361 - DNA, 20 bp, Artificial Sequence
  Description of Artificial Sequence: Synthetic oligonucleotide
  Target: ATXN1; (-) strand; PAM type: YTN; PAM sequence: CTT
ctgcagtctcaccactccta

SEQ ID NO: 162362 - DNA, 20 bp, Artificial Sequence
  Description of Artificial Sequence: Synthetic oligonucleotide
  Target: ATXN1; (-) strand; PAM type: YTN; PAM sequence: CTC
cttctgcagtctcaccactc

SEQ ID NO: 162363 - DNA, 20 bp, Artificial Sequence
  Description of Artificial Sequence: Synthetic oligonucleotide
  Target: ATXN1; (-) strand; PAM type: YTN; PAM sequence: CTG
tgccagaggctccttctgca

SEQ ID NO: 162364 - DNA, 20 bp, Artificial Sequence
  Description of Artificial Sequence: Synthetic oligonucleotide
  Target: ATXN1; (-) strand; PAM type: YTN; PAM sequence: CTC
acgtccgacctgtgccagag

SEQ ID NO: 162365 - DNA, 20 bp, Artificial Sequence
  Description of Artificial Sequence: Synthetic oligonucleotide
  Target: ATXN1; (-) strand; PAM type: YTN; PAM sequence: TTC
ctcacgtccgacctgtgcca

SEQ ID NO: 162366 - DNA, 20 bp, Artificial Sequence
  Description of Artificial Sequence: Synthetic oligonucleotide
  Target: ATXN1; (-) strand; PAM type: YTN; PAM sequence: CTC
agttcctcacgtccgacctg

SEQ ID NO: 162367 - DNA, 20 bp, Artificial Sequence
  Description of Artificial Sequence: Synthetic oligonucleotide
  Target: ATXN1; (-) strand; PAM type: YTN; PAM sequence: CTC
tcagttcctcacgtccgacc

SEQ ID NO: 162368 - DNA, 20 bp, Artificial Sequence
  Description of Artificial Sequence: Synthetic oligonucleotide
  Target: ATXN1; (-) strand; PAM type: YTN; PAM sequence: TTA
gtgctctcagttcctcacgt

SEQ ID NO: 162369 - DNA, 20 bp, Artificial Sequence
  Description of Artificial Sequence: Synthetic oligonucleotide
  Target: ATXN1; (-) strand; PAM type: YTN; PAM sequence: TTC
aaaagcatgttagtgctctc

SEQ ID NO: 162370 - DNA, 20 bp, Artificial Sequence
  Description of Artificial Sequence: Synthetic oligonucleotide
  Target: ATXN1; (-) strand; PAM type: YTN; PAM sequence: TTT
caaaagcatgttagtgctct

SEQ ID NO: 162371 - DNA, 20 bp, Artificial Sequence
  Description of Artificial Sequence: Synthetic oligonucleotide
  Target: ATXN1; (-) strand; PAM type: YTN; PAM sequence: TTG
tttcaaaagcatgttagtgc

SEQ ID NO: 162372 - DNA, 20 bp, Artificial Sequence
  Description of Artificial Sequence: Synthetic oligonucleotide
  Target: ATXN1; (-) strand; PAM type: YTN; PAM sequence: CTT
gtttcaaaagcatgttagtg

SEQ ID NO: 162373 - DNA, 20 bp, Artificial Sequence
  Description of Artificial Sequence: Synthetic oligonucleotide
  Target: ATXN1; (-) strand; PAM type: YTN; PAM sequence: CTA
gagggagagagcttgtttca

SEQ ID NO: 162374 - DNA, 20 bp, Artificial Sequence
  Description of Artificial Sequence: Synthetic oligonucleotide
  Target: ATXN1; (-) strand; PAM type: YTN; PAM sequence: TTG
tgacactagagggagagagc

SEQ ID NO: 162375 - DNA, 20 bp, Artificial Sequence
  Description of Artificial Sequence: Synthetic oligonucleotide
  Target: ATXN1; (-) strand; PAM type: YTN; PAM sequence: CTT
gtgacactagagggagagag

SEQ ID NO: 162376 - DNA, 20 bp, Artificial Sequence
  Description of Artificial Sequence: Synthetic oligonucleotide
  Target: ATXN1; (-) strand; PAM type: YTN; PAM sequence: TTC
ttgtgacactagagggagag

SEQ ID NO: 162377 - DNA, 20 bp, Artificial Sequence
  Description of Artificial Sequence: Synthetic oligonucleotide
  Target: ATXN1; (-) strand; PAM type: YTN; PAM sequence: CTT
cttgtgacactagagggaga

SEQ ID NO: 162378 - DNA, 20 bp, Artificial Sequence
  Description of Artificial Sequence: Synthetic oligonucleotide
  Target: ATXN1; (-) strand; PAM type: YTN; PAM sequence: TTG
cttcttgtgacactagaggg

SEQ ID NO: 162379 - DNA, 20 bp, Artificial Sequence
  Description of Artificial Sequence: Synthetic oligonucleotide
  Target: ATXN1; (-) strand; PAM type: YTN; PAM sequence: CTT
gcttcttgtgacactagagg

SEQ ID NO: 162380 - DNA, 20 bp, Artificial Sequence
  Description of Artificial Sequence: Synthetic oligonucleotide
  Target: ATXN1; (-) strand; PAM type: YTN; PAM sequence: TTG
aacttgcttcttgtgacact

SEQ ID NO: 162381 - DNA, 20 bp, Artificial Sequence
  Description of Artificial Sequence: Synthetic oligonucleotide
  Target: ATXN1; (-) strand; PAM type: YTN; PAM sequence: CTT
gaacttgcttcttgtgacac

SEQ ID NO: 162382 - DNA, 20 bp, Artificial Sequence
  Description of Artificial Sequence: Synthetic oligonucleotide
  Target: ATXN1; (-) strand; PAM type: YTN; PAM sequence: TTG
caggcttgaacttgcttctt

SEQ ID NO: 162383 - DNA, 20 bp, Artificial Sequence
  Description of Artificial Sequence: Synthetic oligonucleotide
  Target: ATXN1; (-) strand; PAM type: YTN; PAM sequence: CTG
tgccaggttgcaggcttgaa

SEQ ID NO: 162384 - DNA, 20 bp, Artificial Sequence
  Description of Artificial Sequence: Synthetic oligonucleotide
  Target: ATXN1; (-) strand; PAM type: YTN; PAM sequence: CTC
aggggagcctgtgccaggtt

SEQ ID NO: 162385 - DNA, 20 bp, Artificial Sequence
  Description of Artificial Sequence: Synthetic oligonucleotide
  Target: ATXN1; (-) strand; PAM type: YTN; PAM sequence: CTG
ccacggactcaggggagcct

SEQ ID NO: 162386 - DNA, 20 bp, Artificial Sequence
  Description of Artificial Sequence: Synthetic oligonucleotide
  Target: ATXN1; (-) strand; PAM type: YTN; PAM sequence: CTG
gctgccacggactcagggga

SEQ ID NO: 162387 - DNA, 20 bp, Artificial Sequence
  Description of Artificial Sequence: Synthetic oligonucleotide
  Target: ATXN1; (-) strand; PAM type: YTN; PAM sequence: CTG
ctggctgccacggactcagg

SEQ ID NO: 162388 - DNA, 20 bp, Artificial Sequence
  Description of Artificial Sequence: Synthetic oligonucleotide
  Target: ATXN1; (-) strand; PAM type: YTN; PAM sequence: CTC
aaagaaaaggaaaatgtggt

SEQ ID NO: 162389 - DNA, 20 bp, Artificial Sequence
  Description of Artificial Sequence: Synthetic oligonucleotide
  Target: ATXN1; (-) strand; PAM type: YTN; PAM sequence: TTG
cctcaaagaaaaggaaaatg

SEQ ID NO: 162390 - DNA, 20 bp, Artificial Sequence
  Description of Artificial Sequence: Synthetic oligonucleotide
  Target: ATXN1; (-) strand; PAM type: YTN; PAM sequence: CTT
gcctcaaagaaaaggaaaat

SEQ ID NO: 162391 - DNA, 20 bp, Artificial Sequence
  Description of Artificial Sequence: Synthetic oligonucleotide
  Target: ATXN1; (-) strand; PAM type: YTN; PAM sequence: CTG
acccaaccacccccaggaag

SEQ ID NO: 162392 - DNA, 20 bp, Artificial Sequence
  Description of Artificial Sequence: Synthetic oligonucleotide
  Target: ATXN1; (-) strand; PAM type: YTN; PAM sequence: TTC
ccctgacccaaccaccccca

SEQ ID NO: 162393 - DNA, 20 bp, Artificial Sequence
  Description of Artificial Sequence: Synthetic oligonucleotide
  Target: ATXN1; (-) strand; PAM type: YTN; PAM sequence: CTG
gcagtggtagtggcagattc

SEQ ID NO: 162394 - DNA, 20 bp, Artificial Sequence
  Description of Artificial Sequence: Synthetic oligonucleotide
  Target: ATXN1; (-) strand; PAM type: YTN; PAM sequence: CTG
cagtcccagctggcagtggt

SEQ ID NO: 162395 - DNA, 20 bp, Artificial Sequence
  Description of Artificial Sequence: Synthetic oligonucleotide
  Target: ATXN1; (-) strand; PAM type: YTN; PAM sequence: TTG
acccactgcagtcccagctg

SEQ ID NO: 162396 - DNA, 20 bp, Artificial Sequence
  Description of Artificial Sequence: Synthetic oligonucleotide
  Target: ATXN1; (-) strand; PAM type: YTN; PAM sequence: CTT
gacccactgcagtcccagct

SEQ ID NO: 162397 - DNA, 20 bp, Artificial Sequence
  Description of Artificial Sequence: Synthetic oligonucleotide
  Target: ATXN1; (-) strand; PAM type: YTN; PAM sequence: TTG
cttgacccactgcagtccca

SEQ ID NO: 162398 - DNA, 20 bp, Artificial Sequence
  Description of Artificial Sequence: Synthetic oligonucleotide
  Target: ATXN1; (-) strand; PAM type: YTN; PAM sequence: TTT
gcttgacccactgcagtccc

SEQ ID NO: 162399 - DNA, 20 bp, Artificial Sequence
  Description of Artificial Sequence: Synthetic oligonucleotide
  Target: ATXN1; (-) strand; PAM type: YTN; PAM sequence: CTT
tgcttgacccactgcagtcc

SEQ ID NO: 162400 - DNA, 20 bp, Artificial Sequence
  Description of Artificial Sequence: Synthetic oligonucleotide
  Target: ATXN1; (-) strand; PAM type: YTN; PAM sequence: CTG
cctttgcttgacccactgca

SEQ ID NO: 162401 - DNA, 20 bp, Artificial Sequence
  Description of Artificial Sequence: Synthetic oligonucleotide
  Target: ATXN1; (-) strand; PAM type: YTN; PAM sequence: CTC
ctgcctttgcttgacccact

SEQ ID NO: 162402 - DNA, 20 bp, Artificial Sequence
  Description of Artificial Sequence: Synthetic oligonucleotide
  Target: ATXN1; (-) strand; PAM type: YTN; PAM sequence: TTC
tcctgcctttgcttgaccca

SEQ ID NO: 162403 - DNA, 20 bp, Artificial Sequence
  Description of Artificial Sequence: Synthetic oligonucleotide
  Target: ATXN1; (-) strand; PAM type: YTN; PAM sequence: TTT
ctcctgcctttgcttgaccc

SEQ ID NO: 162404 - DNA, 20 bp, Artificial Sequence
  Description of Artificial Sequence: Synthetic oligonucleotide
  Target: ATXN1; (-) strand; PAM type: YTN; PAM sequence: TTT
tctcctgcctttgcttgacc

SEQ ID NO: 162405 - DNA, 20 bp, Artificial Sequence
  Description of Artificial Sequence: Synthetic oligonucleotide
  Target: ATXN1; (-) strand; PAM type: YTN; PAM sequence: CTT
ttctcctgcctttgcttgac

SEQ ID NO: 162406 - DNA, 20 bp, Artificial Sequence
  Description of Artificial Sequence: Synthetic oligonucleotide
  Target: ATXN1; (-) strand; PAM type: YTN; PAM sequence: CTG
cttttctcctgcctttgctt

SEQ ID NO: 162407 - DNA, 20 bp, Artificial Sequence
  Description of Artificial Sequence: Synthetic oligonucleotide
  Target: ATXN1; (-) strand; PAM type: YTN; PAM sequence: CTG
ataatataagtagtggggct

SEQ ID NO: 162408 - DNA, 20 bp, Artificial Sequence
  Description of Artificial Sequence: Synthetic oligonucleotide
  Target: ATXN1; (-) strand; PAM type: YTN; PAM sequence: TTC
gtggtgctgataatataagt

SEQ ID NO: 162409 - DNA, 20 bp, Artificial Sequence
  Description of Artificial Sequence: Synthetic oligonucleotide
  Target: ATXN1; (-) strand; PAM type: YTN; PAM sequence: CTA
ttcgtggtgctgataatata

SEQ ID NO: 162410 - DNA, 20 bp, Artificial Sequence
  Description of Artificial Sequence: Synthetic oligonucleotide
  Target: ATXN1; (-) strand; PAM type: YTN; PAM sequence: CTA
ctattcgtggtgctgataat

SEQ ID NO: 162411 - DNA, 20 bp, Artificial Sequence
  Description of Artificial Sequence: Synthetic oligonucleotide
  Target: ATXN1; (-) strand; PAM type: YTN; PAM sequence: CTA
tagatgcatggggtcaaaaa

SEQ ID NO: 162412 - DNA, 20 bp, Artificial Sequence
  Description of Artificial Sequence: Synthetic oligonucleotide
  Target: ATXN1; (-) strand; PAM type: YTN; PAM sequence: TTG
cccaaaaagtctatagatgc

SEQ ID NO: 162413 - DNA, 20 bp, Artificial Sequence
  Description of Artificial Sequence: Synthetic oligonucleotide
  Target: ATXN1; (-) strand; PAM type: YTN; PAM sequence: TTC
aagtatagtcgtatccattg

SEQ ID NO: 162414 - DNA, 20 bp, Artificial Sequence
  Description of Artificial Sequence: Synthetic oligonucleotide
  Target: ATXN1; (-) strand; PAM type: YTN; PAM sequence: CTT
caagtatagtcgtatccatt

SEQ ID NO: 162415 - DNA, 20 bp, Artificial Sequence
  Description of Artificial Sequence: Synthetic oligonucleotide
  Target: ATXN1; (-) strand; PAM type: YTN; PAM sequence: TTG
cttcaagtatagtcgtatcc

SEQ ID NO: 162416 - DNA, 20 bp, Artificial Sequence
  Description of Artificial Sequence: Synthetic oligonucleotide
  Target: ATXN1; (-) strand; PAM type: YTN; PAM sequence: TTA
atcattgcttcaagtatagt

SEQ ID NO: 162417 - DNA, 20 bp, Artificial Sequence
  Description of Artificial Sequence: Synthetic oligonucleotide
  Target: ATXN1; (-) strand; PAM type: YTN; PAM sequence: TTT
aatcattgcttcaagtatag

SEQ ID NO: 162418 - DNA, 20 bp, Artificial Sequence
  Description of Artificial Sequence: Synthetic oligonucleotide
  Target: ATXN1; (-) strand; PAM type: YTN; PAM sequence: TTT
taatcattgcttcaagtata

SEQ ID NO: 162419 - DNA, 20 bp, Artificial Sequence
  Description of Artificial Sequence: Synthetic oligonucleotide
  Target: ATXN1; (-) strand; PAM type: YTN; PAM sequence: TTT
ttaatcattgcttcaagtat

SEQ ID NO: 162420 - DNA, 20 bp, Artificial Sequence
  Description of Artificial Sequence: Synthetic oligonucleotide
  Target: ATXN1; (-) strand; PAM type: YTN; PAM sequence: TTT
tttaatcattgcttcaagta

SEQ ID NO: 162421 - DNA, 20 bp, Artificial Sequence
  Description of Artificial Sequence: Synthetic oligonucleotide
  Target: ATXN1; (-) strand; PAM type: YTN; PAM sequence: TTA
aattttttaatcattgcttc

SEQ ID NO: 162422 - DNA, 20 bp, Artificial Sequence
  Description of Artificial Sequence: Synthetic oligonucleotide
  Target: ATXN1; (-) strand; PAM type: YTN; PAM sequence: TTT
aaattttttaatcattgctt

SEQ ID NO: 162423 - DNA, 20 bp, Artificial Sequence
  Description of Artificial Sequence: Synthetic oligonucleotide
  Target: ATXN1; (-) strand; PAM type: YTN; PAM sequence: TTG
ggtggatttaaattttttaa

SEQ ID NO: 162424 - DNA, 20 bp, Artificial Sequence
  Description of Artificial Sequence: Synthetic oligonucleotide
  Target: ATXN1; (-) strand; PAM type: YTN; PAM sequence: TTT
gggtggatttaaatttttta

SEQ ID NO: 162425 - DNA, 20 bp, Artificial Sequence
  Description of Artificial Sequence: Synthetic oligonucleotide
  Target: ATXN1; (-) strand; PAM type: YTN; PAM sequence: TTT
tgggtggatttaaatttttt

SEQ ID NO: 162426 - DNA, 20 bp, Artificial Sequence
  Description of Artificial Sequence: Synthetic oligonucleotide
  Target: ATXN1; (-) strand; PAM type: YTN; PAM sequence: TTA
ttttgggtggatttaaattt

SEQ ID NO: 162427 - DNA, 20 bp, Artificial Sequence
  Description of Artificial Sequence: Synthetic oligonucleotide
  Target: ATXN1; (-) strand; PAM type: YTN; PAM sequence: CTA
ttattttgggtggatttaaa

SEQ ID NO: 162428 - DNA, 20 bp, Artificial Sequence
  Description of Artificial Sequence: Synthetic oligonucleotide
  Target: ATXN1; (-) strand; PAM type: YTN; PAM sequence: CTA
cccaagccagcgaccacccg

SEQ ID NO: 162429 - DNA, 20 bp, Artificial Sequence
  Description of Artificial Sequence: Synthetic oligonucleotide
  Target: ATXN1; (-) strand; PAM type: YTN; PAM sequence: CTG
gacgcagagctacccaagcc

SEQ ID NO: 162430 - DNA, 20 bp, Artificial Sequence
  Description of Artificial Sequence: Synthetic oligonucleotide
  Target: ATXN1; (-) strand; PAM type: YTN; PAM sequence: CTC
cccactggacgcagagctac

SEQ ID NO: 162431 - DNA, 20 bp, Artificial Sequence
  Description of Artificial Sequence: Synthetic oligonucleotide
  Target: ATXN1; (-) strand; PAM type: YTN; PAM sequence: TTA
atcaaagaacaactccccac

SEQ ID NO: 162432 - DNA, 20 bp, Artificial Sequence
  Description of Artificial Sequence: Synthetic oligonucleotide
  Target: ATXN1; (-) strand; PAM type: YTN; PAM sequence: CTT
aatcaaagaacaactcccca

SEQ ID NO: 162433 - DNA, 20 bp, Artificial Sequence
  Description of Artificial Sequence: Synthetic oligonucleotide
  Target: ATXN1; (-) strand; PAM type: YTN; PAM sequence: TTC
aaggcccttaatcaaagaac

SEQ ID NO: 162434 - DNA, 20 bp, Artificial Sequence
  Description of Artificial Sequence: Synthetic oligonucleotide
  Target: ATXN1; (-) strand; PAM type: YTN; PAM sequence: CTT
caaggcccttaatcaaagaa

SEQ ID NO: 162435 - DNA, 20 bp, Artificial Sequence
  Description of Artificial Sequence: Synthetic oligonucleotide
  Target: ATXN1; (-) strand; PAM type: YTN; PAM sequence: CTC
cccttcaaggcccttaatca

SEQ ID NO: 162436 - DNA, 20 bp, Artificial Sequence
  Description of Artificial Sequence: Synthetic oligonucleotide
  Target: ATXN1; (-) strand; PAM type: YTN; PAM sequence: TTC
cagcctccccttcaaggccc

SEQ ID NO: 162437 - DNA, 20 bp, Artificial Sequence
  Description of Artificial Sequence: Synthetic oligonucleotide
  Target: ATXN1; (-) strand; PAM type: YTN; PAM sequence: TTT
ccagcctccccttcaaggcc

SEQ ID NO: 162438 - DNA, 20 bp, Artificial Sequence
  Description of Artificial Sequence: Synthetic oligonucleotide
  Target: ATXN1; (-) strand; PAM type: YTN; PAM sequence: CTT
tccagcctccccttcaaggc

SEQ ID NO: 162439 - DNA, 20 bp, Artificial Sequence
  Description of Artificial Sequence: Synthetic oligonucleotide
  Target: ATXN1; (-) strand; PAM type: YTN; PAM sequence: TTC
tttccagcctccccttcaag

SEQ ID NO: 162440 - DNA, 20 bp, Artificial Sequence
  Description of Artificial Sequence: Synthetic oligonucleotide
  Target: ATXN1; (-) strand; PAM type: YTN; PAM sequence: TTG
aggaattctttccagcctcc

SEQ ID NO: 162441 - DNA, 20 bp, Artificial Sequence
  Description of Artificial Sequence: Synthetic oligonucleotide
  Target: ATXN1; (-) strand; PAM type: YTN; PAM sequence: CTT
gaggaattctttccagcctc

SEQ ID NO: 162442 - DNA, 20 bp, Artificial Sequence
  Description of Artificial Sequence: Synthetic oligonucleotide
  Target: ATXN1; (-) strand; PAM type: YTN; PAM sequence: CTG
tgtgtcttgaggaattcttt

SEQ ID NO: 162443 - DNA, 20 bp, Artificial Sequence
  Description of Artificial Sequence: Synthetic oligonucleotide
  Target: ATXN1; (-) strand; PAM type: YTN; PAM sequence: TTC
agcagaatggcagccagtgc

SEQ ID NO: 162444 - DNA, 20 bp, Artificial Sequence
  Description of Artificial Sequence: Synthetic oligonucleotide
  Target: ATXN1; (-) strand; PAM type: YTN; PAM sequence: TTA
accacgtgccaagcagacaa

SEQ ID NO: 162445 - DNA, 20 bp, Artificial Sequence
  Description of Artificial Sequence: Synthetic oligonucleotide
  Target: ATXN1; (-) strand; PAM type: YTN; PAM sequence: CTT
aaccacgtgccaagcagaca

SEQ ID NO: 162446 - DNA, 20 bp, Artificial Sequence
  Description of Artificial Sequence: Synthetic oligonucleotide
  Target: ATXN1; (-) strand; PAM type: YTN; PAM sequence: TTA
gggataagggagacagcaac

SEQ ID NO: 162447 - DNA, 20 bp, Artificial Sequence
  Description of Artificial Sequence: Synthetic oligonucleotide
  Target: ATXN1; (-) strand; PAM type: YTN; PAM sequence: CTT
agggataagggagacagcaa

SEQ ID NO: 162448 - DNA, 20 bp, Artificial Sequence
  Description of Artificial Sequence: Synthetic oligonucleotide
  Target: ATXN1; (-) strand; PAM type: YTN; PAM sequence: CTC
agccccacttagggataagg

SEQ ID NO: 162449 - DNA, 20 bp, Artificial Sequence
  Description of Artificial Sequence: Synthetic oligonucleotide
  Target: ATXN1; (-) strand; PAM type: YTN; PAM sequence: TTA
tgtggacaggtagtagcaaa

SEQ ID NO: 162450 - DNA, 20 bp, Artificial Sequence
  Description of Artificial Sequence: Synthetic oligonucleotide
  Target: ATXN1; (-) strand; PAM type: YTN; PAM sequence: CTC
cattatgtggacaggtagta

SEQ ID NO: 162451 - DNA, 20 bp, Artificial Sequence
  Description of Artificial Sequence: Synthetic oligonucleotide
  Target: ATXN1; (-) strand; PAM type: YTN; PAM sequence: CTG
gccctccattatgtggacag

SEQ ID NO: 162452 - DNA, 20 bp, Artificial Sequence
  Description of Artificial Sequence: Synthetic oligonucleotide
  Target: ATXN1; (-) strand; PAM type: YTN; PAM sequence: TTG
atgaagcctggccctccatt

SEQ ID NO: 162453 - DNA, 20 bp, Artificial Sequence
  Description of Artificial Sequence: Synthetic oligonucleotide
  Target: ATXN1; (-) strand; PAM type: YTN; PAM sequence: CTA
agaattgatgaagcctggcc

SEQ ID NO: 162454 - DNA, 20 bp, Artificial Sequence
  Description of Artificial Sequence: Synthetic oligonucleotide
  Target: ATXN1; (-) strand; PAM type: YTN; PAM sequence: CTA
cgaatagcaatggcagaagc

SEQ ID NO: 162455 - DNA, 20 bp, Artificial Sequence
  Description of Artificial Sequence: Synthetic oligonucleotide
  Target: ATXN1; (-) strand; PAM type: YTN; PAM sequence: CTC
actacgaatagcaatggcag

SEQ ID NO: 162456 - DNA, 20 bp, Artificial Sequence
  Description of Artificial Sequence: Synthetic oligonucleotide
  Target: ATXN1; (-) strand; PAM type: YTN; PAM sequence: CTG
ctcactacgaatagcaatgg

SEQ ID NO: 162457 - DNA, 20 bp, Artificial Sequence
  Description of Artificial Sequence: Synthetic oligonucleotide
  Target: ATXN1; (-) strand; PAM type: YTN; PAM sequence: CTG
tcatctgctcactacgaata

SEQ ID NO: 162458 - DNA, 20 bp, Artificial Sequence
  Description of Artificial Sequence: Synthetic oligonucleotide
  Target: ATXN1; (-) strand; PAM type: YTN; PAM sequence: CTG
cacccccagaactgtcatct

SEQ ID NO: 162459 - DNA, 20 bp, Artificial Sequence
  Description of Artificial Sequence: Synthetic oligonucleotide
  Target: ATXN1; (-) strand; PAM type: YTN; PAM sequence: CTA
actgcacccccagaactgtc

SEQ ID NO: 162460 - DNA, 20 bp, Artificial Sequence
  Description of Artificial Sequence: Synthetic oligonucleotide
  Target: ATXN1; (-) strand; PAM type: YTN; PAM sequence: CTC
actaactgcacccccagaac

SEQ ID NO: 162461 - DNA, 20 bp, Artificial Sequence
  Description of Artificial Sequence: Synthetic oligonucleotide
  Target: ATXN1; (-) strand; PAM type: YTN; PAM sequence: TTC
caggggtggcagagctcact

SEQ ID NO: 162462 - DNA, 20 bp, Artificial Sequence
  Description of Artificial Sequence: Synthetic oligonucleotide
  Target: ATXN1; (-) strand; PAM type: YTN; PAM sequence: TTT
ccaggggtggcagagctcac

SEQ ID NO: 162463 - DNA, 20 bp, Artificial Sequence
  Description of Artificial Sequence: Synthetic oligonucleotide
  Target: ATXN1; (-) strand; PAM type: YTN; PAM sequence: CTG
atgtttccaggggtggcaga

SEQ ID NO: 162464 - DNA, 20 bp, Artificial Sequence
  Description of Artificial Sequence: Synthetic oligonucleotide
  Target: ATXN1; (-) strand; PAM type: YTN; PAM sequence: CTC
acggacatgtgccatgagcc

SEQ ID NO: 162465 - DNA, 20 bp, Artificial Sequence
  Description of Artificial Sequence: Synthetic oligonucleotide
  Target: ATXN1; (-) strand; PAM type: YTN; PAM sequence: CTC
tcacggacatgtgccatgag

SEQ ID NO: 162466 - DNA, 20 bp, Artificial Sequence
  Description of Artificial Sequence: Synthetic oligonucleotide
  Target: ATXN1; (-) strand; PAM type: YTN; PAM sequence: CTC
cagctctcacggacatgtgc

SEQ ID NO: 162467 - DNA, 20 bp, Artificial Sequence
  Description of Artificial Sequence: Synthetic oligonucleotide
  Target: ATXN1; (-) strand; PAM type: YTN; PAM sequence: CTG
atcctccagctctcacggac

SEQ ID NO: 162468 - DNA, 20 bp, Artificial Sequence
  Description of Artificial Sequence: Synthetic oligonucleotide
  Target: ATXN1; (-) strand; PAM type: YTN; PAM sequence: CTC
atccaggctgatcctccagc

SEQ ID NO: 162469 - DNA, 20 bp, Artificial Sequence
  Description of Artificial Sequence: Synthetic oligonucleotide
  Target: ATXN1; (-) strand; PAM type: YTN; PAM sequence: TTC
ctcatccaggctgatcctcc

SEQ ID NO: 162470 - DNA, 20 bp, Artificial Sequence
  Description of Artificial Sequence: Synthetic oligonucleotide
  Target: ATXN1; (-) strand; PAM type: YTN; PAM sequence: CTT
cctcatccaggctgatcctc

SEQ ID NO: 162471 - DNA, 20 bp, Artificial Sequence
  Description of Artificial Sequence: Synthetic oligonucleotide
  Target: ATXN1; (-) strand; PAM type: YTN; PAM sequence: CTC
cttcctcatccaggctgatc

SEQ ID NO: 162472 - DNA, 20 bp, Artificial Sequence
  Description of Artificial Sequence: Synthetic oligonucleotide
  Target: ATXN1; (-) strand; PAM type: YTN; PAM sequence: CTC
ctccttcctcatccaggctg

SEQ ID NO: 162473 - DNA, 20 bp, Artificial Sequence
  Description of Artificial Sequence: Synthetic oligonucleotide
  Target: ATXN1; (-) strand; PAM type: YTN; PAM sequence: CTG
tggccccgcccctcctcctt

SEQ ID NO: 162474 - DNA, 20 bp, Artificial Sequence
  Description of Artificial Sequence: Synthetic oligonucleotide
  Target: ATXN1; (-) strand; PAM type: YTN; PAM sequence: CTA
gggatggcccagccaagctg

SEQ ID NO: 162475 - DNA, 20 bp, Artificial Sequence
  Description of Artificial Sequence: Synthetic oligonucleotide
  Target: ATXN1; (-) strand; PAM type: YTN; PAM sequence: TTC
tagggatggcccagccaagc

SEQ ID NO: 162476 - DNA, 20 bp, Artificial Sequence
  Description of Artificial Sequence: Synthetic oligonucleotide
  Target: ATXN1; (-) strand; PAM type: YTN; PAM sequence: CTT
ctagggatggcccagccaag

SEQ ID NO: 162477 - DNA, 20 bp, Artificial Sequence
  Description of Artificial Sequence: Synthetic oligonucleotide
  Target: ATXN1; (-) strand; PAM type: YTN; PAM sequence: TTC
catgtgagccggcttctagg

SEQ ID NO: 162478 - DNA, 20 bp, Artificial Sequence
  Description of Artificial Sequence: Synthetic oligonucleotide
  Target: ATXN1; (-) strand; PAM type: YTN; PAM sequence: TTT
ccatgtgagccggcttctag

SEQ ID NO: 162479 - DNA, 20 bp, Artificial Sequence
  Description of Artificial Sequence: Synthetic oligonucleotide
  Target: ATXN1; (-) strand; PAM type: YTN; PAM sequence: TTT
tccatgtgagccggcttcta

SEQ ID NO: 162480 - DNA, 20 bp, Artificial Sequence
  Description of Artificial Sequence: Synthetic oligonucleotide
  Target: ATXN1; (-) strand; PAM type: YTN; PAM sequence: CTG
cagcgcgttttccatgtgag

SEQ ID NO: 162481 - DNA, 20 bp, Artificial Sequence
  Description of Artificial Sequence: Synthetic oligonucleotide
  Target: ATXN1; (-) strand; PAM type: YTN; PAM sequence: CTA
cacagccactgcagcgcgtt

SEQ ID NO: 162482 - DNA, 20 bp, Artificial Sequence
  Description of Artificial Sequence: Synthetic oligonucleotide
  Target: ATXN1; (-) strand; PAM type: YTN; PAM sequence: CTG
gctacacagccactgcagcg

SEQ ID NO: 162483 - DNA, 20 bp, Artificial Sequence
  Description of Artificial Sequence: Synthetic oligonucleotide
  Target: ATXN1; (-) strand; PAM type: YTN; PAM sequence: TTC
cggcatgggcaggccgccag

SEQ ID NO: 162484 - DNA, 20 bp, Artificial Sequence
  Description of Artificial Sequence: Synthetic oligonucleotide
  Target: ATXN1; (-) strand; PAM type: YTN; PAM sequence: TTC
caggaattccggcatgggca

SEQ ID NO: 162485 - DNA, 20 bp, Artificial Sequence
  Description of Artificial Sequence: Synthetic oligonucleotide
  Target: ATXN1; (-) strand; PAM type: YTN; PAM sequence: TTT
ccaggaattccggcatgggc

SEQ ID NO: 162486 - DNA, 20 bp, Artificial Sequence
  Description of Artificial Sequence: Synthetic oligonucleotide
  Target: ATXN1; (-) strand; PAM type: YTN; PAM sequence: CTT
tccaggaattccggcatggg

SEQ ID NO: 162487 - DNA, 20 bp, Artificial Sequence
  Description of Artificial Sequence: Synthetic oligonucleotide
  Target: ATXN1; (-) strand; PAM type: YTN; PAM sequence: TTG
agcctttccaggaattccgg

SEQ ID NO: 162488 - DNA, 20 bp, Artificial Sequence
  Description of Artificial Sequence: Synthetic oligonucleotide
  Target: ATXN1; (-) strand; PAM type: YTN; PAM sequence: CTT
gagcctttccaggaattccg

SEQ ID NO: 162489 - DNA, 20 bp, Artificial Sequence
  Description of Artificial Sequence: Synthetic oligonucleotide
  Target: ATXN1; (-) strand; PAM type: YTN; PAM sequence: TTC
catcttgagcctttccagga

SEQ ID NO: 162490 - DNA, 20 bp, Artificial Sequence
  Description of Artificial Sequence: Synthetic oligonucleotide
  Target: ATXN1; (-) strand; PAM type: YTN; PAM sequence: TTT
ccatcttgagcctttccagg

SEQ ID NO: 162491 - DNA, 20 bp, Artificial Sequence
  Description of Artificial Sequence: Synthetic oligonucleotide
  Target: ATXN1; (-) strand; PAM type: YTN; PAM sequence: TTT
tccatcttgagcctttccag

SEQ ID NO: 162492 - DNA, 20 bp, Artificial Sequence
  Description of Artificial Sequence: Synthetic oligonucleotide
  Target: ATXN1; (-) strand; PAM type: YTN; PAM sequence: TTT
ttccatcttgagcctttcca

SEQ ID NO: 162493 - DNA, 20 bp, Artificial Sequence
  Description of Artificial Sequence: Synthetic oligonucleotide
  Target: ATXN1; (-) strand; PAM type: YTN; PAM sequence: TTA
tttttccatcttgagccttt

SEQ ID NO: 162494 - DNA, 20 bp, Artificial Sequence
  Description of Artificial Sequence: Synthetic oligonucleotide
  Target: ATXN1; (-) strand; PAM type: YTN; PAM sequence: TTG
gatccagatggttatttttc

SEQ ID NO: 162495 - DNA, 20 bp, Artificial Sequence
  Description of Artificial Sequence: Synthetic oligonucleotide
  Target: ATXN1; (-) strand; PAM type: YTN; PAM sequence: CTT
ggatccagatggttattttt

SEQ ID NO: 162496 - DNA, 20 bp, Artificial Sequence
  Description of Artificial Sequence: Synthetic oligonucleotide
  Target: ATXN1; (-) strand; PAM type: YTN; PAM sequence: TTG
ggaccagcttggatccagat

SEQ ID NO: 162497 - DNA, 20 bp, Artificial Sequence
  Description of Artificial Sequence: Synthetic oligonucleotide
  Target: ATXN1; (-) strand; PAM type: YTN; PAM sequence: TTT
gggaccagcttggatccaga

SEQ ID NO: 162498 - DNA, 20 bp, Artificial Sequence
  Description of Artificial Sequence: Synthetic oligonucleotide
  Target: ATXN1; (-) strand; PAM type: YTN; PAM sequence: TTC
atttgggaccagcttggatc

SEQ ID NO: 162499 - DNA, 20 bp, Artificial Sequence
  Description of Artificial Sequence: Synthetic oligonucleotide
  Target: ATXN1; (-) strand; PAM type: YTN; PAM sequence: CTG
tcagacaattcatttgggac

SEQ ID NO: 162500 - DNA, 20 bp, Artificial Sequence
  Description of Artificial Sequence: Synthetic oligonucleotide
  Target: ATXN1; (-) strand; PAM type: YTN; PAM sequence: CTC
tgtcagacaattcatttggg

SEQ ID NO: 162501 - DNA, 20 bp, Artificial Sequence
  Description of Artificial Sequence: Synthetic oligonucleotide
  Target: ATXN1; (-) strand; PAM type: YTN; PAM sequence: CTC
aacctctgtcagacaattca

SEQ ID NO: 162502 - DNA, 20 bp, Artificial Sequence
  Description of Artificial Sequence: Synthetic oligonucleotide
  Target: ATXN1; (-) strand; PAM type: YTN; PAM sequence: CTC
caactcaacctctgtcagac

SEQ ID NO: 162503 - DNA, 20 bp, Artificial Sequence
  Description of Artificial Sequence: Synthetic oligonucleotide
  Target: ATXN1; (-) strand; PAM type: YTN; PAM sequence: TTA
aaaactccaactcaacctct

SEQ ID NO: 162504 - DNA, 20 bp, Artificial Sequence
  Description of Artificial Sequence: Synthetic oligonucleotide
  Target: ATXN1; (-) strand; PAM type: YTN; PAM sequence: CTT
aaaaactccaactcaacctc

SEQ ID NO: 162505 - DNA, 20 bp, Artificial Sequence
  Description of Artificial Sequence: Synthetic oligonucleotide
  Target: ATXN1; (-) strand; PAM type: YTN; PAM sequence: TTC
ttaaaaactccaactcaacc

SEQ ID NO: 162506 - DNA, 20 bp, Artificial Sequence
  Description of Artificial Sequence: Synthetic oligonucleotide
  Target: ATXN1; (-) strand; PAM type: YTN; PAM sequence: TTT
cttaaaaactccaactcaac

SEQ ID NO: 162507 - DNA, 20 bp, Artificial Sequence
  Description of Artificial Sequence: Synthetic oligonucleotide
  Target: ATXN1; (-) strand; PAM type: YTN; PAM sequence: TTT
tcttaaaaactccaactcaa

SEQ ID NO: 162508 - DNA, 20 bp, Artificial Sequence
  Description of Artificial Sequence: Synthetic oligonucleotide
  Target: ATXN1; (-) strand; PAM type: YTN; PAM sequence: CTT
ttcttaaaaactccaactca

SEQ ID NO: 162509 - DNA, 20 bp, Artificial Sequence
  Description of Artificial Sequence: Synthetic oligonucleotide
  Target: ATXN1; (-) strand; PAM type: YTN; PAM sequence: TTC
cagcttttcttaaaaactcc

SEQ ID NO: 162510 - DNA, 20 bp, Artificial Sequence
  Description of Artificial Sequence: Synthetic oligonucleotide
  Target: ATXN1; (-) strand; PAM type: YTN; PAM sequence: TTT
ccagcttttcttaaaaactc

SEQ ID NO: 162511 - DNA, 20 bp, Artificial Sequence
  Description of Artificial Sequence: Synthetic oligonucleotide
  Target: ATXN1; (-) strand; PAM type: YTN; PAM sequence: TTG
acagaaaggcatttccagct

SEQ ID NO: 162512 - DNA, 20 bp, Artificial Sequence
  Description of Artificial Sequence: Synthetic oligonucleotide
  Target: ATXN1; (-) strand; PAM type: YTN; PAM sequence: CTT
gacagaaaggcatttccagc

SEQ ID NO: 162513 - DNA, 20 bp, Artificial Sequence
  Description of Artificial Sequence: Synthetic oligonucleotide
  Target: ATXN1; (-) strand; PAM type: YTN; PAM sequence: TTG
aatcaggaaaggtcttgaca

SEQ ID NO: 162514 - DNA, 20 bp, Artificial Sequence
  Description of Artificial Sequence: Synthetic oligonucleotide
  Target: ATXN1; (-) strand; PAM type: YTN; PAM sequence: CTG
tattgaatcaggaaaggtct

SEQ ID NO: 162515 - DNA, 20 bp, Artificial Sequence
  Description of Artificial Sequence: Synthetic oligonucleotide
  Target: ATXN1; (-) strand; PAM type: YTN; PAM sequence: TTC
tgtattgaatcaggaaaggt

SEQ ID NO: 162516 - DNA, 20 bp, Artificial Sequence
  Description of Artificial Sequence: Synthetic oligonucleotide
  Target: ATXN1; (-) strand; PAM type: YTN; PAM sequence: CTT
ctgtattgaatcaggaaagg

SEQ ID NO: 162517 - DNA, 20 bp, Artificial Sequence
  Description of Artificial Sequence: Synthetic oligonucleotide
  Target: ATXN1; (-) strand; PAM type: YTN; PAM sequence: TTG
cttctgtattgaatcaggaa

SEQ ID NO: 162518 - DNA, 20 bp, Artificial Sequence
  Description of Artificial Sequence: Synthetic oligonucleotide
  Target: ATXN1; (-) strand; PAM type: YTN; PAM sequence: TTT
gcttctgtattgaatcagga

SEQ ID NO: 162519 - DNA, 20 bp, Artificial Sequence
  Description of Artificial Sequence: Synthetic oligonucleotide
  Target: ATXN1; (-) strand; PAM type: YTN; PAM sequence: TTA
aagcaaaaaagtatttgctt

SEQ ID NO: 162520 - DNA, 20 bp, Artificial Sequence
  Description of Artificial Sequence: Synthetic oligonucleotide
  Target: ATXN1; (-) strand; PAM type: YTN; PAM sequence: TTT
aaagcaaaaaagtatttgct

SEQ ID NO: 162521 - DNA, 20 bp, Artificial Sequence
  Description of Artificial Sequence: Synthetic oligonucleotide
  Target: ATXN1; (-) strand; PAM type: YTN; PAM sequence: CTT
taaagcaaaaaagtatttgc

SEQ ID NO: 162522 - DNA, 20 bp, Artificial Sequence
  Description of Artificial Sequence: Synthetic oligonucleotide
  Target: ATXN1; (-) strand; PAM type: YTN; PAM sequence: CTA
cgctttaaagcaaaaaagta

SEQ ID NO: 162523 - DNA, 20 bp, Artificial Sequence
  Description of Artificial Sequence: Synthetic oligonucleotide
  Target: ATXN1; (-) strand; PAM type: YTN; PAM sequence: CTG
gaatgcactacgctttaaag

SEQ ID NO: 162524 - DNA, 20 bp, Artificial Sequence
  Description of Artificial Sequence: Synthetic oligonucleotide
  Target: ATXN1; (-) strand; PAM type: YTN; PAM sequence: CTA
acctggaatgcactacgctt

SEQ ID NO: 162525 - DNA, 20 bp, Artificial Sequence
  Description of Artificial Sequence: Synthetic oligonucleotide
  Target: ATXN1; (-) strand; PAM type: YTN; PAM sequence: TTC
aaccagagtggtggataaac

SEQ ID NO: 162526 - DNA, 20 bp, Artificial Sequence
  Description of Artificial Sequence: Synthetic oligonucleotide
  Target: ATXN1; (-) strand; PAM type: YTN; PAM sequence: CTT
caaccagagtggtggataaa

SEQ ID NO: 162527 - DNA, 20 bp, Artificial Sequence
  Description of Artificial Sequence: Synthetic oligonucleotide
  Target: ATXN1; (-) strand; PAM type: YTN; PAM sequence: TTC
ccagccttcaaccagagtgg

SEQ ID NO: 162528 - DNA, 20 bp, Artificial Sequence
  Description of Artificial Sequence: Synthetic oligonucleotide
  Target: ATXN1; (-) strand; PAM type: YTN; PAM sequence: CTG
ttcccagccttcaaccagag

SEQ ID NO: 162529 - DNA, 20 bp, Artificial Sequence
  Description of Artificial Sequence: Synthetic oligonucleotide
  Target: ATXN1; (-) strand; PAM type: YTN; PAM sequence: CTG
tgtaactgttcccagccttc

SEQ ID NO: 162530 - DNA, 20 bp, Artificial Sequence
  Description of Artificial Sequence: Synthetic oligonucleotide
  Target: ATXN1; (-) strand; PAM type: YTN; PAM sequence: CTC
caggcagcgtggaaagcatc

SEQ ID NO: 162531 - DNA, 20 bp, Artificial Sequence
  Description of Artificial Sequence: Synthetic oligonucleotide
  Target: ATXN1; (-) strand; PAM type: YTN; PAM sequence: CTA
actccaggcagcgtggaaag

SEQ ID NO: 162532 - DNA, 20 bp, Artificial Sequence
  Description of Artificial Sequence: Synthetic oligonucleotide
  Target: ATXN1; (-) strand; PAM type: YTN; PAM sequence: CTG
ggatgagaaccactaactcc

SEQ ID NO: 162533 - DNA, 20 bp, Artificial Sequence
  Description of Artificial Sequence: Synthetic oligonucleotide
  Target: ATXN1; (-) strand; PAM type: YTN; PAM sequence: CTG
gactgggatgagaaccacta

SEQ ID NO: 162534 - DNA, 20 bp, Artificial Sequence
  Description of Artificial Sequence: Synthetic oligonucleotide
  Target: ATXN1; (-) strand; PAM type: YTN; PAM sequence: TTA
gtctggactgggatgagaac

SEQ ID NO: 162535 - DNA, 20 bp, Artificial Sequence
  Description of Artificial Sequence: Synthetic oligonucleotide
  Target: ATXN1; (-) strand; PAM type: YTN; PAM sequence: TTG
aaacaagttagtctggactg

SEQ ID NO: 162536 - DNA, 20 bp, Artificial Sequence
  Description of Artificial Sequence: Synthetic oligonucleotide
  Target: ATXN1; (-) strand; PAM type: YTN; PAM sequence: TTT
gaaacaagttagtctggact

SEQ ID NO: 162537 - DNA, 20 bp, Artificial Sequence
  Description of Artificial Sequence: Synthetic oligonucleotide
  Target: ATXN1; (-) strand; PAM type: YTN; PAM sequence: CTT
tgaaacaagttagtctggac

SEQ ID NO: 162538 - DNA, 20 bp, Artificial Sequence
  Description of Artificial Sequence: Synthetic oligonucleotide
  Target: ATXN1; (-) strand; PAM type: YTN; PAM sequence: CTC
actttgaaacaagttagtct

SEQ ID NO: 162539 - DNA, 20 bp, Artificial Sequence
  Description of Artificial Sequence: Synthetic oligonucleotide
  Target: ATXN1; (-) strand; PAM type: YTN; PAM sequence: CTC
tcactttgaaacaagttagt

SEQ ID NO: 162540 - DNA, 20 bp, Artificial Sequence
  Description of Artificial Sequence: Synthetic oligonucleotide
  Target: ATXN1; (-) strand; PAM type: YTN; PAM sequence: TTC
ctctcactttgaaacaagtt

SEQ ID NO: 162541 - DNA, 20 bp, Artificial Sequence
  Description of Artificial Sequence: Synthetic oligonucleotide
  Target: ATXN1; (-) strand; PAM type: YTN; PAM sequence: CTT
cctctcactttgaaacaagt

SEQ ID NO: 162542 - DNA, 20 bp, Artificial Sequence
  Description of Artificial Sequence: Synthetic oligonucleotide
  Target: ATXN1; (-) strand; PAM type: YTN; PAM sequence: CTC
acttcctctcactttgaaac

SEQ ID NO: 162543 - DNA, 20 bp, Artificial Sequence
  Description of Artificial Sequence: Synthetic oligonucleotide
  Target: ATXN1; (-) strand; PAM type: YTN; PAM sequence: TTG
aaataagataatgaagaggg

SEQ ID NO: 162544 - DNA, 20 bp, Artificial Sequence
  Description of Artificial Sequence: Synthetic oligonucleotide
  Target: ATXN1; (-) strand; PAM type: YTN; PAM sequence: CTT
gaaataagataatgaagagg

SEQ ID NO: 162545 - DNA, 20 bp, Artificial Sequence
  Description of Artificial Sequence: Synthetic oligonucleotide
  Target: ATXN1; (-) strand; PAM type: YTN; PAM sequence: TTG
catcagtccttgaaataaga

SEQ ID NO: 162546 - DNA, 20 bp, Artificial Sequence
  Description of Artificial Sequence: Synthetic oligonucleotide
  Target: ATXN1; (-) strand; PAM type: YTN; PAM sequence: CTT
gcatcagtccttgaaataag

SEQ ID NO: 162547 - DNA, 20 bp, Artificial Sequence
  Description of Artificial Sequence: Synthetic oligonucleotide
  Target: ATXN1; (-) strand; PAM type: YTN; PAM sequence: TTC
ttgcatcagtccttgaaata

SEQ ID NO: 162548 - DNA, 20 bp, Artificial Sequence
  Description of Artificial Sequence: Synthetic oligonucleotide
  Target: ATXN1; (-) strand; PAM type: YTN; PAM sequence: CTT
cttgcatcagtccttgaaat

SEQ ID NO: 162549 - DNA, 20 bp, Artificial Sequence
  Description of Artificial Sequence: Synthetic oligonucleotide
  Target: ATXN1; (-) strand; PAM type: YTN; PAM sequence: TTC
atcttcttgcatcagtcctt

SEQ ID NO: 162550 - DNA, 20 bp, Artificial Sequence
  Description of Artificial Sequence: Synthetic oligonucleotide
  Target: ATXN1; (-) strand; PAM type: YTN; PAM sequence: TTT
catcttcttgcatcagtcct

SEQ ID NO: 162551 - DNA, 20 bp, Artificial Sequence
  Description of Artificial Sequence: Synthetic oligonucleotide
  Target: ATXN1; (-) strand; PAM type: YTN; PAM sequence: TTT
tcatcttcttgcatcagtcc

SEQ ID NO: 162552 - DNA, 20 bp, Artificial Sequence
  Description of Artificial Sequence: Synthetic oligonucleotide
  Target: ATXN1; (-) strand; PAM type: YTN; PAM sequence: CTT
ttcatcttcttgcatcagtc

SEQ ID NO: 162553 - DNA, 20 bp, Artificial Sequence
  Description of Artificial Sequence: Synthetic oligonucleotide
  Target: ATXN1; (-) strand; PAM type: YTN; PAM sequence: TTG
gccaatacttttcatcttct

SEQ ID NO: 162554 - DNA, 20 bp, Artificial Sequence
  Description of Artificial Sequence: Synthetic oligonucleotide
  Target: ATXN1; (-) strand; PAM type: YTN; PAM sequence: CTT
ggccaatacttttcatcttc

SEQ ID NO: 162555 - DNA, 20 bp, Artificial Sequence
  Description of Artificial Sequence: Synthetic oligonucleotide
  Target: ATXN1; (-) strand; PAM type: YTN; PAM sequence: TTA
ccttggccaatacttttcat

SEQ ID NO: 162556 - DNA, 20 bp, Artificial Sequence
  Description of Artificial Sequence: Synthetic oligonucleotide
  Target: ATXN1; (-) strand; PAM type: YTN; PAM sequence: CTG
tgttaccttggccaatactt

SEQ ID NO: 162557 - DNA, 20 bp, Artificial Sequence
  Description of Artificial Sequence: Synthetic oligonucleotide
  Target: ATXN1; (-) strand; PAM type: YTN; PAM sequence: TTA
ctgtgttaccttggccaata

SEQ ID NO: 162558 - DNA, 20 bp, Artificial Sequence
  Description of Artificial Sequence: Synthetic oligonucleotide
  Target: ATXN1; (-) strand; PAM type: YTN; PAM sequence: CTT
actgtgttaccttggccaat

SEQ ID NO: 162559 - DNA, 20 bp, Artificial Sequence
  Description of Artificial Sequence: Synthetic oligonucleotide
  Target: ATXN1; (-) strand; PAM type: YTN; PAM sequence: TTC
ttactgtgttaccttggcca

SEQ ID NO: 162560 - DNA, 20 bp, Artificial Sequence
  Description of Artificial Sequence: Synthetic oligonucleotide
  Target: ATXN1; (-) strand; PAM type: YTN; PAM sequence: CTG
accccagttcttactgtgtt

SEQ ID NO: 162561 - DNA, 20 bp, Artificial Sequence
  Description of Artificial Sequence: Synthetic oligonucleotide
  Target: ATXN1; (-) strand; PAM type: YTN; PAM sequence: CTC
ctgaccccagttcttactgt

SEQ ID NO: 162562 - DNA, 20 bp, Artificial Sequence
  Description of Artificial Sequence: Synthetic oligonucleotide
  Target: ATXN1; (-) strand; PAM type: YTN; PAM sequence: CTC
atcctcctgaccccagttct

SEQ ID NO: 162563 - DNA, 20 bp, Artificial Sequence
  Description of Artificial Sequence: Synthetic oligonucleotide
  Target: ATXN1; (-) strand; PAM type: YTN; PAM sequence: TTC
tcatcctcctgaccccagtt

SEQ ID NO: 162564 - DNA, 20 bp, Artificial Sequence
  Description of Artificial Sequence: Synthetic oligonucleotide
  Target: ATXN1; (-) strand; PAM type: YTN; PAM sequence: TTC
aagtgagagtcaaagtgaca

SEQ ID NO: 162565 - DNA, 20 bp, Artificial Sequence
  Description of Artificial Sequence: Synthetic oligonucleotide
  Target: ATXN1; (-) strand; PAM type: YTN; PAM sequence: CTA
tcacagtggtggtaagaaac

SEQ ID NO: 162566 - DNA, 20 bp, Artificial Sequence
  Description of Artificial Sequence: Synthetic oligonucleotide
  Target: ATXN1; (-) strand; PAM type: YTN; PAM sequence: TTC
atgcatcgggtagtgagatc

SEQ ID NO: 162567 - DNA, 20 bp, Artificial Sequence
  Description of Artificial Sequence: Synthetic oligonucleotide
  Target: ATXN1; (-) strand; PAM type: YTN; PAM sequence: CTT
catgcatcgggtagtgagat

SEQ ID NO: 162568 - DNA, 20 bp, Artificial Sequence
  Description of Artificial Sequence: Synthetic oligonucleotide
  Target: ATXN1; (-) strand; PAM type: YTN; PAM sequence: CTA
aataggacagtggatgtgaa

SEQ ID NO: 162569 - DNA, 20 bp, Artificial Sequence
  Description of Artificial Sequence: Synthetic oligonucleotide
  Target: ATXN1; (-) strand; PAM type: YTN; PAM sequence: TTC
taaataggacagtggatgtg

SEQ ID NO: 162570 - DNA, 20 bp, Artificial Sequence
  Description of Artificial Sequence: Synthetic oligonucleotide
  Target: ATXN1; (-) strand; PAM type: YTN; PAM sequence: TTG
atattctaaataggacagtg

SEQ ID NO: 162571 - DNA, 20 bp, Artificial Sequence
  Description of Artificial Sequence: Synthetic oligonucleotide
  Target: ATXN1; (-) strand; PAM type: YTN; PAM sequence: CTT
gatattctaaataggacagt

SEQ ID NO: 162572 - DNA, 20 bp, Artificial Sequence
  Description of Artificial Sequence: Synthetic oligonucleotide
  Target: ATXN1; (-) strand; PAM type: YTN; PAM sequence: TTA
tcttgatattctaaatagga

SEQ ID NO: 162573 - DNA, 20 bp, Artificial Sequence
  Description of Artificial Sequence: Synthetic oligonucleotide
  Target: ATXN1; (-) strand; PAM type: YTN; PAM sequence: TTT
atcttgatattctaaatagg

SEQ ID NO: 162574 - DNA, 20 bp, Artificial Sequence
  Description of Artificial Sequence: Synthetic oligonucleotide
  Target: ATXN1; (-) strand; PAM type: YTN; PAM sequence: TTA
atatttatcttgatattcta

SEQ ID NO: 162575 - DNA, 20 bp, Artificial Sequence
  Description of Artificial Sequence: Synthetic oligonucleotide
  Target: ATXN1; (-) strand; PAM type: YTN; PAM sequence: TTA
gtaataataatattaatatt

SEQ ID NO: 162576 - DNA, 20 bp, Artificial Sequence
  Description of Artificial Sequence: Synthetic oligonucleotide
  Target: ATXN1; (-) strand; PAM type: YTN; PAM sequence: TTG
ttagtaataataatattaat

SEQ ID NO: 162577 - DNA, 20 bp, Artificial Sequence
  Description of Artificial Sequence: Synthetic oligonucleotide
  Target: ATXN1; (-) strand; PAM type: YTN; PAM sequence: TTA
tcatcattgttagtaataat

SEQ ID NO: 162578 - DNA, 20 bp, Artificial Sequence
  Description of Artificial Sequence: Synthetic oligonucleotide
  Target: ATXN1; (-) strand; PAM type: YTN; PAM sequence: CTA
ttatcatcattgttagtaat

SEQ ID NO: 162579 - DNA, 20 bp, Artificial Sequence
  Description of Artificial Sequence: Synthetic oligonucleotide
  Target: ATXN1; (-) strand; PAM type: YTN; PAM sequence: TTG
atctattatcatcattgtta

SEQ ID NO: 162580 - DNA, 20 bp, Artificial Sequence
  Description of Artificial Sequence: Synthetic oligonucleotide
  Target: ATXN1; (-) strand; PAM type: YTN; PAM sequence: TTA
ttgatctattatcatcattg

SEQ ID NO: 162581 - DNA, 20 bp, Artificial Sequence
  Description of Artificial Sequence: Synthetic oligonucleotide
  Target: ATXN1; (-) strand; PAM type: YTN; PAM sequence: TTA
gtagtaatagcagtggaata

SEQ ID NO: 162582 - DNA, 20 bp, Artificial Sequence
  Description of Artificial Sequence: Synthetic oligonucleotide
  Target: ATXN1; (-) strand; PAM type: YTN; PAM sequence: CTT
agtagtaatagcagtggaat

SEQ ID NO: 162583 - DNA, 20 bp, Artificial Sequence
  Description of Artificial Sequence: Synthetic oligonucleotide
  Target: ATXN1; (-) strand; PAM type: YTN; PAM sequence: CTG
tgtgtccttagtagtaatag

SEQ ID NO: 162584 - DNA, 20 bp, Artificial Sequence
  Description of Artificial Sequence: Synthetic oligonucleotide
  Target: ATXN1; (-) strand; PAM type: YTN; PAM sequence: TTC
tgtgtgtccttagtagtaat

SEQ ID NO: 162585 - DNA, 20 bp, Artificial Sequence
  Description of Artificial Sequence: Synthetic oligonucleotide
  Target: ATXN1; (-) strand; PAM type: YTN; PAM sequence: CTA
caattctgtgtgtccttagt

SEQ ID NO: 162586 - DNA, 20 bp, Artificial Sequence
  Description of Artificial Sequence: Synthetic oligonucleotide
  Target: ATXN1; (-) strand; PAM type: YTN; PAM sequence: CTA
actacaattctgtgtgtcct

SEQ ID NO: 162587 - DNA, 20 bp, Artificial Sequence
  Description of Artificial Sequence: Synthetic oligonucleotide
  Target: ATXN1; (-) strand; PAM type: YTN; PAM sequence: CTC
taactacaattctgtgtgtc

SEQ ID NO: 162588 - DNA, 20 bp, Artificial Sequence
  Description of Artificial Sequence: Synthetic oligonucleotide
  Target: ATXN1; (-) strand; PAM type: YTN; PAM sequence: TTA
cggcgtagcccactctaact

SEQ ID NO: 162589 - DNA, 20 bp, Artificial Sequence
  Description of Artificial Sequence: Synthetic oligonucleotide
  Target: ATXN1; (-) strand; PAM type: YTN; PAM sequence: CTT
acggcgtagcccactctaac

SEQ ID NO: 162590 - DNA, 20 bp, Artificial Sequence
  Description of Artificial Sequence: Synthetic oligonucleotide
  Target: ATXN1; (-) strand; PAM type: YTN; PAM sequence: CTA
ccttacggcgtagcccactc

SEQ ID NO: 162591 - DNA, 20 bp, Artificial Sequence
  Description of Artificial Sequence: Synthetic oligonucleotide
  Target: ATXN1; (-) strand; PAM type: YTN; PAM sequence: CTC
taccttacggcgtagcccac

SEQ ID NO: 162592 - DNA, 20 bp, Artificial Sequence
  Description of Artificial Sequence: Synthetic oligonucleotide
  Target: ATXN1; (-) strand; PAM type: YTN; PAM sequence: TTC
tctaccttacggcgtagccc

SEQ ID NO: 162593 - DNA, 20 bp, Artificial Sequence
  Description of Artificial Sequence: Synthetic oligonucleotide
  Target: ATXN1; (-) strand; PAM type: YTN; PAM sequence: CTG
ttctctaccttacggcgtag

SEQ ID NO: 162594 - DNA, 20 bp, Artificial Sequence
  Description of Artificial Sequence: Synthetic oligonucleotide
  Target: ATXN1; (-) strand; PAM type: YTN; PAM sequence: TTG
aacctgttctctaccttacg

SEQ ID NO: 162595 - DNA, 20 bp, Artificial Sequence
  Description of Artificial Sequence: Synthetic oligonucleotide
  Target: ATXN1; (-) strand; PAM type: YTN; PAM sequence: TTT
gaacctgttctctaccttac

SEQ ID NO: 162596 - DNA, 20 bp, Artificial Sequence
  Description of Artificial Sequence: Synthetic oligonucleotide
  Target: ATXN1; (-) strand; PAM type: YTN; PAM sequence: TTG
gggtaaagccaaggtttgaa

SEQ ID NO: 162597 - DNA, 20 bp, Artificial Sequence
  Description of Artificial Sequence: Synthetic oligonucleotide
  Target: ATXN1; (-) strand; PAM type: YTN; PAM sequence: TTT
ggggtaaagccaaggtttga

SEQ ID NO: 162598 - DNA, 20 bp, Artificial Sequence
  Description of Artificial Sequence: Synthetic oligonucleotide
  Target: ATXN1; (-) strand; PAM type: YTN; PAM sequence: TTA
aaaatggataacataggtgg

SEQ ID NO: 162599 - DNA, 20 bp, Artificial Sequence
  Description of Artificial Sequence: Synthetic oligonucleotide
  Target: ATXN1; (-) strand; PAM type: YTN; PAM sequence: TTT
aaaaatggataacataggtg

SEQ ID NO: 162600 - DNA, 20 bp, Artificial Sequence
  Description of Artificial Sequence: Synthetic oligonucleotide
  Target: ATXN1; (-) strand; PAM type: YTN; PAM sequence: TTT
taaaaatggataacataggt

SEQ ID NO: 162601 - DNA, 20 bp, Artificial Sequence
  Description of Artificial Sequence: Synthetic oligonucleotide
  Target: ATXN1; (-) strand; PAM type: YTN; PAM sequence: TTT
ttaaaaatggataacatagg

SEQ ID NO: 162602 - DNA, 20 bp, Artificial Sequence
  Description of Artificial Sequence: Synthetic oligonucleotide
  Target: ATXN1; (-) strand; PAM type: YTN; PAM sequence: TTA
tatttttaaaaatggataac

SEQ ID NO: 162603 - DNA, 20 bp, Artificial Sequence
  Description of Artificial Sequence: Synthetic oligonucleotide
  Target: ATXN1; (-) strand; PAM type: YTN; PAM sequence: TTG
caggcatgagccaccacgcc

SEQ ID NO: 162604 - DNA, 20 bp, Artificial Sequence
  Description of Artificial Sequence: Synthetic oligonucleotide
  Target: ATXN1; (-) strand; PAM type: YTN; PAM sequence: TTT
gcaggcatgagccaccacgc

SEQ ID NO: 162605 - DNA, 20 bp, Artificial Sequence
  Description of Artificial Sequence: Synthetic oligonucleotide
  Target: ATXN1; (-) strand; PAM type: YTN; PAM sequence: CTG
ggtttgcaggcatgagccac

SEQ ID NO: 162606 - DNA, 20 bp, Artificial Sequence
  Description of Artificial Sequence: Synthetic oligonucleotide
  Target: ATXN1; (-) strand; PAM type: YTN; PAM sequence: CTA
aagtgctgggtttgcaggca

SEQ ID NO: 162607 - DNA, 20 bp, Artificial Sequence
  Description of Artificial Sequence: Synthetic oligonucleotide
  Target: ATXN1; (-) strand; PAM type: YTN; PAM sequence: CTC
ctaaagtgctgggtttgcag

SEQ ID NO: 162608 - DNA, 20 bp, Artificial Sequence
  Description of Artificial Sequence: Synthetic oligonucleotide
  Target: ATXN1; (-) strand; PAM type: YTN; PAM sequence: CTC
agcctcctaaagtgctgggt

SEQ ID NO: 162609 - DNA, 20 bp, Artificial Sequence
  Description of Artificial Sequence: Synthetic oligonucleotide
  Target: ATXN1; (-) strand; PAM type: YTN; PAM sequence: CTC
gcaatccgcccgcctcagcc

SEQ ID NO: 162610 - DNA, 20 bp, Artificial Sequence
  Description of Artificial Sequence: Synthetic oligonucleotide
  Target: ATXN1; (-) strand; PAM type: YTN; PAM sequence: CTG
acctcgcaatccgcccgcct

SEQ ID NO: 162611 - DNA, 20 bp, Artificial Sequence
  Description of Artificial Sequence: Synthetic oligonucleotide
  Target: ATXN1; (-) strand; PAM type: YTN; PAM sequence: CTC
ctgacctcgcaatccgcccg

SEQ ID NO: 162612 - DNA, 20 bp, Artificial Sequence
  Description of Artificial Sequence: Synthetic oligonucleotide
  Target: ATXN1; (-) strand; PAM type: YTN; PAM sequence: CTC
aatctcctgacctcgcaatc

SEQ ID NO: 162613 - DNA, 20 bp, Artificial Sequence
  Description of Artificial Sequence: Synthetic oligonucleotide
  Target: ATXN1; (-) strand; PAM type: YTN; PAM sequence: TTA
tccaggatggtctcaatctc

SEQ ID NO: 162614 - DNA, 20 bp, Artificial Sequence
  Description of Artificial Sequence: Synthetic oligonucleotide
  Target: ATXN1; (-) strand; PAM type: YTN; PAM sequence: CTG
tgttatccaggatggtctca

SEQ ID NO: 162615 - DNA, 20 bp, Artificial Sequence
  Description of Artificial Sequence: Synthetic oligonucleotide
  Target: ATXN1; (-) strand; PAM type: YTN; PAM sequence: TTC
actgtgttatccaggatggt

SEQ ID NO: 162616 - DNA, 20 bp, Artificial Sequence
  Description of Artificial Sequence: Synthetic oligonucleotide
  Target: ATXN1; (-) strand; PAM type: YTN; PAM sequence: TTT
cactgtgttatccaggatgg

SEQ ID NO: 162617 - DNA, 20 bp, Artificial Sequence
  Description of Artificial Sequence: Synthetic oligonucleotide
  Target: ATXN1; (-) strand; PAM type: YTN; PAM sequence: TTA
gtagagacaggatttcactg

SEQ ID NO: 162618 - DNA, 20 bp, Artificial Sequence
  Description of Artificial Sequence: Synthetic oligonucleotide
  Target: ATXN1; (-) strand; PAM type: YTN; PAM sequence: TTT
agtagagacaggatttcact

SEQ ID NO: 162619 - DNA, 20 bp, Artificial Sequence
  Description of Artificial Sequence: Synthetic oligonucleotide
  Target: ATXN1; (-) strand; PAM type: YTN; PAM sequence: TTT
tagtagagacaggatttcac

SEQ ID NO: 162620 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacaggatttca

SEQ ID NO: 162621 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacagga

SEQ ID NO: 162622 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacagg

SEQ ID NO: 162623 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacag

SEQ ID NO: 162624 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagaca

SEQ ID NO: 162625 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttagtagagac

SEQ ID NO: 162626 - DNA, 20 bp, Artificial Sequence
  Description of Artificial Sequence: Synthetic oligonucleotide
  Target: ATXN1; (-) strand; PAM type: YTN; PAM sequence: CTC
attttttgtatttttagtag

SEQ ID NO: 162627 - DNA, 20 bp, Artificial Sequence
  Description of Artificial Sequence: Synthetic oligonucleotide
  Target: ATXN1; (-) strand; PAM type: YTN; PAM sequence: CTG
gctcattttttgtattttta

SEQ ID NO: 162628 - DNA, 20 bp, Artificial Sequence
  Description of Artificial Sequence: Synthetic oligonucleotide
  Target: ATXN1; (-) strand; PAM type: YTN; PAM sequence: CTG
ccaccacgcctggctcattt

SEQ ID NO: 162629 - DNA, 20 bp, Artificial Sequence
  Description of Artificial Sequence: Synthetic oligonucleotide
  Target: ATXN1; (-) strand; PAM type: YTN; PAM sequence: CTA
caggcgcctgccaccacgcc

SEQ ID NO: 162630 - DNA, 20 bp, Artificial Sequence
  Description of Artificial Sequence: Synthetic oligonucleotide
  Target: ATXN1; (-) strand; PAM type: YTN; PAM sequence: CTG
ggactacaggcgcctgccac

SEQ ID NO: 162631 - DNA, 20 bp, Artificial Sequence
  Description of Artificial Sequence: Synthetic oligonucleotide
  Target: ATXN1; (-) strand; PAM type: YTN; PAM sequence: CTC
gtagctgggactacaggcgc

SEQ ID NO: 162632 - DNA, 20 bp, Artificial Sequence
  Description of Artificial Sequence: Synthetic oligonucleotide
  Target: ATXN1; (-) strand; PAM type: YTN; PAM sequence: CTC
cctcgtagctgggactacag

SEQ ID NO: 162633 - DNA, 20 bp, Artificial Sequence
  Description of Artificial Sequence: Synthetic oligonucleotide
  Target: ATXN1; (-) strand; PAM type: YTN; PAM sequence: TTA
gcctccctcgtagctgggac

SEQ ID NO: 162634 - DNA, 20 bp, Artificial Sequence
  Description of Artificial Sequence: Synthetic oligonucleotide
  Target: ATXN1; (-) strand; PAM type: YTN; PAM sequence: CTT
agcctccctcgtagctggga

SEQ ID NO: 162635 - DNA, 20 bp, Artificial Sequence
  Description of Artificial Sequence: Synthetic oligonucleotide
  Target: ATXN1; (-) strand; PAM type: YTN; PAM sequence: CTG
ccttagcctccctcgtagct

SEQ ID NO: 162636 - DNA, 20 bp, Artificial Sequence
  Description of Artificial Sequence: Synthetic oligonucleotide
  Target: ATXN1; (-) strand; PAM type: YTN; PAM sequence: CTC
ctgccttagcctccctcgta

SEQ ID NO: 162637 - DNA, 20 bp, Artificial Sequence
  Description of Artificial Sequence: Synthetic oligonucleotide
  Target: ATXN1; (-) strand; PAM type: YTN; PAM sequence: TTC
tcctgccttagcctccctcg

SEQ ID NO: 162638 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgccttag

SEQ ID NO: 162639 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcgattctcctgc

SEQ ID NO: 162640 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagcgattctcc

SEQ ID NO: 162641 - DNA, 20 bp, Artificial Sequence
  Description of Artificial Sequence: Synthetic oligonucleotide
  Target: ATXN1; (-) strand; PAM type: YTN; PAM sequence: CTC
cgcctcctgggttcaagcga

SEQ ID NO: 162642 - DNA, 20 bp, Artificial Sequence
  Description of Artificial Sequence: Synthetic oligonucleotide
  Target: ATXN1; (-) strand; PAM type: YTN; PAM sequence: CTG
caacctccgcctcctgggtt

SEQ ID NO: 162643 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccgcctcctg

SEQ ID NO: 162644 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctccgcc

SEQ ID NO: 162645 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgtgatctc

SEQ ID NO: 162646 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggctggagtgcag

SEQ ID NO: 162647 - DNA, 20 bp, Artificial Sequence
  Description of Artificial Sequence: Synthetic oligonucleotide
  Target: ATXN1; (-) strand; PAM type: YTN; PAM sequence: CTC
tgtcgcccaggctggagtgc

SEQ ID NO: 162648 - DNA, 20 bp, Artificial Sequence
  Description of Artificial Sequence: Synthetic oligonucleotide
  Target: ATXN1; (-) strand; PAM type: YTN; PAM sequence: CTC
gctctgtcgcccaggctgga

SEQ ID NO: 162649 - DNA, 20 bp, Artificial Sequence
  Description of Artificial Sequence: Synthetic oligonucleotide
  Target: ATXN1; (-) strand; PAM type: YTN; PAM sequence: TTG
agatggagtctcgctctgtc

SEQ ID NO: 162650 - DNA, 20 bp, Artificial Sequence
  Description of Artificial Sequence: Synthetic oligonucleotide
  Target: ATXN1; (-) strand; PAM type: YTN; PAM sequence: TTT
gagatggagtctcgctctgt

SEQ ID NO: 162651 - DNA, 20 bp, Artificial Sequence
  Description of Artificial Sequence: Synthetic oligonucleotide
  Target: ATXN1; (-) strand; PAM type: YTN; PAM sequence: TTT
tgagatggagtctcgctctg

SEQ ID NO: 162652 - DNA, 20 bp, Artificial Sequence
  Description of Artificial Sequence: Synthetic oligonucleotide
  Target: ATXN1; (-) strand; PAM type: YTN; PAM sequence: TTA
ttttgagatggagtctcgct

SEQ ID NO: 162653 - DNA, 20 bp, Artificial Sequence
  Description of Artificial Sequence: Synthetic oligonucleotide
  Target: ATXN1; (-) strand; PAM type: YTN; PAM sequence: TTA
ttattttgagatggagtctc

SEQ ID NO: 162654 - DNA, 20 bp, Artificial Sequence
  Description of Artificial Sequence: Synthetic oligonucleotide
  Target: ATXN1; (-) strand; PAM type: YTN; PAM sequence: TTA
aaattattattttgagatgg

SEQ ID NO: 162655 - DNA, 20 bp, Artificial Sequence
  Description of Artificial Sequence: Synthetic oligonucleotide
  Target: ATXN1; (-) strand; PAM type: YTN; PAM sequence: TTG
ggcacatgtataatcgcaag

SEQ ID NO: 162656 - DNA, 20 bp, Artificial Sequence
  Description of Artificial Sequence: Synthetic oligonucleotide
  Target: ATXN1; (-) strand; PAM type: YTN; PAM sequence: CTT
gggcacatgtataatcgcaa

SEQ ID NO: 162657 - DNA, 20 bp, Artificial Sequence
  Description of Artificial Sequence: Synthetic oligonucleotide
  Target: ATXN1; (-) strand; PAM type: YTN; PAM sequence: TTA
aacttgggcacatgtataat

SEQ ID NO: 162658 - DNA, 20 bp, Artificial Sequence
  Description of Artificial Sequence: Synthetic oligonucleotide
  Target: ATXN1; (-) strand; PAM type: YTN; PAM sequence: CTC
attaaacttgggcacatgta

SEQ ID NO: 162659 - DNA, 20 bp, Artificial Sequence
  Description of Artificial Sequence: Synthetic oligonucleotide
  Target: ATXN1; (-) strand; PAM type: YTN; PAM sequence: TTG
cctcattaaacttgggcaca

SEQ ID NO: 162660 - DNA, 20 bp, Artificial Sequence
  Description of Artificial Sequence: Synthetic oligonucleotide
  Target: ATXN1; (-) strand; PAM type: YTN; PAM sequence: TTT
gcctcattaaacttgggcac

SEQ ID NO: 162661 - DNA, 20 bp, Artificial Sequence
  Description of Artificial Sequence: Synthetic oligonucleotide
  Target: ATXN1; (-) strand; PAM type: YTN; PAM sequence: TTT
tgcctcattaaacttgggca

SEQ ID NO: 162662 - DNA, 20 bp, Artificial Sequence
  Description of Artificial Sequence: Synthetic oligonucleotide
  Target: ATXN1; (-) strand; PAM type: YTN; PAM sequence: TTT
ttgcctcattaaacttgggc

SEQ ID NO: 162663 - DNA, 20 bp, Artificial Sequence
  Description of Artificial Sequence: Synthetic oligonucleotide
  Target: ATXN1; (-) strand; PAM type: YTN; PAM sequence: TTG
aaatgaaatttttgcctcat

SEQ ID NO: 162664 - DNA, 20 bp, Artificial Sequence
  Description of Artificial Sequence: Synthetic oligonucleotide
  Target: ATXN1; (-) strand; PAM type: YTN; PAM sequence: TTG
ttgaaatgaaatttttgcct

SEQ ID NO: 162665 - DNA, 20 bp, Artificial Sequence
  Description of Artificial Sequence: Synthetic oligonucleotide
  Target: ATXN1; (-) strand; PAM type: YTN; PAM sequence: TTA
cacattgttgaaatgaaatt

SEQ ID NO: 162666 - DNA, 20 bp, Artificial Sequence
  Description of Artificial Sequence: Synthetic oligonucleotide
  Target: ATXN1; (-) strand; PAM type: YTN; PAM sequence: TTT
acacattgttgaaatgaaat

SEQ ID NO: 162667 - DNA, 20 bp, Artificial Sequence
  Description of Artificial Sequence: Synthetic oligonucleotide
  Target: ATXN1; (-) strand; PAM type: YTN; PAM sequence: CTT
tacacattgttgaaatgaaa

SEQ ID NO: 162668 - DNA, 20 bp, Artificial Sequence
  Description of Artificial Sequence: Synthetic oligonucleotide
  Target: ATXN1; (-) strand; PAM type: YTN; PAM sequence: TTA
caactttacacattgttgaa

SEQ ID NO: 162669 - DNA, 20 bp, Artificial Sequence
  Description of Artificial Sequence: Synthetic oligonucleotide
  Target: ATXN1; (-) strand; PAM type: YTN; PAM sequence: TTA
aaggcagagattacaacttt

SEQ ID NO: 162670 - DNA, 20 bp, Artificial Sequence
  Description of Artificial Sequence: Synthetic oligonucleotide
  Target: ATXN1; (-) strand; PAM type: YTN; PAM sequence: TTT
aaaggcagagattacaactt

SEQ ID NO: 162671 - DNA, 20 bp, Artificial Sequence
  Description of Artificial Sequence: Synthetic oligonucleotide
  Target: ATXN1; (-) strand; PAM type: YTN; PAM sequence: TTT
taaaggcagagattacaact

SEQ ID NO: 162672 - DNA, 20 bp, Artificial Sequence
  Description of Artificial Sequence: Synthetic oligonucleotide
  Target: ATXN1; (-) strand; PAM type: YTN; PAM sequence: TTC
cccattttaaaggcagagat

SEQ ID NO: 162673 - DNA, 20 bp, Artificial Sequence
  Description of Artificial Sequence: Synthetic oligonucleotide
  Target: ATXN1; (-) strand; PAM type: YTN; PAM sequence: CTT
ccccattttaaaggcagaga

SEQ ID NO: 162674 - DNA, 20 bp, Artificial Sequence
  Description of Artificial Sequence: Synthetic oligonucleotide
  Target: ATXN1; (-) strand; PAM type: YTN; PAM sequence: TTC
ttccccattttaaaggcaga

SEQ ID NO: 162675 - DNA, 20 bp, Artificial Sequence
  Description of Artificial Sequence: Synthetic oligonucleotide
  Target: ATXN1; (-) strand; PAM type: YTN; PAM sequence: TTA
attcttccccattttaaagg

SEQ ID NO: 162676 - DNA, 20 bp, Artificial Sequence
  Description of Artificial Sequence: Synthetic oligonucleotide
  Target: ATXN1; (-) strand; PAM type: YTN; PAM sequence: CTG
tgcatgttaattcttcccca

SEQ ID NO: 162677 - DNA, 20 bp, Artificial Sequence
  Description of Artificial Sequence: Synthetic oligonucleotide
  Target: ATXN1; (-) strand; PAM type: YTN; PAM sequence: CTA
ggcactgtgcatgttaattc

SEQ ID NO: 162678 - DNA, 20 bp, Artificial Sequence
  Description of Artificial Sequence: Synthetic oligonucleotide
  Target: ATXN1; (-) strand; PAM type: YTN; PAM sequence: TTA
tactaggcactgtgcatgtt

SEQ ID NO: 162679 - DNA, 20 bp, Artificial Sequence
  Description of Artificial Sequence: Synthetic oligonucleotide
  Target: ATXN1; (-) strand; PAM type: YTN; PAM sequence: CTG
agtgtgtgttatactaggca

SEQ ID NO: 162680 - DNA, 20 bp, Artificial Sequence
  Description of Artificial Sequence: Synthetic oligonucleotide
  Target: ATXN1; (-) strand; PAM type: YTN; PAM sequence: CTA
cgatggcgaccatgtactga

SEQ ID NO: 162681 - DNA, 20 bp, Artificial Sequence
  Description of Artificial Sequence: Synthetic oligonucleotide
  Target: ATXN1; (-) strand; PAM type: YTN; PAM sequence: TTA
taactacgatggcgaccatg

SEQ ID NO: 162682 - DNA, 20 bp, Artificial Sequence
  Description of Artificial Sequence: Synthetic oligonucleotide
  Target: ATXN1; (-) strand; PAM type: YTN; PAM sequence: TTG
aattataactacgatggcga

SEQ ID NO: 162683 - DNA, 20 bp, Artificial Sequence
  Description of Artificial Sequence: Synthetic oligonucleotide
  Target: ATXN1; (-) strand; PAM type: YTN; PAM sequence: TTA
ttgaattataactacgatgg

SEQ ID NO: 162684 - DNA, 20 bp, Artificial Sequence
  Description of Artificial Sequence: Synthetic oligonucleotide
  Target: ATXN1; (-) strand; PAM type: YTN; PAM sequence: TTT
attgaattataactacgatg

SEQ ID NO: 162685 - DNA, 20 bp, Artificial Sequence
  Description of Artificial Sequence: Synthetic oligonucleotide
  Target: ATXN1; (-) strand; PAM type: YTN; PAM sequence: TTC
atgaggaaatgtttattgaa

SEQ ID NO: 162686 - DNA, 20 bp, Artificial Sequence
  Description of Artificial Sequence: Synthetic oligonucleotide
  Target: ATXN1; (-) strand; PAM type: YTN; PAM sequence: CTG
agaattcatgaggaaatgtt

SEQ ID NO: 162687 - DNA, 20 bp, Artificial Sequence
  Description of Artificial Sequence: Synthetic oligonucleotide
  Target: ATXN1; (-) strand; PAM type: YTN; PAM sequence: TTA
catcatggccaggagagatg

SEQ ID NO: 162688 - DNA, 20 bp, Artificial Sequence
  Description of Artificial Sequence: Synthetic oligonucleotide
  Target: ATXN1; (-) strand; PAM type: YTN; PAM sequence: TTG
attacatcatggccaggaga

SEQ ID NO: 162689 - DNA, 20 bp, Artificial Sequence
  Description of Artificial Sequence: Synthetic oligonucleotide
  Target: ATXN1; (-) strand; PAM type: YTN; PAM sequence: TTG
tattgattacatcatggcca

SEQ ID NO: 162690 - DNA, 20 bp, Artificial Sequence
  Description of Artificial Sequence: Synthetic oligonucleotide
  Target: ATXN1; (-) strand; PAM type: YTN; PAM sequence: TTG
aaggtgttgtattgattaca

SEQ ID NO: 162691 - DNA, 20 bp, Artificial Sequence
  Description of Artificial Sequence: Synthetic oligonucleotide
  Target: ATXN1; (-) strand; PAM type: YTN; PAM sequence: TTT
gaaggtgttgtattgattac

SEQ ID NO: 162692 - DNA, 20 bp, Artificial Sequence
  Description of Artificial Sequence: Synthetic oligonucleotide
  Target: ATXN1; (-) strand; PAM type: YTN; PAM sequence: TTG
atagtttgaaggtgttgtat

SEQ ID NO: 162693 - DNA, 20 bp, Artificial Sequence
  Description of Artificial Sequence: Synthetic oligonucleotide
  Target: ATXN1; (-) strand; PAM type: YTN; PAM sequence: TTG
aaagaattgatagtttgaag

SEQ ID NO: 162694 - DNA, 20 bp, Artificial Sequence
  Description of Artificial Sequence: Synthetic oligonucleotide
  Target: ATXN1; (-) strand; PAM type: YTN; PAM sequence: TTT
gaaagaattgatagtttgaa

SEQ ID NO: 162695 - DNA, 20 bp, Artificial Sequence
  Description of Artificial Sequence: Synthetic oligonucleotide
  Target: ATXN1; (-) strand; PAM type: YTN; PAM sequence: CTA
tcacagatgtgaggaaaaaa

SEQ ID NO: 162696 - DNA, 20 bp, Artificial Sequence
  Description of Artificial Sequence: Synthetic oligonucleotide
  Target: ATXN1; (-) strand; PAM type: YTN; PAM sequence: TTC
tatcacagatgtgaggaaaa

SEQ ID NO: 162697 - DNA, 20 bp, Artificial Sequence
  Description of Artificial Sequence: Synthetic oligonucleotide
  Target: ATXN1; (-) strand; PAM type: YTN; PAM sequence: TTT
ctatcacagatgtgaggaaa

SEQ ID NO: 162698 - DNA, 20 bp, Artificial Sequence
  Description of Artificial Sequence: Synthetic oligonucleotide
  Target: ATXN1; (-) strand; PAM type: YTN; PAM sequence: TTT
tctatcacagatgtgaggaa

SEQ ID NO: 162699 - DNA, 20 bp, Artificial Sequence
  Description of Artificial Sequence: Synthetic oligonucleotide
  Target: ATXN1; (-) strand; PAM type: YTN; PAM sequence: TTT
ttctatcacagatgtgagga

SEQ ID NO: 162700 - DNA, 20 bp, Artificial Sequence
  Description of Artificial Sequence: Synthetic oligonucleotide
  Target: ATXN1; (-) strand; PAM type: YTN; PAM sequence: CTT
tttctatcacagatgtgagg

SEQ ID NO: 162701 - DNA, 20 bp, Artificial Sequence
  Description of Artificial Sequence: Synthetic oligonucleotide
  Target: ATXN1; (-) strand; PAM type: YTN; PAM sequence: CTC
tttttctatcacagatgtga

SEQ ID NO: 162702 - DNA, 20 bp, Artificial Sequence
  Description of Artificial Sequence: Synthetic oligonucleotide
  Target: ATXN1; (-) strand; PAM type: YTN; PAM sequence: TTC
ctctttttctatcacagatg

SEQ ID NO: 162703 - DNA, 20 bp, Artificial Sequence
  Description of Artificial Sequence: Synthetic oligonucleotide
  Target: ATXN1; (-) strand; PAM type: YTN; PAM sequence: CTT
cctctttttctatcacagat

SEQ ID NO: 162704 - DNA, 20 bp, Artificial Sequence
  Description of Artificial Sequence: Synthetic oligonucleotide
  Target: ATXN1; (-) strand; PAM type: YTN; PAM sequence: CTC
aaacacccatcacttcctct

SEQ ID NO: 162705 - DNA, 20 bp, Artificial Sequence
  Description of Artificial Sequence: Synthetic oligonucleotide
  Target: ATXN1; (-) strand; PAM type: YTN; PAM sequence: CTC
tcaaacacccatcacttcct

SEQ ID NO: 162706 - DNA, 20 bp, Artificial Sequence
  Description of Artificial Sequence: Synthetic oligonucleotide
  Target: ATXN1; (-) strand; PAM type: YTN; PAM sequence: CTA
tcaagtgaagaaaaaaatga

SEQ ID NO: 162707 - DNA, 20 bp, Artificial Sequence
  Description of Artificial Sequence: Synthetic oligonucleotide
  Target: ATXN1; (-) strand; PAM type: YTN; PAM sequence: TTA
tcccacctatcaagtgaaga

SEQ ID NO: 162708 - DNA, 20 bp, Artificial Sequence
  Description of Artificial Sequence: Synthetic oligonucleotide
  Target: ATXN1; (-) strand; PAM type: YTN; PAM sequence: TTA
taaatattatcccacctatc

SEQ ID NO: 162709 - DNA, 20 bp, Artificial Sequence
  Description of Artificial Sequence: Synthetic oligonucleotide
  Target: ATXN1; (-) strand; PAM type: YTN; PAM sequence: CTT
ataaatattatcccacctat

SEQ ID NO: 162710 - DNA, 20 bp, Artificial Sequence
  Description of Artificial Sequence: Synthetic oligonucleotide
  Target: ATXN1; (-) strand; PAM type: YTN; PAM sequence: TTG
ggcacttataaatattatcc

SEQ ID NO: 162711 - DNA, 20 bp, Artificial Sequence
  Description of Artificial Sequence: Synthetic oligonucleotide
  Target: ATXN1; (-) strand; PAM type: YTN; PAM sequence: CTG
cacattgggcacttataaat

SEQ ID NO: 162712 - DNA, 20 bp, Artificial Sequence
  Description of Artificial Sequence: Synthetic oligonucleotide
  Target: ATXN1; (-) strand; PAM type: YTN; PAM sequence: TTG
gtgtgcataggggtctgcac

SEQ ID NO: 162713 - DNA, 20 bp, Artificial Sequence
  Description of Artificial Sequence: Synthetic oligonucleotide
  Target: ATXN1; (-) strand; PAM type: YTN; PAM sequence: TTG
ttggtgtgcataggggtctg

SEQ ID NO: 162714 - DNA, 20 bp, Artificial Sequence
  Description of Artificial Sequence: Synthetic oligonucleotide
  Target: ATXN1; (-) strand; PAM type: YTN; PAM sequence: CTT
gttggtgtgcataggggtct

SEQ ID NO: 162715 - DNA, 20 bp, Artificial Sequence
  Description of Artificial Sequence: Synthetic oligonucleotide
  Target: ATXN1; (-) strand; PAM type: YTN; PAM sequence: TTC
ttgttggtgtgcataggggt

SEQ ID NO: 162716 - DNA, 20 bp, Artificial Sequence
  Description of Artificial Sequence: Synthetic oligonucleotide
  Target: ATXN1; (-) strand; PAM type: YTN; PAM sequence: CTT
cttgttggtgtgcatagggg

SEQ ID NO: 162717 - DNA, 20 bp, Artificial Sequence
  Description of Artificial Sequence: Synthetic oligonucleotide
  Target: ATXN1; (-) strand; PAM type: YTN; PAM sequence: TTC
cttcttgttggtgtgcatag

SEQ ID NO: 162718 - DNA, 20 bp, Artificial Sequence
  Description of Artificial Sequence: Synthetic oligonucleotide
  Target: ATXN1; (-) strand; PAM type: YTN; PAM sequence: CTT
ccttcttgttggtgtgcata

SEQ ID NO: 162719 - DNA, 20 bp, Artificial Sequence
  Description of Artificial Sequence: Synthetic oligonucleotide
  Target: ATXN1; (-) strand; PAM type: YTN; PAM sequence: TTG
ccttccttcttgttggtgtg

SEQ ID NO: 162720 - DNA, 20 bp, Artificial Sequence
  Description of Artificial Sequence: Synthetic oligonucleotide
  Target: ATXN1; (-) strand; PAM type: YTN; PAM sequence: CTG
aattgccttccttcttgttg

SEQ ID NO: 162721 - DNA, 20 bp, Artificial Sequence
  Description of Artificial Sequence: Synthetic oligonucleotide
  Target: ATXN1; (-) strand; PAM type: YTN; PAM sequence: TTG
tgtgctgaattgccttcctt

SEQ ID NO: 162722 - DNA, 20 bp, Artificial Sequence
  Description of Artificial Sequence: Synthetic oligonucleotide
  Target: ATXN1; (-) strand; PAM type: YTN; PAM sequence: CTT
gtgtgctgaattgccttcct

SEQ ID NO: 162723 - DNA, 20 bp, Artificial Sequence
  Description of Artificial Sequence: Synthetic oligonucleotide
  Target: ATXN1; (-) strand; PAM type: YTN; PAM sequence: CTG
cttgtgtgctgaattgcctt

SEQ ID NO: 162724 - DNA, 20 bp, Artificial Sequence
  Description of Artificial Sequence: Synthetic oligonucleotide
  Target: ATXN1; (-) strand; PAM type: YTN; PAM sequence: TTC
tgcttgtgtgctgaattgcc

SEQ ID NO: 162725 - DNA, 20 bp, Artificial Sequence
  Description of Artificial Sequence: Synthetic oligonucleotide
  Target: ATXN1; (-) strand; PAM type: YTN; PAM sequence: TTA
ttctgcttgtgtgctgaatt

SEQ ID NO: 162726 - DNA, 20 bp, Artificial Sequence
  Description of Artificial Sequence: Synthetic oligonucleotide
  Target: ATXN1; (-) strand; PAM type: YTN; PAM sequence: TTT
attctgcttgtgtgctgaat

SEQ ID NO: 162727 - DNA, 20 bp, Artificial Sequence
  Description of Artificial Sequence: Synthetic oligonucleotide
  Target: ATXN1; (-) strand; PAM type: YTN; PAM sequence: CTG
tttattctgcttgtgtgctg

SEQ ID NO: 162728 - DNA, 20 bp, Artificial Sequence
  Description of Artificial Sequence: Synthetic oligonucleotide
  Target: ATXN1; (-) strand; PAM type: YTN; PAM sequence: TTC
tgtttattctgcttgtgtgc

SEQ ID NO: 162729 - DNA, 20 bp, Artificial Sequence
  Description of Artificial Sequence: Synthetic oligonucleotide
  Target: ATXN1; (-) strand; PAM type: YTN; PAM sequence: TTT
ctgtttattctgcttgtgtg

SEQ ID NO: 162730 - DNA, 20 bp, Artificial Sequence
  Description of Artificial Sequence: Synthetic oligonucleotide
  Target: ATXN1; (-) strand; PAM type: YTN; PAM sequence: CTT
tctgtttattctgcttgtgt

SEQ ID NO: 162731 - DNA, 20 bp, Artificial Sequence
  Description of Artificial Sequence: Synthetic oligonucleotide
  Target: ATXN1; (-) strand; PAM type: YTN; PAM sequence: CTG
agctttctgtttattctgct

SEQ ID NO: 162732 - DNA, 20 bp, Artificial Sequence
  Description of Artificial Sequence: Synthetic oligonucleotide
  Target: ATXN1; (-) strand; PAM type: YTN; PAM sequence: TTA
gcgtctgagctttctgttta

SEQ ID NO: 162733 - DNA, 20 bp, Artificial Sequence
  Description of Artificial Sequence: Synthetic oligonucleotide
  Target: ATXN1; (-) strand; PAM type: YTN; PAM sequence: TTT
agcgtctgagctttctgttt

SEQ ID NO: 162734 - DNA, 20 bp, Artificial Sequence
  Description of Artificial Sequence: Synthetic oligonucleotide
  Target: ATXN1; (-) strand; PAM type: YTN; PAM sequence: TTG
agtttagcgtctgagctttc

SEQ ID NO: 162735 - DNA, 20 bp, Artificial Sequence
  Description of Artificial Sequence: Synthetic oligonucleotide
  Target: ATXN1; (-) strand; PAM type: YTN; PAM sequence: CTT
gagtttagcgtctgagcttt

SEQ ID NO: 162736 - DNA, 20 bp, Artificial Sequence
  Description of Artificial Sequence: Synthetic oligonucleotide
  Target: ATXN1; (-) strand; PAM type: YTN; PAM sequence: CTG
gaaatgccatccttgagttt

SEQ ID NO: 162737 - DNA, 20 bp, Artificial Sequence
  Description of Artificial Sequence: Synthetic oligonucleotide
  Target: ATXN1; (-) strand; PAM type: YTN; PAM sequence: TTC
cctggaaatgccatccttga

SEQ ID NO: 162738 - DNA, 20 bp, Artificial Sequence
  Description of Artificial Sequence: Synthetic oligonucleotide
  Target: ATXN1; (-) strand; PAM type: YTN; PAM sequence: CTT
ccctggaaatgccatccttg

SEQ ID NO: 162739 - DNA, 20 bp, Artificial Sequence
  Description of Artificial Sequence: Synthetic oligonucleotide
  Target: ATXN1; (-) strand; PAM type: YTN; PAM sequence: TTA
acccttccctggaaatgcca

SEQ ID NO: 162740 - DNA, 20 bp, Artificial Sequence
  Description of Artificial Sequence: Synthetic oligonucleotide
  Target: ATXN1; (-) strand; PAM type: YTN; PAM sequence: CTT
aacccttccctggaaatgcc

SEQ ID NO: 162741 - DNA, 20 bp, Artificial Sequence
  Description of Artificial Sequence: Synthetic oligonucleotide
  Target: ATXN1; (-) strand; PAM type: YTN; PAM sequence: TTG
cacttaacccttccctggaa

SEQ ID NO: 162742 - DNA, 20 bp, Artificial Sequence
  Description of Artificial Sequence: Synthetic oligonucleotide
  Target: ATXN1; (-) strand; PAM type: YTN; PAM sequence: TTG
tggaaaagcaggcagagtga

SEQ ID NO: 162743 - DNA, 20 bp, Artificial Sequence
  Description of Artificial Sequence: Synthetic oligonucleotide
  Target: ATXN1; (-) strand; PAM type: YTN; PAM sequence: CTC
atccaaaaagtattgtggaa

SEQ ID NO: 162744 - DNA, 20 bp, Artificial Sequence
  Description of Artificial Sequence: Synthetic oligonucleotide
  Target: ATXN1; (-) strand; PAM type: YTN; PAM sequence: TTA
ctcatccaaaaagtattgtg

SEQ ID NO: 162745 - DNA, 20 bp, Artificial Sequence
  Description of Artificial Sequence: Synthetic oligonucleotide
  Target: ATXN1; (-) strand; PAM type: YTN; PAM sequence: TTG
ggaattactcatccaaaaag

SEQ ID NO: 162746 - DNA, 20 bp, Artificial Sequence
  Description of Artificial Sequence: Synthetic oligonucleotide
  Target: ATXN1; (-) strand; PAM type: YTN; PAM sequence: CTT
gggaattactcatccaaaaa

SEQ ID NO: 162747 - DNA, 20 bp, Artificial Sequence
  Description of Artificial Sequence: Synthetic oligonucleotide
  Target: ATXN1; (-) strand; PAM type: YTN; PAM sequence: TTC
cccaccatgcgtcttgggaa

SEQ ID NO: 162748 - DNA, 20 bp, Artificial Sequence
  Description of Artificial Sequence: Synthetic oligonucleotide
  Target: ATXN1; (-) strand; PAM type: YTN; PAM sequence: TTT
ccccaccatgcgtcttggga

SEQ ID NO: 162749 - DNA, 20 bp, Artificial Sequence
  Description of Artificial Sequence: Synthetic oligonucleotide
  Target: ATXN1; (-) strand; PAM type: YTN; PAM sequence: CTG
catttccccaccatgcgtct

SEQ ID NO: 162750 - DNA, 20 bp, Artificial Sequence
  Description of Artificial Sequence: Synthetic oligonucleotide
  Target: ATXN1; (-) strand; PAM type: YTN; PAM sequence: TTC
tgcatttccccaccatgcgt

SEQ ID NO: 162751 - DNA, 20 bp, Artificial Sequence
  Description of Artificial Sequence: Synthetic oligonucleotide
  Target: ATXN1; (-) strand; PAM type: YTN; PAM sequence: CTG
cgggatgtggaaggaggatt

SEQ ID NO: 162752 - DNA, 20 bp, Artificial Sequence
  Description of Artificial Sequence: Synthetic oligonucleotide
  Target: ATXN1; (-) strand; PAM type: YTN; PAM sequence: TTC
cctgcgggatgtggaaggag

SEQ ID NO: 162753 - DNA, 20 bp, Artificial Sequence
  Description of Artificial Sequence: Synthetic oligonucleotide
  Target: ATXN1; (-) strand; PAM type: YTN; PAM sequence: CTT
ccctgcgggatgtggaagga

SEQ ID NO: 162754 - DNA, 20 bp, Artificial Sequence
  Description of Artificial Sequence: Synthetic oligonucleotide
  Target: ATXN1; (-) strand; PAM type: YTN; PAM sequence: CTG
gcagccttccctgcgggatg

SEQ ID NO: 162755 - DNA, 20 bp, Artificial Sequence
  Description of Artificial Sequence: Synthetic oligonucleotide
  Target: ATXN1; (-) strand; PAM type: YTN; PAM sequence: CTC
gtgagtgtgtgtgcgggtag

SEQ ID NO: 162756 - DNA, 20 bp, Artificial Sequence
  Description of Artificial Sequence: Synthetic oligonucleotide
  Target: ATXN1; (-) strand; PAM type: YTN; PAM sequence: TTG
tgtggtgaagctcgtgagtg

SEQ ID NO: 162757 - DNA, 20 bp, Artificial Sequence
  Description of Artificial Sequence: Synthetic oligonucleotide
  Target: ATXN1; (-) strand; PAM type: YTN; PAM sequence: TTG
catcgtgttgtgtggtgaag

SEQ ID NO: 162758 - DNA, 20 bp, Artificial Sequence
  Description of Artificial Sequence: Synthetic oligonucleotide
  Target: ATXN1; (-) strand; PAM type: YTN; PAM sequence: TTT
gcatcgtgttgtgtggtgaa

SEQ ID NO: 162759 - DNA, 20 bp, Artificial Sequence
  Description of Artificial Sequence: Synthetic oligonucleotide
  Target: ATXN1; (-) strand; PAM type: YTN; PAM sequence: CTT
tgcatcgtgttgtgtggtga

SEQ ID NO: 162760 - DNA, 20 bp, Artificial Sequence
  Description of Artificial Sequence: Synthetic oligonucleotide
  Target: ATXN1; (-) strand; PAM type: YTN; PAM sequence: CTG
gcgctttgcatcgtgttgtg

SEQ ID NO: 162761 - DNA, 20 bp, Artificial Sequence
  Description of Artificial Sequence: Synthetic oligonucleotide
  Target: ATXN1; (-) strand; PAM type: YTN; PAM sequence: TTG
ctggcgctttgcatcgtgtt

SEQ ID NO: 162762 - DNA, 20 bp, Artificial Sequence
  Description of Artificial Sequence: Synthetic oligonucleotide
  Target: ATXN1; (-) strand; PAM type: YTN; PAM sequence: CTG
gagcagttgctggcgctttg

SEQ ID NO: 162763 - DNA, 20 bp, Artificial Sequence
  Description of Artificial Sequence: Synthetic oligonucleotide
  Target: ATXN1; (-) strand; PAM type: YTN; PAM sequence: CTC
ctggagcagttgctggcgct

SEQ ID NO: 162764 - DNA, 20 bp, Artificial Sequence
  Description of Artificial Sequence: Synthetic oligonucleotide
  Target: ATXN1; (-) strand; PAM type: YTN; PAM sequence: CTA
ggcctcctggagcagttgct

SEQ ID NO: 162765 - DNA, 20 bp, Artificial Sequence
  Description of Artificial Sequence: Synthetic oligonucleotide
  Target: ATXN1; (-) strand; PAM type: YTN; PAM sequence: CTG
gcaggatccagcctaggcct

SEQ ID NO: 162766 - DNA, 20 bp, Artificial Sequence
  Description of Artificial Sequence: Synthetic oligonucleotide
  Target: ATXN1; (-) strand; PAM type: YTN; PAM sequence: CTG
gtggctggcaggatccagcc

SEQ ID NO: 162767 - DNA, 20 bp, Artificial Sequence
  Description of Artificial Sequence: Synthetic oligonucleotide
  Target: ATXN1; (-) strand; PAM type: YTN; PAM sequence: CTG
gaaacccagccccctggtgg

SEQ ID NO: 162768 - DNA, 20 bp, Artificial Sequence
  Description of Artificial Sequence: Synthetic oligonucleotide
  Target: ATXN1; (-) strand; PAM type: YTN; PAM sequence: CTA
atgtcctggaaacccagccc

SEQ ID NO: 162769 - DNA, 20 bp, Artificial Sequence
  Description of Artificial Sequence: Synthetic oligonucleotide
  Target: ATXN1; (-) strand; PAM type: YTN; PAM sequence: CTG
tctaatgtcctggaaaccca

SEQ ID NO: 162770 - DNA, 20 bp, Artificial Sequence
  Description of Artificial Sequence: Synthetic oligonucleotide
  Target: ATXN1; (-) strand; PAM type: YTN; PAM sequence: CTG
gggctgtctaatgtcctgga

SEQ ID NO: 162771 - DNA, 20 bp, Artificial Sequence
  Description of Artificial Sequence: Synthetic oligonucleotide
  Target: ATXN1; (-) strand; PAM type: YTN; PAM sequence: TTG
tagactggggctgtctaatg

SEQ ID NO: 162772 - DNA, 20 bp, Artificial Sequence
  Description of Artificial Sequence: Synthetic oligonucleotide
  Target: ATXN1; (-) strand; PAM type: YTN; PAM sequence: CTG
ttgtagactggggctgtcta

SEQ ID NO: 162773 - DNA, 20 bp, Artificial Sequence
  Description of Artificial Sequence: Synthetic oligonucleotide
  Target: ATXN1; (-) strand; PAM type: YTN; PAM sequence: CTC
tgttgtagactggggctgtc

SEQ ID NO: 162774 - DNA, 20 bp, Artificial Sequence
  Description of Artificial Sequence: Synthetic oligonucleotide
  Target: ATXN1; (-) strand; PAM type: YTN; PAM sequence: TTC
tctgttgtagactggggctg

SEQ ID NO: 162775 - DNA, 20 bp, Artificial Sequence
  Description of Artificial Sequence: Synthetic oligonucleotide
  Target: ATXN1; (-) strand; PAM type: YTN; PAM sequence: TTA
tgttctctgttgtagactgg

SEQ ID NO: 162776 - DNA, 20 bp, Artificial Sequence
  Description of Artificial Sequence: Synthetic oligonucleotide
  Target: ATXN1; (-) strand; PAM type: YTN; PAM sequence: TTT
atgttctctgttgtagactg

SEQ ID NO: 162777 - DNA, 20 bp, Artificial Sequence
  Description of Artificial Sequence: Synthetic oligonucleotide
  Target: ATXN1; (-) strand; PAM type: YTN; PAM sequence: TTT
tatgttctctgttgtagact

SEQ ID NO: 162778 - DNA, 20 bp, Artificial Sequence
  Description of Artificial Sequence: Synthetic oligonucleotide
  Target: ATXN1; (-) strand; PAM type: YTN; PAM sequence: TTG
atggagagttttatgttctc

SEQ ID NO: 162779 - DNA, 20 bp, Artificial Sequence
  Description of Artificial Sequence: Synthetic oligonucleotide
  Target: ATXN1; (-) strand; PAM type: YTN; PAM sequence: CTT
gatggagagttttatgttct

SEQ ID NO: 162780 - DNA, 20 bp, Artificial Sequence
  Description of Artificial Sequence: Synthetic oligonucleotide
  Target: ATXN1; (-) strand; PAM type: YTN; PAM sequence: CTG
acttgatggagagttttatg

SEQ ID NO: 162781 - DNA, 20 bp, Artificial Sequence
  Description of Artificial Sequence: Synthetic oligonucleotide
  Target: ATXN1; (-) strand; PAM type: YTN; PAM sequence: TTC
ctgacttgatggagagtttt

SEQ ID NO: 162782 - DNA, 20 bp, Artificial Sequence
  Description of Artificial Sequence: Synthetic oligonucleotide
  Target: ATXN1; (-) strand; PAM type: YTN; PAM sequence: TTT
cctgacttgatggagagttt

SEQ ID NO: 162783 - DNA, 20 bp, Artificial Sequence
  Description of Artificial Sequence: Synthetic oligonucleotide
  Target: ATXN1; (-) strand; PAM type: YTN; PAM sequence: TTT
tcctgacttgatggagagtt

SEQ ID NO: 162784 - DNA, 20 bp, Artificial Sequence
  Description of Artificial Sequence: Synthetic oligonucleotide
  Target: ATXN1; (-) strand; PAM type: YTN; PAM sequence: TTT
ttcctgacttgatggagagt

SEQ ID NO: 162785 - DNA, 20 bp, Artificial Sequence
  Description of Artificial Sequence: Synthetic oligonucleotide
  Target: ATXN1; (-) strand; PAM type: YTN; PAM sequence: CTT
tttcctgacttgatggagag

SEQ ID NO: 162786 - DNA, 20 bp, Artificial Sequence
  Description of Artificial Sequence: Synthetic oligonucleotide
  Target: ATXN1; (-) strand; PAM type: YTN; PAM sequence: TTC
ccacgagacctttttcctga

SEQ ID NO: 162787 - DNA, 20 bp, Artificial Sequence
  Description of Artificial Sequence: Synthetic oligonucleotide
  Target: ATXN1; (-) strand; PAM type: YTN; PAM sequence: CTC
agttcccacgagaccttttt

SEQ ID NO: 162788 - DNA, 20 bp, Artificial Sequence
  Description of Artificial Sequence: Synthetic oligonucleotide
  Target: ATXN1; (-) strand; PAM type: YTN; PAM sequence: CTC
ccagagtacctcagttccca

SEQ ID NO: 162789 - DNA, 20 bp, Artificial Sequence
  Description of Artificial Sequence: Synthetic oligonucleotide
  Target: ATXN1; (-) strand; PAM type: YTN; PAM sequence: CTC
tcccagagtacctcagttcc

SEQ ID NO: 162790 - DNA, 20 bp, Artificial Sequence
  Description of Artificial Sequence: Synthetic oligonucleotide
  Target: ATXN1; (-) strand; PAM type: YTN; PAM sequence: TTA
agactctcccagagtacctc

SEQ ID NO: 162791 - DNA, 20 bp, Artificial Sequence
  Description of Artificial Sequence: Synthetic oligonucleotide
  Target: ATXN1; (-) strand; PAM type: YTN; PAM sequence: TTT
aagactctcccagagtacct

SEQ ID NO: 162792 - DNA, 20 bp, Artificial Sequence
  Description of Artificial Sequence: Synthetic oligonucleotide
  Target: ATXN1; (-) strand; PAM type: YTN; PAM sequence: TTT
taagactctcccagagtacc

SEQ ID NO: 162793 - DNA, 20 bp, Artificial Sequence
  Description of Artificial Sequence: Synthetic oligonucleotide
  Target: ATXN1; (-) strand; PAM type: YTN; PAM sequence: TTC
agccacaccaaggacagtga

SEQ ID NO: 162794 - DNA, 20 bp, Artificial Sequence
  Description of Artificial Sequence: Synthetic oligonucleotide
  Target: ATXN1; (-) strand; PAM type: YTN; PAM sequence: TTC
attcagccacaccaaggaca

SEQ ID NO: 162795 - DNA, 20 bp, Artificial Sequence
  Description of Artificial Sequence: Synthetic oligonucleotide
  Target: ATXN1; (-) strand; PAM type: YTN; PAM sequence: TTT
cattcagccacaccaaggac

SEQ ID NO: 162796 - DNA, 20 bp, Artificial Sequence
  Description of Artificial Sequence: Synthetic oligonucleotide
  Target: ATXN1; (-) strand; PAM type: YTN; PAM sequence: CTT
tcattcagccacaccaagga

SEQ ID NO: 162797 - DNA, 20 bp, Artificial Sequence
  Description of Artificial Sequence: Synthetic oligonucleotide
  Target: ATXN1; (-) strand; PAM type: YTN; PAM sequence: TTG
ctttcattcagccacaccaa

SEQ ID NO: 162798 - DNA, 20 bp, Artificial Sequence
  Description of Artificial Sequence: Synthetic oligonucleotide
  Target: ATXN1; (-) strand; PAM type: YTN; PAM sequence: TTT
gctttcattcagccacacca

SEQ ID NO: 162799 - DNA, 20 bp, Artificial Sequence
  Description of Artificial Sequence: Synthetic oligonucleotide
  Target: ATXN1; (-) strand; PAM type: YTN; PAM sequence: CTT
tgctttcattcagccacacc

SEQ ID NO: 162800 - DNA, 20 bp, Artificial Sequence
  Description of Artificial Sequence: Synthetic oligonucleotide
  Target: ATXN1; (-) strand; PAM type: YTN; PAM sequence: TTG
gctttgctttcattcagcca

SEQ ID NO: 162801 - DNA, 20 bp, Artificial Sequence
  Description of Artificial Sequence: Synthetic oligonucleotide
  Target: ATXN1; (-) strand; PAM type: YTN; PAM sequence: CTG
gaggcattggctttgctttc

SEQ ID NO: 162802 - DNA, 20 bp, Artificial Sequence
  Description of Artificial Sequence: Synthetic oligonucleotide
  Target: ATXN1; (-) strand; PAM type: YTN; PAM sequence: TTA
tctggaggcattggctttgc

SEQ ID NO: 162803 - DNA, 20 bp, Artificial Sequence
  Description of Artificial Sequence: Synthetic oligonucleotide
  Target: ATXN1; (-) strand; PAM type: YTN; PAM sequence: TTA
tgaattatctggaggcattg

SEQ ID NO: 162804 - DNA, 20 bp, Artificial Sequence
  Description of Artificial Sequence: Synthetic oligonucleotide
  Target: ATXN1; (-) strand; PAM type: YTN; PAM sequence: TTT
atgaattatctggaggcatt

SEQ ID NO: 162805 - DNA, 20 bp, Artificial Sequence
  Description of Artificial Sequence: Synthetic oligonucleotide
  Target: ATXN1; (-) strand; PAM type: YTN; PAM sequence: TTA
gtttatgaattatctggagg

SEQ ID NO: 162806 - DNA, 20 bp, Artificial Sequence
  Description of Artificial Sequence: Synthetic oligonucleotide
  Target: ATXN1; (-) strand; PAM type: YTN; PAM sequence: CTG
gttagtttatgaattatctg

SEQ ID NO: 162807 - DNA, 20 bp, Artificial Sequence
  Description of Artificial Sequence: Synthetic oligonucleotide
  Target: ATXN1; (-) strand; PAM type: YTN; PAM sequence: CTG
gaggaacagctggttagttt

SEQ ID NO: 162808 - DNA, 20 bp, Artificial Sequence
  Description of Artificial Sequence: Synthetic oligonucleotide
  Target: ATXN1; (-) strand; PAM type: YTN; PAM sequence: CTG
aaaccaccatagaaggtaag

SEQ ID NO: 162809 - DNA, 20 bp, Artificial Sequence
  Description of Artificial Sequence: Synthetic oligonucleotide
  Target: ATXN1; (-) strand; PAM type: YTN; PAM sequence: CTC
agtgactgaaaccaccatag

SEQ ID NO: 162810 - DNA, 20 bp, Artificial Sequence
  Description of Artificial Sequence: Synthetic oligonucleotide
  Target: ATXN1; (-) strand; PAM type: YTN; PAM sequence: TTG
tgcagtgtctcagtgactga

SEQ ID NO: 162811 - DNA, 20 bp, Artificial Sequence
  Description of Artificial Sequence: Synthetic oligonucleotide
  Target: ATXN1; (-) strand; PAM type: YTN; PAM sequence: TTG
aattgtgcagtgtctcagtg

SEQ ID NO: 162812 - DNA, 20 bp, Artificial Sequence
  Description of Artificial Sequence: Synthetic oligonucleotide
  Target: ATXN1; (-) strand; PAM type: YTN; PAM sequence: TTG
agagcattgaattgtgcagt

SEQ ID NO: 162813 - DNA, 20 bp, Artificial Sequence
  Description of Artificial Sequence: Synthetic oligonucleotide
  Target: ATXN1; (-) strand; PAM type: YTN; PAM sequence: TTG
cagttgagagcattgaattg

SEQ ID NO: 162814 - DNA, 20 bp, Artificial Sequence
  Description of Artificial Sequence: Synthetic oligonucleotide
  Target: ATXN1; (-) strand; PAM type: YTN; PAM sequence: TTT
gcagttgagagcattgaatt

SEQ ID NO: 162815 - DNA, 20 bp, Artificial Sequence
  Description of Artificial Sequence: Synthetic oligonucleotide
  Target: ATXN1; (-) strand; PAM type: YTN; PAM sequence: CTT
tgcagttgagagcattgaat

SEQ ID NO: 162816 - DNA, 20 bp, Artificial Sequence
  Description of Artificial Sequence: Synthetic oligonucleotide
  Target: ATXN1; (-) strand; PAM type: YTN; PAM sequence: TTG
gggtctttgcagttgagagc

SEQ ID NO: 162817 - DNA, 20 bp, Artificial Sequence
  Description of Artificial Sequence: Synthetic oligonucleotide
  Target: ATXN1; (-) strand; PAM type: YTN; PAM sequence: CTT
ggggtctttgcagttgagag

SEQ ID NO: 162818 - DNA, 20 bp, Artificial Sequence
  Description of Artificial Sequence: Synthetic oligonucleotide
  Target: ATXN1; (-) strand; PAM type: YTN; PAM sequence: CTG
ggtcccgggaggtcttgggg

SEQ ID NO: 162819 - DNA, 20 bp, Artificial Sequence
  Description of Artificial Sequence: Synthetic oligonucleotide
  Target: ATXN1; (-) strand; PAM type: YTN; PAM sequence: TTA
gagagcctgggtcccgggag

SEQ ID NO: 162820 - DNA, 20 bp, Artificial Sequence
  Description of Artificial Sequence: Synthetic oligonucleotide
  Target: ATXN1; (-) strand; PAM type: YTN; PAM sequence: CTT
agagagcctgggtcccggga

SEQ ID NO: 162821 - DNA, 20 bp, Artificial Sequence
  Description of Artificial Sequence: Synthetic oligonucleotide
  Target: ATXN1; (-) strand; PAM type: YTN; PAM sequence: CTG
tgccttagagagcctgggtc

SEQ ID NO: 162822 - DNA, 20 bp, Artificial Sequence
  Description of Artificial Sequence: Synthetic oligonucleotide
  Target: ATXN1; (-) strand; PAM type: YTN; PAM sequence: CTG
ctgtgccttagagagcctgg

SEQ ID NO: 162823 - DNA, 20 bp, Artificial Sequence
  Description of Artificial Sequence: Synthetic oligonucleotide
  Target: ATXN1; (-) strand; PAM type: YTN; PAM sequence: CTG
cctgctgtgccttagagagc

SEQ ID NO: 162824 - DNA, 20 bp, Artificial Sequence
  Description of Artificial Sequence: Synthetic oligonucleotide
  Target: ATXN1; (-) strand; PAM type: YTN; PAM sequence: TTG
tcctgcctgctgtgccttag

SEQ ID NO: 162825 - DNA, 20 bp, Artificial Sequence
  Description of Artificial Sequence: Synthetic oligonucleotide
  Target: ATXN1; (-) strand; PAM type: YTN; PAM sequence: CTT
gtcctgcctgctgtgcctta

SEQ ID NO: 162826 - DNA, 20 bp, Artificial Sequence
  Description of Artificial Sequence: Synthetic oligonucleotide
  Target: ATXN1; (-) strand; PAM type: YTN; PAM sequence: TTA
agcatcgtgacttgtcctgc

SEQ ID NO: 162827 - DNA, 20 bp, Artificial Sequence
  Description of Artificial Sequence: Synthetic oligonucleotide
  Target: ATXN1; (-) strand; PAM type: YTN; PAM sequence: CTG
cacaaattaagcatcgtgac

SEQ ID NO: 162828 - DNA, 20 bp, Artificial Sequence
  Description of Artificial Sequence: Synthetic oligonucleotide
  Target: ATXN1; (-) strand; PAM type: YTN; PAM sequence: CTG
tagcctgcacaaattaagca

SEQ ID NO: 162829 - DNA, 20 bp, Artificial Sequence
  Description of Artificial Sequence: Synthetic oligonucleotide
  Target: ATXN1; (-) strand; PAM type: YTN; PAM sequence: TTG
ctgtagcctgcacaaattaa

SEQ ID NO: 162830 - DNA, 20 bp, Artificial Sequence
  Description of Artificial Sequence: Synthetic oligonucleotide
  Target: ATXN1; (-) strand; PAM type: YTN; PAM sequence: TTA
tatgtaaagcattgctgtag

SEQ ID NO: 162831 - DNA, 20 bp, Artificial Sequence
  Description of Artificial Sequence: Synthetic oligonucleotide
  Target: ATXN1; (-) strand; PAM type: YTN; PAM sequence: TTT
atatgtaaagcattgctgta

SEQ ID NO: 162832 - DNA, 20 bp, Artificial Sequence
  Description of Artificial Sequence: Synthetic oligonucleotide
  Target: ATXN1; (-) strand; PAM type: YTN; PAM sequence: TTA
tttatatgtaaagcattgct

SEQ ID NO: 162833 - DNA, 20 bp, Artificial Sequence
  Description of Artificial Sequence: Synthetic oligonucleotide
  Target: ATXN1; (-) strand; PAM type: YTN; PAM sequence: TTG
ttatttatatgtaaagcatt

SEQ ID NO: 162834 - DNA, 20 bp, Artificial Sequence
  Description of Artificial Sequence: Synthetic oligonucleotide
  Target: ATXN1; (-) strand; PAM type: YTN; PAM sequence: CTA
gttgttatttatatgtaaag

SEQ ID NO: 162835 - DNA, 20 bp, Artificial Sequence
  Description of Artificial Sequence: Synthetic oligonucleotide
  Target: ATXN1; (-) strand; PAM type: YTN; PAM sequence: TTG
aaatggggtgatcatatgct

SEQ ID NO: 162836 - DNA, 20 bp, Artificial Sequence
  Description of Artificial Sequence: Synthetic oligonucleotide
  Target: ATXN1; (-) strand; PAM type: YTN; PAM sequence: TTT
gaaatggggtgatcatatgc

SEQ ID NO: 162837 - DNA, 20 bp, Artificial Sequence
  Description of Artificial Sequence: Synthetic oligonucleotide
  Target: ATXN1; (-) strand; PAM type: YTN; PAM sequence: CTT
tgaaatggggtgatcatatg

SEQ ID NO: 162838 - DNA, 20 bp, Artificial Sequence
  Description of Artificial Sequence: Synthetic oligonucleotide
  Target: ATXN1; (-) strand; PAM type: YTN; PAM sequence: TTG
tctttgaaatggggtgatca

SEQ ID NO: 162839 - DNA, 20 bp, Artificial Sequence
  Description of Artificial Sequence: Synthetic oligonucleotide
  Target: ATXN1; (-) strand; PAM type: YTN; PAM sequence: CTT
gtctttgaaatggggtgatc

SEQ ID NO: 162840 - DNA, 20 bp, Artificial Sequence
  Description of Artificial Sequence: Synthetic oligonucleotide
  Target: ATXN1; (-) strand; PAM type: YTN; PAM sequence: TTC
aatgtccttgtctttgaaat

SEQ ID NO: 162841 - DNA, 20 bp, Artificial Sequence
  Description of Artificial Sequence: Synthetic oligonucleotide
  Target: ATXN1; (-) strand; PAM type: YTN; PAM sequence: CTT
caatgtccttgtctttgaaa

SEQ ID NO: 162842 - DNA, 20 bp, Artificial Sequence
  Description of Artificial Sequence: Synthetic oligonucleotide
  Target: ATXN1; (-) strand; PAM type: YTN; PAM sequence: CTG
agcttcaatgtccttgtctt

SEQ ID NO: 162843 - DNA, 20 bp, Artificial Sequence
  Description of Artificial Sequence: Synthetic oligonucleotide
  Target: ATXN1; (-) strand; PAM type: YTN; PAM sequence: CTC
tgagcttcaatgtccttgtc

SEQ ID NO: 162844 - DNA, 20 bp, Artificial Sequence
  Description of Artificial Sequence: Synthetic oligonucleotide
  Target: ATXN1; (-) strand; PAM type: YTN; PAM sequence: TTA
cactctgagcttcaatgtcc

SEQ ID NO: 162845 - DNA, 20 bp, Artificial Sequence
  Description of Artificial Sequence: Synthetic oligonucleotide
  Target: ATXN1; (-) strand; PAM type: YTN; PAM sequence: CTT
acactctgagcttcaatgtc

SEQ ID NO: 162846 - DNA, 20 bp, Artificial Sequence
  Description of Artificial Sequence: Synthetic oligonucleotide
  Target: ATXN1; (-) strand; PAM type: YTN; PAM sequence: TTA
ggcaagtgacttacactctg

SEQ ID NO: 162847 - DNA, 20 bp, Artificial Sequence
  Description of Artificial Sequence: Synthetic oligonucleotide
  Target: ATXN1; (-) strand; PAM type: YTN; PAM sequence: CTT
aggcaagtgacttacactct

SEQ ID NO: 162848 - DNA, 20 bp, Artificial Sequence
  Description of Artificial Sequence: Synthetic oligonucleotide
  Target: ATXN1; (-) strand; PAM type: YTN; PAM sequence: TTA
gccatgtaatcttaggcaag

SEQ ID NO: 162849 - DNA, 20 bp, Artificial Sequence
  Description of Artificial Sequence: Synthetic oligonucleotide
  Target: ATXN1; (-) strand; PAM type: YTN; PAM sequence: TTT
agccatgtaatcttaggcaa

SEQ ID NO: 162850 - DNA, 20 bp, Artificial Sequence
  Description of Artificial Sequence: Synthetic oligonucleotide
  Target: ATXN1; (-) strand; PAM type: YTN; PAM sequence: TTT
tagccatgtaatcttaggca

SEQ ID NO: 162851 - DNA, 20 bp, Artificial Sequence
  Description of Artificial Sequence: Synthetic oligonucleotide
  Target: ATXN1; (-) strand; PAM type: YTN; PAM sequence: TTT
ttagccatgtaatcttaggc

SEQ ID NO: 162852 - DNA, 20 bp, Artificial Sequence
  Description of Artificial Sequence: Synthetic oligonucleotide
  Target: ATXN1; (-) strand; PAM type: YTN; PAM sequence: TTT
tttagccatgtaatcttagg

SEQ ID NO: 162853 - DNA, 20 bp, Artificial Sequence
  Description of Artificial Sequence: Synthetic oligonucleotide
  Target: ATXN1; (-) strand; PAM type: YTN; PAM sequence: CTT
ttttagccatgtaatcttag

SEQ ID NO: 162854 - DNA, 20 bp, Artificial Sequence
  Description of Artificial Sequence: Synthetic oligonucleotide
  Target: ATXN1; (-) strand; PAM type: YTN; PAM sequence: CTG
cccttttttagccatgtaat

SEQ ID NO: 162855 - DNA, 20 bp, Artificial Sequence
  Description of Artificial Sequence: Synthetic oligonucleotide
  Target: ATXN1; (-) strand; PAM type: YTN; PAM sequence: TTC
tgcccttttttagccatgta

SEQ ID NO: 162856 - DNA, 20 bp, Artificial Sequence
  Description of Artificial Sequence: Synthetic oligonucleotide
  Target: ATXN1; (-) strand; PAM type: YTN; PAM sequence: TTT
ctgcccttttttagccatgt

SEQ ID NO: 162857 - DNA, 20 bp, Artificial Sequence
  Description of Artificial Sequence: Synthetic oligonucleotide
  Target: ATXN1; (-) strand; PAM type: YTN; PAM sequence: TTG
tttctgcccttttttagcca

SEQ ID NO: 162858 - DNA, 20 bp, Artificial Sequence
  Description of Artificial Sequence: Synthetic oligonucleotide
  Target: ATXN1; (-) strand; PAM type: YTN; PAM sequence: TTG
tgtgttgtttctgccctttt

SEQ ID NO: 162859 - DNA, 20 bp, Artificial Sequence
  Description of Artificial Sequence: Synthetic oligonucleotide
  Target: ATXN1; (-) strand; PAM type: YTN; PAM sequence: TTT
gtgtgttgtttctgcccttt

SEQ ID NO: 162860 - DNA, 20 bp, Artificial Sequence
  Description of Artificial Sequence: Synthetic oligonucleotide
  Target: ATXN1; (-) strand; PAM type: YTN; PAM sequence: TTT
tgtgtgttgtttctgccctt

SEQ ID NO: 162861 - DNA, 20 bp, Artificial Sequence
  Description of Artificial Sequence: Synthetic oligonucleotide
  Target: ATXN1; (-) strand; PAM type: YTN; PAM sequence: TTT
ttgtgtgttgtttctgccct

SEQ ID NO: 162862 - DNA, 20 bp, Artificial Sequence
  Description of Artificial Sequence: Synthetic oligonucleotide
  Target: ATXN1; (-) strand; PAM type: YTN; PAM sequence: TTT
tttgtgtgttgtttctgccc

SEQ ID NO: 162863 - DNA, 20 bp, Artificial Sequence
  Description of Artificial Sequence: Synthetic oligonucleotide
  Target: ATXN1; (-) strand; PAM type: YTN; PAM sequence: TTA
ggattttttgtgtgttgttt

SEQ ID NO: 162864 - DNA, 20 bp, Artificial Sequence
  Description of Artificial Sequence: Synthetic oligonucleotide
  Target: ATXN1; (-) strand; PAM type: YTN; PAM sequence: TTC
atattaggattttttgtgtg

SEQ ID NO: 162865 - DNA, 20 bp, Artificial Sequence
  Description of Artificial Sequence: Synthetic oligonucleotide
  Target: ATXN1; (-) strand; PAM type: YTN; PAM sequence: TTT
catattaggattttttgtgt

SEQ ID NO: 162866 - DNA, 20 bp, Artificial Sequence
  Description of Artificial Sequence: Synthetic oligonucleotide
  Target: ATXN1; (-) strand; PAM type: YTN; PAM sequence: TTT
tcatattaggattttttgtg

SEQ ID NO: 162867 - DNA, 20 bp, Artificial Sequence
  Description of Artificial Sequence: Synthetic oligonucleotide
  Target: ATXN1; (-) strand; PAM type: YTN; PAM sequence: CTA
gatcccaagttttcatatta

SEQ ID NO: 162868 - DNA, 20 bp, Artificial Sequence
  Description of Artificial Sequence: Synthetic oligonucleotide
  Target: ATXN1; (-) strand; PAM type: YTN; PAM sequence: CTA
cacaacccaagaactagatc

SEQ ID NO: 162869 - DNA, 20 bp, Artificial Sequence
  Description of Artificial Sequence: Synthetic oligonucleotide
  Target: ATXN1; (-) strand; PAM type: YTN; PAM sequence: CTA
atgacccactacacaaccca

SEQ ID NO: 162870 - DNA, 20 bp, Artificial Sequence
  Description of Artificial Sequence: Synthetic oligonucleotide
  Target: ATXN1; (-) strand; PAM type: YTN; PAM sequence: CTA
cacactaatgacccactaca

SEQ ID NO: 162871 - DNA, 20 bp, Artificial Sequence
  Description of Artificial Sequence: Synthetic oligonucleotide
  Target: ATXN1; (-) strand; PAM type: YTN; PAM sequence: TTC
actacacactaatgacccac

SEQ ID NO: 162872 - DNA, 20 bp, Artificial Sequence
  Description of Artificial Sequence: Synthetic oligonucleotide
  Target: ATXN1; (-) strand; PAM type: YTN; PAM sequence: CTT
cactacacactaatgaccca

SEQ ID NO: 162873 - DNA, 20 bp, Artificial Sequence
  Description of Artificial Sequence: Synthetic oligonucleotide
  Target: ATXN1; (-) strand; PAM type: YTN; PAM sequence: TTC
ttcactacacactaatgacc

SEQ ID NO: 162874 - DNA, 20 bp, Artificial Sequence
  Description of Artificial Sequence: Synthetic oligonucleotide
  Target: ATXN1; (-) strand; PAM type: YTN; PAM sequence: CTC
aaaaaagaaaaaaaattctt

SEQ ID NO: 162875 - DNA, 20 bp, Artificial Sequence
  Description of Artificial Sequence: Synthetic oligonucleotide
  Target: ATXN1; (-) strand; PAM type: YTN; PAM sequence: CTC
cgtctcaaaaaagaaaaaaa

SEQ ID NO: 162876 - DNA, 20 bp, Artificial Sequence
  Description of Artificial Sequence: Synthetic oligonucleotide
  Target: ATXN1; (-) strand; PAM type: YTN; PAM sequence: CTA
cagcatggtgacagagtgag

SEQ ID NO: 162877 - DNA, 20 bp, Artificial Sequence
  Description of Artificial Sequence: Synthetic oligonucleotide
  Target: ATXN1; (-) strand; PAM type: YTN; PAM sequence: CTG
cactacagcatggtgacaga

SEQ ID NO: 162878 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatcacgcc

SEQ ID NO: 162879 - DNA, 20 bp, Artificial Sequence
  Description of Artificial Sequence: Synthetic oligonucleotide
  Target: ATXN1; (-) strand; PAM type: YTN; PAM sequence: TTG
aacccaggaggcagaggttg

SEQ ID NO: 162880 - DNA, 20 bp, Artificial Sequence
  Description of Artificial Sequence: Synthetic oligonucleotide
  Target: ATXN1; (-) strand; PAM type: YTN; PAM sequence: CTT
gaacccaggaggcagaggtt

SEQ ID NO: 162881 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcgcttgaa

SEQ ID NO: 162882 - DNA, 20 bp, Artificial Sequence
  Description of Artificial Sequence: Synthetic oligonucleotide
  Target: ATXN1; (-) strand; PAM type: YTN; PAM sequence: TTG
gaaggctgaggcaggagaat

SEQ ID NO: 162883 - DNA, 20 bp, Artificial Sequence
  Description of Artificial Sequence: Synthetic oligonucleotide
  Target: ATXN1; (-) strand; PAM type: YTN; PAM sequence: CTT
ggaaggctgaggcaggagaa

SEQ ID NO: 162884 - DNA, 20 bp, Artificial Sequence
  Description of Artificial Sequence: Synthetic oligonucleotide
  Target: ATXN1; (-) strand; PAM type: YTN; PAM sequence: TTC
ttggaaggctgaggcaggag

SEQ ID NO: 162885 - DNA, 20 bp, Artificial Sequence
  Description of Artificial Sequence: Synthetic oligonucleotide
  Target: ATXN1; (-) strand; PAM type: YTN; PAM sequence: CTT
cttggaaggctgaggcagga

SEQ ID NO: 162886 - DNA, 20 bp, Artificial Sequence
  Description of Artificial Sequence: Synthetic oligonucleotide
  Target: ATXN1; (-) strand; PAM type: YTN; PAM sequence: CTG
tagtcccagcttcttggaag

SEQ ID NO: 162887 - DNA, 20 bp, Artificial Sequence
  Description of Artificial Sequence: Synthetic oligonucleotide
  Target: ATXN1; (-) strand; PAM type: YTN; PAM sequence: CTG
ggcatggtggcatgcgcctg

SEQ ID NO: 162888 - DNA, 20 bp, Artificial Sequence
  Description of Artificial Sequence: Synthetic oligonucleotide
  Target: ATXN1; (-) strand; PAM type: YTN; PAM sequence: TTA
gctgggcatggtggcatgcg

SEQ ID NO: 162889 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattagctgg

SEQ ID NO: 162890 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaattagc

SEQ ID NO: 162891 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaatta

SEQ ID NO: 162892 - DNA, 20 bp, Artificial Sequence
  Description of Artificial Sequence: Synthetic oligonucleotide
  Target: ATXN1; (-) strand; PAM type: YTN; PAM sequence: CTG
tctctactaaaaatacaaaa

SEQ ID NO: 162893 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaaccctg

SEQ ID NO: 162894 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggtgggcagac

SEQ ID NO: 162895 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggtgggcaga

SEQ ID NO: 162896 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggtgggcag

SEQ ID NO: 162897 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 162898 - DNA, 20 bp, Artificial Sequence
  Description of Artificial Sequence: Synthetic oligonucleotide
  Target: ATXN1; (-) strand; PAM type: YTN; PAM sequence: CTC
atacctgtaatcccagcact

SEQ ID NO: 162899 - DNA, 20 bp, Artificial Sequence
  Description of Artificial Sequence: Synthetic oligonucleotide
  Target: ATXN1; (-) strand; PAM type: YTN; PAM sequence: TTC
atggtcaggcgcggtggctc

SEQ ID NO: 162900 - DNA, 20 bp, Artificial Sequence
  Description of Artificial Sequence: Synthetic oligonucleotide
  Target: ATXN1; (-) strand; PAM type: YTN; PAM sequence: CTT
catggtcaggcgcggtggct

SEQ ID NO: 162901 - DNA, 20 bp, Artificial Sequence
  Description of Artificial Sequence: Synthetic oligonucleotide
  Target: ATXN1; (-) strand; PAM type: YTN; PAM sequence: TTC
ttcatggtcaggcgcggtgg

SEQ ID NO: 162902 - DNA, 20 bp, Artificial Sequence
  Description of Artificial Sequence: Synthetic oligonucleotide
  Target: ATXN1; (-) strand; PAM type: YTN; PAM sequence: TTA
aattcttcatggtcaggcgc

SEQ ID NO: 162903 - DNA, 20 bp, Artificial Sequence
  Description of Artificial Sequence: Synthetic oligonucleotide
  Target: ATXN1; (-) strand; PAM type: YTN; PAM sequence: TTG
ggtgaggttaaattcttcat

SEQ ID NO: 162904 - DNA, 20 bp, Artificial Sequence
  Description of Artificial Sequence: Synthetic oligonucleotide
  Target: ATXN1; (-) strand; PAM type: YTN; PAM sequence: TTT
gggtgaggttaaattcttca

SEQ ID NO: 162905 - DNA, 20 bp, Artificial Sequence
  Description of Artificial Sequence: Synthetic oligonucleotide
  Target: ATXN1; (-) strand; PAM type: YTN; PAM sequence: CTG
agtttgggtgaggttaaatt

SEQ ID NO: 162906 - DNA, 20 bp, Artificial Sequence
  Description of Artificial Sequence: Synthetic oligonucleotide
  Target: ATXN1; (-) strand; PAM type: YTN; PAM sequence: CTC
cccacaggtgggggcaaagg

SEQ ID NO: 162907 - DNA, 20 bp, Artificial Sequence
  Description of Artificial Sequence: Synthetic oligonucleotide
  Target: ATXN1; (-) strand; PAM type: YTN; PAM sequence: TTC
cagaggccgagagatcacct

SEQ ID NO: 162908 - DNA, 20 bp, Artificial Sequence
  Description of Artificial Sequence: Synthetic oligonucleotide
  Target: ATXN1; (-) strand; PAM type: YTN; PAM sequence: CTG
tgaggcaggacattccagag

SEQ ID NO: 162909 - DNA, 20 bp, Artificial Sequence
  Description of Artificial Sequence: Synthetic oligonucleotide
  Target: ATXN1; (-) strand; PAM type: YTN; PAM sequence: TTC
tgtgaggcaggacattccag

SEQ ID NO: 162910 - DNA, 20 bp, Artificial Sequence
  Description of Artificial Sequence: Synthetic oligonucleotide
  Target: ATXN1; (-) strand; PAM type: YTN; PAM sequence: CTT
ctgtgaggcaggacattcca

SEQ ID NO: 162911 - DNA, 20 bp, Artificial Sequence
  Description of Artificial Sequence: Synthetic oligonucleotide
  Target: ATXN1; (-) strand; PAM type: YTN; PAM sequence: CTC
catccagtggccaataaaca

SEQ ID NO: 162912 - DNA, 20 bp, Artificial Sequence
  Description of Artificial Sequence: Synthetic oligonucleotide
  Target: ATXN1; (-) strand; PAM type: YTN; PAM sequence: TTA
ctccatccagtggccaataa

SEQ ID NO: 162913 - DNA, 20 bp, Artificial Sequence
  Description of Artificial Sequence: Synthetic oligonucleotide
  Target: ATXN1; (-) strand; PAM type: YTN; PAM sequence: TTG
ttactccatccagtggccaa

SEQ ID NO: 162914 - DNA, 20 bp, Artificial Sequence
  Description of Artificial Sequence: Synthetic oligonucleotide
  Target: ATXN1; (-) strand; PAM type: YTN; PAM sequence: CTC
atggcccaaagcccccatca

SEQ ID NO: 162915 - DNA, 20 bp, Artificial Sequence
  Description of Artificial Sequence: Synthetic oligonucleotide
  Target: ATXN1; (-) strand; PAM type: YTN; PAM sequence: TTG
gaacgtatacctcatggccc

SEQ ID NO: 162916 - DNA, 20 bp, Artificial Sequence
  Description of Artificial Sequence: Synthetic oligonucleotide
  Target: ATXN1; (-) strand; PAM type: YTN; PAM sequence: CTG
aggttggaacgtatacctca

SEQ ID NO: 162917 - DNA, 20 bp, Artificial Sequence
  Description of Artificial Sequence: Synthetic oligonucleotide
  Target: ATXN1; (-) strand; PAM type: YTN; PAM sequence: CTC
tgaggttggaacgtatacct

SEQ ID NO: 162918 - DNA, 20 bp, Artificial Sequence
  Description of Artificial Sequence: Synthetic oligonucleotide
  Target: ATXN1; (-) strand; PAM type: YTN; PAM sequence: TTC
ctctgaggttggaacgtata

SEQ ID NO: 162919 - DNA, 20 bp, Artificial Sequence
  Description of Artificial Sequence: Synthetic oligonucleotide
  Target: ATXN1; (-) strand; PAM type: YTN; PAM sequence: TTA
gttcctctgaggttggaacg

SEQ ID NO: 162920 - DNA, 20 bp, Artificial Sequence
  Description of Artificial Sequence: Synthetic oligonucleotide
  Target: ATXN1; (-) strand; PAM type: YTN; PAM sequence: TTA
ttagttcctctgaggttgga

SEQ ID NO: 162921 - DNA, 20 bp, Artificial Sequence
  Description of Artificial Sequence: Synthetic oligonucleotide
  Target: ATXN1; (-) strand; PAM type: YTN; PAM sequence: TTC
attattagttcctctgaggt

SEQ ID NO: 162922 - DNA, 20 bp, Artificial Sequence
  Description of Artificial Sequence: Synthetic oligonucleotide
  Target: ATXN1; (-) strand; PAM type: YTN; PAM sequence: TTT
cattattagttcctctgagg

SEQ ID NO: 162923 - DNA, 20 bp, Artificial Sequence
  Description of Artificial Sequence: Synthetic oligonucleotide
  Target: ATXN1; (-) strand; PAM type: YTN; PAM sequence: CTT
tcattattagttcctctgag

SEQ ID NO: 162924 - DNA, 20 bp, Artificial Sequence
  Description of Artificial Sequence: Synthetic oligonucleotide
  Target: ATXN1; (-) strand; PAM type: YTN; PAM sequence: CTG
gagatcaggcaaatatcttt

SEQ ID NO: 162925 - DNA, 20 bp, Artificial Sequence
  Description of Artificial Sequence: Synthetic oligonucleotide
  Target: ATXN1; (-) strand; PAM type: YTN; PAM sequence: CTC
ctggagatcaggcaaatatc

SEQ ID NO: 162926 - DNA, 20 bp, Artificial Sequence
  Description of Artificial Sequence: Synthetic oligonucleotide
  Target: ATXN1; (-) strand; PAM type: YTN; PAM sequence: CTA
ggccctcctggagatcaggc

SEQ ID NO: 162927 - DNA, 20 bp, Artificial Sequence
  Description of Artificial Sequence: Synthetic oligonucleotide
  Target: ATXN1; (-) strand; PAM type: YTN; PAM sequence: CTA
gtccctaggccctcctggag

SEQ ID NO: 162928 - DNA, 20 bp, Artificial Sequence
  Description of Artificial Sequence: Synthetic oligonucleotide
  Target: ATXN1; (-) strand; PAM type: YTN; PAM sequence: CTC
tagtccctaggccctcctgg

SEQ ID NO: 162929 - DNA, 20 bp, Artificial Sequence
  Description of Artificial Sequence: Synthetic oligonucleotide
  Target: ATXN1; (-) strand; PAM type: YTN; PAM sequence: CTG
acctctagtccctaggccct

SEQ ID NO: 162930 - DNA, 20 bp, Artificial Sequence
  Description of Artificial Sequence: Synthetic oligonucleotide
  Target: ATXN1; (-) strand; PAM type: YTN; PAM sequence: CTC
atgactgacctctagtccct

SEQ ID NO: 162931 - DNA, 20 bp, Artificial Sequence
  Description of Artificial Sequence: Synthetic oligonucleotide
  Target: ATXN1; (-) strand; PAM type: YTN; PAM sequence: CTG
tcctcatgactgacctctag

SEQ ID NO: 162932 - DNA, 20 bp, Artificial Sequence
  Description of Artificial Sequence: Synthetic oligonucleotide
  Target: ATXN1; (-) strand; PAM type: YTN; PAM sequence: CTA
ctgtcctcatgactgacctc

SEQ ID NO: 162933 - DNA, 20 bp, Artificial Sequence
  Description of Artificial Sequence: Synthetic oligonucleotide
  Target: ATXN1; (-) strand; PAM type: YTN; PAM sequence: TTG
ctactgtcctcatgactgac

SEQ ID NO: 162934 - DNA, 20 bp, Artificial Sequence
  Description of Artificial Sequence: Synthetic oligonucleotide
  Target: ATXN1; (-) strand; PAM type: YTN; PAM sequence: CTC
aattgctactgtcctcatga

SEQ ID NO: 162935 - DNA, 20 bp, Artificial Sequence
  Description of Artificial Sequence: Synthetic oligonucleotide
  Target: ATXN1; (-) strand; PAM type: YTN; PAM sequence: TTG
gagctcaattgctactgtcc

SEQ ID NO: 162936 - DNA, 20 bp, Artificial Sequence
  Description of Artificial Sequence: Synthetic oligonucleotide
  Target: ATXN1; (-) strand; PAM type: YTN; PAM sequence: TTA
ttggagctcaattgctactg

SEQ ID NO: 162937 - DNA, 20 bp, Artificial Sequence
  Description of Artificial Sequence: Synthetic oligonucleotide
  Target: ATXN1; (-) strand; PAM type: YTN; PAM sequence: TTT
attggagctcaattgctact

SEQ ID NO: 162938 - DNA, 20 bp, Artificial Sequence
  Description of Artificial Sequence: Synthetic oligonucleotide
  Target: ATXN1; (-) strand; PAM type: YTN; PAM sequence: TTT
tattggagctcaattgctac

SEQ ID NO: 162939 - DNA, 20 bp, Artificial Sequence
  Description of Artificial Sequence: Synthetic oligonucleotide
  Target: ATXN1; (-) strand; PAM type: YTN; PAM sequence: TTT
ttattggagctcaattgcta

SEQ ID NO: 162940 - DNA, 20 bp, Artificial Sequence
  Description of Artificial Sequence: Synthetic oligonucleotide
  Target: ATXN1; (-) strand; PAM type: YTN; PAM sequence: CTA
gagtttttattggagctcaa

SEQ ID NO: 162941 - DNA, 20 bp, Artificial Sequence
  Description of Artificial Sequence: Synthetic oligonucleotide
  Target: ATXN1; (-) strand; PAM type: YTN; PAM sequence: CTC
agcatctagagtttttattg

SEQ ID NO: 162942 - DNA, 20 bp, Artificial Sequence
  Description of Artificial Sequence: Synthetic oligonucleotide
  Target: ATXN1; (-) strand; PAM type: YTN; PAM sequence: CTC
acgcgaacctcagcatctag

SEQ ID NO: 162943 - DNA, 20 bp, Artificial Sequence
  Description of Artificial Sequence: Synthetic oligonucleotide
  Target: ATXN1; (-) strand; PAM type: YTN; PAM sequence: CTC
ccagccatgatgtgaagaat

SEQ ID NO: 162944 - DNA, 20 bp, Artificial Sequence
  Description of Artificial Sequence: Synthetic oligonucleotide
  Target: ATXN1; (-) strand; PAM type: YTN; PAM sequence: CTC
ctcccagccatgatgtgaag

SEQ ID NO: 162945 - DNA, 20 bp, Artificial Sequence
  Description of Artificial Sequence: Synthetic oligonucleotide
  Target: ATXN1; (-) strand; PAM type: YTN; PAM sequence: TTA
cctcctcccagccatgatgt

SEQ ID NO: 162946 - DNA, 20 bp, Artificial Sequence
  Description of Artificial Sequence: Synthetic oligonucleotide
  Target: ATXN1; (-) strand; PAM type: YTN; PAM sequence: CTG
cccatgaagtgatgaacagc

SEQ ID NO: 162947 - DNA, 20 bp, Artificial Sequence
  Description of Artificial Sequence: Synthetic oligonucleotide
  Target: ATXN1; (-) strand; PAM type: YTN; PAM sequence: CTC
tgcccatgaagtgatgaaca

SEQ ID NO: 162948 - DNA, 20 bp, Artificial Sequence
  Description of Artificial Sequence: Synthetic oligonucleotide
  Target: ATXN1; (-) strand; PAM type: YTN; PAM sequence: TTG
ccctctgcccatgaagtgat

SEQ ID NO: 162949 - DNA, 20 bp, Artificial Sequence
  Description of Artificial Sequence: Synthetic oligonucleotide
  Target: ATXN1; (-) strand; PAM type: YTN; PAM sequence: CTG
ttgccctctgcccatgaagt

SEQ ID NO: 162950 - DNA, 20 bp, Artificial Sequence
  Description of Artificial Sequence: Synthetic oligonucleotide
  Target: ATXN1; (-) strand; PAM type: YTN; PAM sequence: TTC
tgttgccctctgcccatgaa

SEQ ID NO: 162951 - DNA, 20 bp, Artificial Sequence
  Description of Artificial Sequence: Synthetic oligonucleotide
  Target: ATXN1; (-) strand; PAM type: YTN; PAM sequence: CTT
ctgttgccctctgcccatga

SEQ ID NO: 162952 - DNA, 20 bp, Artificial Sequence
  Description of Artificial Sequence: Synthetic oligonucleotide
  Target: ATXN1; (-) strand; PAM type: YTN; PAM sequence: CTA
gaggggtccagacatggggc

SEQ ID NO: 162953 - DNA, 20 bp, Artificial Sequence
  Description of Artificial Sequence: Synthetic oligonucleotide
  Target: ATXN1; (-) strand; PAM type: YTN; PAM sequence: TTA
gccagggtaagaggcatata

SEQ ID NO: 162954 - DNA, 20 bp, Artificial Sequence
  Description of Artificial Sequence: Synthetic oligonucleotide
  Target: ATXN1; (-) strand; PAM type: YTN; PAM sequence: CTT
agccagggtaagaggcatat

SEQ ID NO: 162955 - DNA, 20 bp, Artificial Sequence
  Description of Artificial Sequence: Synthetic oligonucleotide
  Target: ATXN1; (-) strand; PAM type: YTN; PAM sequence: TTA
aacttagccagggtaagagg

SEQ ID NO: 162956 - DNA, 20 bp, Artificial Sequence
  Description of Artificial Sequence: Synthetic oligonucleotide
  Target: ATXN1; (-) strand; PAM type: YTN; PAM sequence: TTA
cagggaaaggatacaagtta

SEQ ID NO: 162957 - DNA, 20 bp, Artificial Sequence
  Description of Artificial Sequence: Synthetic oligonucleotide
  Target: ATXN1; (-) strand; PAM type: YTN; PAM sequence: TTA
ttacagggaaaggatacaag

SEQ ID NO: 162958 - DNA, 20 bp, Artificial Sequence
  Description of Artificial Sequence: Synthetic oligonucleotide
  Target: ATXN1; (-) strand; PAM type: YTN; PAM sequence: CTT
attacagggaaaggatacaa

SEQ ID NO: 162959 - DNA, 20 bp, Artificial Sequence
  Description of Artificial Sequence: Synthetic oligonucleotide
  Target: ATXN1; (-) strand; PAM type: YTN; PAM sequence: CTC
atacttattacagggaaagg

SEQ ID NO: 162960 - DNA, 20 bp, Artificial Sequence
  Description of Artificial Sequence: Synthetic oligonucleotide
  Target: ATXN1; (-) strand; PAM type: YTN; PAM sequence: CTA
ctcatacttattacagggaa

SEQ ID NO: 162961 - DNA, 20 bp, Artificial Sequence
  Description of Artificial Sequence: Synthetic oligonucleotide
  Target: ATXN1; (-) strand; PAM type: YTN; PAM sequence: TTC
tactcatacttattacaggg

SEQ ID NO: 162962 - DNA, 20 bp, Artificial Sequence
  Description of Artificial Sequence: Synthetic oligonucleotide
  Target: ATXN1; (-) strand; PAM type: YTN; PAM sequence: CTG
ttctactcatacttattaca

SEQ ID NO: 162963 - DNA, 20 bp, Artificial Sequence
  Description of Artificial Sequence: Synthetic oligonucleotide
  Target: ATXN1; (-) strand; PAM type: YTN; PAM sequence: CTG
aaagctgttctactcatact

SEQ ID NO: 162964 - DNA, 20 bp, Artificial Sequence
  Description of Artificial Sequence: Synthetic oligonucleotide
  Target: ATXN1; (-) strand; PAM type: YTN; PAM sequence: CTC
actgaaagctgttctactca

SEQ ID NO: 162965 - DNA, 20 bp, Artificial Sequence
  Description of Artificial Sequence: Synthetic oligonucleotide
  Target: ATXN1; (-) strand; PAM type: YTN; PAM sequence: CTC
acagaactcactgaaagctg

SEQ ID NO: 162966 - DNA, 20 bp, Artificial Sequence
  Description of Artificial Sequence: Synthetic oligonucleotide
  Target: ATXN1; (-) strand; PAM type: YTN; PAM sequence: TTC
agtaaaaggactcacagaac

SEQ ID NO: 162967 - DNA, 20 bp, Artificial Sequence
  Description of Artificial Sequence: Synthetic oligonucleotide
  Target: ATXN1; (-) strand; PAM type: YTN; PAM sequence: TTG
ataattcagtaaaaggactc

SEQ ID NO: 162968 - DNA, 20 bp, Artificial Sequence
  Description of Artificial Sequence: Synthetic oligonucleotide
  Target: ATXN1; (-) strand; PAM type: YTN; PAM sequence: TTT
gataattcagtaaaaggact

SEQ ID NO: 162969 - DNA, 20 bp, Artificial Sequence
  Description of Artificial Sequence: Synthetic oligonucleotide
  Target: ATXN1; (-) strand; PAM type: YTN; PAM sequence: TTT
tgataattcagtaaaaggac

SEQ ID NO: 162970 - DNA, 20 bp, Artificial Sequence
  Description of Artificial Sequence: Synthetic oligonucleotide
  Target: ATXN1; (-) strand; PAM type: YTN; PAM sequence: CTC
cgttttgataattcagtaaa

SEQ ID NO: 162971 - DNA, 20 bp, Artificial Sequence
  Description of Artificial Sequence: Synthetic oligonucleotide
  Target: ATXN1; (-) strand; PAM type: YTN; PAM sequence: TTC
ccagaccaccctccgttttg

SEQ ID NO: 162972 - DNA, 20 bp, Artificial Sequence
  Description of Artificial Sequence: Synthetic oligonucleotide
  Target: ATXN1; (-) strand; PAM type: YTN; PAM sequence: TTT
cccagaccaccctccgtttt

SEQ ID NO: 162973 - DNA, 20 bp, Artificial Sequence
  Description of Artificial Sequence: Synthetic oligonucleotide
  Target: ATXN1; (-) strand; PAM type: YTN; PAM sequence: TTC
agggggtttcccagaccacc

SEQ ID NO: 162974 - DNA, 20 bp, Artificial Sequence
  Description of Artificial Sequence: Synthetic oligonucleotide
  Target: ATXN1; (-) strand; PAM type: YTN; PAM sequence: TTG
caagttcagggggtttccca

SEQ ID NO: 162975 - DNA, 20 bp, Artificial Sequence
  Description of Artificial Sequence: Synthetic oligonucleotide
  Target: ATXN1; (-) strand; PAM type: YTN; PAM sequence: CTG
caccacgaattgcaagttca

SEQ ID NO: 162976 - DNA, 20 bp, Artificial Sequence
  Description of Artificial Sequence: Synthetic oligonucleotide
  Target: ATXN1; (-) strand; PAM type: YTN; PAM sequence: TTA
gagagagcagtgcctgcacc

SEQ ID NO: 162977 - DNA, 20 bp, Artificial Sequence
  Description of Artificial Sequence: Synthetic oligonucleotide
  Target: ATXN1; (-) strand; PAM type: YTN; PAM sequence: CTA
caacgttagagagagcagtg

SEQ ID NO: 162978 - DNA, 20 bp, Artificial Sequence
  Description of Artificial Sequence: Synthetic oligonucleotide
  Target: ATXN1; (-) strand; PAM type: YTN; PAM sequence: CTA
taagaaggtgaccaactaca

SEQ ID NO: 162979 - DNA, 20 bp, Artificial Sequence
  Description of Artificial Sequence: Synthetic oligonucleotide
  Target: ATXN1; (-) strand; PAM type: YTN; PAM sequence: CTA
gctataagaaggtgaccaac

SEQ ID NO: 162980 - DNA, 20 bp, Artificial Sequence
  Description of Artificial Sequence: Synthetic oligonucleotide
  Target: ATXN1; (-) strand; PAM type: YTN; PAM sequence: TTA
agtgtataaccatcactagc

SEQ ID NO: 162981 - DNA, 20 bp, Artificial Sequence
  Description of Artificial Sequence: Synthetic oligonucleotide
  Target: ATXN1; (-) strand; PAM type: YTN; PAM sequence: TTT
aagtgtataaccatcactag

SEQ ID NO: 162982 - DNA, 20 bp, Artificial Sequence
  Description of Artificial Sequence: Synthetic oligonucleotide
  Target: ATXN1; (-) strand; PAM type: YTN; PAM sequence: CTA
tttaagtgtataaccatcac

SEQ ID NO: 162983 - DNA, 20 bp, Artificial Sequence
  Description of Artificial Sequence: Synthetic oligonucleotide
  Target: ATXN1; (-) strand; PAM type: YTN; PAM sequence: TTG
gcctatttaagtgtataacc

SEQ ID NO: 162984 - DNA, 20 bp, Artificial Sequence
  Description of Artificial Sequence: Synthetic oligonucleotide
  Target: ATXN1; (-) strand; PAM type: YTN; PAM sequence: CTT
ggcctatttaagtgtataac

SEQ ID NO: 162985 - DNA, 20 bp, Artificial Sequence
  Description of Artificial Sequence: Synthetic oligonucleotide
  Target: ATXN1; (-) strand; PAM type: YTN; PAM sequence: TTA
cttggcctatttaagtgtat

SEQ ID NO: 162986 - DNA, 20 bp, Artificial Sequence
  Description of Artificial Sequence: Synthetic oligonucleotide
  Target: ATXN1; (-) strand; PAM type: YTN; PAM sequence: TTA
ttacttggcctatttaagtg

SEQ ID NO: 162987 - DNA, 20 bp, Artificial Sequence
  Description of Artificial Sequence: Synthetic oligonucleotide
  Target: ATXN1; (-) strand; PAM type: YTN; PAM sequence: TTT
attacttggcctatttaagt

SEQ ID NO: 162988 - DNA, 20 bp, Artificial Sequence
  Description of Artificial Sequence: Synthetic oligonucleotide
  Target: ATXN1; (-) strand; PAM type: YTN; PAM sequence: TTT
tattacttggcctatttaag

SEQ ID NO: 162989 - DNA, 20 bp, Artificial Sequence
  Description of Artificial Sequence: Synthetic oligonucleotide
  Target: ATXN1; (-) strand; PAM type: YTN; PAM sequence: TTA
tattttattacttggcctat

SEQ ID NO: 162990 - DNA, 20 bp, Artificial Sequence
  Description of Artificial Sequence: Synthetic oligonucleotide
  Target: ATXN1; (-) strand; PAM type: YTN; PAM sequence: TTG
ttatattttattacttggcc

SEQ ID NO: 162991 - DNA, 20 bp, Artificial Sequence
  Description of Artificial Sequence: Synthetic oligonucleotide
  Target: ATXN1; (-) strand; PAM type: YTN; PAM sequence: TTC
aacgttgttatattttatta

SEQ ID NO: 162992 - DNA, 20 bp, Artificial Sequence
  Description of Artificial Sequence: Synthetic oligonucleotide
  Target: ATXN1; (-) strand; PAM type: YTN; PAM sequence: CTT
caacgttgttatattttatt

SEQ ID NO: 162993 - DNA, 20 bp, Artificial Sequence
  Description of Artificial Sequence: Synthetic oligonucleotide
  Target: ATXN1; (-) strand; PAM type: YTN; PAM sequence: TTA
cttcaacgttgttatatttt

SEQ ID NO: 162994 - DNA, 20 bp, Artificial Sequence
  Description of Artificial Sequence: Synthetic oligonucleotide
  Target: ATXN1; (-) strand; PAM type: YTN; PAM sequence: CTG
atggatgttacttcaacgtt

SEQ ID NO: 162995 - DNA, 20 bp, Artificial Sequence
  Description of Artificial Sequence: Synthetic oligonucleotide
  Target: ATXN1; (-) strand; PAM type: YTN; PAM sequence: CTG
aacgctgatggatgttactt

SEQ ID NO: 162996 - DNA, 20 bp, Artificial Sequence
  Description of Artificial Sequence: Synthetic oligonucleotide
  Target: ATXN1; (-) strand; PAM type: YTN; PAM sequence: TTA
tcactgaacgctgatggatg

SEQ ID NO: 162997 - DNA, 20 bp, Artificial Sequence
  Description of Artificial Sequence: Synthetic oligonucleotide
  Target: ATXN1; (-) strand; PAM type: YTN; PAM sequence: CTT
atcactgaacgctgatggat

SEQ ID NO: 162998 - DNA, 20 bp, Artificial Sequence
  Description of Artificial Sequence: Synthetic oligonucleotide
  Target: ATXN1; (-) strand; PAM type: YTN; PAM sequence: TTC
ttatcactgaacgctgatgg

SEQ ID NO: 162999 - DNA, 20 bp, Artificial Sequence
  Description of Artificial Sequence: Synthetic oligonucleotide
  Target: ATXN1; (-) strand; PAM type: YTN; PAM sequence: TTC
acaaggcattcttatcactg

SEQ ID NO: 163000 - DNA, 20 bp, Artificial Sequence
  Description of Artificial Sequence: Synthetic oligonucleotide
  Target: ATXN1; (-) strand; PAM type: YTN; PAM sequence: TTT
cacaaggcattcttatcact

SEQ ID NO: 163001 - DNA, 20 bp, Artificial Sequence
  Description of Artificial Sequence: Synthetic oligonucleotide
  Target: ATXN1; (-) strand; PAM type: YTN; PAM sequence: TTG
tttcacaaggcattcttatc

SEQ ID NO: 163002 - DNA, 20 bp, Artificial Sequence
  Description of Artificial Sequence: Synthetic oligonucleotide
  Target: ATXN1; (-) strand; PAM type: YTN; PAM sequence: TTA
ttgtttcacaaggcattctt

SEQ ID NO: 163003 - DNA, 20 bp, Artificial Sequence
  Description of Artificial Sequence: Synthetic oligonucleotide
  Target: ATXN1; (-) strand; PAM type: YTN; PAM sequence: CTA
attattgtttcacaaggcat

SEQ ID NO: 163004 - DNA, 20 bp, Artificial Sequence
  Description of Artificial Sequence: Synthetic oligonucleotide
  Target: ATXN1; (-) strand; PAM type: YTN; PAM sequence: TTA
acctaattattgtttcacaa

SEQ ID NO: 163005 - DNA, 20 bp, Artificial Sequence
  Description of Artificial Sequence: Synthetic oligonucleotide
  Target: ATXN1; (-) strand; PAM type: YTN; PAM sequence: TTA
gattaacctaattattgttt

SEQ ID NO: 163006 - DNA, 20 bp, Artificial Sequence
  Description of Artificial Sequence: Synthetic oligonucleotide
  Target: ATXN1; (-) strand; PAM type: YTN; PAM sequence: TTT
agattaacctaattattgtt

SEQ ID NO: 163007 - DNA, 20 bp, Artificial Sequence
  Description of Artificial Sequence: Synthetic oligonucleotide
  Target: ATXN1; (-) strand; PAM type: YTN; PAM sequence: TTG
gggtataccaatttagatta

SEQ ID NO: 163008 - DNA, 20 bp, Artificial Sequence
  Description of Artificial Sequence: Synthetic oligonucleotide
  Target: ATXN1; (-) strand; PAM type: YTN; PAM sequence: TTT
ggggtataccaatttagatt

SEQ ID NO: 163009 - DNA, 20 bp, Artificial Sequence
  Description of Artificial Sequence: Synthetic oligonucleotide
  Target: ATXN1; (-) strand; PAM type: YTN; PAM sequence: CTG
gccacagtttggggtatacc

SEQ ID NO: 163010 - DNA, 20 bp, Artificial Sequence
  Description of Artificial Sequence: Synthetic oligonucleotide
  Target: ATXN1; (-) strand; PAM type: YTN; PAM sequence: TTC
cctggccacagtttggggta

SEQ ID NO: 163011 - DNA, 20 bp, Artificial Sequence
  Description of Artificial Sequence: Synthetic oligonucleotide
  Target: ATXN1; (-) strand; PAM type: YTN; PAM sequence: CTG
ttccctggccacagtttggg

SEQ ID NO: 163012 - DNA, 20 bp, Artificial Sequence
  Description of Artificial Sequence: Synthetic oligonucleotide
  Target: ATXN1; (-) strand; PAM type: YTN; PAM sequence: CTG
cctgttccctggccacagtt

SEQ ID NO: 163013 - DNA, 20 bp, Artificial Sequence
  Description of Artificial Sequence: Synthetic oligonucleotide
  Target: ATXN1; (-) strand; PAM type: YTN; PAM sequence: CTG
taccacccatctgcctgttc

SEQ ID NO: 163014 - DNA, 20 bp, Artificial Sequence
  Description of Artificial Sequence: Synthetic oligonucleotide
  Target: ATXN1; (-) strand; PAM type: YTN; PAM sequence: TTC
tgtaccacccatctgcctgt

SEQ ID NO: 163015 - DNA, 20 bp, Artificial Sequence
  Description of Artificial Sequence: Synthetic oligonucleotide
  Target: ATXN1; (-) strand; PAM type: YTN; PAM sequence: TTT
ctgtaccacccatctgcctg

SEQ ID NO: 163016 - DNA, 20 bp, Artificial Sequence
  Description of Artificial Sequence: Synthetic oligonucleotide
  Target: ATXN1; (-) strand; PAM type: YTN; PAM sequence: CTT
tctgtaccacccatctgcct

SEQ ID NO: 163017 - DNA, 20 bp, Artificial Sequence
  Description of Artificial Sequence: Synthetic oligonucleotide
  Target: ATXN1; (-) strand; PAM type: YTN; PAM sequence: TTC
ctttctgtaccacccatctg

SEQ ID NO: 163018 - DNA, 20 bp, Artificial Sequence
  Description of Artificial Sequence: Synthetic oligonucleotide
  Target: ATXN1; (-) strand; PAM type: YTN; PAM sequence: CTG
ttcctttctgtaccacccat

SEQ ID NO: 163019 - DNA, 20 bp, Artificial Sequence
  Description of Artificial Sequence: Synthetic oligonucleotide
  Target: ATXN1; (-) strand; PAM type: YTN; PAM sequence: CTG
agtaatatatatccctgttc

SEQ ID NO: 163020 - DNA, 20 bp, Artificial Sequence
  Description of Artificial Sequence: Synthetic oligonucleotide
  Target: ATXN1; (-) strand; PAM type: YTN; PAM sequence: TTA
cactgagtaatatatatccc

SEQ ID NO: 163021 - DNA, 20 bp, Artificial Sequence
  Description of Artificial Sequence: Synthetic oligonucleotide
  Target: ATXN1; (-) strand; PAM type: YTN; PAM sequence: CTG
gtgacattacactgagtaat

SEQ ID NO: 163022 - DNA, 20 bp, Artificial Sequence
  Description of Artificial Sequence: Synthetic oligonucleotide
  Target: ATXN1; (-) strand; PAM type: YTN; PAM sequence: TTG
gccctggtgacattacactg

SEQ ID NO: 163023 - DNA, 20 bp, Artificial Sequence
  Description of Artificial Sequence: Synthetic oligonucleotide
  Target: ATXN1; (-) strand; PAM type: YTN; PAM sequence: TTT
ggccctggtgacattacact

SEQ ID NO: 163024 - DNA, 20 bp, Artificial Sequence
  Description of Artificial Sequence: Synthetic oligonucleotide
  Target: ATXN1; (-) strand; PAM type: YTN; PAM sequence: CTT
tggccctggtgacattacac

SEQ ID NO: 163025 - DNA, 20 bp, Artificial Sequence
  Description of Artificial Sequence: Synthetic oligonucleotide
  Target: ATXN1; (-) strand; PAM type: YTN; PAM sequence: CTG
agcctttggccctggtgaca

SEQ ID NO: 163026 - DNA, 20 bp, Artificial Sequence
  Description of Artificial Sequence: Synthetic oligonucleotide
  Target: ATXN1; (-) strand; PAM type: YTN; PAM sequence: CTC
tgagcctttggccctggtga

SEQ ID NO: 163027 - DNA, 20 bp, Artificial Sequence
  Description of Artificial Sequence: Synthetic oligonucleotide
  Target: ATXN1; (-) strand; PAM type: YTN; PAM sequence: TTC
tctgagcctttggccctggt

SEQ ID NO: 163028 - DNA, 20 bp, Artificial Sequence
  Description of Artificial Sequence: Synthetic oligonucleotide
  Target: ATXN1; (-) strand; PAM type: YTN; PAM sequence: TTT
ctctgagcctttggccctgg

SEQ ID NO: 163029 - DNA, 20 bp, Artificial Sequence
  Description of Artificial Sequence: Synthetic oligonucleotide
  Target: ATXN1; (-) strand; PAM type: YTN; PAM sequence: CTT
tctctgagcctttggccctg

SEQ ID NO: 163030 - DNA, 20 bp, Artificial Sequence
  Description of Artificial Sequence: Synthetic oligonucleotide
  Target: ATXN1; (-) strand; PAM type: YTN; PAM sequence: TTC
cacagggaggctttctctga

SEQ ID NO: 163031 - DNA, 20 bp, Artificial Sequence
  Description of Artificial Sequence: Synthetic oligonucleotide
  Target: ATXN1; (-) strand; PAM type: YTN; PAM sequence: TTT
ccacagggaggctttctctg

SEQ ID NO: 163032 - DNA, 20 bp, Artificial Sequence
  Description of Artificial Sequence: Synthetic oligonucleotide
  Target: ATXN1; (-) strand; PAM type: YTN; PAM sequence: TTG
gggagatttccacagggagg

SEQ ID NO: 163033 - DNA, 20 bp, Artificial Sequence
  Description of Artificial Sequence: Synthetic oligonucleotide
  Target: ATXN1; (-) strand; PAM type: YTN; PAM sequence: TTA
catgtatgtgccattgggga

SEQ ID NO: 163034 - DNA, 20 bp, Artificial Sequence
  Description of Artificial Sequence: Synthetic oligonucleotide
  Target: ATXN1; (-) strand; PAM type: YTN; PAM sequence: CTT
acatgtatgtgccattgggg

SEQ ID NO: 163035 - DNA, 20 bp, Artificial Sequence
  Description of Artificial Sequence: Synthetic oligonucleotide
  Target: ATXN1; (-) strand; PAM type: YTN; PAM sequence: TTC
ttacatgtatgtgccattgg

SEQ ID NO: 163036 - DNA, 20 bp, Artificial Sequence
  Description of Artificial Sequence: Synthetic oligonucleotide
  Target: ATXN1; (-) strand; PAM type: YTN; PAM sequence: CTT
cttacatgtatgtgccattg

SEQ ID NO: 163037 - DNA, 20 bp, Artificial Sequence
  Description of Artificial Sequence: Synthetic oligonucleotide
  Target: ATXN1; (-) strand; PAM type: YTN; PAM sequence: CTC
agtgcttcttacatgtatgt

SEQ ID NO: 163038 - DNA, 20 bp, Artificial Sequence
  Description of Artificial Sequence: Synthetic oligonucleotide
  Target: ATXN1; (-) strand; PAM type: YTN; PAM sequence: TTG
atccactcagtgcttcttac

SEQ ID NO: 163039 - DNA, 20 bp, Artificial Sequence
  Description of Artificial Sequence: Synthetic oligonucleotide
  Target: ATXN1; (-) strand; PAM type: YTN; PAM sequence: CTG
taccccaaaaattgatccac

SEQ ID NO: 163040 - DNA, 20 bp, Artificial Sequence
  Description of Artificial Sequence: Synthetic oligonucleotide
  Target: ATXN1; (-) strand; PAM type: YTN; PAM sequence: CTC
tgtaccccaaaaattgatcc

SEQ ID NO: 163041 - DNA, 20 bp, Artificial Sequence
  Description of Artificial Sequence: Synthetic oligonucleotide
  Target: ATXN1; (-) strand; PAM type: YTN; PAM sequence: TTG
aactctgtaccccaaaaatt

SEQ ID NO: 163042 - DNA, 20 bp, Artificial Sequence
  Description of Artificial Sequence: Synthetic oligonucleotide
  Target: ATXN1; (-) strand; PAM type: YTN; PAM sequence: TTT
gaactctgtaccccaaaaat

SEQ ID NO: 163043 - DNA, 20 bp, Artificial Sequence
  Description of Artificial Sequence: Synthetic oligonucleotide
  Target: ATXN1; (-) strand; PAM type: YTN; PAM sequence: CTT
tgaactctgtaccccaaaaa

SEQ ID NO: 163044 - DNA, 20 bp, Artificial Sequence
  Description of Artificial Sequence: Synthetic oligonucleotide
  Target: ATXN1; (-) strand; PAM type: YTN; PAM sequence: CTC
caacactttgaactctgtac

SEQ ID NO: 163045 - DNA, 20 bp, Artificial Sequence
  Description of Artificial Sequence: Synthetic oligonucleotide
  Target: ATXN1; (-) strand; PAM type: YTN; PAM sequence: TTG
ctccaacactttgaactctg

SEQ ID NO: 163046 - DNA, 20 bp, Artificial Sequence
  Description of Artificial Sequence: Synthetic oligonucleotide
  Target: ATXN1; (-) strand; PAM type: YTN; PAM sequence: TTC
ccccattgctccaacacttt

SEQ ID NO: 163047 - DNA, 20 bp, Artificial Sequence
  Description of Artificial Sequence: Synthetic oligonucleotide
  Target: ATXN1; (-) strand; PAM type: YTN; PAM sequence: CTG
atgtgttcccccattgctcc

SEQ ID NO: 163048 - DNA, 20 bp, Artificial Sequence
  Description of Artificial Sequence: Synthetic oligonucleotide
  Target: ATXN1; (-) strand; PAM type: YTN; PAM sequence: TTA
gctgatgtgttcccccattg

SEQ ID NO: 163049 - DNA, 20 bp, Artificial Sequence
  Description of Artificial Sequence: Synthetic oligonucleotide
  Target: ATXN1; (-) strand; PAM type: YTN; PAM sequence: TTA
agacaccggaagttagctga

SEQ ID NO: 163050 - DNA, 20 bp, Artificial Sequence
  Description of Artificial Sequence: Synthetic oligonucleotide
  Target: ATXN1; (-) strand; PAM type: YTN; PAM sequence: CTG
aggatattaagacaccggaa

SEQ ID NO: 163051 - DNA, 20 bp, Artificial Sequence
  Description of Artificial Sequence: Synthetic oligonucleotide
  Target: ATXN1; (-) strand; PAM type: YTN; PAM sequence: CTC
agtgggctgaggatattaag

SEQ ID NO: 163052 - DNA, 20 bp, Artificial Sequence
  Description of Artificial Sequence: Synthetic oligonucleotide
  Target: ATXN1; (-) strand; PAM type: YTN; PAM sequence: TTC
actcagtgggctgaggatat

SEQ ID NO: 163053 - DNA, 20 bp, Artificial Sequence
  Description of Artificial Sequence: Synthetic oligonucleotide
  Target: ATXN1; (-) strand; PAM type: YTN; PAM sequence: TTT
cactcagtgggctgaggata

SEQ ID NO: 163054 - DNA, 20 bp, Artificial Sequence
  Description of Artificial Sequence: Synthetic oligonucleotide
  Target: ATXN1; (-) strand; PAM type: YTN; PAM sequence: CTA
gtaagtcaatttcactcagt

SEQ ID NO: 163055 - DNA, 20 bp, Artificial Sequence
  Description of Artificial Sequence: Synthetic oligonucleotide
  Target: ATXN1; (-) strand; PAM type: YTN; PAM sequence: TTC
tagtaagtcaatttcactca

SEQ ID NO: 163056 - DNA, 20 bp, Artificial Sequence
  Description of Artificial Sequence: Synthetic oligonucleotide
  Target: ATXN1; (-) strand; PAM type: YTN; PAM sequence: TTT
ctagtaagtcaatttcactc

SEQ ID NO: 163057 - DNA, 20 bp, Artificial Sequence
  Description of Artificial Sequence: Synthetic oligonucleotide
  Target: ATXN1; (-) strand; PAM type: YTN; PAM sequence: CTA
tggtagatttctagtaagtc

SEQ ID NO: 163058 - DNA, 20 bp, Artificial Sequence
  Description of Artificial Sequence: Synthetic oligonucleotide
  Target: ATXN1; (-) strand; PAM type: YTN; PAM sequence: TTC
tatggtagatttctagtaag

SEQ ID NO: 163059 - DNA, 20 bp, Artificial Sequence
  Description of Artificial Sequence: Synthetic oligonucleotide
  Target: ATXN1; (-) strand; PAM type: YTN; PAM sequence: TTC
agtattctatggtagatttc

SEQ ID NO: 163060 - DNA, 20 bp, Artificial Sequence
  Description of Artificial Sequence: Synthetic oligonucleotide
  Target: ATXN1; (-) strand; PAM type: YTN; PAM sequence: TTG
ggatgttcagtattctatgg

SEQ ID NO: 163061 - DNA, 20 bp, Artificial Sequence
  Description of Artificial Sequence: Synthetic oligonucleotide
  Target: ATXN1; (-) strand; PAM type: YTN; PAM sequence: CTG
ttgggatgttcagtattcta

SEQ ID NO: 163062 - DNA, 20 bp, Artificial Sequence
  Description of Artificial Sequence: Synthetic oligonucleotide
  Target: ATXN1; (-) strand; PAM type: YTN; PAM sequence: TTG
gtctgttgggatgttcagta

SEQ ID NO: 163063 - DNA, 20 bp, Artificial Sequence
  Description of Artificial Sequence: Synthetic oligonucleotide
  Target: ATXN1; (-) strand; PAM type: YTN; PAM sequence: TTT
ggtctgttgggatgttcagt

SEQ ID NO: 163064 - DNA, 20 bp, Artificial Sequence
  Description of Artificial Sequence: Synthetic oligonucleotide
  Target: ATXN1; (-) strand; PAM type: YTN; PAM sequence: CTC
catttggtctgttgggatgt

SEQ ID NO: 163065 - DNA, 20 bp, Artificial Sequence
  Description of Artificial Sequence: Synthetic oligonucleotide
  Target: ATXN1; (-) strand; PAM type: YTN; PAM sequence: CTC
ctccatttggtctgttggga

SEQ ID NO: 163066 - DNA, 20 bp, Artificial Sequence
  Description of Artificial Sequence: Synthetic oligonucleotide
  Target: ATXN1; (-) strand; PAM type: YTN; PAM sequence: CTG
cagagccaagtgcgggagcc

SEQ ID NO: 163067 - DNA, 20 bp, Artificial Sequence
  Description of Artificial Sequence: Synthetic oligonucleotide
  Target: ATXN1; (-) strand; PAM type: YTN; PAM sequence: TTG
tggaggaaatatgtccccaa

SEQ ID NO: 163068 - DNA, 20 bp, Artificial Sequence
  Description of Artificial Sequence: Synthetic oligonucleotide
  Target: ATXN1; (-) strand; PAM type: YTN; PAM sequence: TTG
tattgtggaggaaatatgtc

SEQ ID NO: 163069 - DNA, 20 bp, Artificial Sequence
  Description of Artificial Sequence: Synthetic oligonucleotide
  Target: ATXN1; (-) strand; PAM type: YTN; PAM sequence: TTT
gtattgtggaggaaatatgt

SEQ ID NO: 163070 - DNA, 20 bp, Artificial Sequence
  Description of Artificial Sequence: Synthetic oligonucleotide
  Target: ATXN1; (-) strand; PAM type: YTN; PAM sequence: CTT
tgtattgtggaggaaatatg

SEQ ID NO: 163071 - DNA, 20 bp, Artificial Sequence
  Description of Artificial Sequence: Synthetic oligonucleotide
  Target: ATXN1; (-) strand; PAM type: YTN; PAM sequence: CTC
ctttgtattgtggaggaaat

SEQ ID NO: 163072 - DNA, 20 bp, Artificial Sequence
  Description of Artificial Sequence: Synthetic oligonucleotide
  Target: ATXN1; (-) strand; PAM type: YTN; PAM sequence: TTC
agcatgaccacaaacacagt

SEQ ID NO: 163073 - DNA, 20 bp, Artificial Sequence
  Description of Artificial Sequence: Synthetic oligonucleotide
  Target: ATXN1; (-) strand; PAM type: YTN; PAM sequence: TTA
ttcagcatgaccacaaacac

SEQ ID NO: 163074 - DNA, 20 bp, Artificial Sequence
  Description of Artificial Sequence: Synthetic oligonucleotide
  Target: ATXN1; (-) strand; PAM type: YTN; PAM sequence: CTG
atacaccattattcagcatg

SEQ ID NO: 163075 - DNA, 20 bp, Artificial Sequence
  Description of Artificial Sequence: Synthetic oligonucleotide
  Target: ATXN1; (-) strand; PAM type: YTN; PAM sequence: CTG
ccactgatacaccattattc

SEQ ID NO: 163076 - DNA, 20 bp, Artificial Sequence
  Description of Artificial Sequence: Synthetic oligonucleotide
  Target: ATXN1; (-) strand; PAM type: YTN; PAM sequence: CTG
ctgccactgatacaccatta

SEQ ID NO: 163077 - DNA, 20 bp, Artificial Sequence
  Description of Artificial Sequence: Synthetic oligonucleotide
  Target: ATXN1; (-) strand; PAM type: YTN; PAM sequence: CTC
agccagagctgctgccactg

SEQ ID NO: 163078 - DNA, 20 bp, Artificial Sequence
  Description of Artificial Sequence: Synthetic oligonucleotide
  Target: ATXN1; (-) strand; PAM type: YTN; PAM sequence: CTC
tcagccagagctgctgccac

SEQ ID NO: 163079 - DNA, 20 bp, Artificial Sequence
  Description of Artificial Sequence: Synthetic oligonucleotide
  Target: ATXN1; (-) strand; PAM type: YTN; PAM sequence: CTG
gtctctcagccagagctgct

SEQ ID NO: 163080 - DNA, 20 bp, Artificial Sequence
  Description of Artificial Sequence: Synthetic oligonucleotide
  Target: ATXN1; (-) strand; PAM type: YTN; PAM sequence: TTC
tggtctctcagccagagctg

SEQ ID NO: 163081 - DNA, 20 bp, Artificial Sequence
  Description of Artificial Sequence: Synthetic oligonucleotide
  Target: ATXN1; (-) strand; PAM type: YTN; PAM sequence: CTG
caagggttctggtctctcag

SEQ ID NO: 163082 - DNA, 20 bp, Artificial Sequence
  Description of Artificial Sequence: Synthetic oligonucleotide
  Target: ATXN1; (-) strand; PAM type: YTN; PAM sequence: CTA
aggctgcaagggttctggtc

SEQ ID NO: 163083 - DNA, 20 bp, Artificial Sequence
  Description of Artificial Sequence: Synthetic oligonucleotide
  Target: ATXN1; (-) strand; PAM type: YTN; PAM sequence: CTA
gtactaaggctgcaagggtt

SEQ ID NO: 163084 - DNA, 20 bp, Artificial Sequence
  Description of Artificial Sequence: Synthetic oligonucleotide
  Target: ATXN1; (-) strand; PAM type: YTN; PAM sequence: CTG
caggtgagagagtatggccc

SEQ ID NO: 163085 - DNA, 20 bp, Artificial Sequence
  Description of Artificial Sequence: Synthetic oligonucleotide
  Target: ATXN1; (-) strand; PAM type: YTN; PAM sequence: TTC
tgcaggtgagagagtatggc

SEQ ID NO: 163086 - DNA, 20 bp, Artificial Sequence
  Description of Artificial Sequence: Synthetic oligonucleotide
  Target: ATXN1; (-) strand; PAM type: YTN; PAM sequence: TTA
ttctgcaggtgagagagtat

SEQ ID NO: 163087 - DNA, 20 bp, Artificial Sequence
  Description of Artificial Sequence: Synthetic oligonucleotide
  Target: ATXN1; (-) strand; PAM type: YTN; PAM sequence: CTT
attctgcaggtgagagagta

SEQ ID NO: 163088 - DNA, 20 bp, Artificial Sequence
  Description of Artificial Sequence: Synthetic oligonucleotide
  Target: ATXN1; (-) strand; PAM type: YTN; PAM sequence: TTC
ttattctgcaggtgagagag

SEQ ID NO: 163089 - DNA, 20 bp, Artificial Sequence
  Description of Artificial Sequence: Synthetic oligonucleotide
  Target: ATXN1; (-) strand; PAM type: YTN; PAM sequence: TTT
cttattctgcaggtgagaga

SEQ ID NO: 163090 - DNA, 20 bp, Artificial Sequence
  Description of Artificial Sequence: Synthetic oligonucleotide
  Target: ATXN1; (-) strand; PAM type: YTN; PAM sequence: TTG
atttcttattctgcaggtga

SEQ ID NO: 163091 - DNA, 20 bp, Artificial Sequence
  Description of Artificial Sequence: Synthetic oligonucleotide
  Target: ATXN1; (-) strand; PAM type: YTN; PAM sequence: CTG
atgtgccgtcagcattgatt

SEQ ID NO: 163092 - DNA, 20 bp, Artificial Sequence
  Description of Artificial Sequence: Synthetic oligonucleotide
  Target: ATXN1; (-) strand; PAM type: YTN; PAM sequence: CTG
ggtgagtctgatgtgccgtc

SEQ ID NO: 163093 - DNA, 20 bp, Artificial Sequence
  Description of Artificial Sequence: Synthetic oligonucleotide
  Target: ATXN1; (-) strand; PAM type: YTN; PAM sequence: CTC
cctgggtgagtctgatgtgc

SEQ ID NO: 163094 - DNA, 20 bp, Artificial Sequence
  Description of Artificial Sequence: Synthetic oligonucleotide
  Target: ATXN1; (-) strand; PAM type: YTN; PAM sequence: TTA
aaagctccctgggtgagtct

SEQ ID NO: 163095 - DNA, 20 bp, Artificial Sequence
  Description of Artificial Sequence: Synthetic oligonucleotide
  Target: ATXN1; (-) strand; PAM type: YTN; PAM sequence: TTT
aaaagctccctgggtgagtc

SEQ ID NO: 163096 - DNA, 20 bp, Artificial Sequence
  Description of Artificial Sequence: Synthetic oligonucleotide
  Target: ATXN1; (-) strand; PAM type: YTN; PAM sequence: TTT
taaaagctccctgggtgagt

SEQ ID NO: 163097 - DNA, 20 bp, Artificial Sequence
  Description of Artificial Sequence: Synthetic oligonucleotide
  Target: ATXN1; (-) strand; PAM type: YTN; PAM sequence: TTT
ttaaaagctccctgggtgag

SEQ ID NO: 163098 - DNA, 20 bp, Artificial Sequence
  Description of Artificial Sequence: Synthetic oligonucleotide
  Target: ATXN1; (-) strand; PAM type: YTN; PAM sequence: TTA
tgtttttaaaagctccctgg

SEQ ID NO: 163099 - DNA, 20 bp, Artificial Sequence
  Description of Artificial Sequence: Synthetic oligonucleotide
  Target: ATXN1; (-) strand; PAM type: YTN; PAM sequence: CTG
gacattatgtttttaaaagc

SEQ ID NO: 163100 - DNA, 20 bp, Artificial Sequence
  Description of Artificial Sequence: Synthetic oligonucleotide
  Target: ATXN1; (-) strand; PAM type: YTN; PAM sequence: CTG
gggtagatctggacattatg

SEQ ID NO: 163101 - DNA, 20 bp, Artificial Sequence
  Description of Artificial Sequence: Synthetic oligonucleotide
  Target: ATXN1; (-) strand; PAM type: YTN; PAM sequence: TTG
gtctggggtagatctggaca

SEQ ID NO: 163102 - DNA, 20 bp, Artificial Sequence
  Description of Artificial Sequence: Synthetic oligonucleotide
  Target: ATXN1; (-) strand; PAM type: YTN; PAM sequence: TTC
agttggtctggggtagatct

SEQ ID NO: 163103 - DNA, 20 bp, Artificial Sequence
  Description of Artificial Sequence: Synthetic oligonucleotide
  Target: ATXN1; (-) strand; PAM type: YTN; PAM sequence: TTA
ttcagttggtctggggtaga

SEQ ID NO: 163104 - DNA, 20 bp, Artificial Sequence
  Description of Artificial Sequence: Synthetic oligonucleotide
  Target: ATXN1; (-) strand; PAM type: YTN; PAM sequence: CTT
attcagttggtctggggtag

SEQ ID NO: 163105 - DNA, 20 bp, Artificial Sequence
  Description of Artificial Sequence: Synthetic oligonucleotide
  Target: ATXN1; (-) strand; PAM type: YTN; PAM sequence: TTC
ttattcagttggtctggggt

SEQ ID NO: 163106 - DNA, 20 bp, Artificial Sequence
  Description of Artificial Sequence: Synthetic oligonucleotide
  Target: ATXN1; (-) strand; PAM type: YTN; PAM sequence: CTA
gggattcttattcagttggt

SEQ ID NO: 163107 - DNA, 20 bp, Artificial Sequence
  Description of Artificial Sequence: Synthetic oligonucleotide
  Target: ATXN1; (-) strand; PAM type: YTN; PAM sequence: CTA
aaatgccagtggtggtccca

SEQ ID NO: 163108 - DNA, 20 bp, Artificial Sequence
  Description of Artificial Sequence: Synthetic oligonucleotide
  Target: ATXN1; (-) strand; PAM type: YTN; PAM sequence: TTC
ctaaaatgccagtggtggtc

SEQ ID NO: 163109 - DNA, 20 bp, Artificial Sequence
  Description of Artificial Sequence: Synthetic oligonucleotide
  Target: ATXN1; (-) strand; PAM type: YTN; PAM sequence: TTT
cctaaaatgccagtggtggt

SEQ ID NO: 163110 - DNA, 20 bp, Artificial Sequence
  Description of Artificial Sequence: Synthetic oligonucleotide
  Target: ATXN1; (-) strand; PAM type: YTN; PAM sequence: CTG
gtgcatttcctaaaatgcca

SEQ ID NO: 163111 - DNA, 20 bp, Artificial Sequence
  Description of Artificial Sequence: Synthetic oligonucleotide
  Target: ATXN1; (-) strand; PAM type: YTN; PAM sequence: TTA
gaatcccctggtgcatttcc

SEQ ID NO: 163112 - DNA, 20 bp, Artificial Sequence
  Description of Artificial Sequence: Synthetic oligonucleotide
  Target: ATXN1; (-) strand; PAM type: YTN; PAM sequence: CTG
caaattagaatcccctggtg

SEQ ID NO: 163113 - DNA, 20 bp, Artificial Sequence
  Description of Artificial Sequence: Synthetic oligonucleotide
  Target: ATXN1; (-) strand; PAM type: YTN; PAM sequence: CTG
gctgcaaattagaatcccct

SEQ ID NO: 163114 - DNA, 20 bp, Artificial Sequence
  Description of Artificial Sequence: Synthetic oligonucleotide
  Target: ATXN1; (-) strand; PAM type: YTN; PAM sequence: CTC
tggctgcaaattagaatccc

SEQ ID NO: 163115 - DNA, 20 bp, Artificial Sequence
  Description of Artificial Sequence: Synthetic oligonucleotide
  Target: ATXN1; (-) strand; PAM type: YTN; PAM sequence: CTC
acctctggctgcaaattaga

SEQ ID NO: 163116 - DNA, 20 bp, Artificial Sequence
  Description of Artificial Sequence: Synthetic oligonucleotide
  Target: ATXN1; (-) strand; PAM type: YTN; PAM sequence: TTC
tcacctctggctgcaaatta

SEQ ID NO: 163117 - DNA, 20 bp, Artificial Sequence
  Description of Artificial Sequence: Synthetic oligonucleotide
  Target: ATXN1; (-) strand; PAM type: YTN; PAM sequence: CTA
taccagaggttctcacctct

SEQ ID NO: 163118 - DNA, 20 bp, Artificial Sequence
  Description of Artificial Sequence: Synthetic oligonucleotide
  Target: ATXN1; (-) strand; PAM type: YTN; PAM sequence: CTC
tataccagaggttctcacct

SEQ ID NO: 163119 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaaaaaaaaaa

SEQ ID NO: 163120 - DNA, 20 bp, Artificial Sequence
  Description of Artificial Sequence: Synthetic oligonucleotide
  Target: ATXN1; (-) strand; PAM type: YTN; PAM sequence: CTG
tctcaaaaaaaaaaaaaaaa

SEQ ID NO: 163121 - DNA, 20 bp, Artificial Sequence
  Description of Artificial Sequence: Synthetic oligonucleotide
  Target: ATXN1; (-) strand; PAM type: YTN; PAM sequence: CTC
tgtctcaaaaaaaaaaaaaa

SEQ ID NO: 163122 - DNA, 20 bp, Artificial Sequence
  Description of Artificial Sequence: Synthetic oligonucleotide
  Target: ATXN1; (-) strand; PAM type: YTN; PAM sequence: CTG
ggggacagagcgagactctg

SEQ ID NO: 163123 - DNA, 20 bp, Artificial Sequence
  Description of Artificial Sequence: Synthetic oligonucleotide
  Target: ATXN1; (-) strand; PAM type: YTN; PAM sequence: TTC
cagcctgggggacagagcga

SEQ ID NO: 163124 - DNA, 20 bp, Artificial Sequence
  Description of Artificial Sequence: Synthetic oligonucleotide
  Target: ATXN1; (-) strand; PAM type: YTN; PAM sequence: CTG
cattccagcctgggggacag

SEQ ID NO: 163125 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatcacgcc

SEQ ID NO: 163126 - DNA, 20 bp, Artificial Sequence
  Description of Artificial Sequence: Synthetic oligonucleotide
  Target: ATXN1; (-) strand; PAM type: YTN; PAM sequence: CTT
gcagtgagccgagatcacgc

SEQ ID NO: 163127 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatggtgtgaa

SEQ ID NO: 163128 - DNA, 20 bp, Artificial Sequence
  Description of Artificial Sequence: Synthetic oligonucleotide
  Target: ATXN1; (-) strand; PAM type: YTN; PAM sequence: CTC
gggaggctgaggcaggagaa

SEQ ID NO: 163129 - DNA, 20 bp, Artificial Sequence
  Description of Artificial Sequence: Synthetic oligonucleotide
  Target: ATXN1; (-) strand; PAM type: YTN; PAM sequence: CTG
tagtcccagccactcgggag

SEQ ID NO: 163130 - DNA, 20 bp, Artificial Sequence
  Description of Artificial Sequence: Synthetic oligonucleotide
  Target: ATXN1; (-) strand; PAM type: YTN; PAM sequence: TTA
gccaggcgtggtggtgggtg

SEQ ID NO: 163131 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaaaattagcc

SEQ ID NO: 163132 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaaaatta

SEQ ID NO: 163133 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaaaat

SEQ ID NO: 163134 - DNA, 20 bp, Artificial Sequence
  Description of Artificial Sequence: Synthetic oligonucleotide
  Target: ATXN1; (-) strand; PAM type: YTN; PAM sequence: CTA
acacggtgaaaccccatctc

SEQ ID NO: 163135 - DNA, 20 bp, Artificial Sequence
  Description of Artificial Sequence: Synthetic oligonucleotide
  Target: ATXN1; (-) strand; PAM type: YTN; PAM sequence: CTG
gctaacacggtgaaacccca

SEQ ID NO: 163136 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggcaggcagat

SEQ ID NO: 163137 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggcaggcaga

SEQ ID NO: 163138 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggcaggcag

SEQ ID NO: 163139 - DNA, 20 bp, Artificial Sequence
  Description of Artificial Sequence: Synthetic oligonucleotide
  Target: ATXN1; (-) strand; PAM type: YTN; PAM sequence: CTA
taatcccagtactttgggag

SEQ ID NO: 163140 - DNA, 20 bp, Artificial Sequence
  Description of Artificial Sequence: Synthetic oligonucleotide
  Target: ATXN1; (-) strand; PAM type: YTN; PAM sequence: CTC
acgcctataatcccagtact

SEQ ID NO: 163141 - DNA, 20 bp, Artificial Sequence
  Description of Artificial Sequence: Synthetic oligonucleotide
  Target: ATXN1; (-) strand; PAM type: YTN; PAM sequence: CTA
taccagccgggtgcggtggc

SEQ ID NO: 163142 - DNA, 20 bp, Artificial Sequence
  Description of Artificial Sequence: Synthetic oligonucleotide
  Target: ATXN1; (-) strand; PAM type: YTN; PAM sequence: CTC
tataccagccgggtgcggtg

SEQ ID NO: 163143 - DNA, 20 bp, Artificial Sequence
  Description of Artificial Sequence: Synthetic oligonucleotide
  Target: ATXN1; (-) strand; PAM type: YTN; PAM sequence: TTA
aagatcctctataccagccg

SEQ ID NO: 163144 - DNA, 20 bp, Artificial Sequence
  Description of Artificial Sequence: Synthetic oligonucleotide
  Target: ATXN1; (-) strand; PAM type: YTN; PAM sequence: CTT
aaagatcctctataccagcc

SEQ ID NO: 163145 - DNA, 20 bp, Artificial Sequence
  Description of Artificial Sequence: Synthetic oligonucleotide
  Target: ATXN1; (-) strand; PAM type: YTN; PAM sequence: TTA
gggggcttaaagatcctcta

SEQ ID NO: 163146 - DNA, 20 bp, Artificial Sequence
  Description of Artificial Sequence: Synthetic oligonucleotide
  Target: ATXN1; (-) strand; PAM type: YTN; PAM sequence: CTG
ccaaggacagatggagttag

SEQ ID NO: 163147 - DNA, 20 bp, Artificial Sequence
  Description of Artificial Sequence: Synthetic oligonucleotide
  Target: ATXN1; (-) strand; PAM type: YTN; PAM sequence: CTG
agacatactgccaaggacag

SEQ ID NO: 163148 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaaaaaaaaaa

SEQ ID NO: 163149 - DNA, 20 bp, Artificial Sequence
  Description of Artificial Sequence: Synthetic oligonucleotide
  Target: ATXN1; (-) strand; PAM type: YTN; PAM sequence: CTC
cgtctcaaaaaaaaaaaaaa

SEQ ID NO: 163150 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagcgagactccg

SEQ ID NO: 163151 - DNA, 20 bp, Artificial Sequence
  Description of Artificial Sequence: Synthetic oligonucleotide
  Target: ATXN1; (-) strand; PAM type: YTN; PAM sequence: TTG
cacaccagcctgggtgacag

SEQ ID NO: 163152 - DNA, 20 bp, Artificial Sequence
  Description of Artificial Sequence: Synthetic oligonucleotide
  Target: ATXN1; (-) strand; PAM type: YTN; PAM sequence: CTG
cacccattgcacaccagcct

SEQ ID NO: 163153 - DNA, 20 bp, Artificial Sequence
  Description of Artificial Sequence: Synthetic oligonucleotide
  Target: ATXN1; (-) strand; PAM type: YTN; PAM sequence: CTG
ggaggtgcagtgagccgaga

SEQ ID NO: 163154 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggtgcagtgag

SEQ ID NO: 163155 - DNA, 20 bp, Artificial Sequence
  Description of Artificial Sequence: Synthetic oligonucleotide
  Target: ATXN1; (-) strand; PAM type: YTN; PAM sequence: CTT
gaacctgggaggtgcagtga

SEQ ID NO: 163156 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcacttgaa

SEQ ID NO: 163157 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggagaat

SEQ ID NO: 163158 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggagaa

SEQ ID NO: 163159 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcagga

SEQ ID NO: 163160 - DNA, 20 bp, Artificial Sequence
  Description of Artificial Sequence: Synthetic oligonucleotide
  Target: ATXN1; (-) strand; PAM type: YTN; PAM sequence: CTG
taatcccaactacttgggag

SEQ ID NO: 163161 - DNA, 20 bp, Artificial Sequence
  Description of Artificial Sequence: Synthetic oligonucleotide
  Target: ATXN1; (-) strand; PAM type: YTN; PAM sequence: CTA
ccaaaaataaaaataaaaat

SEQ ID NO: 163162 - DNA, 20 bp, Artificial Sequence
  Description of Artificial Sequence: Synthetic oligonucleotide
  Target: ATXN1; (-) strand; PAM type: YTN; PAM sequence: CTC
taccaaaaataaaaataaaa

SEQ ID NO: 163163 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtaaaaccccg

SEQ ID NO: 163164 - DNA, 20 bp, Artificial Sequence
  Description of Artificial Sequence: Synthetic oligonucleotide
  Target: ATXN1; (-) strand; PAM type: YTN; PAM sequence: TTG
agaccagcctggccaacatg

SEQ ID NO: 163165 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctggccaacat

SEQ ID NO: 163166 - DNA, 20 bp, Artificial Sequence
  Description of Artificial Sequence: Synthetic oligonucleotide
  Target: ATXN1; (-) strand; PAM type: YTN; PAM sequence: CTC
aggtcaggagtttgagacca

SEQ ID NO: 163167 - DNA, 20 bp, Artificial Sequence
  Description of Artificial Sequence: Synthetic oligonucleotide
  Target: ATXN1; (-) strand; PAM type: YTN; PAM sequence: TTG
ggaggccaaggtaggtggat

SEQ ID NO: 163168 - DNA, 20 bp, Artificial Sequence
  Description of Artificial Sequence: Synthetic oligonucleotide
  Target: ATXN1; (-) strand; PAM type: YTN; PAM sequence: CTG
taatcccagcacgttgggag

SEQ ID NO: 163169 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcccagcacg

SEQ ID NO: 163170 - DNA, 20 bp, Artificial Sequence
  Description of Artificial Sequence: Synthetic oligonucleotide
  Target: ATXN1; (-) strand; PAM type: YTN; PAM sequence: CTC
agtggctcacgcctgtaatc

SEQ ID NO: 163171 - DNA, 20 bp, Artificial Sequence
  Description of Artificial Sequence: Synthetic oligonucleotide
  Target: ATXN1; (-) strand; PAM type: YTN; PAM sequence: CTG
agacaggccgggctcagtgg

SEQ ID NO: 163172 - DNA, 20 bp, Artificial Sequence
  Description of Artificial Sequence: Synthetic oligonucleotide
  Target: ATXN1; (-) strand; PAM type: YTN; PAM sequence: TTA
aaatcactgagacaggccgg

SEQ ID NO: 163173 - DNA, 20 bp, Artificial Sequence
  Description of Artificial Sequence: Synthetic oligonucleotide
  Target: ATXN1; (-) strand; PAM type: YTN; PAM sequence: CTG
taattaaaatcactgagaca

SEQ ID NO: 163174 - DNA, 20 bp, Artificial Sequence
  Description of Artificial Sequence: Synthetic oligonucleotide
  Target: ATXN1; (-) strand; PAM type: YTN; PAM sequence: CTG
ctgtaattaaaatcactgag

SEQ ID NO: 163175 - DNA, 20 bp, Artificial Sequence
  Description of Artificial Sequence: Synthetic oligonucleotide
  Target: ATXN1; (-) strand; PAM type: YTN; PAM sequence: TTG
gctgctgtaattaaaatcac

SEQ ID NO: 163176 - DNA, 20 bp, Artificial Sequence
  Description of Artificial Sequence: Synthetic oligonucleotide
  Target: ATXN1; (-) strand; PAM type: YTN; PAM sequence: TTG
gcaaagtggggaaaaggatt

SEQ ID NO: 163177 - DNA, 20 bp, Artificial Sequence
  Description of Artificial Sequence: Synthetic oligonucleotide
  Target: ATXN1; (-) strand; PAM type: YTN; PAM sequence: TTG
tgttggcaaagtggggaaaa

SEQ ID NO: 163178 - DNA, 20 bp, Artificial Sequence
  Description of Artificial Sequence: Synthetic oligonucleotide
  Target: ATXN1; (-) strand; PAM type: YTN; PAM sequence: TTT
gtgttggcaaagtggggaaa

SEQ ID NO: 163179 - DNA, 20 bp, Artificial Sequence
  Description of Artificial Sequence: Synthetic oligonucleotide
  Target: ATXN1; (-) strand; PAM type: YTN; PAM sequence: TTT
tgtgttggcaaagtggggaa

SEQ ID NO: 163180 - DNA, 20 bp, Artificial Sequence
  Description of Artificial Sequence: Synthetic oligonucleotide
  Target: ATXN1; (-) strand; PAM type: YTN; PAM sequence: CTT
ttgtgttggcaaagtgggga

SEQ ID NO: 163181 - DNA, 20 bp, Artificial Sequence
  Description of Artificial Sequence: Synthetic oligonucleotide
  Target: ATXN1; (-) strand; PAM type: YTN; PAM sequence: TTA
gaacacgacttttgtgttgg

SEQ ID NO: 163182 - DNA, 20 bp, Artificial Sequence
  Description of Artificial Sequence: Synthetic oligonucleotide
  Target: ATXN1; (-) strand; PAM type: YTN; PAM sequence: TTA
aaggaggttagaacacgact

SEQ ID NO: 163183 - DNA, 20 bp, Artificial Sequence
  Description of Artificial Sequence: Synthetic oligonucleotide
  Target: ATXN1; (-) strand; PAM type: YTN; PAM sequence: TTA
agtatgattaaaggaggtta

SEQ ID NO: 163184 - DNA, 20 bp, Artificial Sequence
  Description of Artificial Sequence: Synthetic oligonucleotide
  Target: ATXN1; (-) strand; PAM type: YTN; PAM sequence: TTT
aagtatgattaaaggaggtt

SEQ ID NO: 163185 - DNA, 20 bp, Artificial Sequence
  Description of Artificial Sequence: Synthetic oligonucleotide
  Target: ATXN1; (-) strand; PAM type: YTN; PAM sequence: TTT
taagtatgattaaaggaggt

SEQ ID NO: 163186 - DNA, 20 bp, Artificial Sequence
  Description of Artificial Sequence: Synthetic oligonucleotide
  Target: ATXN1; (-) strand; PAM type: YTN; PAM sequence: TTG
tggacatagcatataatttt

SEQ ID NO: 163187 - DNA, 20 bp, Artificial Sequence
  Description of Artificial Sequence: Synthetic oligonucleotide
  Target: ATXN1; (-) strand; PAM type: YTN; PAM sequence: CTC
attgtggacatagcatataa

SEQ ID NO: 163188 - DNA, 20 bp, Artificial Sequence
  Description of Artificial Sequence: Synthetic oligonucleotide
  Target: ATXN1; (-) strand; PAM type: YTN; PAM sequence: TTA
atgagtgtgaagtggtgtct

SEQ ID NO: 163189 - DNA, 20 bp, Artificial Sequence
  Description of Artificial Sequence: Synthetic oligonucleotide
  Target: ATXN1; (-) strand; PAM type: YTN; PAM sequence: CTT
aatgagtgtgaagtggtgtc

SEQ ID NO: 163190 - DNA, 20 bp, Artificial Sequence
  Description of Artificial Sequence: Synthetic oligonucleotide
  Target: ATXN1; (-) strand; PAM type: YTN; PAM sequence: TTA
aaaaaaagaatataatgtcc

SEQ ID NO: 163191 - DNA, 20 bp, Artificial Sequence
  Description of Artificial Sequence: Synthetic oligonucleotide
  Target: ATXN1; (-) strand; PAM type: YTN; PAM sequence: TTT
aaaaaaaagaatataatgtc

SEQ ID NO: 163192 - DNA, 20 bp, Artificial Sequence
  Description of Artificial Sequence: Synthetic oligonucleotide
  Target: ATXN1; (-) strand; PAM type: YTN; PAM sequence: TTT
taaaaaaaagaatataatgt

SEQ ID NO: 163193 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaaaagaatataatg

SEQ ID NO: 163194 - DNA, 20 bp, Artificial Sequence
  Description of Artificial Sequence: Synthetic oligonucleotide
  Target: ATXN1; (-) strand; PAM type: YTN; PAM sequence: TTT
tttaaaaaaaagaatataat

SEQ ID NO: 163195 - DNA, 20 bp, Artificial Sequence
  Description of Artificial Sequence: Synthetic oligonucleotide
  Target: ATXN1; (-) strand; PAM type: YTN; PAM sequence: TTT
ttttaaaaaaaagaatataa

SEQ ID NO: 163196 - DNA, 20 bp, Artificial Sequence
  Description of Artificial Sequence: Synthetic oligonucleotide
  Target: ATXN1; (-) strand; PAM type: YTN; PAM sequence: TTT
tttttaaaaaaaagaatata

SEQ ID NO: 163197 - DNA, 20 bp, Artificial Sequence
  Description of Artificial Sequence: Synthetic oligonucleotide
  Target: ATXN1; (-) strand; PAM type: YTN; PAM sequence: TTT
ttttttaaaaaaaagaatat

SEQ ID NO: 163198 - DNA, 20 bp, Artificial Sequence
  Description of Artificial Sequence: Synthetic oligonucleotide
  Target: ATXN1; (-) strand; PAM type: YTN; PAM sequence: TTT
tttttttaaaaaaaagaata

SEQ ID NO: 163199 - DNA, 20 bp, Artificial Sequence
  Description of Artificial Sequence: Synthetic oligonucleotide
  Target: ATXN1; (-) strand; PAM type: YTN; PAM sequence: TTT
ttttttttaaaaaaaagaat

SEQ ID NO: 163200 - DNA, 20 bp, Artificial Sequence
  Description of Artificial Sequence: Synthetic oligonucleotide
  Target: ATXN1; (-) strand; PAM type: YTN; PAM sequence: TTG
tttttttttttaaaaaaaag

SEQ ID NO: 163201 - DNA, 20 bp, Artificial Sequence
  Description of Artificial Sequence: Synthetic oligonucleotide
  Target: ATXN1; (-) strand; PAM type: YTN; PAM sequence: TTT
gtttttttttttaaaaaaaa

SEQ ID NO: 163202 - DNA, 20 bp, Artificial Sequence
  Description of Artificial Sequence: Synthetic oligonucleotide
  Target: ATXN1; (-) strand; PAM type: YTN; PAM sequence: TTT
tgtttttttttttaaaaaaa

SEQ ID NO: 163203 - DNA, 20 bp, Artificial Sequence
  Description of Artificial Sequence: Synthetic oligonucleotide
  Target: ATXN1; (-) strand; PAM type: YTN; PAM sequence: TTG
ttttgtttttttttttaaaa

SEQ ID NO: 163204 - DNA, 20 bp, Artificial Sequence
  Description of Artificial Sequence: Synthetic oligonucleotide
  Target: ATXN1; (-) strand; PAM type: YTN; PAM sequence: TTT
gttttgtttttttttttaaa

SEQ ID NO: 163205 - DNA, 20 bp, Artificial Sequence
  Description of Artificial Sequence: Synthetic oligonucleotide
  Target: ATXN1; (-) strand; PAM type: YTN; PAM sequence: TTT
tgttttgtttttttttttaa

SEQ ID NO: 163206 - DNA, 20 bp, Artificial Sequence
  Description of Artificial Sequence: Synthetic oligonucleotide
  Target: ATXN1; (-) strand; PAM type: YTN; PAM sequence: TTT
ttgttttgttttttttttta

SEQ ID NO: 163207 - DNA, 20 bp, Artificial Sequence
  Description of Artificial Sequence: Synthetic oligonucleotide
  Target: ATXN1; (-) strand; PAM type: YTN; PAM sequence: TTC
catttttgttttgttttttt

SEQ ID NO: 163208 - DNA, 20 bp, Artificial Sequence
  Description of Artificial Sequence: Synthetic oligonucleotide
  Target: ATXN1; (-) strand; PAM type: YTN; PAM sequence: TTT
ccatttttgttttgtttttt

SEQ ID NO: 163209 - DNA, 20 bp, Artificial Sequence
  Description of Artificial Sequence: Synthetic oligonucleotide
  Target: ATXN1; (-) strand; PAM type: YTN; PAM sequence: TTT
tccatttttgttttgttttt

SEQ ID NO: 163210 - DNA, 20 bp, Artificial Sequence
  Description of Artificial Sequence: Synthetic oligonucleotide
  Target: ATXN1; (-) strand; PAM type: YTN; PAM sequence: CTA
ttttccatttttgttttgtt

SEQ ID NO: 163211 - DNA, 20 bp, Artificial Sequence
  Description of Artificial Sequence: Synthetic oligonucleotide
  Target: ATXN1; (-) strand; PAM type: YTN; PAM sequence: TTG
ctattttccatttttgtttt

SEQ ID NO: 163212 - DNA, 20 bp, Artificial Sequence
  Description of Artificial Sequence: Synthetic oligonucleotide
  Target: ATXN1; (-) strand; PAM type: YTN; PAM sequence: CTT
gctattttccatttttgttt

SEQ ID NO: 163213 - DNA, 20 bp, Artificial Sequence
  Description of Artificial Sequence: Synthetic oligonucleotide
  Target: ATXN1; (-) strand; PAM type: YTN; PAM sequence: CTC
caccaacacttgctattttc

SEQ ID NO: 163214 - DNA, 20 bp, Artificial Sequence
  Description of Artificial Sequence: Synthetic oligonucleotide
  Target: ATXN1; (-) strand; PAM type: YTN; PAM sequence: TTC
cccatctccaccaacacttg

SEQ ID NO: 163215 - DNA, 20 bp, Artificial Sequence
  Description of Artificial Sequence: Synthetic oligonucleotide
  Target: ATXN1; (-) strand; PAM type: YTN; PAM sequence: TTT
ccccatctccaccaacactt

SEQ ID NO: 163216 - DNA, 20 bp, Artificial Sequence
  Description of Artificial Sequence: Synthetic oligonucleotide
  Target: ATXN1; (-) strand; PAM type: YTN; PAM sequence: CTC
gtttccccatctccaccaac

SEQ ID NO: 163217 - DNA, 20 bp, Artificial Sequence
  Description of Artificial Sequence: Synthetic oligonucleotide
  Target: ATXN1; (-) strand; PAM type: YTN; PAM sequence: TTC
tcgtttccccatctccacca

SEQ ID NO: 163218 - DNA, 20 bp, Artificial Sequence
  Description of Artificial Sequence: Synthetic oligonucleotide
  Target: ATXN1; (-) strand; PAM type: YTN; PAM sequence: TTC
ccaccaacgatgcacatagg

SEQ ID NO: 163219 - DNA, 20 bp, Artificial Sequence
  Description of Artificial Sequence: Synthetic oligonucleotide
  Target: ATXN1; (-) strand; PAM type: YTN; PAM sequence: TTA
cgttcccaccaacgatgcac

SEQ ID NO: 163220 - DNA, 20 bp, Artificial Sequence
  Description of Artificial Sequence: Synthetic oligonucleotide
  Target: ATXN1; (-) strand; PAM type: YTN; PAM sequence: TTT
acgttcccaccaacgatgca

SEQ ID NO: 163221 - DNA, 20 bp, Artificial Sequence
  Description of Artificial Sequence: Synthetic oligonucleotide
  Target: ATXN1; (-) strand; PAM type: YTN; PAM sequence: TTT
tacgttcccaccaacgatgc

SEQ ID NO: 163222 - DNA, 20 bp, Artificial Sequence
  Description of Artificial Sequence: Synthetic oligonucleotide
  Target: ATXN1; (-) strand; PAM type: YTN; PAM sequence: CTG
catcattttacgttcccacc

SEQ ID NO: 163223 - DNA, 20 bp, Artificial Sequence
  Description of Artificial Sequence: Synthetic oligonucleotide
  Target: ATXN1; (-) strand; PAM type: YTN; PAM sequence: TTC
catgcagctgcatcatttta

SEQ ID NO: 163224 - DNA, 20 bp, Artificial Sequence
  Description of Artificial Sequence: Synthetic oligonucleotide
  Target: ATXN1; (-) strand; PAM type: YTN; PAM sequence: TTT
ccatgcagctgcatcatttt

SEQ ID NO: 163225 - DNA, 20 bp, Artificial Sequence
  Description of Artificial Sequence: Synthetic oligonucleotide
  Target: ATXN1; (-) strand; PAM type: YTN; PAM sequence: TTT
tccatgcagctgcatcattt

SEQ ID NO: 163226 - DNA, 20 bp, Artificial Sequence
  Description of Artificial Sequence: Synthetic oligonucleotide
  Target: ATXN1; (-) strand; PAM type: YTN; PAM sequence: CTG
ccaaaatgttttccatgcag

SEQ ID NO: 163227 - DNA, 20 bp, Artificial Sequence
  Description of Artificial Sequence: Synthetic oligonucleotide
  Target: ATXN1; (-) strand; PAM type: YTN; PAM sequence: TTG
aggaactgccaaaatgtttt

SEQ ID NO: 163228 - DNA, 20 bp, Artificial Sequence
  Description of Artificial Sequence: Synthetic oligonucleotide
  Target: ATXN1; (-) strand; PAM type: YTN; PAM sequence: TTT
gaggaactgccaaaatgttt

SEQ ID NO: 163229 - DNA, 20 bp, Artificial Sequence
  Description of Artificial Sequence: Synthetic oligonucleotide
  Target: ATXN1; (-) strand; PAM type: YTN; PAM sequence: TTT
tgaggaactgccaaaatgtt

SEQ ID NO: 163230 - DNA, 20 bp, Artificial Sequence
  Description of Artificial Sequence: Synthetic oligonucleotide
  Target: ATXN1; (-) strand; PAM type: YTN; PAM sequence: TTC
acattttgaggaactgccaa

SEQ ID NO: 163231 - DNA, 20 bp, Artificial Sequence
  Description of Artificial Sequence: Synthetic oligonucleotide
  Target: ATXN1; (-) strand; PAM type: YTN; PAM sequence: TTT
cacattttgaggaactgcca

SEQ ID NO: 163232 - DNA, 20 bp, Artificial Sequence
  Description of Artificial Sequence: Synthetic oligonucleotide
  Target: ATXN1; (-) strand; PAM type: YTN; PAM sequence: CTG
tatttcacattttgaggaac

SEQ ID NO: 163233 - DNA, 20 bp, Artificial Sequence
  Description of Artificial Sequence: Synthetic oligonucleotide
  Target: ATXN1; (-) strand; PAM type: YTN; PAM sequence: TTC
tgtatttcacattttgagga

SEQ ID NO: 163234 - DNA, 20 bp, Artificial Sequence
  Description of Artificial Sequence: Synthetic oligonucleotide
  Target: ATXN1; (-) strand; PAM type: YTN; PAM sequence: CTG
agtcatgtggtaattctgta

SEQ ID NO: 163235 - DNA, 20 bp, Artificial Sequence
  Description of Artificial Sequence: Synthetic oligonucleotide
  Target: ATXN1; (-) strand; PAM type: YTN; PAM sequence: TTG
ctgagtcatgtggtaattct

SEQ ID NO: 163236 - DNA, 20 bp, Artificial Sequence
  Description of Artificial Sequence: Synthetic oligonucleotide
  Target: ATXN1; (-) strand; PAM type: YTN; PAM sequence: TTG
tggtagatatccagacgtgg

SEQ ID NO: 163237 - DNA, 20 bp, Artificial Sequence
  Description of Artificial Sequence: Synthetic oligonucleotide
  Target: ATXN1; (-) strand; PAM type: YTN; PAM sequence: TTT
gtggtagatatccagacgtg

SEQ ID NO: 163238 - DNA, 20 bp, Artificial Sequence
  Description of Artificial Sequence: Synthetic oligonucleotide
  Target: ATXN1; (-) strand; PAM type: YTN; PAM sequence: CTT
tgtggtagatatccagacgt

SEQ ID NO: 163239 - DNA, 20 bp, Artificial Sequence
  Description of Artificial Sequence: Synthetic oligonucleotide
  Target: ATXN1; (-) strand; PAM type: YTN; PAM sequence: TTC
agtgctttgtggtagatatc

SEQ ID NO: 163240 - DNA, 20 bp, Artificial Sequence
  Description of Artificial Sequence: Synthetic oligonucleotide
  Target: ATXN1; (-) strand; PAM type: YTN; PAM sequence: TTT
cagtgctttgtggtagatat

SEQ ID NO: 163241 - DNA, 20 bp, Artificial Sequence
  Description of Artificial Sequence: Synthetic oligonucleotide
  Target: ATXN1; (-) strand; PAM type: YTN; PAM sequence: CTT
tcagtgctttgtggtagata

SEQ ID NO: 163242 - DNA, 20 bp, Artificial Sequence
  Description of Artificial Sequence: Synthetic oligonucleotide
  Target: ATXN1; (-) strand; PAM type: YTN; PAM sequence: CTG
ctttcagtgctttgtggtag

SEQ ID NO: 163243 - DNA, 20 bp, Artificial Sequence
  Description of Artificial Sequence: Synthetic oligonucleotide
  Target: ATXN1; (-) strand; PAM type: YTN; PAM sequence: CTG
agtccctgctttcagtgctt

SEQ ID NO: 163244 - DNA, 20 bp, Artificial Sequence
  Description of Artificial Sequence: Synthetic oligonucleotide
  Target: ATXN1; (-) strand; PAM type: YTN; PAM sequence: CTA
tgaacacgggtgtggaatat

SEQ ID NO: 163245 - DNA, 20 bp, Artificial Sequence
  Description of Artificial Sequence: Synthetic oligonucleotide
  Target: ATXN1; (-) strand; PAM type: YTN; PAM sequence: CTG
ctatgaacacgggtgtggaa

SEQ ID NO: 163246 - DNA, 20 bp, Artificial Sequence
  Description of Artificial Sequence: Synthetic oligonucleotide
  Target: ATXN1; (-) strand; PAM type: YTN; PAM sequence: CTC
gtgtgcacaatgctgctatg

SEQ ID NO: 163247 - DNA, 20 bp, Artificial Sequence
  Description of Artificial Sequence: Synthetic oligonucleotide
  Target: ATXN1; (-) strand; PAM type: YTN; PAM sequence: TTG
gctcgtgtgcacaatgctgc

SEQ ID NO: 163248 - DNA, 20 bp, Artificial Sequence
  Description of Artificial Sequence: Synthetic oligonucleotide
  Target: ATXN1; (-) strand; PAM type: YTN; PAM sequence: TTT
ggctcgtgtgcacaatgctg

SEQ ID NO: 163249 - DNA, 20 bp, Artificial Sequence
  Description of Artificial Sequence: Synthetic oligonucleotide
  Target: ATXN1; (-) strand; PAM type: YTN; PAM sequence: TTT
tggctcgtgtgcacaatgct

SEQ ID NO: 163250 - DNA, 20 bp, Artificial Sequence
  Description of Artificial Sequence: Synthetic oligonucleotide
  Target: ATXN1; (-) strand; PAM type: YTN; PAM sequence: CTT
ttggctcgtgtgcacaatgc

SEQ ID NO: 163251 - DNA, 20 bp, Artificial Sequence
  Description of Artificial Sequence: Synthetic oligonucleotide
  Target: ATXN1; (-) strand; PAM type: YTN; PAM sequence: TTG
acaccttttggctcgtgtgc

SEQ ID NO: 163252 - DNA, 20 bp, Artificial Sequence
  Description of Artificial Sequence: Synthetic oligonucleotide
  Target: ATXN1; (-) strand; PAM type: YTN; PAM sequence: TTG
ttgacaccttttggctcgtg

SEQ ID NO: 163253 - DNA, 20 bp, Artificial Sequence
  Description of Artificial Sequence: Synthetic oligonucleotide
  Target: ATXN1; (-) strand; PAM type: YTN; PAM sequence: TTG
ggttgttgacaccttttggc

SEQ ID NO: 163254 - DNA, 20 bp, Artificial Sequence
  Description of Artificial Sequence: Synthetic oligonucleotide
  Target: ATXN1; (-) strand; PAM type: YTN; PAM sequence: TTG
atgatcattgggttgttgac

SEQ ID NO: 163255 - DNA, 20 bp, Artificial Sequence
  Description of Artificial Sequence: Synthetic oligonucleotide
  Target: ATXN1; (-) strand; PAM type: YTN; PAM sequence: CTG
ttgatgatcattgggttgtt

SEQ ID NO: 163256 - DNA, 20 bp, Artificial Sequence
  Description of Artificial Sequence: Synthetic oligonucleotide
  Target: ATXN1; (-) strand; PAM type: YTN; PAM sequence: TTC
atctgttgatgatcattggg

SEQ ID NO: 163257 - DNA, 20 bp, Artificial Sequence
  Description of Artificial Sequence: Synthetic oligonucleotide
  Target: ATXN1; (-) strand; PAM type: YTN; PAM sequence: TTA
ttcatctgttgatgatcatt

SEQ ID NO: 163258 - DNA, 20 bp, Artificial Sequence
  Description of Artificial Sequence: Synthetic oligonucleotide
  Target: ATXN1; (-) strand; PAM type: YTN; PAM sequence: TTT
attcatctgttgatgatcat

SEQ ID NO: 163259 - DNA, 20 bp, Artificial Sequence
  Description of Artificial Sequence: Synthetic oligonucleotide
  Target: ATXN1; (-) strand; PAM type: YTN; PAM sequence: TTA
aagtttattcatctgttgat

SEQ ID NO: 163260 - DNA, 20 bp, Artificial Sequence
  Description of Artificial Sequence: Synthetic oligonucleotide
  Target: ATXN1; (-) strand; PAM type: YTN; PAM sequence: TTT
aaagtttattcatctgttga

SEQ ID NO: 163261 - DNA, 20 bp, Artificial Sequence
  Description of Artificial Sequence: Synthetic oligonucleotide
  Target: ATXN1; (-) strand; PAM type: YTN; PAM sequence: TTT
taaagtttattcatctgttg

SEQ ID NO: 163262 - DNA, 20 bp, Artificial Sequence
  Description of Artificial Sequence: Synthetic oligonucleotide
  Target: ATXN1; (-) strand; PAM type: YTN; PAM sequence: TTT
ttaaagtttattcatctgtt

SEQ ID NO: 163263 - DNA, 20 bp, Artificial Sequence
  Description of Artificial Sequence: Synthetic oligonucleotide
  Target: ATXN1; (-) strand; PAM type: YTN; PAM sequence: CTC
gtcataaggatataccacat

SEQ ID NO: 163264 - DNA, 20 bp, Artificial Sequence
  Description of Artificial Sequence: Synthetic oligonucleotide
  Target: ATXN1; (-) strand; PAM type: YTN; PAM sequence: TTG
taaggagagggggatgaata

SEQ ID NO: 163265 - DNA, 20 bp, Artificial Sequence
  Description of Artificial Sequence: Synthetic oligonucleotide
  Target: ATXN1; (-) strand; PAM type: YTN; PAM sequence: TTT
gtaaggagagggggatgaat

SEQ ID NO: 163266 - DNA, 20 bp, Artificial Sequence
  Description of Artificial Sequence: Synthetic oligonucleotide
  Target: ATXN1; (-) strand; PAM type: YTN; PAM sequence: CTT
tgtaaggagagggggatgaa

SEQ ID NO: 163267 - DNA, 20 bp, Artificial Sequence
  Description of Artificial Sequence: Synthetic oligonucleotide
  Target: ATXN1; (-) strand; PAM type: YTN; PAM sequence: TTC
ctttgtaaggagagggggat

SEQ ID NO: 163268 - DNA, 20 bp, Artificial Sequence
  Description of Artificial Sequence: Synthetic oligonucleotide
  Target: ATXN1; (-) strand; PAM type: YTN; PAM sequence: TTA
tcaatgtcatagcatgtaac

SEQ ID NO: 163269 - DNA, 20 bp, Artificial Sequence
  Description of Artificial Sequence: Synthetic oligonucleotide
  Target: ATXN1; (-) strand; PAM type: YTN; PAM sequence: TTT
atcaatgtcatagcatgtaa

SEQ ID NO: 163270 - DNA, 20 bp, Artificial Sequence
  Description of Artificial Sequence: Synthetic oligonucleotide
  Target: ATXN1; (-) strand; PAM type: YTN; PAM sequence: TTG
aagatttatcaatgtcatag

SEQ ID NO: 163271 - DNA, 20 bp, Artificial Sequence
  Description of Artificial Sequence: Synthetic oligonucleotide
  Target: ATXN1; (-) strand; PAM type: YTN; PAM sequence: TTT
gaagatttatcaatgtcata

SEQ ID NO: 163272 - DNA, 20 bp, Artificial Sequence
  Description of Artificial Sequence: Synthetic oligonucleotide
  Target: ATXN1; (-) strand; PAM type: YTN; PAM sequence: TTA
gcataatgtttgaagattta

SEQ ID NO: 163273 - DNA, 20 bp, Artificial Sequence
  Description of Artificial Sequence: Synthetic oligonucleotide
  Target: ATXN1; (-) strand; PAM type: YTN; PAM sequence: CTT
agcataatgtttgaagattt

SEQ ID NO: 163274 - DNA, 20 bp, Artificial Sequence
  Description of Artificial Sequence: Synthetic oligonucleotide
  Target: ATXN1; (-) strand; PAM type: YTN; PAM sequence: TTC
acttagcataatgtttgaag

SEQ ID NO: 163275 - DNA, 20 bp, Artificial Sequence
  Description of Artificial Sequence: Synthetic oligonucleotide
  Target: ATXN1; (-) strand; PAM type: YTN; PAM sequence: TTT
cacttagcataatgtttgaa

SEQ ID NO: 163276 - DNA, 20 bp, Artificial Sequence
  Description of Artificial Sequence: Synthetic oligonucleotide
  Target: ATXN1; (-) strand; PAM type: YTN; PAM sequence: CTT
tcacttagcataatgtttga

SEQ ID NO: 163277 - DNA, 20 bp, Artificial Sequence
  Description of Artificial Sequence: Synthetic oligonucleotide
  Target: ATXN1; (-) strand; PAM type: YTN; PAM sequence: TTC
tttcacttagcataatgttt

SEQ ID NO: 163278 - DNA, 20 bp, Artificial Sequence
  Description of Artificial Sequence: Synthetic oligonucleotide
  Target: ATXN1; (-) strand; PAM type: YTN; PAM sequence: CTT
ctttcacttagcataatgtt

SEQ ID NO: 163279 - DNA, 20 bp, Artificial Sequence
  Description of Artificial Sequence: Synthetic oligonucleotide
  Target: ATXN1; (-) strand; PAM type: YTN; PAM sequence: CTG
gcttctttcacttagcataa

SEQ ID NO: 163280 - DNA, 20 bp, Artificial Sequence
  Description of Artificial Sequence: Synthetic oligonucleotide
  Target: ATXN1; (-) strand; PAM type: YTN; PAM sequence: TTG
tgtctggcttctttcactta

SEQ ID NO: 163281 - DNA, 20 bp, Artificial Sequence
  Description of Artificial Sequence: Synthetic oligonucleotide
  Target: ATXN1; (-) strand; PAM type: YTN; PAM sequence: TTT
gtgtctggcttctttcactt

SEQ ID NO: 163282 - DNA, 20 bp, Artificial Sequence
  Description of Artificial Sequence: Synthetic oligonucleotide
  Target: ATXN1; (-) strand; PAM type: YTN; PAM sequence: TTT
tgtgtctggcttctttcact

SEQ ID NO: 163283 - DNA, 20 bp, Artificial Sequence
  Description of Artificial Sequence: Synthetic oligonucleotide
  Target: ATXN1; (-) strand; PAM type: YTN; PAM sequence: CTT
ttgtgtctggcttctttcac

SEQ ID NO: 163284 - DNA, 20 bp, Artificial Sequence
  Description of Artificial Sequence: Synthetic oligonucleotide
  Target: ATXN1; (-) strand; PAM type: YTN; PAM sequence: TTC
ttttgtgtctggcttctttc

SEQ ID NO: 163285 - DNA, 20 bp, Artificial Sequence
  Description of Artificial Sequence: Synthetic oligonucleotide
  Target: ATXN1; (-) strand; PAM type: YTN; PAM sequence: TTG
ttcttttgtgtctggcttct

SEQ ID NO: 163286 - DNA, 20 bp, Artificial Sequence
  Description of Artificial Sequence: Synthetic oligonucleotide
  Target: ATXN1; (-) strand; PAM type: YTN; PAM sequence: CTC
atagaaggggaatcatatga

SEQ ID NO: 163287 - DNA, 20 bp, Artificial Sequence
  Description of Artificial Sequence: Synthetic oligonucleotide
  Target: ATXN1; (-) strand; PAM type: YTN; PAM sequence: TTC
ctcatagaaggggaatcata

SEQ ID NO: 163288 - DNA, 20 bp, Artificial Sequence
  Description of Artificial Sequence: Synthetic oligonucleotide
  Target: ATXN1; (-) strand; PAM type: YTN; PAM sequence: CTA
gattcctcatagaaggggaa

SEQ ID NO: 163289 - DNA, 20 bp, Artificial Sequence
  Description of Artificial Sequence: Synthetic oligonucleotide
  Target: ATXN1; (-) strand; PAM type: YTN; PAM sequence: TTC
tagattcctcatagaagggg

SEQ ID NO: 163290 - DNA, 20 bp, Artificial Sequence
  Description of Artificial Sequence: Synthetic oligonucleotide
  Target: ATXN1; (-) strand; PAM type: YTN; PAM sequence: CTA
ttctagattcctcatagaag

SEQ ID NO: 163291 - DNA, 20 bp, Artificial Sequence
  Description of Artificial Sequence: Synthetic oligonucleotide
  Target: ATXN1; (-) strand; PAM type: YTN; PAM sequence: TTG
actattctagattcctcata

SEQ ID NO: 163292 - DNA, 20 bp, Artificial Sequence
  Description of Artificial Sequence: Synthetic oligonucleotide
  Target: ATXN1; (-) strand; PAM type: YTN; PAM sequence: TTT
gactattctagattcctcat

SEQ ID NO: 163293 - DNA, 20 bp, Artificial Sequence
  Description of Artificial Sequence: Synthetic oligonucleotide
  Target: ATXN1; (-) strand; PAM type: YTN; PAM sequence: CTC
caaatttgactattctagat

SEQ ID NO: 163294 - DNA, 20 bp, Artificial Sequence
  Description of Artificial Sequence: Synthetic oligonucleotide
  Target: ATXN1; (-) strand; PAM type: YTN; PAM sequence: CTC
tccaaatttgactattctag

SEQ ID NO: 163295 - DNA, 20 bp, Artificial Sequence
  Description of Artificial Sequence: Synthetic oligonucleotide
  Target: ATXN1; (-) strand; PAM type: YTN; PAM sequence: CTC
tctccaaatttgactattct

SEQ ID NO: 163296 - DNA, 20 bp, Artificial Sequence
  Description of Artificial Sequence: Synthetic oligonucleotide
  Target: ATXN1; (-) strand; PAM type: YTN; PAM sequence: CTA
cgctctctccaaatttgact

SEQ ID NO: 163297 - DNA, 20 bp, Artificial Sequence
  Description of Artificial Sequence: Synthetic oligonucleotide
  Target: ATXN1; (-) strand; PAM type: YTN; PAM sequence: TTC
tacgctctctccaaatttga

SEQ ID NO: 163298 - DNA, 20 bp, Artificial Sequence
  Description of Artificial Sequence: Synthetic oligonucleotide
  Target: ATXN1; (-) strand; PAM type: YTN; PAM sequence: CTG
ttctacgctctctccaaatt

SEQ ID NO: 163299 - DNA, 20 bp, Artificial Sequence
  Description of Artificial Sequence: Synthetic oligonucleotide
  Target: ATXN1; (-) strand; PAM type: YTN; PAM sequence: CTA
acgcctgttctacgctctct

SEQ ID NO: 163300 - DNA, 20 bp, Artificial Sequence
  Description of Artificial Sequence: Synthetic oligonucleotide
  Target: ATXN1; (-) strand; PAM type: YTN; PAM sequence: CTG
ctaacgcctgttctacgctc

SEQ ID NO: 163301 - DNA, 20 bp, Artificial Sequence
  Description of Artificial Sequence: Synthetic oligonucleotide
  Target: ATXN1; (-) strand; PAM type: YTN; PAM sequence: CTC
ctgctaacgcctgttctacg

SEQ ID NO: 163302 - DNA, 20 bp, Artificial Sequence
  Description of Artificial Sequence: Synthetic oligonucleotide
  Target: ATXN1; (-) strand; PAM type: YTN; PAM sequence: CTC
ccagctcctgctaacgcctg

SEQ ID NO: 163303 - DNA, 20 bp, Artificial Sequence
  Description of Artificial Sequence: Synthetic oligonucleotide
  Target: ATXN1; (-) strand; PAM type: YTN; PAM sequence: TTG
ccccgtcctcccagctcctg

SEQ ID NO: 163304 - DNA, 20 bp, Artificial Sequence
  Description of Artificial Sequence: Synthetic oligonucleotide
  Target: ATXN1; (-) strand; PAM type: YTN; PAM sequence: CTC
ccattgccccgtcctcccag

SEQ ID NO: 163305 - DNA, 20 bp, Artificial Sequence
  Description of Artificial Sequence: Synthetic oligonucleotide
  Target: ATXN1; (-) strand; PAM type: YTN; PAM sequence: TTA
aacaactcccattgccccgt

SEQ ID NO: 163306 - DNA, 20 bp, Artificial Sequence
  Description of Artificial Sequence: Synthetic oligonucleotide
  Target: ATXN1; (-) strand; PAM type: YTN; PAM sequence: CTG
gaaccgttaaacaactccca

SEQ ID NO: 163307 - DNA, 20 bp, Artificial Sequence
  Description of Artificial Sequence: Synthetic oligonucleotide
  Target: ATXN1; (-) strand; PAM type: YTN; PAM sequence: TTC
tggaaccgttaaacaactcc

SEQ ID NO: 163308 - DNA, 20 bp, Artificial Sequence
  Description of Artificial Sequence: Synthetic oligonucleotide
  Target: ATXN1; (-) strand; PAM type: YTN; PAM sequence: CTG
aaattctggaaccgttaaac

SEQ ID NO: 163309 - DNA, 20 bp, Artificial Sequence
  Description of Artificial Sequence: Synthetic oligonucleotide
  Target: ATXN1; (-) strand; PAM type: YTN; PAM sequence: TTC
catcataccaaactgaaatt

SEQ ID NO: 163310 - DNA, 20 bp, Artificial Sequence
  Description of Artificial Sequence: Synthetic oligonucleotide
  Target: ATXN1; (-) strand; PAM type: YTN; PAM sequence: TTT
ccatcataccaaactgaaat

SEQ ID NO: 163311 - DNA, 20 bp, Artificial Sequence
  Description of Artificial Sequence: Synthetic oligonucleotide
  Target: ATXN1; (-) strand; PAM type: YTN; PAM sequence: CTC
cagaatgtttccatcatacc

SEQ ID NO: 163312 - DNA, 20 bp, Artificial Sequence
  Description of Artificial Sequence: Synthetic oligonucleotide
  Target: ATXN1; (-) strand; PAM type: YTN; PAM sequence: CTG
tctccagaatgtttccatca

SEQ ID NO: 163313 - DNA, 20 bp, Artificial Sequence
  Description of Artificial Sequence: Synthetic oligonucleotide
  Target: ATXN1; (-) strand; PAM type: YTN; PAM sequence: TTC
aaccatcaccaccatctgtc

SEQ ID NO: 163314 - DNA, 20 bp, Artificial Sequence
  Description of Artificial Sequence: Synthetic oligonucleotide
  Target: ATXN1; (-) strand; PAM type: YTN; PAM sequence: TTG
ttcaaccatcaccaccatct

SEQ ID NO: 163315 - DNA, 20 bp, Artificial Sequence
  Description of Artificial Sequence: Synthetic oligonucleotide
  Target: ATXN1; (-) strand; PAM type: YTN; PAM sequence: CTT
gttcaaccatcaccaccatc

SEQ ID NO: 163316 - DNA, 20 bp, Artificial Sequence
  Description of Artificial Sequence: Synthetic oligonucleotide
  Target: ATXN1; (-) strand; PAM type: YTN; PAM sequence: TTC
ttgttcaaccatcaccacca

SEQ ID NO: 163317 - DNA, 20 bp, Artificial Sequence
  Description of Artificial Sequence: Synthetic oligonucleotide
  Target: ATXN1; (-) strand; PAM type: YTN; PAM sequence: TTA
agtggcacattcttgttcaa

SEQ ID NO: 163318 - DNA, 20 bp, Artificial Sequence
  Description of Artificial Sequence: Synthetic oligonucleotide
  Target: ATXN1; (-) strand; PAM type: YTN; PAM sequence: TTA
cgtgcacggttaagtggcac

SEQ ID NO: 163319 - DNA, 20 bp, Artificial Sequence
  Description of Artificial Sequence: Synthetic oligonucleotide
  Target: ATXN1; (-) strand; PAM type: YTN; PAM sequence: TTT
acgtgcacggttaagtggca

SEQ ID NO: 163320 - DNA, 20 bp, Artificial Sequence
  Description of Artificial Sequence: Synthetic oligonucleotide
  Target: ATXN1; (-) strand; PAM type: YTN; PAM sequence: TTT
tacgtgcacggttaagtggc

SEQ ID NO: 163321 - DNA, 20 bp, Artificial Sequence
  Description of Artificial Sequence: Synthetic oligonucleotide
  Target: ATXN1; (-) strand; PAM type: YTN; PAM sequence: TTT
ttacgtgcacggttaagtgg

SEQ ID NO: 163322 - DNA, 20 bp, Artificial Sequence
  Description of Artificial Sequence: Synthetic oligonucleotide
  Target: ATXN1; (-) strand; PAM type: YTN; PAM sequence: TTA
atcatttttacgtgcacggt

SEQ ID NO: 163323 - DNA, 20 bp, Artificial Sequence
  Description of Artificial Sequence: Synthetic oligonucleotide
  Target: ATXN1; (-) strand; PAM type: YTN; PAM sequence: CTT
aatcatttttacgtgcacgg

SEQ ID NO: 163324 - DNA, 20 bp, Artificial Sequence
  Description of Artificial Sequence: Synthetic oligonucleotide
  Target: ATXN1; (-) strand; PAM type: YTN; PAM sequence: TTA
ccatcttaatcatttttacg

SEQ ID NO: 163325 - DNA, 20 bp, Artificial Sequence
  Description of Artificial Sequence: Synthetic oligonucleotide
  Target: ATXN1; (-) strand; PAM type: YTN; PAM sequence: TTT
accatcttaatcatttttac

SEQ ID NO: 163326 - DNA, 20 bp, Artificial Sequence
  Description of Artificial Sequence: Synthetic oligonucleotide
  Target: ATXN1; (-) strand; PAM type: YTN; PAM sequence: CTG
gtgacaaaatatgcataata

SEQ ID NO: 163327 - DNA, 20 bp, Artificial Sequence
  Description of Artificial Sequence: Synthetic oligonucleotide
  Target: ATXN1; (-) strand; PAM type: YTN; PAM sequence: TTG
actggtgacaaaatatgcat

SEQ ID NO: 163328 - DNA, 20 bp, Artificial Sequence
  Description of Artificial Sequence: Synthetic oligonucleotide
  Target: ATXN1; (-) strand; PAM type: YTN; PAM sequence: TTT
gactggtgacaaaatatgca

SEQ ID NO: 163329 - DNA, 20 bp, Artificial Sequence
  Description of Artificial Sequence: Synthetic oligonucleotide
  Target: ATXN1; (-) strand; PAM type: YTN; PAM sequence: TTT
tgactggtgacaaaatatgc

SEQ ID NO: 163330 - DNA, 20 bp, Artificial Sequence
  Description of Artificial Sequence: Synthetic oligonucleotide
  Target: ATXN1; (-) strand; PAM type: YTN; PAM sequence: TTT
ttgactggtgacaaaatatg

SEQ ID NO: 163331 - DNA, 20 bp, Artificial Sequence
  Description of Artificial Sequence: Synthetic oligonucleotide
  Target: ATXN1; (-) strand; PAM type: YTN; PAM sequence: TTA
aaaatttttgactggtgaca

SEQ ID NO: 163332 - DNA, 20 bp, Artificial Sequence
  Description of Artificial Sequence: Synthetic oligonucleotide
  Target: ATXN1; (-) strand; PAM type: YTN; PAM sequence: TTT
aaaaatttttgactggtgac

SEQ ID NO: 163333 - DNA, 20 bp, Artificial Sequence
  Description of Artificial Sequence: Synthetic oligonucleotide
  Target: ATXN1; (-) strand; PAM type: YTN; PAM sequence: TTT
taaaaatttttgactggtga

SEQ ID NO: 163334 - DNA, 20 bp, Artificial Sequence
  Description of Artificial Sequence: Synthetic oligonucleotide
  Target: ATXN1; (-) strand; PAM type: YTN; PAM sequence: TTT
ttaaaaatttttgactggtg

SEQ ID NO: 163335 - DNA, 20 bp, Artificial Sequence
  Description of Artificial Sequence: Synthetic oligonucleotide
  Target: ATXN1; (-) strand; PAM type: YTN; PAM sequence: TTA
tttttaaaaatttttgactg

SEQ ID NO: 163336 - DNA, 20 bp, Artificial Sequence
  Description of Artificial Sequence: Synthetic oligonucleotide
  Target: ATXN1; (-) strand; PAM type: YTN; PAM sequence: CTT
atttttaaaaatttttgact

SEQ ID NO: 163337 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaacgcgcc

SEQ ID NO: 163338 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccaa

SEQ ID NO: 163339 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 163340 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 163341 - DNA, 20 bp, Artificial Sequence
  Description of Artificial Sequence: Synthetic oligonucleotide
  Target: ATXN1; (-) strand; PAM type: YTN; PAM sequence: CTG
cgcgcctcagcctcccaaag

SEQ ID NO: 163342 - DNA, 20 bp, Artificial Sequence
  Description of Artificial Sequence: Synthetic oligonucleotide
  Target: ATXN1; (-) strand; PAM type: YTN; PAM sequence: TTG
tgatctgcgcgcctcagcct

SEQ ID NO: 163343 - DNA, 20 bp, Artificial Sequence
  Description of Artificial Sequence: Synthetic oligonucleotide
  Target: ATXN1; (-) strand; PAM type: YTN; PAM sequence: CTT
gtgatctgcgcgcctcagcc

SEQ ID NO: 163344 - DNA, 20 bp, Artificial Sequence
  Description of Artificial Sequence: Synthetic oligonucleotide
  Target: ATXN1; (-) strand; PAM type: YTN; PAM sequence: CTG
accttgtgatctgcgcgcct

SEQ ID NO: 163345 - DNA, 20 bp, Artificial Sequence
  Description of Artificial Sequence: Synthetic oligonucleotide
  Target: ATXN1; (-) strand; PAM type: YTN; PAM sequence: CTC
ctgaccttgtgatctgcgcg

SEQ ID NO: 163346 - DNA, 20 bp, Artificial Sequence
  Description of Artificial Sequence: Synthetic oligonucleotide
  Target: ATXN1; (-) strand; PAM type: YTN; PAM sequence: TTG
atctcctgaccttgtgatct

SEQ ID NO: 163347 - DNA, 20 bp, Artificial Sequence
  Description of Artificial Sequence: Synthetic oligonucleotide
  Target: ATXN1; (-) strand; PAM type: YTN; PAM sequence: CTT
gatctcctgaccttgtgatc

SEQ ID NO: 163348 - DNA, 20 bp, Artificial Sequence
  Description of Artificial Sequence: Synthetic oligonucleotide
  Target: ATXN1; (-) strand; PAM type: YTN; PAM sequence: TTA
gccaggatggtcttgatctc

SEQ ID NO: 163349 - DNA, 20 bp, Artificial Sequence
  Description of Artificial Sequence: Synthetic oligonucleotide
  Target: ATXN1; (-) strand; PAM type: YTN; PAM sequence: TTC
accgtgttagccaggatggt

SEQ ID NO: 163350 - DNA, 20 bp, Artificial Sequence
  Description of Artificial Sequence: Synthetic oligonucleotide
  Target: ATXN1; (-) strand; PAM type: YTN; PAM sequence: TTT
caccgtgttagccaggatgg

SEQ ID NO: 163351 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcaccg

SEQ ID NO: 163352 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcacc

SEQ ID NO: 163353 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagggtttcac

SEQ ID NO: 163354 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagggtttca

SEQ ID NO: 163355 - DNA, 20 bp, Artificial Sequence
  Description of Artificial Sequence: Synthetic oligonucleotide
  Target: ATXN1; (-) strand; PAM type: YTN; PAM sequence: TTT
tttagtagagacagggtttc

SEQ ID NO: 163356 - DNA, 20 bp, Artificial Sequence
  Description of Artificial Sequence: Synthetic oligonucleotide
  Target: ATXN1; (-) strand; PAM type: YTN; PAM sequence: CTA
ttttttagtagagacagggt

SEQ ID NO: 163357 - DNA, 20 bp, Artificial Sequence
  Description of Artificial Sequence: Synthetic oligonucleotide
  Target: ATXN1; (-) strand; PAM type: YTN; PAM sequence: TTC
tattttttagtagagacagg

SEQ ID NO: 163358 - DNA, 20 bp, Artificial Sequence
  Description of Artificial Sequence: Synthetic oligonucleotide
  Target: ATXN1; (-) strand; PAM type: YTN; PAM sequence: TTT
ctattttttagtagagacag

SEQ ID NO: 163359 - DNA, 20 bp, Artificial Sequence
  Description of Artificial Sequence: Synthetic oligonucleotide
  Target: ATXN1; (-) strand; PAM type: YTN; PAM sequence: TTT
tctattttttagtagagaca

SEQ ID NO: 163360 - DNA, 20 bp, Artificial Sequence
  Description of Artificial Sequence: Synthetic oligonucleotide
  Target: ATXN1; (-) strand; PAM type: YTN; PAM sequence: TTT
ttctattttttagtagagac

SEQ ID NO: 163361 - DNA, 20 bp, Artificial Sequence
  Description of Artificial Sequence: Synthetic oligonucleotide
  Target: ATXN1; (-) strand; PAM type: YTN; PAM sequence: TTT
tttctattttttagtagaga

SEQ ID NO: 163362 - DNA, 20 bp, Artificial Sequence
  Description of Artificial Sequence: Synthetic oligonucleotide
  Target: ATXN1; (-) strand; PAM type: YTN; PAM sequence: CTA
attttttctattttttagta

SEQ ID NO: 163363 - DNA, 20 bp, Artificial Sequence
  Description of Artificial Sequence: Synthetic oligonucleotide
  Target: ATXN1; (-) strand; PAM type: YTN; PAM sequence: CTA
cacgtgcccaccaccacgcc

SEQ ID NO: 163364 - DNA, 20 bp, Artificial Sequence
  Description of Artificial Sequence: Synthetic oligonucleotide
  Target: ATXN1; (-) strand; PAM type: YTN; PAM sequence: CTG
ggactacacgtgcccaccac

SEQ ID NO: 163365 - DNA, 20 bp, Artificial Sequence
  Description of Artificial Sequence: Synthetic oligonucleotide
  Target: ATXN1; (-) strand; PAM type: YTN; PAM sequence: CTC
gagtagctgggactacacgt

SEQ ID NO: 163366 - DNA, 20 bp, Artificial Sequence
  Description of Artificial Sequence: Synthetic oligonucleotide
  Target: ATXN1; (-) strand; PAM type: YTN; PAM sequence: CTC
tcgagtagctgggactacac

SEQ ID NO: 163367 - DNA, 20 bp, Artificial Sequence
  Description of Artificial Sequence: Synthetic oligonucleotide
  Target: ATXN1; (-) strand; PAM type: YTN; PAM sequence: CTC
agcctctcgagtagctggga

SEQ ID NO: 163368 - DNA, 20 bp, Artificial Sequence
  Description of Artificial Sequence: Synthetic oligonucleotide
  Target: ATXN1; (-) strand; PAM type: YTN; PAM sequence: CTG
tctcagcctctcgagtagct

SEQ ID NO: 163369 - DNA, 20 bp, Artificial Sequence
  Description of Artificial Sequence: Synthetic oligonucleotide
  Target: ATXN1; (-) strand; PAM type: YTN; PAM sequence: CTC
ctgtctcagcctctcgagta

SEQ ID NO: 163370 - DNA, 20 bp, Artificial Sequence
  Description of Artificial Sequence: Synthetic oligonucleotide
  Target: ATXN1; (-) strand; PAM type: YTN; PAM sequence: TTC
tcctgtctcagcctctcgag

SEQ ID NO: 163371 - DNA, 20 bp, Artificial Sequence
  Description of Artificial Sequence: Synthetic oligonucleotide
  Target: ATXN1; (-) strand; PAM type: YTN; PAM sequence: TTC
acgccattctcctgtctcag

SEQ ID NO: 163372 - DNA, 20 bp, Artificial Sequence
  Description of Artificial Sequence: Synthetic oligonucleotide
  Target: ATXN1; (-) strand; PAM type: YTN; PAM sequence: CTC
ccaggttcacgccattctcc

SEQ ID NO: 163373 - DNA, 20 bp, Artificial Sequence
  Description of Artificial Sequence: Synthetic oligonucleotide
  Target: ATXN1; (-) strand; PAM type: YTN; PAM sequence: CTG
cctcccaggttcacgccatt

SEQ ID NO: 163374 - DNA, 20 bp, Artificial Sequence
  Description of Artificial Sequence: Synthetic oligonucleotide
  Target: ATXN1; (-) strand; PAM type: YTN; PAM sequence: CTG
caagcctgcctcccaggttc

SEQ ID NO: 163375 - DNA, 20 bp, Artificial Sequence
  Description of Artificial Sequence: Synthetic oligonucleotide
  Target: ATXN1; (-) strand; PAM type: YTN; PAM sequence: CTC
actgcaagcctgcctcccag

SEQ ID NO: 163376 - DNA, 20 bp, Artificial Sequence
  Description of Artificial Sequence: Synthetic oligonucleotide
  Target: ATXN1; (-) strand; PAM type: YTN; PAM sequence: CTC
agctcactgcaagcctgcct

SEQ ID NO: 163377 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgcgatctc

SEQ ID NO: 163378 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggagtgcag

SEQ ID NO: 163379 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctggagtgc

SEQ ID NO: 163380 - DNA, 20 bp, Artificial Sequence
  Description of Artificial Sequence: Synthetic oligonucleotide
  Target: ATXN1; (-) strand; PAM type: YTN; PAM sequence: CTC
gctctgtcacccaggctgga

SEQ ID NO: 163381 - DNA, 20 bp, Artificial Sequence
  Description of Artificial Sequence: Synthetic oligonucleotide
  Target: ATXN1; (-) strand; PAM type: YTN; PAM sequence: TTG
agacagagtctcgctctgtc

SEQ ID NO: 163382 - DNA, 20 bp, Artificial Sequence
  Description of Artificial Sequence: Synthetic oligonucleotide
  Target: ATXN1; (-) strand; PAM type: YTN; PAM sequence: TTT
gagacagagtctcgctctgt

SEQ ID NO: 163383 - DNA, 20 bp, Artificial Sequence
  Description of Artificial Sequence: Synthetic oligonucleotide
  Target: ATXN1; (-) strand; PAM type: YTN; PAM sequence: TTA
tttgagacagagtctcgctc

SEQ ID NO: 163384 - DNA, 20 bp, Artificial Sequence
  Description of Artificial Sequence: Synthetic oligonucleotide
  Target: ATXN1; (-) strand; PAM type: YTN; PAM sequence: TTT
atttgagacagagtctcgct

SEQ ID NO: 163385 - DNA, 20 bp, Artificial Sequence
  Description of Artificial Sequence: Synthetic oligonucleotide
  Target: ATXN1; (-) strand; PAM type: YTN; PAM sequence: TTA
tttatttgagacagagtctc

SEQ ID NO: 163386 - DNA, 20 bp, Artificial Sequence
  Description of Artificial Sequence: Synthetic oligonucleotide
  Target: ATXN1; (-) strand; PAM type: YTN; PAM sequence: TTT
atttatttgagacagagtct

SEQ ID NO: 163387 - DNA, 20 bp, Artificial Sequence
  Description of Artificial Sequence: Synthetic oligonucleotide
  Target: ATXN1; (-) strand; PAM type: YTN; PAM sequence: TTA
tttatttatttgagacagag

SEQ ID NO: 163388 - DNA, 20 bp, Artificial Sequence
  Description of Artificial Sequence: Synthetic oligonucleotide
  Target: ATXN1; (-) strand; PAM type: YTN; PAM sequence: TTT
atttatttatttgagacaga

SEQ ID NO: 163389 - DNA, 20 bp, Artificial Sequence
  Description of Artificial Sequence: Synthetic oligonucleotide
  Target: ATXN1; (-) strand; PAM type: YTN; PAM sequence: TTA
tttatttatttatttgagac

SEQ ID NO: 163390 - DNA, 20 bp, Artificial Sequence
  Description of Artificial Sequence: Synthetic oligonucleotide
  Target: ATXN1; (-) strand; PAM type: YTN; PAM sequence: TTT
atttatttatttatttgaga

SEQ ID NO: 163391 - DNA, 20 bp, Artificial Sequence
  Description of Artificial Sequence: Synthetic oligonucleotide
  Target: ATXN1; (-) strand; PAM type: YTN; PAM sequence: TTA
agatcatgacatatttattt

SEQ ID NO: 163392 - DNA, 20 bp, Artificial Sequence
  Description of Artificial Sequence: Synthetic oligonucleotide
  Target: ATXN1; (-) strand; PAM type: YTN; PAM sequence: TTT
aagatcatgacatatttatt

SEQ ID NO: 163393 - DNA, 20 bp, Artificial Sequence
  Description of Artificial Sequence: Synthetic oligonucleotide
  Target: ATXN1; (-) strand; PAM type: YTN; PAM sequence: TTT
taagatcatgacatatttat

SEQ ID NO: 163394 - DNA, 20 bp, Artificial Sequence
  Description of Artificial Sequence: Synthetic oligonucleotide
  Target: ATXN1; (-) strand; PAM type: YTN; PAM sequence: CTT
ttaagatcatgacatattta

SEQ ID NO: 163395 - DNA, 20 bp, Artificial Sequence
  Description of Artificial Sequence: Synthetic oligonucleotide
  Target: ATXN1; (-) strand; PAM type: YTN; PAM sequence: TTC
acaaacttttaagatcatga

SEQ ID NO: 163396 - DNA, 20 bp, Artificial Sequence
  Description of Artificial Sequence: Synthetic oligonucleotide
  Target: ATXN1; (-) strand; PAM type: YTN; PAM sequence: TTG
ttcacaaacttttaagatca

SEQ ID NO: 163397 - DNA, 20 bp, Artificial Sequence
  Description of Artificial Sequence: Synthetic oligonucleotide
  Target: ATXN1; (-) strand; PAM type: YTN; PAM sequence: TTT
gttcacaaacttttaagatc

SEQ ID NO: 163398 - DNA, 20 bp, Artificial Sequence
  Description of Artificial Sequence: Synthetic oligonucleotide
  Target: ATXN1; (-) strand; PAM type: YTN; PAM sequence: TTC
aaaacagaaatgcagtttgt

SEQ ID NO: 163399 - DNA, 20 bp, Artificial Sequence
  Description of Artificial Sequence: Synthetic oligonucleotide
  Target: ATXN1; (-) strand; PAM type: YTN; PAM sequence: TTT
caaaacagaaatgcagtttg

SEQ ID NO: 163400 - DNA, 20 bp, Artificial Sequence
  Description of Artificial Sequence: Synthetic oligonucleotide
  Target: ATXN1; (-) strand; PAM type: YTN; PAM sequence: CTG
tgtggtttcaaaacagaaat

SEQ ID NO: 163401 - DNA, 20 bp, Artificial Sequence
  Description of Artificial Sequence: Synthetic oligonucleotide
  Target: ATXN1; (-) strand; PAM type: YTN; PAM sequence: CTC
caagcagatgagggagcggg

SEQ ID NO: 163402 - DNA, 20 bp, Artificial Sequence
  Description of Artificial Sequence: Synthetic oligonucleotide
  Target: ATXN1; (-) strand; PAM type: YTN; PAM sequence: TTG
tagctccaagcagatgaggg

SEQ ID NO: 163403 - DNA, 20 bp, Artificial Sequence
  Description of Artificial Sequence: Synthetic oligonucleotide
  Target: ATXN1; (-) strand; PAM type: YTN; PAM sequence: CTT
gtagctccaagcagatgagg

SEQ ID NO: 163404 - DNA, 20 bp, Artificial Sequence
  Description of Artificial Sequence: Synthetic oligonucleotide
  Target: ATXN1; (-) strand; PAM type: YTN; PAM sequence: CTC
agagatccttgtagctccaa

SEQ ID NO: 163405 - DNA, 20 bp, Artificial Sequence
  Description of Artificial Sequence: Synthetic oligonucleotide
  Target: ATXN1; (-) strand; PAM type: YTN; PAM sequence: CTA
atgccagcaggtatctcaga

SEQ ID NO: 163406 - DNA, 20 bp, Artificial Sequence
  Description of Artificial Sequence: Synthetic oligonucleotide
  Target: ATXN1; (-) strand; PAM type: YTN; PAM sequence: CTG
gaatacaggctaatgccagc

SEQ ID NO: 163407 - DNA, 20 bp, Artificial Sequence
  Description of Artificial Sequence: Synthetic oligonucleotide
  Target: ATXN1; (-) strand; PAM type: YTN; PAM sequence: CTG
acgtccagtcctggaataca

SEQ ID NO: 163408 - DNA, 20 bp, Artificial Sequence
  Description of Artificial Sequence: Synthetic oligonucleotide
  Target: ATXN1; (-) strand; PAM type: YTN; PAM sequence: TTA
aaggatgccctgacgtccag

SEQ ID NO: 163409 - DNA, 20 bp, Artificial Sequence
  Description of Artificial Sequence: Synthetic oligonucleotide
  Target: ATXN1; (-) strand; PAM type: YTN; PAM sequence: CTT
aaaggatgccctgacgtcca

SEQ ID NO: 163410 - DNA, 20 bp, Artificial Sequence
  Description of Artificial Sequence: Synthetic oligonucleotide
  Target: ATXN1; (-) strand; PAM type: YTN; PAM sequence: TTA
agggcttaaaggatgccctg

SEQ ID NO: 163411 - DNA, 20 bp, Artificial Sequence
  Description of Artificial Sequence: Synthetic oligonucleotide
  Target: ATXN1; (-) strand; PAM type: YTN; PAM sequence: TTT
aagggcttaaaggatgccct

SEQ ID NO: 163412 - DNA, 20 bp, Artificial Sequence
  Description of Artificial Sequence: Synthetic oligonucleotide
  Target: ATXN1; (-) strand; PAM type: YTN; PAM sequence: CTT
taagggcttaaaggatgccc

SEQ ID NO: 163413 - DNA, 20 bp, Artificial Sequence
  Description of Artificial Sequence: Synthetic oligonucleotide
  Target: ATXN1; (-) strand; PAM type: YTN; PAM sequence: TTG
cggatgtgagaaagggcata

SEQ ID NO: 163414 - DNA, 20 bp, Artificial Sequence
  Description of Artificial Sequence: Synthetic oligonucleotide
  Target: ATXN1; (-) strand; PAM type: YTN; PAM sequence: TTT
gcggatgtgagaaagggcat

SEQ ID NO: 163415 - DNA, 20 bp, Artificial Sequence
  Description of Artificial Sequence: Synthetic oligonucleotide
  Target: ATXN1; (-) strand; PAM type: YTN; PAM sequence: CTT
tgcggatgtgagaaagggca

SEQ ID NO: 163416 - DNA, 20 bp, Artificial Sequence
  Description of Artificial Sequence: Synthetic oligonucleotide
  Target: ATXN1; (-) strand; PAM type: YTN; PAM sequence: CTC
acagtcccctttgcggatgt

SEQ ID NO: 163417 - DNA, 20 bp, Artificial Sequence
  Description of Artificial Sequence: Synthetic oligonucleotide
  Target: ATXN1; (-) strand; PAM type: YTN; PAM sequence: TTA
cagctcacagtcccctttgc

SEQ ID NO: 163418 - DNA, 20 bp, Artificial Sequence
  Description of Artificial Sequence: Synthetic oligonucleotide
  Target: ATXN1; (-) strand; PAM type: YTN; PAM sequence: TTT
acagctcacagtcccctttg

SEQ ID NO: 163419 - DNA, 20 bp, Artificial Sequence
  Description of Artificial Sequence: Synthetic oligonucleotide
  Target: ATXN1; (-) strand; PAM type: YTN; PAM sequence: TTT
tacagctcacagtccccttt

SEQ ID NO: 163420 - DNA, 20 bp, Artificial Sequence
  Description of Artificial Sequence: Synthetic oligonucleotide
  Target: ATXN1; (-) strand; PAM type: YTN; PAM sequence: TTT
ttacagctcacagtcccctt

SEQ ID NO: 163421 - DNA, 20 bp, Artificial Sequence
  Description of Artificial Sequence: Synthetic oligonucleotide
  Target: ATXN1; (-) strand; PAM type: YTN; PAM sequence: CTT
tttacagctcacagtcccct

SEQ ID NO: 163422 - DNA, 20 bp, Artificial Sequence
  Description of Artificial Sequence: Synthetic oligonucleotide
  Target: ATXN1; (-) strand; PAM type: YTN; PAM sequence: CTC
actttttacagctcacagtc

SEQ ID NO: 163423 - DNA, 20 bp, Artificial Sequence
  Description of Artificial Sequence: Synthetic oligonucleotide
  Target: ATXN1; (-) strand; PAM type: YTN; PAM sequence: CTG
cctcactttttacagctcac

SEQ ID NO: 163424 - DNA, 20 bp, Artificial Sequence
  Description of Artificial Sequence: Synthetic oligonucleotide
  Target: ATXN1; (-) strand; PAM type: YTN; PAM sequence: CTG
ctgcctcactttttacagct

SEQ ID NO: 163425 - DNA, 20 bp, Artificial Sequence
  Description of Artificial Sequence: Synthetic oligonucleotide
  Target: ATXN1; (-) strand; PAM type: YTN; PAM sequence: CTA
agatactgctgcctcacttt

SEQ ID NO: 163426 - DNA, 20 bp, Artificial Sequence
  Description of Artificial Sequence: Synthetic oligonucleotide
  Target: ATXN1; (-) strand; PAM type: YTN; PAM sequence: TTC
agtgagcaatgacatgatag

SEQ ID NO: 163427 - DNA, 20 bp, Artificial Sequence
  Description of Artificial Sequence: Synthetic oligonucleotide
  Target: ATXN1; (-) strand; PAM type: YTN; PAM sequence: CTT
cagtgagcaatgacatgata

SEQ ID NO: 163428 - DNA, 20 bp, Artificial Sequence
  Description of Artificial Sequence: Synthetic oligonucleotide
  Target: ATXN1; (-) strand; PAM type: YTN; PAM sequence: TTC
agtcttcagtgagcaatgac

SEQ ID NO: 163429 - DNA, 20 bp, Artificial Sequence
  Description of Artificial Sequence: Synthetic oligonucleotide
  Target: ATXN1; (-) strand; PAM type: YTN; PAM sequence: TTT
cagtcttcagtgagcaatga

SEQ ID NO: 163430 - DNA, 20 bp, Artificial Sequence
  Description of Artificial Sequence: Synthetic oligonucleotide
  Target: ATXN1; (-) strand; PAM type: YTN; PAM sequence: CTT
tcagtcttcagtgagcaatg

SEQ ID NO: 163431 - DNA, 20 bp, Artificial Sequence
  Description of Artificial Sequence: Synthetic oligonucleotide
  Target: ATXN1; (-) strand; PAM type: YTN; PAM sequence: CTG
atgacagaatcaggggagaa

SEQ ID NO: 163432 - DNA, 20 bp, Artificial Sequence
  Description of Artificial Sequence: Synthetic oligonucleotide
  Target: ATXN1; (-) strand; PAM type: YTN; PAM sequence: CTG
acataacctgatgacagaat

SEQ ID NO: 163433 - DNA, 20 bp, Artificial Sequence
  Description of Artificial Sequence: Synthetic oligonucleotide
  Target: ATXN1; (-) strand; PAM type: YTN; PAM sequence: TTC
agagggtggaactgacataa

SEQ ID NO: 163434 - DNA, 20 bp, Artificial Sequence
  Description of Artificial Sequence: Synthetic oligonucleotide
  Target: ATXN1; (-) strand; PAM type: YTN; PAM sequence: CTG
attcagagggtggaactgac

SEQ ID NO: 163435 - DNA, 20 bp, Artificial Sequence
  Description of Artificial Sequence: Synthetic oligonucleotide
  Target: ATXN1; (-) strand; PAM type: YTN; PAM sequence: TTC
cagtccctgattcagagggt

SEQ ID NO: 163436 - DNA, 20 bp, Artificial Sequence
  Description of Artificial Sequence: Synthetic oligonucleotide
  Target: ATXN1; (-) strand; PAM type: YTN; PAM sequence: TTT
ccagtccctgattcagaggg

SEQ ID NO: 163437 - DNA, 20 bp, Artificial Sequence
  Description of Artificial Sequence: Synthetic oligonucleotide
  Target: ATXN1; (-) strand; PAM type: YTN; PAM sequence: TTT
tccagtccctgattcagagg

SEQ ID NO: 163438 - DNA, 20 bp, Artificial Sequence
  Description of Artificial Sequence: Synthetic oligonucleotide
  Target: ATXN1; (-) strand; PAM type: YTN; PAM sequence: CTA
ggtggccgcgcatcgtcaag

SEQ ID NO: 163439 - DNA, 20 bp, Artificial Sequence
  Description of Artificial Sequence: Synthetic oligonucleotide
  Target: ATXN1; (-) strand; PAM type: YTN; PAM sequence: TTA
ctaggtggccgcgcatcgtc

SEQ ID NO: 163440 - DNA, 20 bp, Artificial Sequence
  Description of Artificial Sequence: Synthetic oligonucleotide
  Target: ATXN1; (-) strand; PAM type: YTN; PAM sequence: TTT
actaggtggccgcgcatcgt

SEQ ID NO: 163441 - DNA, 20 bp, Artificial Sequence
  Description of Artificial Sequence: Synthetic oligonucleotide
  Target: ATXN1; (-) strand; PAM type: YTN; PAM sequence: CTG
agtaatggccacagaggtgt

SEQ ID NO: 163442 - DNA, 20 bp, Artificial Sequence
  Description of Artificial Sequence: Synthetic oligonucleotide
  Target: ATXN1; (-) strand; PAM type: YTN; PAM sequence: CTG
cagaggtagagctgagtaat

SEQ ID NO: 163443 - DNA, 20 bp, Artificial Sequence
  Description of Artificial Sequence: Synthetic oligonucleotide
  Target: ATXN1; (-) strand; PAM type: YTN; PAM sequence: TTC
agcctgcagaggtagagctg

SEQ ID NO: 163444 - DNA, 20 bp, Artificial Sequence
  Description of Artificial Sequence: Synthetic oligonucleotide
  Target: ATXN1; (-) strand; PAM type: YTN; PAM sequence: TTT
cagcctgcagaggtagagct

SEQ ID NO: 163445 - DNA, 20 bp, Artificial Sequence
  Description of Artificial Sequence: Synthetic oligonucleotide
  Target: ATXN1; (-) strand; PAM type: YTN; PAM sequence: CTT
tcagcctgcagaggtagagc

SEQ ID NO: 163446 - DNA, 20 bp, Artificial Sequence
  Description of Artificial Sequence: Synthetic oligonucleotide
  Target: ATXN1; (-) strand; PAM type: YTN; PAM sequence: TTG
ctttcagcctgcagaggtag

SEQ ID NO: 163447 - DNA, 20 bp, Artificial Sequence
  Description of Artificial Sequence: Synthetic oligonucleotide
  Target: ATXN1; (-) strand; PAM type: YTN; PAM sequence: CTG
tggttgctttcagcctgcag

SEQ ID NO: 163448 - DNA, 20 bp, Artificial Sequence
  Description of Artificial Sequence: Synthetic oligonucleotide
  Target: ATXN1; (-) strand; PAM type: YTN; PAM sequence: TTA
tctgtggttgctttcagcct

SEQ ID NO: 163449 - DNA, 20 bp, Artificial Sequence
  Description of Artificial Sequence: Synthetic oligonucleotide
  Target: ATXN1; (-) strand; PAM type: YTN; PAM sequence: TTA
caaattatctgtggttgctt

SEQ ID NO: 163450 - DNA, 20 bp, Artificial Sequence
  Description of Artificial Sequence: Synthetic oligonucleotide
  Target: ATXN1; (-) strand; PAM type: YTN; PAM sequence: CTG
gttacaaattatctgtggtt

SEQ ID NO: 163451 - DNA, 20 bp, Artificial Sequence
  Description of Artificial Sequence: Synthetic oligonucleotide
  Target: ATXN1; (-) strand; PAM type: YTN; PAM sequence: TTG
atcaggacacagccacccac

SEQ ID NO: 163452 - DNA, 20 bp, Artificial Sequence
  Description of Artificial Sequence: Synthetic oligonucleotide
  Target: ATXN1; (-) strand; PAM type: YTN; PAM sequence: CTT
gatcaggacacagccaccca

SEQ ID NO: 163453 - DNA, 20 bp, Artificial Sequence
  Description of Artificial Sequence: Synthetic oligonucleotide
  Target: ATXN1; (-) strand; PAM type: YTN; PAM sequence: TTG
aggcttgatcaggacacagc

SEQ ID NO: 163454 - DNA, 20 bp, Artificial Sequence
  Description of Artificial Sequence: Synthetic oligonucleotide
  Target: ATXN1; (-) strand; PAM type: YTN; PAM sequence: TTT
gaggcttgatcaggacacag

SEQ ID NO: 163455 - DNA, 20 bp, Artificial Sequence
  Description of Artificial Sequence: Synthetic oligonucleotide
  Target: ATXN1; (-) strand; PAM type: YTN; PAM sequence: CTG
cagcaggcatatttgaggct

SEQ ID NO: 163456 - DNA, 20 bp, Artificial Sequence
  Description of Artificial Sequence: Synthetic oligonucleotide
  Target: ATXN1; (-) strand; PAM type: YTN; PAM sequence: CTA
acagagcagagggaacacat

SEQ ID NO: 163457 - DNA, 20 bp, Artificial Sequence
  Description of Artificial Sequence: Synthetic oligonucleotide
  Target: ATXN1; (-) strand; PAM type: YTN; PAM sequence: CTC
taacagagcagagggaacac

SEQ ID NO: 163458 - DNA, 20 bp, Artificial Sequence
  Description of Artificial Sequence: Synthetic oligonucleotide
  Target: ATXN1; (-) strand; PAM type: YTN; PAM sequence: CTG
gtgtggaaagtactctaaca

SEQ ID NO: 163459 - DNA, 20 bp, Artificial Sequence
  Description of Artificial Sequence: Synthetic oligonucleotide
  Target: ATXN1; (-) strand; PAM type: YTN; PAM sequence: TTG
cggaggagcggtggctggtg

SEQ ID NO: 163460 - DNA, 20 bp, Artificial Sequence
  Description of Artificial Sequence: Synthetic oligonucleotide
  Target: ATXN1; (-) strand; PAM type: YTN; PAM sequence: CTT
gcggaggagcggtggctggt

SEQ ID NO: 163461 - DNA, 20 bp, Artificial Sequence
  Description of Artificial Sequence: Synthetic oligonucleotide
  Target: ATXN1; (-) strand; PAM type: YTN; PAM sequence: TTA
gaaaacaggtgacagtgcct

SEQ ID NO: 163462 - DNA, 20 bp, Artificial Sequence
  Description of Artificial Sequence: Synthetic oligonucleotide
  Target: ATXN1; (-) strand; PAM type: YTN; PAM sequence: CTG
cattagaaaacaggtgacag

SEQ ID NO: 163463 - DNA, 20 bp, Artificial Sequence
  Description of Artificial Sequence: Synthetic oligonucleotide
  Target: ATXN1; (-) strand; PAM type: YTN; PAM sequence: CTC
gagtataagaaccactgcat

SEQ ID NO: 163464 - DNA, 20 bp, Artificial Sequence
  Description of Artificial Sequence: Synthetic oligonucleotide
  Target: ATXN1; (-) strand; PAM type: YTN; PAM sequence: CTC
cgggtgaatgtgatgcgcac

SEQ ID NO: 163465 - DNA, 20 bp, Artificial Sequence
  Description of Artificial Sequence: Synthetic oligonucleotide
  Target: ATXN1; (-) strand; PAM type: YTN; PAM sequence: CTG
ggaactccgggtgaatgtga

SEQ ID NO: 163466 - DNA, 20 bp, Artificial Sequence
  Description of Artificial Sequence: Synthetic oligonucleotide
  Target: ATXN1; (-) strand; PAM type: YTN; PAM sequence: CTG
gaccagcagcatcagcagca

SEQ ID NO: 163467 - DNA, 20 bp, Artificial Sequence
  Description of Artificial Sequence: Synthetic oligonucleotide
  Target: ATXN1; (-) strand; PAM type: YTN; PAM sequence: TTC
ctggaccagcagcatcagca

SEQ ID NO: 163468 - DNA, 20 bp, Artificial Sequence
  Description of Artificial Sequence: Synthetic oligonucleotide
  Target: ATXN1; (-) strand; PAM type: YTN; PAM sequence: CTG
gaagtgtggttcctggacca

SEQ ID NO: 163469 - DNA, 20 bp, Artificial Sequence
  Description of Artificial Sequence: Synthetic oligonucleotide
  Target: ATXN1; (-) strand; PAM type: YTN; PAM sequence: TTC
tggaagtgtggttcctggac

SEQ ID NO: 163470 - DNA, 20 bp, Artificial Sequence
  Description of Artificial Sequence: Synthetic oligonucleotide
  Target: ATXN1; (-) strand; PAM type: YTN; PAM sequence: CTT
ctggaagtgtggttcctgga

SEQ ID NO: 163471 - DNA, 20 bp, Artificial Sequence
  Description of Artificial Sequence: Synthetic oligonucleotide
  Target: ATXN1; (-) strand; PAM type: YTN; PAM sequence: CTG
aaagatgggtgaggccagtg

SEQ ID NO: 163472 - DNA, 20 bp, Artificial Sequence
  Description of Artificial Sequence: Synthetic oligonucleotide
  Target: ATXN1; (-) strand; PAM type: YTN; PAM sequence: TTA
aggaggtgacatggaaggag

SEQ ID NO: 163473 - DNA, 20 bp, Artificial Sequence
  Description of Artificial Sequence: Synthetic oligonucleotide
  Target: ATXN1; (-) strand; PAM type: YTN; PAM sequence: CTT
aaggaggtgacatggaagga

SEQ ID NO: 163474 - DNA, 20 bp, Artificial Sequence
  Description of Artificial Sequence: Synthetic oligonucleotide
  Target: ATXN1; (-) strand; PAM type: YTN; PAM sequence: TTG
gagtggggagagccttaagg

SEQ ID NO: 163475 - DNA, 20 bp, Artificial Sequence
  Description of Artificial Sequence: Synthetic oligonucleotide
  Target: ATXN1; (-) strand; PAM type: YTN; PAM sequence: CTA
aggaggcacagaggagaggc

SEQ ID NO: 163476 - DNA, 20 bp, Artificial Sequence
  Description of Artificial Sequence: Synthetic oligonucleotide
  Target: ATXN1; (-) strand; PAM type: YTN; PAM sequence: TTG
gagcagggtgctaaggaggc

SEQ ID NO: 163477 - DNA, 20 bp, Artificial Sequence
  Description of Artificial Sequence: Synthetic oligonucleotide
  Target: ATXN1; (-) strand; PAM type: YTN; PAM sequence: CTG
aacggtgtgtggatgagaat

SEQ ID NO: 163478 - DNA, 20 bp, Artificial Sequence
  Description of Artificial Sequence: Synthetic oligonucleotide
  Target: ATXN1; (-) strand; PAM type: YTN; PAM sequence: TTC
ctgaacggtgtgtggatgag

SEQ ID NO: 163479 - DNA, 20 bp, Artificial Sequence
  Description of Artificial Sequence: Synthetic oligonucleotide
  Target: ATXN1; (-) strand; PAM type: YTN; PAM sequence: TTG
gaggatagtcgaggaaacgg

SEQ ID NO: 163480 - DNA, 20 bp, Artificial Sequence
  Description of Artificial Sequence: Synthetic oligonucleotide
  Target: ATXN1; (-) strand; PAM type: YTN; PAM sequence: CTT
ggaggatagtcgaggaaacg

SEQ ID NO: 163481 - DNA, 20 bp, Artificial Sequence
  Description of Artificial Sequence: Synthetic oligonucleotide
  Target: ATXN1; (-) strand; PAM type: YTN; PAM sequence: TTG
gagccttggaggatagtcga

SEQ ID NO: 163482 - DNA, 20 bp, Artificial Sequence
  Description of Artificial Sequence: Synthetic oligonucleotide
  Target: ATXN1; (-) strand; PAM type: YTN; PAM sequence: CTA
attggagccttggaggatag

SEQ ID NO: 163483 - DNA, 20 bp, Artificial Sequence
  Description of Artificial Sequence: Synthetic oligonucleotide
  Target: ATXN1; (-) strand; PAM type: YTN; PAM sequence: TTA
gactaattggagccttggag

SEQ ID NO: 163484 - DNA, 20 bp, Artificial Sequence
  Description of Artificial Sequence: Synthetic oligonucleotide
  Target: ATXN1; (-) strand; PAM type: YTN; PAM sequence: CTG
gtgttagactaattggagcc

SEQ ID NO: 163485 - DNA, 20 bp, Artificial Sequence
  Description of Artificial Sequence: Synthetic oligonucleotide
  Target: ATXN1; (-) strand; PAM type: YTN; PAM sequence: TTA
accatcatgcccaccatggt

SEQ ID NO: 163486 - DNA, 20 bp, Artificial Sequence
  Description of Artificial Sequence: Synthetic oligonucleotide
  Target: ATXN1; (-) strand; PAM type: YTN; PAM sequence: CTC
agtattaaccatcatgccca

SEQ ID NO: 163487 - DNA, 20 bp, Artificial Sequence
  Description of Artificial Sequence: Synthetic oligonucleotide
  Target: ATXN1; (-) strand; PAM type: YTN; PAM sequence: TTG
acactcagtattaaccatca

SEQ ID NO: 163488 - DNA, 20 bp, Artificial Sequence
  Description of Artificial Sequence: Synthetic oligonucleotide
  Target: ATXN1; (-) strand; PAM type: YTN; PAM sequence: TTC
aatccaatcaagttgacact

SEQ ID NO: 163489 - DNA, 20 bp, Artificial Sequence
  Description of Artificial Sequence: Synthetic oligonucleotide
  Target: ATXN1; (-) strand; PAM type: YTN; PAM sequence: CTT
caatccaatcaagttgacac

SEQ ID NO: 163490 - DNA, 20 bp, Artificial Sequence
  Description of Artificial Sequence: Synthetic oligonucleotide
  Target: ATXN1; (-) strand; PAM type: YTN; PAM sequence: TTG
catccttcaatccaatcaag

SEQ ID NO: 163491 - DNA, 20 bp, Artificial Sequence
  Description of Artificial Sequence: Synthetic oligonucleotide
  Target: ATXN1; (-) strand; PAM type: YTN; PAM sequence: TTT
gcatccttcaatccaatcaa

SEQ ID NO: 163492 - DNA, 20 bp, Artificial Sequence
  Description of Artificial Sequence: Synthetic oligonucleotide
  Target: ATXN1; (-) strand; PAM type: YTN; PAM sequence: CTT
tgcatccttcaatccaatca

SEQ ID NO: 163493 - DNA, 20 bp, Artificial Sequence
  Description of Artificial Sequence: Synthetic oligonucleotide
  Target: ATXN1; (-) strand; PAM type: YTN; PAM sequence: CTC
acagacacaaccaagaataa

SEQ ID NO: 163494 - DNA, 20 bp, Artificial Sequence
  Description of Artificial Sequence: Synthetic oligonucleotide
  Target: ATXN1; (-) strand; PAM type: YTN; PAM sequence: TTG
gcaacaccctcacagacaca

SEQ ID NO: 163495 - DNA, 20 bp, Artificial Sequence
  Description of Artificial Sequence: Synthetic oligonucleotide
  Target: ATXN1; (-) strand; PAM type: YTN; PAM sequence: TTT
ggcaacaccctcacagacac

SEQ ID NO: 163496 - DNA, 20 bp, Artificial Sequence
  Description of Artificial Sequence: Synthetic oligonucleotide
  Target: ATXN1; (-) strand; PAM type: YTN; PAM sequence: CTT
tggcaacaccctcacagaca

SEQ ID NO: 163497 - DNA, 20 bp, Artificial Sequence
  Description of Artificial Sequence: Synthetic oligonucleotide
  Target: ATXN1; (-) strand; PAM type: YTN; PAM sequence: CTC
ctttggcaacaccctcacag

SEQ ID NO: 163498 - DNA, 20 bp, Artificial Sequence
  Description of Artificial Sequence: Synthetic oligonucleotide
  Target: ATXN1; (-) strand; PAM type: YTN; PAM sequence: TTA
tctcctttggcaacaccctc

SEQ ID NO: 163499 - DNA, 20 bp, Artificial Sequence
  Description of Artificial Sequence: Synthetic oligonucleotide
  Target: ATXN1; (-) strand; PAM type: YTN; PAM sequence: TTT
atctcctttggcaacaccct

SEQ ID NO: 163500 - DNA, 20 bp, Artificial Sequence
  Description of Artificial Sequence: Synthetic oligonucleotide
  Target: ATXN1; (-) strand; PAM type: YTN; PAM sequence: CTC
caagcccatgacccaaatgt

SEQ ID NO: 163501 - DNA, 20 bp, Artificial Sequence
  Description of Artificial Sequence: Synthetic oligonucleotide
  Target: ATXN1; (-) strand; PAM type: YTN; PAM sequence: CTC
tccaagcccatgacccaaat

SEQ ID NO: 163502 - DNA, 20 bp, Artificial Sequence
  Description of Artificial Sequence: Synthetic oligonucleotide
  Target: ATXN1; (-) strand; PAM type: YTN; PAM sequence: TTC
ctctccaagcccatgaccca

SEQ ID NO: 163503 - DNA, 20 bp, Artificial Sequence
  Description of Artificial Sequence: Synthetic oligonucleotide
  Target: ATXN1; (-) strand; PAM type: YTN; PAM sequence: CTT
cctctccaagcccatgaccc

SEQ ID NO: 163504 - DNA, 20 bp, Artificial Sequence
  Description of Artificial Sequence: Synthetic oligonucleotide
  Target: ATXN1; (-) strand; PAM type: YTN; PAM sequence: TTG
agggtgggtcttcctctcca

SEQ ID NO: 163505 - DNA, 20 bp, Artificial Sequence
  Description of Artificial Sequence: Synthetic oligonucleotide
  Target: ATXN1; (-) strand; PAM type: YTN; PAM sequence: TTG
tgcccacccagattgagggt

SEQ ID NO: 163506 - DNA, 20 bp, Artificial Sequence
  Description of Artificial Sequence: Synthetic oligonucleotide
  Target: ATXN1; (-) strand; PAM type: YTN; PAM sequence: TTA
gattgtgcccacccagattg

SEQ ID NO: 163507 - DNA, 20 bp, Artificial Sequence
  Description of Artificial Sequence: Synthetic oligonucleotide
  Target: ATXN1; (-) strand; PAM type: YTN; PAM sequence: CTG
attagattgtgcccacccag

SEQ ID NO: 163508 - DNA, 20 bp, Artificial Sequence
  Description of Artificial Sequence: Synthetic oligonucleotide
  Target: ATXN1; (-) strand; PAM type: YTN; PAM sequence: CTG
gcagctgattagattgtgcc

SEQ ID NO: 163509 - DNA, 20 bp, Artificial Sequence
  Description of Artificial Sequence: Synthetic oligonucleotide
  Target: ATXN1; (-) strand; PAM type: YTN; PAM sequence: CTC
actggcagctgattagattg

SEQ ID NO: 163510 - DNA, 20 bp, Artificial Sequence
  Description of Artificial Sequence: Synthetic oligonucleotide
  Target: ATXN1; (-) strand; PAM type: YTN; PAM sequence: CTA
gcctcactggcagctgatta

SEQ ID NO: 163511 - DNA, 20 bp, Artificial Sequence
  Description of Artificial Sequence: Synthetic oligonucleotide
  Target: ATXN1; (-) strand; PAM type: YTN; PAM sequence: TTC
tagcctcactggcagctgat

SEQ ID NO: 163512 - DNA, 20 bp, Artificial Sequence
  Description of Artificial Sequence: Synthetic oligonucleotide
  Target: ATXN1; (-) strand; PAM type: YTN; PAM sequence: TTC
attctagcctcactggcagc

SEQ ID NO: 163513 - DNA, 20 bp, Artificial Sequence
  Description of Artificial Sequence: Synthetic oligonucleotide
  Target: ATXN1; (-) strand; PAM type: YTN; PAM sequence: TTT
cattctagcctcactggcag

SEQ ID NO: 163514 - DNA, 20 bp, Artificial Sequence
  Description of Artificial Sequence: Synthetic oligonucleotide
  Target: ATXN1; (-) strand; PAM type: YTN; PAM sequence: CTT
tcattctagcctcactggca

SEQ ID NO: 163515 - DNA, 20 bp, Artificial Sequence
  Description of Artificial Sequence: Synthetic oligonucleotide
  Target: ATXN1; (-) strand; PAM type: YTN; PAM sequence: CTG
ctttcattctagcctcactg

SEQ ID NO: 163516 - DNA, 20 bp, Artificial Sequence
  Description of Artificial Sequence: Synthetic oligonucleotide
  Target: ATXN1; (-) strand; PAM type: YTN; PAM sequence: CTG
cctgctttcattctagcctc

SEQ ID NO: 163517 - DNA, 20 bp, Artificial Sequence
  Description of Artificial Sequence: Synthetic oligonucleotide
  Target: ATXN1; (-) strand; PAM type: YTN; PAM sequence: TTC
tgcctgctttcattctagcc

SEQ ID NO: 163518 - DNA, 20 bp, Artificial Sequence
  Description of Artificial Sequence: Synthetic oligonucleotide
  Target: ATXN1; (-) strand; PAM type: YTN; PAM sequence: CTT
ctgcctgctttcattctagc

SEQ ID NO: 163519 - DNA, 20 bp, Artificial Sequence
  Description of Artificial Sequence: Synthetic oligonucleotide
  Target: ATXN1; (-) strand; PAM type: YTN; PAM sequence: TTC
ttctgcctgctttcattcta

SEQ ID NO: 163520 - DNA, 20 bp, Artificial Sequence
  Description of Artificial Sequence: Synthetic oligonucleotide
  Target: ATXN1; (-) strand; PAM type: YTN; PAM sequence: CTA
cgttcttctgcctgctttca

SEQ ID NO: 163521 - DNA, 20 bp, Artificial Sequence
  Description of Artificial Sequence: Synthetic oligonucleotide
  Target: ATXN1; (-) strand; PAM type: YTN; PAM sequence: TTC
tacgttcttctgcctgcttt

SEQ ID NO: 163522 - DNA, 20 bp, Artificial Sequence
  Description of Artificial Sequence: Synthetic oligonucleotide
  Target: ATXN1; (-) strand; PAM type: YTN; PAM sequence: CTT
ctacgttcttctgcctgctt

SEQ ID NO: 163523 - DNA, 20 bp, Artificial Sequence
  Description of Artificial Sequence: Synthetic oligonucleotide
  Target: ATXN1; (-) strand; PAM type: YTN; PAM sequence: CTA
gtccttctacgttcttctgc

SEQ ID NO: 163524 - DNA, 20 bp, Artificial Sequence
  Description of Artificial Sequence: Synthetic oligonucleotide
  Target: ATXN1; (-) strand; PAM type: YTN; PAM sequence: CTC
agccagtctagtccttctac

SEQ ID NO: 163525 - DNA, 20 bp, Artificial Sequence
  Description of Artificial Sequence: Synthetic oligonucleotide
  Target: ATXN1; (-) strand; PAM type: YTN; PAM sequence: TTC
gagggcaggaagcatccagc

SEQ ID NO: 163526 - DNA, 20 bp, Artificial Sequence
  Description of Artificial Sequence: Synthetic oligonucleotide
  Target: ATXN1; (-) strand; PAM type: YTN; PAM sequence: TTC
aagtcgggtgttcgagggca

SEQ ID NO: 163527 - DNA, 20 bp, Artificial Sequence
  Description of Artificial Sequence: Synthetic oligonucleotide
  Target: ATXN1; (-) strand; PAM type: YTN; PAM sequence: CTT
caagtcgggtgttcgagggc

SEQ ID NO: 163528 - DNA, 20 bp, Artificial Sequence
  Description of Artificial Sequence: Synthetic oligonucleotide
  Target: ATXN1; (-) strand; PAM type: YTN; PAM sequence: CTG
aagaacttcaagtcgggtgt

SEQ ID NO: 163529 - DNA, 20 bp, Artificial Sequence
  Description of Artificial Sequence: Synthetic oligonucleotide
  Target: ATXN1; (-) strand; PAM type: YTN; PAM sequence: TTA
gtgtaggtccaagagtccaa

SEQ ID NO: 163530 - DNA, 20 bp, Artificial Sequence
  Description of Artificial Sequence: Synthetic oligonucleotide
  Target: ATXN1; (-) strand; PAM type: YTN; PAM sequence: CTG
gccaaccattagtgtaggtc

SEQ ID NO: 163531 - DNA, 20 bp, Artificial Sequence
  Description of Artificial Sequence: Synthetic oligonucleotide
  Target: ATXN1; (-) strand; PAM type: YTN; PAM sequence: CTG
tggccaaaggcccaagagcc

SEQ ID NO: 163532 - DNA, 20 bp, Artificial Sequence
  Description of Artificial Sequence: Synthetic oligonucleotide
  Target: ATXN1; (-) strand; PAM type: YTN; PAM sequence: TTC
agcctgtggccaaaggccca

SEQ ID NO: 163533 - DNA, 20 bp, Artificial Sequence
  Description of Artificial Sequence: Synthetic oligonucleotide
  Target: ATXN1; (-) strand; PAM type: YTN; PAM sequence: CTT
cagcctgtggccaaaggccc

SEQ ID NO: 163534 - DNA, 20 bp, Artificial Sequence
  Description of Artificial Sequence: Synthetic oligonucleotide
  Target: ATXN1; (-) strand; PAM type: YTN; PAM sequence: CTC
aaaagtagggaagccgacag

SEQ ID NO: 163535 - DNA, 20 bp, Artificial Sequence
  Description of Artificial Sequence: Synthetic oligonucleotide
  Target: ATXN1; (-) strand; PAM type: YTN; PAM sequence: CTG
agtcccaagacctcaaaagt

SEQ ID NO: 163536 - DNA, 20 bp, Artificial Sequence
  Description of Artificial Sequence: Synthetic oligonucleotide
  Target: ATXN1; (-) strand; PAM type: YTN; PAM sequence: TTG
accagtctgagtcccaagac

SEQ ID NO: 163537 - DNA, 20 bp, Artificial Sequence
  Description of Artificial Sequence: Synthetic oligonucleotide
  Target: ATXN1; (-) strand; PAM type: YTN; PAM sequence: CTG
aggagcaaggaagccagtgg

SEQ ID NO: 163538 - DNA, 20 bp, Artificial Sequence
  Description of Artificial Sequence: Synthetic oligonucleotide
  Target: ATXN1; (-) strand; PAM type: YTN; PAM sequence: CTG
caagctgaggagcaaggaag

SEQ ID NO: 163539 - DNA, 20 bp, Artificial Sequence
  Description of Artificial Sequence: Synthetic oligonucleotide
  Target: ATXN1; (-) strand; PAM type: YTN; PAM sequence: CTA
caataggccacctgcaagct

SEQ ID NO: 163540 - DNA, 20 bp, Artificial Sequence
  Description of Artificial Sequence: Synthetic oligonucleotide
  Target: ATXN1; (-) strand; PAM type: YTN; PAM sequence: CTC
acatgatcaaaaggtcaagt

SEQ ID NO: 163541 - DNA, 20 bp, Artificial Sequence
  Description of Artificial Sequence: Synthetic oligonucleotide
  Target: ATXN1; (-) strand; PAM type: YTN; PAM sequence: TTG
actcacatgatcaaaaggtc

SEQ ID NO: 163542 - DNA, 20 bp, Artificial Sequence
  Description of Artificial Sequence: Synthetic oligonucleotide
  Target: ATXN1; (-) strand; PAM type: YTN; PAM sequence: TTA
aggaatattgactcacatga

SEQ ID NO: 163543 - DNA, 20 bp, Artificial Sequence
  Description of Artificial Sequence: Synthetic oligonucleotide
  Target: ATXN1; (-) strand; PAM type: YTN; PAM sequence: TTA
ttaaggaatattgactcaca

SEQ ID NO: 163544 - DNA, 20 bp, Artificial Sequence
  Description of Artificial Sequence: Synthetic oligonucleotide
  Target: ATXN1; (-) strand; PAM type: YTN; PAM sequence: TTT
attaaggaatattgactcac

SEQ ID NO: 163545 - DNA, 20 bp, Artificial Sequence
  Description of Artificial Sequence: Synthetic oligonucleotide
  Target: ATXN1; (-) strand; PAM type: YTN; PAM sequence: CTA
ataggatagatgtatatatg

SEQ ID NO: 163546 - DNA, 20 bp, Artificial Sequence
  Description of Artificial Sequence: Synthetic oligonucleotide
  Target: ATXN1; (-) strand; PAM type: YTN; PAM sequence: CTA
gacagacaggactaatagga

SEQ ID NO: 163547 - DNA, 20 bp, Artificial Sequence
  Description of Artificial Sequence: Synthetic oligonucleotide
  Target: ATXN1; (-) strand; PAM type: YTN; PAM sequence: CTC
tagacagacaggactaatag

SEQ ID NO: 163548 - DNA, 20 bp, Artificial Sequence
  Description of Artificial Sequence: Synthetic oligonucleotide
  Target: ATXN1; (-) strand; PAM type: YTN; PAM sequence: TTC
tctagacagacaggactaat

SEQ ID NO: 163549 - DNA, 20 bp, Artificial Sequence
  Description of Artificial Sequence: Synthetic oligonucleotide
  Target: ATXN1; (-) strand; PAM type: YTN; PAM sequence: TTA
gtcagggttctctagacaga

SEQ ID NO: 163550 - DNA, 20 bp, Artificial Sequence
  Description of Artificial Sequence: Synthetic oligonucleotide
  Target: ATXN1; (-) strand; PAM type: YTN; PAM sequence: CTG
tattagtcagggttctctag

SEQ ID NO: 163551 - DNA, 20 bp, Artificial Sequence
  Description of Artificial Sequence: Synthetic oligonucleotide
  Target: ATXN1; (-) strand; PAM type: YTN; PAM sequence: TTA
ggggacccactgtattagtc

SEQ ID NO: 163552 - DNA, 20 bp, Artificial Sequence
  Description of Artificial Sequence: Synthetic oligonucleotide
  Target: ATXN1; (-) strand; PAM type: YTN; PAM sequence: CTA
aggaagtagcagttagggga

SEQ ID NO: 163553 - DNA, 20 bp, Artificial Sequence
  Description of Artificial Sequence: Synthetic oligonucleotide
  Target: ATXN1; (-) strand; PAM type: YTN; PAM sequence: TTG
cctaaggaagtagcagttag

SEQ ID NO: 163554 - DNA, 20 bp, Artificial Sequence
  Description of Artificial Sequence: Synthetic oligonucleotide
  Target: ATXN1; (-) strand; PAM type: YTN; PAM sequence: TTA
ggaatgattgcctaaggaag

SEQ ID NO: 163555 - DNA, 20 bp, Artificial Sequence
  Description of Artificial Sequence: Synthetic oligonucleotide
  Target: ATXN1; (-) strand; PAM type: YTN; PAM sequence: TTT
aggaatgattgcctaaggaa

SEQ ID NO: 163556 - DNA, 20 bp, Artificial Sequence
  Description of Artificial Sequence: Synthetic oligonucleotide
  Target: ATXN1; (-) strand; PAM type: YTN; PAM sequence: CTG
agagtttaggaatgattgcc

SEQ ID NO: 163557 - DNA, 20 bp, Artificial Sequence
  Description of Artificial Sequence: Synthetic oligonucleotide
  Target: ATXN1; (-) strand; PAM type: YTN; PAM sequence: TTG
ctgagagtttaggaatgatt

SEQ ID NO: 163558 - DNA, 20 bp, Artificial Sequence
  Description of Artificial Sequence: Synthetic oligonucleotide
  Target: ATXN1; (-) strand; PAM type: YTN; PAM sequence: TTT
gctgagagtttaggaatgat

SEQ ID NO: 163559 - DNA, 20 bp, Artificial Sequence
  Description of Artificial Sequence: Synthetic oligonucleotide
  Target: ATXN1; (-) strand; PAM type: YTN; PAM sequence: CTT
tgctgagagtttaggaatga

SEQ ID NO: 163560 - DNA, 20 bp, Artificial Sequence
  Description of Artificial Sequence: Synthetic oligonucleotide
  Target: ATXN1; (-) strand; PAM type: YTN; PAM sequence: TTG
cagcagccggaagtggcttt

SEQ ID NO: 163561 - DNA, 20 bp, Artificial Sequence
  Description of Artificial Sequence: Synthetic oligonucleotide
  Target: ATXN1; (-) strand; PAM type: YTN; PAM sequence: CTA
atgacgaaaacacgtgaaaa

SEQ ID NO: 163562 - DNA, 20 bp, Artificial Sequence
  Description of Artificial Sequence: Synthetic oligonucleotide
  Target: ATXN1; (-) strand; PAM type: YTN; PAM sequence: TTA
cggtctaatgacgaaaacac

SEQ ID NO: 163563 - DNA, 20 bp, Artificial Sequence
  Description of Artificial Sequence: Synthetic oligonucleotide
  Target: ATXN1; (-) strand; PAM type: YTN; PAM sequence: TTT
acggtctaatgacgaaaaca

SEQ ID NO: 163564 - DNA, 20 bp, Artificial Sequence
  Description of Artificial Sequence: Synthetic oligonucleotide
  Target: ATXN1; (-) strand; PAM type: YTN; PAM sequence: CTA
agcagcatcggagtttacgg

SEQ ID NO: 163565 - DNA, 20 bp, Artificial Sequence
  Description of Artificial Sequence: Synthetic oligonucleotide
  Target: ATXN1; (-) strand; PAM type: YTN; PAM sequence: CTC
taagcagcatcggagtttac

SEQ ID NO: 163566 - DNA, 20 bp, Artificial Sequence
  Description of Artificial Sequence: Synthetic oligonucleotide
  Target: ATXN1; (-) strand; PAM type: YTN; PAM sequence: TTC
agtctctaagcagcatcgga

SEQ ID NO: 163567 - DNA, 20 bp, Artificial Sequence
  Description of Artificial Sequence: Synthetic oligonucleotide
  Target: ATXN1; (-) strand; PAM type: YTN; PAM sequence: CTT
cagtctctaagcagcatcgg

SEQ ID NO: 163568 - DNA, 20 bp, Artificial Sequence
  Description of Artificial Sequence: Synthetic oligonucleotide
  Target: ATXN1; (-) strand; PAM type: YTN; PAM sequence: TTG
tgaacttcagtctctaagca

SEQ ID NO: 163569 - DNA, 20 bp, Artificial Sequence
  Description of Artificial Sequence: Synthetic oligonucleotide
  Target: ATXN1; (-) strand; PAM type: YTN; PAM sequence: CTA
gaaacccaaggggttgtgaa

SEQ ID NO: 163570 - DNA, 20 bp, Artificial Sequence
  Description of Artificial Sequence: Synthetic oligonucleotide
  Target: ATXN1; (-) strand; PAM type: YTN; PAM sequence: CTG
caagagatggacacaagata

SEQ ID NO: 163571 - DNA, 20 bp, Artificial Sequence
  Description of Artificial Sequence: Synthetic oligonucleotide
  Target: ATXN1; (-) strand; PAM type: YTN; PAM sequence: TTG
taaggaagacaaactgcaag

SEQ ID NO: 163572 - DNA, 20 bp, Artificial Sequence
  Description of Artificial Sequence: Synthetic oligonucleotide
  Target: ATXN1; (-) strand; PAM type: YTN; PAM sequence: CTT
gtaaggaagacaaactgcaa

SEQ ID NO: 163573 - DNA, 20 bp, Artificial Sequence
  Description of Artificial Sequence: Synthetic oligonucleotide
  Target: ATXN1; (-) strand; PAM type: YTN; PAM sequence: TTA
ataaccagcttgtaaggaag

SEQ ID NO: 163574 - DNA, 20 bp, Artificial Sequence
  Description of Artificial Sequence: Synthetic oligonucleotide
  Target: ATXN1; (-) strand; PAM type: YTN; PAM sequence: TTT
aataaccagcttgtaaggaa

SEQ ID NO: 163575 - DNA, 20 bp, Artificial Sequence
  Description of Artificial Sequence: Synthetic oligonucleotide
  Target: ATXN1; (-) strand; PAM type: YTN; PAM sequence: TTT
taataaccagcttgtaagga

SEQ ID NO: 163576 - DNA, 20 bp, Artificial Sequence
  Description of Artificial Sequence: Synthetic oligonucleotide
  Target: ATXN1; (-) strand; PAM type: YTN; PAM sequence: CTT
ttaataaccagcttgtaagg

SEQ ID NO: 163577 - DNA, 20 bp, Artificial Sequence
  Description of Artificial Sequence: Synthetic oligonucleotide
  Target: ATXN1; (-) strand; PAM type: YTN; PAM sequence: TTG
ccttttaataaccagcttgt

SEQ ID NO: 163578 - DNA, 20 bp, Artificial Sequence
  Description of Artificial Sequence: Synthetic oligonucleotide
  Target: ATXN1; (-) strand; PAM type: YTN; PAM sequence: TTT
gccttttaataaccagcttg

SEQ ID NO: 163579 - DNA, 20 bp, Artificial Sequence
  Description of Artificial Sequence: Synthetic oligonucleotide
  Target: ATXN1; (-) strand; PAM type: YTN; PAM sequence: CTT
tgccttttaataaccagctt

SEQ ID NO: 163580 - DNA, 20 bp, Artificial Sequence
  Description of Artificial Sequence: Synthetic oligonucleotide
  Target: ATXN1; (-) strand; PAM type: YTN; PAM sequence: CTA
gaaaatgatccagaaatcct

SEQ ID NO: 163581 - DNA, 20 bp, Artificial Sequence
  Description of Artificial Sequence: Synthetic oligonucleotide
  Target: ATXN1; (-) strand; PAM type: YTN; PAM sequence: TTA
tcatcacatccaaaatctag

SEQ ID NO: 163582 - DNA, 20 bp, Artificial Sequence
  Description of Artificial Sequence: Synthetic oligonucleotide
  Target: ATXN1; (-) strand; PAM type: YTN; PAM sequence: TTT
atcatcacatccaaaatcta

SEQ ID NO: 163583 - DNA, 20 bp, Artificial Sequence
  Description of Artificial Sequence: Synthetic oligonucleotide
  Target: ATXN1; (-) strand; PAM type: YTN; PAM sequence: TTT
tatcatcacatccaaaatct

SEQ ID NO: 163584 - DNA, 20 bp, Artificial Sequence
  Description of Artificial Sequence: Synthetic oligonucleotide
  Target: ATXN1; (-) strand; PAM type: YTN; PAM sequence: TTT
ttatcatcacatccaaaatc

SEQ ID NO: 163585 - DNA, 20 bp, Artificial Sequence
  Description of Artificial Sequence: Synthetic oligonucleotide
  Target: ATXN1; (-) strand; PAM type: YTN; PAM sequence: TTT
tttatcatcacatccaaaat

SEQ ID NO: 163586 - DNA, 20 bp, Artificial Sequence
  Description of Artificial Sequence: Synthetic oligonucleotide
  Target: ATXN1; (-) strand; PAM type: YTN; PAM sequence: TTC
agttttttatcatcacatcc

SEQ ID NO: 163587 - DNA, 20 bp, Artificial Sequence
  Description of Artificial Sequence: Synthetic oligonucleotide
  Target: ATXN1; (-) strand; PAM type: YTN; PAM sequence: CTC
cgtaatgagttcagtttttt

SEQ ID NO: 163588 - DNA, 20 bp, Artificial Sequence
  Description of Artificial Sequence: Synthetic oligonucleotide
  Target: ATXN1; (-) strand; PAM type: YTN; PAM sequence: TTA
tgtccctccgtaatgagttc

SEQ ID NO: 163589 - DNA, 20 bp, Artificial Sequence
  Description of Artificial Sequence: Synthetic oligonucleotide
  Target: ATXN1; (-) strand; PAM type: YTN; PAM sequence: TTT
atgtccctccgtaatgagtt

SEQ ID NO: 163590 - DNA, 20 bp, Artificial Sequence
  Description of Artificial Sequence: Synthetic oligonucleotide
  Target: ATXN1; (-) strand; PAM type: YTN; PAM sequence: TTT
tatgtccctccgtaatgagt

SEQ ID NO: 163591 - DNA, 20 bp, Artificial Sequence
  Description of Artificial Sequence: Synthetic oligonucleotide
  Target: ATXN1; (-) strand; PAM type: YTN; PAM sequence: TTA
ttttatgtccctccgtaatg

SEQ ID NO: 163592 - DNA, 20 bp, Artificial Sequence
  Description of Artificial Sequence: Synthetic oligonucleotide
  Target: ATXN1; (-) strand; PAM type: YTN; PAM sequence: TTG
cagataccacaacattattt

SEQ ID NO: 163593 - DNA, 20 bp, Artificial Sequence
  Description of Artificial Sequence: Synthetic oligonucleotide
  Target: ATXN1; (-) strand; PAM type: YTN; PAM sequence: TTT
gcagataccacaacattatt

SEQ ID NO: 163594 - DNA, 20 bp, Artificial Sequence
  Description of Artificial Sequence: Synthetic oligonucleotide
  Target: ATXN1; (-) strand; PAM type: YTN; PAM sequence: CTT
tgcagataccacaacattat

SEQ ID NO: 163595 - DNA, 20 bp, Artificial Sequence
  Description of Artificial Sequence: Synthetic oligonucleotide
  Target: ATXN1; (-) strand; PAM type: YTN; PAM sequence: TTC
tttgcagataccacaacatt

SEQ ID NO: 163596 - DNA, 20 bp, Artificial Sequence
  Description of Artificial Sequence: Synthetic oligonucleotide
  Target: ATXN1; (-) strand; PAM type: YTN; PAM sequence: CTC
aaggggcagattctttgcag

SEQ ID NO: 163597 - DNA, 20 bp, Artificial Sequence
  Description of Artificial Sequence: Synthetic oligonucleotide
  Target: ATXN1; (-) strand; PAM type: YTN; PAM sequence: TTG
aaatggaatctcaaggggca

SEQ ID NO: 163598 - DNA, 20 bp, Artificial Sequence
  Description of Artificial Sequence: Synthetic oligonucleotide
  Target: ATXN1; (-) strand; PAM type: YTN; PAM sequence: TTT
gaaatggaatctcaaggggc

SEQ ID NO: 163599 - DNA, 20 bp, Artificial Sequence
  Description of Artificial Sequence: Synthetic oligonucleotide
  Target: ATXN1; (-) strand; PAM type: YTN; PAM sequence: CTC
acgtgagaaagtatgtttga

SEQ ID NO: 163600 - DNA, 20 bp, Artificial Sequence
  Description of Artificial Sequence: Synthetic oligonucleotide
  Target: ATXN1; (-) strand; PAM type: YTN; PAM sequence: TTA
ataatctcacgtgagaaagt

SEQ ID NO: 163601 - DNA, 20 bp, Artificial Sequence
  Description of Artificial Sequence: Synthetic oligonucleotide
  Target: ATXN1; (-) strand; PAM type: YTN; PAM sequence: CTG
acccgagaagtaacaggagt

SEQ ID NO: 163602 - DNA, 20 bp, Artificial Sequence
  Description of Artificial Sequence: Synthetic oligonucleotide
  Target: ATXN1; (-) strand; PAM type: YTN; PAM sequence: TTC
ctgacccgagaagtaacagg

SEQ ID NO: 163603 - DNA, 20 bp, Artificial Sequence
  Description of Artificial Sequence: Synthetic oligonucleotide
  Target: ATXN1; (-) strand; PAM type: YTN; PAM sequence: CTT
cctgacccgagaagtaacag

SEQ ID NO: 163604 - DNA, 20 bp, Artificial Sequence
  Description of Artificial Sequence: Synthetic oligonucleotide
  Target: ATXN1; (-) strand; PAM type: YTN; PAM sequence: TTG
tacttcctgacccgagaagt

SEQ ID NO: 163605 - DNA, 20 bp, Artificial Sequence
  Description of Artificial Sequence: Synthetic oligonucleotide
  Target: ATXN1; (-) strand; PAM type: YTN; PAM sequence: CTT
gtacttcctgacccgagaag

SEQ ID NO: 163606 - DNA, 20 bp, Artificial Sequence
  Description of Artificial Sequence: Synthetic oligonucleotide
  Target: ATXN1; (-) strand; PAM type: YTN; PAM sequence: TTA
tacttgtacttcctgacccg

SEQ ID NO: 163607 - DNA, 20 bp, Artificial Sequence
  Description of Artificial Sequence: Synthetic oligonucleotide
  Target: ATXN1; (-) strand; PAM type: YTN; PAM sequence: CTC
acacaatatattatacttgt

SEQ ID NO: 163608 - DNA, 20 bp, Artificial Sequence
  Description of Artificial Sequence: Synthetic oligonucleotide
  Target: ATXN1; (-) strand; PAM type: YTN; PAM sequence: TTA
acatctcacacaatatatta

SEQ ID NO: 163609 - DNA, 20 bp, Artificial Sequence
  Description of Artificial Sequence: Synthetic oligonucleotide
  Target: ATXN1; (-) strand; PAM type: YTN; PAM sequence: TTT
aacatctcacacaatatatt

SEQ ID NO: 163610 - DNA, 20 bp, Artificial Sequence
  Description of Artificial Sequence: Synthetic oligonucleotide
  Target: ATXN1; (-) strand; PAM type: YTN; PAM sequence: CTT
taacatctcacacaatatat

SEQ ID NO: 163611 - DNA, 20 bp, Artificial Sequence
  Description of Artificial Sequence: Synthetic oligonucleotide
  Target: ATXN1; (-) strand; PAM type: YTN; PAM sequence: TTC
ccatatagcaagtgtcttta

SEQ ID NO: 163612 - DNA, 20 bp, Artificial Sequence
  Description of Artificial Sequence: Synthetic oligonucleotide
  Target: ATXN1; (-) strand; PAM type: YTN; PAM sequence: CTT
cccatatagcaagtgtcttt

SEQ ID NO: 163613 - DNA, 20 bp, Artificial Sequence
  Description of Artificial Sequence: Synthetic oligonucleotide
  Target: ATXN1; (-) strand; PAM type: YTN; PAM sequence: TTA
gaggccttcccatatagcaa

SEQ ID NO: 163614 - DNA, 20 bp, Artificial Sequence
  Description of Artificial Sequence: Synthetic oligonucleotide
  Target: ATXN1; (-) strand; PAM type: YTN; PAM sequence: TTT
agaggccttcccatatagca

SEQ ID NO: 163615 - DNA, 20 bp, Artificial Sequence
  Description of Artificial Sequence: Synthetic oligonucleotide
  Target: ATXN1; (-) strand; PAM type: YTN; PAM sequence: TTG
gatatgaatgtttagaggcc

SEQ ID NO: 163616 - DNA, 20 bp, Artificial Sequence
  Description of Artificial Sequence: Synthetic oligonucleotide
  Target: ATXN1; (-) strand; PAM type: YTN; PAM sequence: TTG
gataattggatatgaatgtt

SEQ ID NO: 163617 - DNA, 20 bp, Artificial Sequence
  Description of Artificial Sequence: Synthetic oligonucleotide
  Target: ATXN1; (-) strand; PAM type: YTN; PAM sequence: TTT
ggataattggatatgaatgt

SEQ ID NO: 163618 - DNA, 20 bp, Artificial Sequence
  Description of Artificial Sequence: Synthetic oligonucleotide
  Target: ATXN1; (-) strand; PAM type: YTN; PAM sequence: TTT
tggataattggatatgaatg

SEQ ID NO: 163619 - DNA, 20 bp, Artificial Sequence
  Description of Artificial Sequence: Synthetic oligonucleotide
  Target: ATXN1; (-) strand; PAM type: YTN; PAM sequence: TTA
gttttggataattggatatg

SEQ ID NO: 163620 - DNA, 20 bp, Artificial Sequence
  Description of Artificial Sequence: Synthetic oligonucleotide
  Target: ATXN1; (-) strand; PAM type: YTN; PAM sequence: TTA
attagttttggataattgga

SEQ ID NO: 163621 - DNA, 20 bp, Artificial Sequence
  Description of Artificial Sequence: Synthetic oligonucleotide
  Target: ATXN1; (-) strand; PAM type: YTN; PAM sequence: TTT
aattagttttggataattgg

SEQ ID NO: 163622 - DNA, 20 bp, Artificial Sequence
  Description of Artificial Sequence: Synthetic oligonucleotide
  Target: ATXN1; (-) strand; PAM type: YTN; PAM sequence: CTT
taattagttttggataattg

SEQ ID NO: 163623 - DNA, 20 bp, Artificial Sequence
  Description of Artificial Sequence: Synthetic oligonucleotide
  Target: ATXN1; (-) strand; PAM type: YTN; PAM sequence: CTA
agacaatctttaattagttt

SEQ ID NO: 163624 - DNA, 20 bp, Artificial Sequence
  Description of Artificial Sequence: Synthetic oligonucleotide
  Target: ATXN1; (-) strand; PAM type: YTN; PAM sequence: TTG
agcctaagacaatctttaat

SEQ ID NO: 163625 - DNA, 20 bp, Artificial Sequence
  Description of Artificial Sequence: Synthetic oligonucleotide
  Target: ATXN1; (-) strand; PAM type: YTN; PAM sequence: TTG
agattgagcctaagacaatc

SEQ ID NO: 163626 - DNA, 20 bp, Artificial Sequence
  Description of Artificial Sequence: Synthetic oligonucleotide
  Target: ATXN1; (-) strand; PAM type: YTN; PAM sequence: CTT
gagattgagcctaagacaat

SEQ ID NO: 163627 - DNA, 20 bp, Artificial Sequence
  Description of Artificial Sequence: Synthetic oligonucleotide
  Target: ATXN1; (-) strand; PAM type: YTN; PAM sequence: TTC
cttgagattgagcctaagac

SEQ ID NO: 163628 - DNA, 20 bp, Artificial Sequence
  Description of Artificial Sequence: Synthetic oligonucleotide
  Target: ATXN1; (-) strand; PAM type: YTN; PAM sequence: TTT
ccttgagattgagcctaaga

SEQ ID NO: 163629 - DNA, 20 bp, Artificial Sequence
  Description of Artificial Sequence: Synthetic oligonucleotide
  Target: ATXN1; (-) strand; PAM type: YTN; PAM sequence: CTA
ccgaggtgtttccttgagat

SEQ ID NO: 163630 - DNA, 20 bp, Artificial Sequence
  Description of Artificial Sequence: Synthetic oligonucleotide
  Target: ATXN1; (-) strand; PAM type: YTN; PAM sequence: TTC
cagtaaatccagagactacc

SEQ ID NO: 163631 - DNA, 20 bp, Artificial Sequence
  Description of Artificial Sequence: Synthetic oligonucleotide
  Target: ATXN1; (-) strand; PAM type: YTN; PAM sequence: CTT
ccagtaaatccagagactac

SEQ ID NO: 163632 - DNA, 20 bp, Artificial Sequence
  Description of Artificial Sequence: Synthetic oligonucleotide
  Target: ATXN1; (-) strand; PAM type: YTN; PAM sequence: CTC
ttccagtaaatccagagact

SEQ ID NO: 163633 - DNA, 20 bp, Artificial Sequence
  Description of Artificial Sequence: Synthetic oligonucleotide
  Target: ATXN1; (-) strand; PAM type: YTN; PAM sequence: TTG
taaatacacacctcttccag

SEQ ID NO: 163634 - DNA, 20 bp, Artificial Sequence
  Description of Artificial Sequence: Synthetic oligonucleotide
  Target: ATXN1; (-) strand; PAM type: YTN; PAM sequence: TTT
gtaaatacacacctcttcca

SEQ ID NO: 163635 - DNA, 20 bp, Artificial Sequence
  Description of Artificial Sequence: Synthetic oligonucleotide
  Target: ATXN1; (-) strand; PAM type: YTN; PAM sequence: CTT
tgtaaatacacacctcttcc

SEQ ID NO: 163636 - DNA, 20 bp, Artificial Sequence
  Description of Artificial Sequence: Synthetic oligonucleotide
  Target: ATXN1; (-) strand; PAM type: YTN; PAM sequence: TTG
tctttgtaaatacacacctc

SEQ ID NO: 163637 - DNA, 20 bp, Artificial Sequence
  Description of Artificial Sequence: Synthetic oligonucleotide
  Target: ATXN1; (-) strand; PAM type: YTN; PAM sequence: TTG
ttgtctttgtaaatacacac

SEQ ID NO: 163638 - DNA, 20 bp, Artificial Sequence
  Description of Artificial Sequence: Synthetic oligonucleotide
  Target: ATXN1; (-) strand; PAM type: YTN; PAM sequence: TTC
aacaaaattgttgtctttgt

SEQ ID NO: 163639 - DNA, 20 bp, Artificial Sequence
  Description of Artificial Sequence: Synthetic oligonucleotide
  Target: ATXN1; (-) strand; PAM type: YTN; PAM sequence: TTT
caacaaaattgttgtctttg

SEQ ID NO: 163640 - DNA, 20 bp, Artificial Sequence
  Description of Artificial Sequence: Synthetic oligonucleotide
  Target: ATXN1; (-) strand; PAM type: YTN; PAM sequence: CTG
gtttcaacaaaattgttgtc

SEQ ID NO: 163641 - DNA, 20 bp, Artificial Sequence
  Description of Artificial Sequence: Synthetic oligonucleotide
  Target: ATXN1; (-) strand; PAM type: YTN; PAM sequence: TTA
ggctggtttcaacaaaattg

SEQ ID NO: 163642 - DNA, 20 bp, Artificial Sequence
  Description of Artificial Sequence: Synthetic oligonucleotide
  Target: ATXN1; (-) strand; PAM type: YTN; PAM sequence: TTT
aggctggtttcaacaaaatt

SEQ ID NO: 163643 - DNA, 20 bp, Artificial Sequence
  Description of Artificial Sequence: Synthetic oligonucleotide
  Target: ATXN1; (-) strand; PAM type: YTN; PAM sequence: TTG
atttaggctggtttcaacaa

SEQ ID NO: 163644 - DNA, 20 bp, Artificial Sequence
  Description of Artificial Sequence: Synthetic oligonucleotide
  Target: ATXN1; (-) strand; PAM type: YTN; PAM sequence: CTA
cgattgatttaggctggttt

SEQ ID NO: 163645 - DNA, 20 bp, Artificial Sequence
  Description of Artificial Sequence: Synthetic oligonucleotide
  Target: ATXN1; (-) strand; PAM type: YTN; PAM sequence: TTC
ctacgattgatttaggctgg

SEQ ID NO: 163646 - DNA, 20 bp, Artificial Sequence
  Description of Artificial Sequence: Synthetic oligonucleotide
  Target: ATXN1; (-) strand; PAM type: YTN; PAM sequence: CTT
cctacgattgatttaggctg

SEQ ID NO: 163647 - DNA, 20 bp, Artificial Sequence
  Description of Artificial Sequence: Synthetic oligonucleotide
  Target: ATXN1; (-) strand; PAM type: YTN; PAM sequence: TTG
tccttcctacgattgattta

SEQ ID NO: 163648 - DNA, 20 bp, Artificial Sequence
  Description of Artificial Sequence: Synthetic oligonucleotide
  Target: ATXN1; (-) strand; PAM type: YTN; PAM sequence: CTT
gtccttcctacgattgattt

SEQ ID NO: 163649 - DNA, 20 bp, Artificial Sequence
  Description of Artificial Sequence: Synthetic oligonucleotide
  Target: ATXN1; (-) strand; PAM type: YTN; PAM sequence: CTC
cttgtccttcctacgattga

SEQ ID NO: 163650 - DNA, 20 bp, Artificial Sequence
  Description of Artificial Sequence: Synthetic oligonucleotide
  Target: ATXN1; (-) strand; PAM type: YTN; PAM sequence: CTG
atctccttgtccttcctacg

SEQ ID NO: 163651 - DNA, 20 bp, Artificial Sequence
  Description of Artificial Sequence: Synthetic oligonucleotide
  Target: ATXN1; (-) strand; PAM type: YTN; PAM sequence: TTG
gccgatgtgtacagctgatc

SEQ ID NO: 163652 - DNA, 20 bp, Artificial Sequence
  Description of Artificial Sequence: Synthetic oligonucleotide
  Target: ATXN1; (-) strand; PAM type: YTN; PAM sequence: CTT
ggccgatgtgtacagctgat

SEQ ID NO: 163653 - DNA, 20 bp, Artificial Sequence
  Description of Artificial Sequence: Synthetic oligonucleotide
  Target: ATXN1; (-) strand; PAM type: YTN; PAM sequence: TTA
tcttggccgatgtgtacagc

SEQ ID NO: 163654 - DNA, 20 bp, Artificial Sequence
  Description of Artificial Sequence: Synthetic oligonucleotide
  Target: ATXN1; (-) strand; PAM type: YTN; PAM sequence: CTT
atcttggccgatgtgtacag

SEQ ID NO: 163655 - DNA, 20 bp, Artificial Sequence
  Description of Artificial Sequence: Synthetic oligonucleotide
  Target: ATXN1; (-) strand; PAM type: YTN; PAM sequence: TTC
ttatcttggccgatgtgtac

SEQ ID NO: 163656 - DNA, 20 bp, Artificial Sequence
  Description of Artificial Sequence: Synthetic oligonucleotide
  Target: ATXN1; (-) strand; PAM type: YTN; PAM sequence: TTG
cagagagaattcttatcttg

SEQ ID NO: 163657 - DNA, 20 bp, Artificial Sequence
  Description of Artificial Sequence: Synthetic oligonucleotide
  Target: ATXN1; (-) strand; PAM type: YTN; PAM sequence: TTA
ttgcagagagaattcttatc

SEQ ID NO: 163658 - DNA, 20 bp, Artificial Sequence
  Description of Artificial Sequence: Synthetic oligonucleotide
  Target: ATXN1; (-) strand; PAM type: YTN; PAM sequence: TTT
attgcagagagaattcttat

SEQ ID NO: 163659 - DNA, 20 bp, Artificial Sequence
  Description of Artificial Sequence: Synthetic oligonucleotide
  Target: ATXN1; (-) strand; PAM type: YTN; PAM sequence: TTA
aaacaaacatttattgcaga

SEQ ID NO: 163660 - DNA, 20 bp, Artificial Sequence
  Description of Artificial Sequence: Synthetic oligonucleotide
  Target: ATXN1; (-) strand; PAM type: YTN; PAM sequence: TTT
aaaacaaacatttattgcag

SEQ ID NO: 163661 - DNA, 20 bp, Artificial Sequence
  Description of Artificial Sequence: Synthetic oligonucleotide
  Target: ATXN1; (-) strand; PAM type: YTN; PAM sequence: TTT
taaaacaaacatttattgca

SEQ ID NO: 163662 - DNA, 20 bp, Artificial Sequence
  Description of Artificial Sequence: Synthetic oligonucleotide
  Target: ATXN1; (-) strand; PAM type: YTN; PAM sequence: CTA
attttaaaacaaacatttat

SEQ ID NO: 163663 - DNA, 20 bp, Artificial Sequence
  Description of Artificial Sequence: Synthetic oligonucleotide
  Target: ATXN1; (-) strand; PAM type: YTN; PAM sequence: TTC
accgagtgtgagtcataccc

SEQ ID NO: 163664 - DNA, 20 bp, Artificial Sequence
  Description of Artificial Sequence: Synthetic oligonucleotide
  Target: ATXN1; (-) strand; PAM type: YTN; PAM sequence: TTG
agggtcagaagtcagccacc

SEQ ID NO: 163665 - DNA, 20 bp, Artificial Sequence
  Description of Artificial Sequence: Synthetic oligonucleotide
  Target: ATXN1; (-) strand; PAM type: YTN; PAM sequence: TTT
gagggtcagaagtcagccac

SEQ ID NO: 163666 - DNA, 20 bp, Artificial Sequence
  Description of Artificial Sequence: Synthetic oligonucleotide
  Target: ATXN1; (-) strand; PAM type: YTN; PAM sequence: TTT
tgagggtcagaagtcagcca

SEQ ID NO: 163667 - DNA, 20 bp, Artificial Sequence
  Description of Artificial Sequence: Synthetic oligonucleotide
  Target: ATXN1; (-) strand; PAM type: YTN; PAM sequence: CTT
ttgagggtcagaagtcagcc

SEQ ID NO: 163668 - DNA, 20 bp, Artificial Sequence
  Description of Artificial Sequence: Synthetic oligonucleotide
  Target: ATXN1; (-) strand; PAM type: YTN; PAM sequence: TTC
atcttttgagggtcagaagt

SEQ ID NO: 163669 - DNA, 20 bp, Artificial Sequence
  Description of Artificial Sequence: Synthetic oligonucleotide
  Target: ATXN1; (-) strand; PAM type: YTN; PAM sequence: TTC
aaaatgagccattcatcttt

SEQ ID NO: 163670 - DNA, 20 bp, Artificial Sequence
  Description of Artificial Sequence: Synthetic oligonucleotide
  Target: ATXN1; (-) strand; PAM type: YTN; PAM sequence: TTT
caaaatgagccattcatctt

SEQ ID NO: 163671 - DNA, 20 bp, Artificial Sequence
  Description of Artificial Sequence: Synthetic oligonucleotide
  Target: ATXN1; (-) strand; PAM type: YTN; PAM sequence: TTT
tcaaaatgagccattcatct

SEQ ID NO: 163672 - DNA, 20 bp, Artificial Sequence
  Description of Artificial Sequence: Synthetic oligonucleotide
  Target: ATXN1; (-) strand; PAM type: YTN; PAM sequence: CTT
ttcaaaatgagccattcatc

SEQ ID NO: 163673 - DNA, 20 bp, Artificial Sequence
  Description of Artificial Sequence: Synthetic oligonucleotide
  Target: ATXN1; (-) strand; PAM type: YTN; PAM sequence: CTG
ggcttttcaaaatgagccat

SEQ ID NO: 163674 - DNA, 20 bp, Artificial Sequence
  Description of Artificial Sequence: Synthetic oligonucleotide
  Target: ATXN1; (-) strand; PAM type: YTN; PAM sequence: TTG
ctgggcttttcaaaatgagc

SEQ ID NO: 163675 - DNA, 20 bp, Artificial Sequence
  Description of Artificial Sequence: Synthetic oligonucleotide
  Target: ATXN1; (-) strand; PAM type: YTN; PAM sequence: CTT
gctgggcttttcaaaatgag

SEQ ID NO: 163676 - DNA, 20 bp, Artificial Sequence
  Description of Artificial Sequence: Synthetic oligonucleotide
  Target: ATXN1; (-) strand; PAM type: YTN; PAM sequence: TTC
ccacttgctgggcttttcaa

SEQ ID NO: 163677 - DNA, 20 bp, Artificial Sequence
  Description of Artificial Sequence: Synthetic oligonucleotide
  Target: ATXN1; (-) strand; PAM type: YTN; PAM sequence: CTT
cccacttgctgggcttttca

SEQ ID NO: 163678 - DNA, 20 bp, Artificial Sequence
  Description of Artificial Sequence: Synthetic oligonucleotide
  Target: ATXN1; (-) strand; PAM type: YTN; PAM sequence: CTG
aagtcagtggaggtagaaag

SEQ ID NO: 163679 - DNA, 20 bp, Artificial Sequence
  Description of Artificial Sequence: Synthetic oligonucleotide
  Target: ATXN1; (-) strand; PAM type: YTN; PAM sequence: TTC
tgaagtcagtggaggtagaa

SEQ ID NO: 163680 - DNA, 20 bp, Artificial Sequence
  Description of Artificial Sequence: Synthetic oligonucleotide
  Target: ATXN1; (-) strand; PAM type: YTN; PAM sequence: CTC
attctgaagtcagtggaggt

SEQ ID NO: 163681 - DNA, 20 bp, Artificial Sequence
  Description of Artificial Sequence: Synthetic oligonucleotide
  Target: ATXN1; (-) strand; PAM type: YTN; PAM sequence: CTG
cagcctcattctgaagtcag

SEQ ID NO: 163682 - DNA, 20 bp, Artificial Sequence
  Description of Artificial Sequence: Synthetic oligonucleotide
  Target: ATXN1; (-) strand; PAM type: YTN; PAM sequence: CTA
cactgcagcctcattctgaa

SEQ ID NO: 163683 - DNA, 20 bp, Artificial Sequence
  Description of Artificial Sequence: Synthetic oligonucleotide
  Target: ATXN1; (-) strand; PAM type: YTN; PAM sequence: CTC
cactacactgcagcctcatt

SEQ ID NO: 163684 - DNA, 20 bp, Artificial Sequence
  Description of Artificial Sequence: Synthetic oligonucleotide
  Target: ATXN1; (-) strand; PAM type: YTN; PAM sequence: TTG
ggctccactacactgcagcc

SEQ ID NO: 163685 - DNA, 20 bp, Artificial Sequence
  Description of Artificial Sequence: Synthetic oligonucleotide
  Target: ATXN1; (-) strand; PAM type: YTN; PAM sequence: CTT
gggctccactacactgcagc

SEQ ID NO: 163686 - DNA, 20 bp, Artificial Sequence
  Description of Artificial Sequence: Synthetic oligonucleotide
  Target: ATXN1; (-) strand; PAM type: YTN; PAM sequence: CTC
ggggccatcttgggctccac

SEQ ID NO: 163687 - DNA, 20 bp, Artificial Sequence
  Description of Artificial Sequence: Synthetic oligonucleotide
  Target: ATXN1; (-) strand; PAM type: YTN; PAM sequence: CTG
gaaacaactcggggccatct

SEQ ID NO: 163688 - DNA, 20 bp, Artificial Sequence
  Description of Artificial Sequence: Synthetic oligonucleotide
  Target: ATXN1; (-) strand; PAM type: YTN; PAM sequence: CTA
gtgactggaaacaactcggg

SEQ ID NO: 163689 - DNA, 20 bp, Artificial Sequence
  Description of Artificial Sequence: Synthetic oligonucleotide
  Target: ATXN1; (-) strand; PAM type: YTN; PAM sequence: TTG
ctagtgactggaaacaactc

SEQ ID NO: 163690 - DNA, 20 bp, Artificial Sequence
  Description of Artificial Sequence: Synthetic oligonucleotide
  Target: ATXN1; (-) strand; PAM type: YTN; PAM sequence: CTT
gctagtgactggaaacaact

SEQ ID NO: 163691 - DNA, 20 bp, Artificial Sequence
  Description of Artificial Sequence: Synthetic oligonucleotide
  Target: ATXN1; (-) strand; PAM type: YTN; PAM sequence: TTG
tccatcttgctagtgactgg

SEQ ID NO: 163692 - DNA, 20 bp, Artificial Sequence
  Description of Artificial Sequence: Synthetic oligonucleotide
  Target: ATXN1; (-) strand; PAM type: YTN; PAM sequence: CTG
caggtagcgagtcatcccat

SEQ ID NO: 163693 - DNA, 20 bp, Artificial Sequence
  Description of Artificial Sequence: Synthetic oligonucleotide
  Target: ATXN1; (-) strand; PAM type: YTN; PAM sequence: TTG
aaaacagctgcaggtagcga

SEQ ID NO: 163694 - DNA, 20 bp, Artificial Sequence
  Description of Artificial Sequence: Synthetic oligonucleotide
  Target: ATXN1; (-) strand; PAM type: YTN; PAM sequence: TTA
ttgaaaacagctgcaggtag

SEQ ID NO: 163695 - DNA, 20 bp, Artificial Sequence
  Description of Artificial Sequence: Synthetic oligonucleotide
  Target: ATXN1; (-) strand; PAM type: YTN; PAM sequence: TTT
attgaaaacagctgcaggta

SEQ ID NO: 163696 - DNA, 20 bp, Artificial Sequence
  Description of Artificial Sequence: Synthetic oligonucleotide
  Target: ATXN1; (-) strand; PAM type: YTN; PAM sequence: TTT
tattgaaaacagctgcaggt

SEQ ID NO: 163697 - DNA, 20 bp, Artificial Sequence
  Description of Artificial Sequence: Synthetic oligonucleotide
  Target: ATXN1; (-) strand; PAM type: YTN; PAM sequence: TTT
ttattgaaaacagctgcagg

SEQ ID NO: 163698 - DNA, 20 bp, Artificial Sequence
  Description of Artificial Sequence: Synthetic oligonucleotide
  Target: ATXN1; (-) strand; PAM type: YTN; PAM sequence: TTT
tttattgaaaacagctgcag

SEQ ID NO: 163699 - DNA, 20 bp, Artificial Sequence
  Description of Artificial Sequence: Synthetic oligonucleotide
  Target: ATXN1; (-) strand; PAM type: YTN; PAM sequence: CTT
ttttattgaaaacagctgca

SEQ ID NO: 163700 - DNA, 20 bp, Artificial Sequence
  Description of Artificial Sequence: Synthetic oligonucleotide
  Target: ATXN1; (-) strand; PAM type: YTN; PAM sequence: CTC
agcttttttattgaaaacag

SEQ ID NO: 163701 - DNA, 20 bp, Artificial Sequence
  Description of Artificial Sequence: Synthetic oligonucleotide
  Target: ATXN1; (-) strand; PAM type: YTN; PAM sequence: TTA
ctcagcttttttattgaaaa

SEQ ID NO: 163702 - DNA, 20 bp, Artificial Sequence
  Description of Artificial Sequence: Synthetic oligonucleotide
  Target: ATXN1; (-) strand; PAM type: YTN; PAM sequence: CTG
taattactcagcttttttat

SEQ ID NO: 163703 - DNA, 20 bp, Artificial Sequence
  Description of Artificial Sequence: Synthetic oligonucleotide
  Target: ATXN1; (-) strand; PAM type: YTN; PAM sequence: CTG
ctgtaattactcagcttttt

SEQ ID NO: 163704 - DNA, 20 bp, Artificial Sequence
  Description of Artificial Sequence: Synthetic oligonucleotide
  Target: ATXN1; (-) strand; PAM type: YTN; PAM sequence: CTG
ggccgcatgtgagccccagg

SEQ ID NO: 163705 - DNA, 20 bp, Artificial Sequence
  Description of Artificial Sequence: Synthetic oligonucleotide
  Target: ATXN1; (-) strand; PAM type: YTN; PAM sequence: TTG
tgctgggccgcatgtgagcc

SEQ ID NO: 163706 - DNA, 20 bp, Artificial Sequence
  Description of Artificial Sequence: Synthetic oligonucleotide
  Target: ATXN1; (-) strand; PAM type: YTN; PAM sequence: TTT
gtgctgggccgcatgtgagc

SEQ ID NO: 163707 - DNA, 20 bp, Artificial Sequence
  Description of Artificial Sequence: Synthetic oligonucleotide
  Target: ATXN1; (-) strand; PAM type: YTN; PAM sequence: CTT
tgtgctgggccgcatgtgag

SEQ ID NO: 163708 - DNA, 20 bp, Artificial Sequence
  Description of Artificial Sequence: Synthetic oligonucleotide
  Target: ATXN1; (-) strand; PAM type: YTN; PAM sequence: TTG
gctttgtgctgggccgcatg

SEQ ID NO: 163709 - DNA, 20 bp, Artificial Sequence
  Description of Artificial Sequence: Synthetic oligonucleotide
  Target: ATXN1; (-) strand; PAM type: YTN; PAM sequence: TTC
cattggctttgtgctgggcc

SEQ ID NO: 163710 - DNA, 20 bp, Artificial Sequence
  Description of Artificial Sequence: Synthetic oligonucleotide
  Target: ATXN1; (-) strand; PAM type: YTN; PAM sequence: TTA
atgttccattggctttgtgc

SEQ ID NO: 163711 - DNA, 20 bp, Artificial Sequence
  Description of Artificial Sequence: Synthetic oligonucleotide
  Target: ATXN1; (-) strand; PAM type: YTN; PAM sequence: CTT
aatgttccattggctttgtg

SEQ ID NO: 163712 - DNA, 20 bp, Artificial Sequence
  Description of Artificial Sequence: Synthetic oligonucleotide
  Target: ATXN1; (-) strand; PAM type: YTN; PAM sequence: TTC
agtgtccttaatgttccatt

SEQ ID NO: 163713 - DNA, 20 bp, Artificial Sequence
  Description of Artificial Sequence: Synthetic oligonucleotide
  Target: ATXN1; (-) strand; PAM type: YTN; PAM sequence: CTC
attcagtgtccttaatgttc

SEQ ID NO: 163714 - DNA, 20 bp, Artificial Sequence
  Description of Artificial Sequence: Synthetic oligonucleotide
  Target: ATXN1; (-) strand; PAM type: YTN; PAM sequence: CTG
gcagctcattcagtgtcctt

SEQ ID NO: 163715 - DNA, 20 bp, Artificial Sequence
  Description of Artificial Sequence: Synthetic oligonucleotide
  Target: ATXN1; (-) strand; PAM type: YTN; PAM sequence: TTC
tggcagctcattcagtgtcc

SEQ ID NO: 163716 - DNA, 20 bp, Artificial Sequence
  Description of Artificial Sequence: Synthetic oligonucleotide
  Target: ATXN1; (-) strand; PAM type: YTN; PAM sequence: CTT
ctggcagctcattcagtgtc

SEQ ID NO: 163717 - DNA, 20 bp, Artificial Sequence
  Description of Artificial Sequence: Synthetic oligonucleotide
  Target: ATXN1; (-) strand; PAM type: YTN; PAM sequence: CTG
aagggcttctggcagctcat

SEQ ID NO: 163718 - DNA, 20 bp, Artificial Sequence
  Description of Artificial Sequence: Synthetic oligonucleotide
  Target: ATXN1; (-) strand; PAM type: YTN; PAM sequence: TTG
gcagcccaatgctgaagggc

SEQ ID NO: 163719 - DNA, 20 bp, Artificial Sequence
  Description of Artificial Sequence: Synthetic oligonucleotide
  Target: ATXN1; (-) strand; PAM type: YTN; PAM sequence: TTT
ggcagcccaatgctgaaggg

SEQ ID NO: 163720 - DNA, 20 bp, Artificial Sequence
  Description of Artificial Sequence: Synthetic oligonucleotide
  Target: ATXN1; (-) strand; PAM type: YTN; PAM sequence: CTG
ggggaggaggagcagtttgg

SEQ ID NO: 163721 - DNA, 20 bp, Artificial Sequence
  Description of Artificial Sequence: Synthetic oligonucleotide
  Target: ATXN1; (-) strand; PAM type: YTN; PAM sequence: CTG
agctgggggaggaggagcag

SEQ ID NO: 163722 - DNA, 20 bp, Artificial Sequence
  Description of Artificial Sequence: Synthetic oligonucleotide
  Target: ATXN1; (-) strand; PAM type: YTN; PAM sequence: TTA
atgacgctgagctgggggag

SEQ ID NO: 163723 - DNA, 20 bp, Artificial Sequence
  Description of Artificial Sequence: Synthetic oligonucleotide
  Target: ATXN1; (-) strand; PAM type: YTN; PAM sequence: TTA
agttaatgacgctgagctgg

SEQ ID NO: 163724 - DNA, 20 bp, Artificial Sequence
  Description of Artificial Sequence: Synthetic oligonucleotide
  Target: ATXN1; (-) strand; PAM type: YTN; PAM sequence: CTG
attaagttaatgacgctgag

SEQ ID NO: 163725 - DNA, 20 bp, Artificial Sequence
  Description of Artificial Sequence: Synthetic oligonucleotide
  Target: ATXN1; (-) strand; PAM type: YTN; PAM sequence: TTG
aatgaatacctgattaagtt

SEQ ID NO: 163726 - DNA, 20 bp, Artificial Sequence
  Description of Artificial Sequence: Synthetic oligonucleotide
  Target: ATXN1; (-) strand; PAM type: YTN; PAM sequence: TTA
ttgaatgaatacctgattaa

SEQ ID NO: 163727 - DNA, 20 bp, Artificial Sequence
  Description of Artificial Sequence: Synthetic oligonucleotide
  Target: ATXN1; (-) strand; PAM type: YTN; PAM sequence: TTT
attgaatgaatacctgatta

SEQ ID NO: 163728 - DNA, 20 bp, Artificial Sequence
  Description of Artificial Sequence: Synthetic oligonucleotide
  Target: ATXN1; (-) strand; PAM type: YTN; PAM sequence: TTT
tattgaatgaatacctgatt

SEQ ID NO: 163729 - DNA, 20 bp, Artificial Sequence
  Description of Artificial Sequence: Synthetic oligonucleotide
  Target: ATXN1; (-) strand; PAM type: YTN; PAM sequence: TTT
ttattgaatgaatacctgat

SEQ ID NO: 163730 - DNA, 20 bp, Artificial Sequence
  Description of Artificial Sequence: Synthetic oligonucleotide
  Target: ATXN1; (-) strand; PAM type: YTN; PAM sequence: TTT
tttattgaatgaatacctga

SEQ ID NO: 163731 - DNA, 20 bp, Artificial Sequence
  Description of Artificial Sequence: Synthetic oligonucleotide
  Target: ATXN1; (-) strand; PAM type: YTN; PAM sequence: TTT
ttttattgaatgaatacctg

SEQ ID NO: 163732 - DNA, 20 bp, Artificial Sequence
  Description of Artificial Sequence: Synthetic oligonucleotide
  Target: ATXN1; (-) strand; PAM type: YTN; PAM sequence: TTT
tttttattgaatgaatacct

SEQ ID NO: 163733 - DNA, 20 bp, Artificial Sequence
  Description of Artificial Sequence: Synthetic oligonucleotide
  Target: ATXN1; (-) strand; PAM type: YTN; PAM sequence: TTT
ttttttattgaatgaatacc

SEQ ID NO: 163734 - DNA, 20 bp, Artificial Sequence
  Description of Artificial Sequence: Synthetic oligonucleotide
  Target: ATXN1; (-) strand; PAM type: YTN; PAM sequence: CTA
catccagggagtgtcaattt

SEQ ID NO: 163735 - DNA, 20 bp, Artificial Sequence
  Description of Artificial Sequence: Synthetic oligonucleotide
  Target: ATXN1; (-) strand; PAM type: YTN; PAM sequence: TTG
cctacatccagggagtgtca

SEQ ID NO: 163736 - DNA, 20 bp, Artificial Sequence
  Description of Artificial Sequence: Synthetic oligonucleotide
  Target: ATXN1; (-) strand; PAM type: YTN; PAM sequence: TTC
agagggtgttgcctacatcc

SEQ ID NO: 163737 - DNA, 20 bp, Artificial Sequence
  Description of Artificial Sequence: Synthetic oligonucleotide
  Target: ATXN1; (-) strand; PAM type: YTN; PAM sequence: CTC
attcagagggtgttgcctac

SEQ ID NO: 163738 - DNA, 20 bp, Artificial Sequence
  Description of Artificial Sequence: Synthetic oligonucleotide
  Target: ATXN1; (-) strand; PAM type: YTN; PAM sequence: TTG
acagtgtgcctcattcagag

SEQ ID NO: 163739 - DNA, 20 bp, Artificial Sequence
  Description of Artificial Sequence: Synthetic oligonucleotide
  Target: ATXN1; (-) strand; PAM type: YTN; PAM sequence: TTT
gacagtgtgcctcattcaga

SEQ ID NO: 163740 - DNA, 20 bp, Artificial Sequence
  Description of Artificial Sequence: Synthetic oligonucleotide
  Target: ATXN1; (-) strand; PAM type: YTN; PAM sequence: CTG
ccggatgcagtcaatttgac

SEQ ID NO: 163741 - DNA, 20 bp, Artificial Sequence
  Description of Artificial Sequence: Synthetic oligonucleotide
  Target: ATXN1; (-) strand; PAM type: YTN; PAM sequence: TTC
ctgccggatgcagtcaattt

SEQ ID NO: 163742 - DNA, 20 bp, Artificial Sequence
  Description of Artificial Sequence: Synthetic oligonucleotide
  Target: ATXN1; (-) strand; PAM type: YTN; PAM sequence: CTT
cctgccggatgcagtcaatt

SEQ ID NO: 163743 - DNA, 20 bp, Artificial Sequence
  Description of Artificial Sequence: Synthetic oligonucleotide
  Target: ATXN1; (-) strand; PAM type: YTN; PAM sequence: CTC
acacttcctgccggatgcag

SEQ ID NO: 163744 - DNA, 20 bp, Artificial Sequence
  Description of Artificial Sequence: Synthetic oligonucleotide
  Target: ATXN1; (-) strand; PAM type: YTN; PAM sequence: TTA
aaagaatatagaaccgccct

SEQ ID NO: 163745 - DNA, 20 bp, Artificial Sequence
  Description of Artificial Sequence: Synthetic oligonucleotide
  Target: ATXN1; (-) strand; PAM type: YTN; PAM sequence: CTC
aaaataaataaataaataaa

SEQ ID NO: 163746 - DNA, 20 bp, Artificial Sequence
  Description of Artificial Sequence: Synthetic oligonucleotide
  Target: ATXN1; (-) strand; PAM type: YTN; PAM sequence: CTG
tctcaaaataaataaataaa

SEQ ID NO: 163747 - DNA, 20 bp, Artificial Sequence
  Description of Artificial Sequence: Synthetic oligonucleotide
  Target: ATXN1; (-) strand; PAM type: YTN; PAM sequence: CTA
ctgtctcaaaataaataaat

SEQ ID NO: 163748 - DNA, 20 bp, Artificial Sequence
  Description of Artificial Sequence: Synthetic oligonucleotide
  Target: ATXN1; (-) strand; PAM type: YTN; PAM sequence: CTG
gctactgtctcaaaataaat

SEQ ID NO: 163749 - DNA, 20 bp, Artificial Sequence
  Description of Artificial Sequence: Synthetic oligonucleotide
  Target: ATXN1; (-) strand; PAM type: YTN; PAM sequence: CTC
tggctactgtctcaaaataa

SEQ ID NO: 163750 - DNA, 20 bp, Artificial Sequence
  Description of Artificial Sequence: Synthetic oligonucleotide
  Target: ATXN1; (-) strand; PAM type: YTN; PAM sequence: CTC
cagctctggctactgtctca

SEQ ID NO: 163751 - DNA, 20 bp, Artificial Sequence
  Description of Artificial Sequence: Synthetic oligonucleotide
  Target: ATXN1; (-) strand; PAM type: YTN; PAM sequence: CTG
cgctccagctctggctactg

SEQ ID NO: 163752 - DNA, 20 bp, Artificial Sequence
  Description of Artificial Sequence: Synthetic oligonucleotide
  Target: ATXN1; (-) strand; PAM type: YTN; PAM sequence: CTG
ggatcacgtgactgcgctcc

SEQ ID NO: 163753 - DNA, 20 bp, Artificial Sequence
  Description of Artificial Sequence: Synthetic oligonucleotide
  Target: ATXN1; (-) strand; PAM type: YTN; PAM sequence: TTG
cagtgagctgggatcacgtg

SEQ ID NO: 163754 - DNA, 20 bp, Artificial Sequence
  Description of Artificial Sequence: Synthetic oligonucleotide
  Target: ATXN1; (-) strand; PAM type: YTN; PAM sequence: TTG
aacccaggaggcggaggttg

SEQ ID NO: 163755 - DNA, 20 bp, Artificial Sequence
  Description of Artificial Sequence: Synthetic oligonucleotide
  Target: ATXN1; (-) strand; PAM type: YTN; PAM sequence: CTT
gaacccaggaggcggaggtt

SEQ ID NO: 163756 - DNA, 20 bp, Artificial Sequence
  Description of Artificial Sequence: Synthetic oligonucleotide
  Target: ATXN1; (-) strand; PAM type: YTN; PAM sequence: CTG
aggcatgagaatcgcttgaa

SEQ ID NO: 163757 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggcatgagaa

SEQ ID NO: 163758 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgaggcatga

SEQ ID NO: 163759 - DNA, 20 bp, Artificial Sequence
  Description of Artificial Sequence: Synthetic oligonucleotide
  Target: ATXN1; (-) strand; PAM type: YTN; PAM sequence: CTG
taatcccagctactcaggag

SEQ ID NO: 163760 - DNA, 20 bp, Artificial Sequence
  Description of Artificial Sequence: Synthetic oligonucleotide
  Target: ATXN1; (-) strand; PAM type: YTN; PAM sequence: CTA
gccaggcatggtggcaggcg

SEQ ID NO: 163761 - DNA, 20 bp, Artificial Sequence
  Description of Artificial Sequence: Synthetic oligonucleotide
  Target: ATXN1; (-) strand; PAM type: YTN; PAM sequence: CTG
aaaaaagtacaaaaactagc

SEQ ID NO: 163762 - DNA, 20 bp, Artificial Sequence
  Description of Artificial Sequence: Synthetic oligonucleotide
  Target: ATXN1; (-) strand; PAM type: YTN; PAM sequence: CTG
tctgaaaaaagtacaaaaac

SEQ ID NO: 163763 - DNA, 20 bp, Artificial Sequence
  Description of Artificial Sequence: Synthetic oligonucleotide
  Target: ATXN1; (-) strand; PAM type: YTN; PAM sequence: CTG
gccaacatgatataaccctg

SEQ ID NO: 163764 - DNA, 20 bp, Artificial Sequence
  Description of Artificial Sequence: Synthetic oligonucleotide
  Target: ATXN1; (-) strand; PAM type: YTN; PAM sequence: TTG
agaccagcctggccaacatg

SEQ ID NO: 163765 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctggccaacat

SEQ ID NO: 163766 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagtttgagacca

SEQ ID NO: 163767 - DNA, 20 bp, Artificial Sequence
  Description of Artificial Sequence: Synthetic oligonucleotide
  Target: ATXN1; (-) strand; PAM type: YTN; PAM sequence: TTG
ggaggccgagatgggcggat

SEQ ID NO: 163768 - DNA, 20 bp, Artificial Sequence
  Description of Artificial Sequence: Synthetic oligonucleotide
  Target: ATXN1; (-) strand; PAM type: YTN; PAM sequence: TTT
gggaggccgagatgggcgga

SEQ ID NO: 163769 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgagatgggcgg

SEQ ID NO: 163770 - DNA, 20 bp, Artificial Sequence
  Description of Artificial Sequence: Synthetic oligonucleotide
  Target: ATXN1; (-) strand; PAM type: YTN; PAM sequence: CTC
ccactttgggaggccgagat

SEQ ID NO: 163771 - DNA, 20 bp, Artificial Sequence
  Description of Artificial Sequence: Synthetic oligonucleotide
  Target: ATXN1; (-) strand; PAM type: YTN; PAM sequence: CTC
actcccactttgggaggccg

SEQ ID NO: 163772 - DNA, 20 bp, Artificial Sequence
  Description of Artificial Sequence: Synthetic oligonucleotide
  Target: ATXN1; (-) strand; PAM type: YTN; PAM sequence: CTG
taatcccaagcggtggctca

SEQ ID NO: 163773 - DNA, 20 bp, Artificial Sequence
  Description of Artificial Sequence: Synthetic oligonucleotide
  Target: ATXN1; (-) strand; PAM type: YTN; PAM sequence: CTC
agggctgtaatcccaagcgg

SEQ ID NO: 163774 - DNA, 20 bp, Artificial Sequence
  Description of Artificial Sequence: Synthetic oligonucleotide
  Target: ATXN1; (-) strand; PAM type: YTN; PAM sequence: CTG
agcgtggtggctcagggctg

SEQ ID NO: 163775 - DNA, 20 bp, Artificial Sequence
  Description of Artificial Sequence: Synthetic oligonucleotide
  Target: ATXN1; (-) strand; PAM type: YTN; PAM sequence: TTA
aataggctgagcgtggtggc

SEQ ID NO: 163776 - DNA, 20 bp, Artificial Sequence
  Description of Artificial Sequence: Synthetic oligonucleotide
  Target: ATXN1; (-) strand; PAM type: YTN; PAM sequence: TTA
aaaataaattaaataggctg

SEQ ID NO: 163777 - DNA, 20 bp, Artificial Sequence
  Description of Artificial Sequence: Synthetic oligonucleotide
  Target: ATXN1; (-) strand; PAM type: YTN; PAM sequence: TTT
aaaaataaattaaataggct

SEQ ID NO: 163778 - DNA, 20 bp, Artificial Sequence
  Description of Artificial Sequence: Synthetic oligonucleotide
  Target: ATXN1; (-) strand; PAM type: YTN; PAM sequence: CTA
aatttaaaaataaattaaat

SEQ ID NO: 163779 - DNA, 20 bp, Artificial Sequence
  Description of Artificial Sequence: Synthetic oligonucleotide
  Target: ATXN1; (-) strand; PAM type: YTN; PAM sequence: TTC
ccagcccctaaatttaaaaa

SEQ ID NO: 163780 - DNA, 20 bp, Artificial Sequence
  Description of Artificial Sequence: Synthetic oligonucleotide
  Target: ATXN1; (-) strand; PAM type: YTN; PAM sequence: CTT
cccagcccctaaatttaaaa

SEQ ID NO: 163781 - DNA, 20 bp, Artificial Sequence
  Description of Artificial Sequence: Synthetic oligonucleotide
  Target: ATXN1; (-) strand; PAM type: YTN; PAM sequence: TTC
ccatcttcccagcccctaaa

SEQ ID NO: 163782 - DNA, 20 bp, Artificial Sequence
  Description of Artificial Sequence: Synthetic oligonucleotide
  Target: ATXN1; (-) strand; PAM type: YTN; PAM sequence: CTG
catagaggaggattcccatc

SEQ ID NO: 163783 - DNA, 20 bp, Artificial Sequence
  Description of Artificial Sequence: Synthetic oligonucleotide
  Target: ATXN1; (-) strand; PAM type: YTN; PAM sequence: TTA
ctgcatagaggaggattccc

SEQ ID NO: 163784 - DNA, 20 bp, Artificial Sequence
  Description of Artificial Sequence: Synthetic oligonucleotide
  Target: ATXN1; (-) strand; PAM type: YTN; PAM sequence: CTG
catgtccaaggattactgca

SEQ ID NO: 163785 - DNA, 20 bp, Artificial Sequence
  Description of Artificial Sequence: Synthetic oligonucleotide
  Target: ATXN1; (-) strand; PAM type: YTN; PAM sequence: TTC
cactgcatgtccaaggatta

SEQ ID NO: 163786 - DNA, 20 bp, Artificial Sequence
  Description of Artificial Sequence: Synthetic oligonucleotide
  Target: ATXN1; (-) strand; PAM type: YTN; PAM sequence: CTT
ccactgcatgtccaaggatt

SEQ ID NO: 163787 - DNA, 20 bp, Artificial Sequence
  Description of Artificial Sequence: Synthetic oligonucleotide
  Target: ATXN1; (-) strand; PAM type: YTN; PAM sequence: CTC
ttccactgcatgtccaagga

SEQ ID NO: 163788 - DNA, 20 bp, Artificial Sequence
  Description of Artificial Sequence: Synthetic oligonucleotide
  Target: ATXN1; (-) strand; PAM type: YTN; PAM sequence: CTC
tcttccactgcatgtccaag

SEQ ID NO: 163789 - DNA, 20 bp, Artificial Sequence
  Description of Artificial Sequence: Synthetic oligonucleotide
  Target: ATXN1; (-) strand; PAM type: YTN; PAM sequence: CTA
taacctctcttccactgcat

SEQ ID NO: 163790 - DNA, 20 bp, Artificial Sequence
  Description of Artificial Sequence: Synthetic oligonucleotide
  Target: ATXN1; (-) strand; PAM type: YTN; PAM sequence: CTC
actataacctctcttccact

SEQ ID NO: 163791 - DNA, 20 bp, Artificial Sequence
  Description of Artificial Sequence: Synthetic oligonucleotide
  Target: ATXN1; (-) strand; PAM type: YTN; PAM sequence: CTG
ctcactataacctctcttcc

SEQ ID NO: 163792 - DNA, 20 bp, Artificial Sequence
  Description of Artificial Sequence: Synthetic oligonucleotide
  Target: ATXN1; (-) strand; PAM type: YTN; PAM sequence: CTG
tgaccagcagctgctcacta

SEQ ID NO: 163793 - DNA, 20 bp, Artificial Sequence
  Description of Artificial Sequence: Synthetic oligonucleotide
  Target: ATXN1; (-) strand; PAM type: YTN; PAM sequence: TTA
gtctgtgaccagcagctgct

SEQ ID NO: 163794 - DNA, 20 bp, Artificial Sequence
  Description of Artificial Sequence: Synthetic oligonucleotide
  Target: ATXN1; (-) strand; PAM type: YTN; PAM sequence: TTT
agtctgtgaccagcagctgc

SEQ ID NO: 163795 - DNA, 20 bp, Artificial Sequence
  Description of Artificial Sequence: Synthetic oligonucleotide
  Target: ATXN1; (-) strand; PAM type: YTN; PAM sequence: CTT
tagtctgtgaccagcagctg

SEQ ID NO: 163796 - DNA, 20 bp, Artificial Sequence
  Description of Artificial Sequence: Synthetic oligonucleotide
  Target: ATXN1; (-) strand; PAM type: YTN; PAM sequence: CTC
tttagtctgtgaccagcagc

SEQ ID NO: 163797 - DNA, 20 bp, Artificial Sequence
  Description of Artificial Sequence: Synthetic oligonucleotide
  Target: ATXN1; (-) strand; PAM type: YTN; PAM sequence: TTC
tctttagtctgtgaccagca

SEQ ID NO: 163798 - DNA, 20 bp, Artificial Sequence
  Description of Artificial Sequence: Synthetic oligonucleotide
  Target: ATXN1; (-) strand; PAM type: YTN; PAM sequence: CTT
ctctttagtctgtgaccagc

SEQ ID NO: 163799 - DNA, 20 bp, Artificial Sequence
  Description of Artificial Sequence: Synthetic oligonucleotide
  Target: ATXN1; (-) strand; PAM type: YTN; PAM sequence: TTC
ttctctttagtctgtgacca

SEQ ID NO: 163800 - DNA, 20 bp, Artificial Sequence
  Description of Artificial Sequence: Synthetic oligonucleotide
  Target: ATXN1; (-) strand; PAM type: YTN; PAM sequence: TTT
cttctctttagtctgtgacc

SEQ ID NO: 163801 - DNA, 20 bp, Artificial Sequence
  Description of Artificial Sequence: Synthetic oligonucleotide
  Target: ATXN1; (-) strand; PAM type: YTN; PAM sequence: CTA
aatgcaaagagggagcaagg

SEQ ID NO: 163802 - DNA, 20 bp, Artificial Sequence
  Description of Artificial Sequence: Synthetic oligonucleotide
  Target: ATXN1; (-) strand; PAM type: YTN; PAM sequence: TTC
taaatgcaaagagggagcaa

SEQ ID NO: 163803 - DNA, 20 bp, Artificial Sequence
  Description of Artificial Sequence: Synthetic oligonucleotide
  Target: ATXN1; (-) strand; PAM type: YTN; PAM sequence: CTT
ctaaatgcaaagagggagca

SEQ ID NO: 163804 - DNA, 20 bp, Artificial Sequence
  Description of Artificial Sequence: Synthetic oligonucleotide
  Target: ATXN1; (-) strand; PAM type: YTN; PAM sequence: TTA
atgcttctaaatgcaaagag

SEQ ID NO: 163805 - DNA, 20 bp, Artificial Sequence
  Description of Artificial Sequence: Synthetic oligonucleotide
  Target: ATXN1; (-) strand; PAM type: YTN; PAM sequence: TTA
tcaagtgttaatgcttctaa

SEQ ID NO: 163806 - DNA, 20 bp, Artificial Sequence
  Description of Artificial Sequence: Synthetic oligonucleotide
  Target: ATXN1; (-) strand; PAM type: YTN; PAM sequence: CTC
aggagtcagaacgatattat

SEQ ID NO: 163807 - DNA, 20 bp, Artificial Sequence
  Description of Artificial Sequence: Synthetic oligonucleotide
  Target: ATXN1; (-) strand; PAM type: YTN; PAM sequence: CTG
ctcaggagtcagaacgatat

SEQ ID NO: 163808 - DNA, 20 bp, Artificial Sequence
  Description of Artificial Sequence: Synthetic oligonucleotide
  Target: ATXN1; (-) strand; PAM type: YTN; PAM sequence: TTC
ctgctcaggagtcagaacga

SEQ ID NO: 163809 - DNA, 20 bp, Artificial Sequence
  Description of Artificial Sequence: Synthetic oligonucleotide
  Target: ATXN1; (-) strand; PAM type: YTN; PAM sequence: CTT
cctgctcaggagtcagaacg

SEQ ID NO: 163810 - DNA, 20 bp, Artificial Sequence
  Description of Artificial Sequence: Synthetic oligonucleotide
  Target: ATXN1; (-) strand; PAM type: YTN; PAM sequence: CTA
tgtgcttcctgctcaggagt

SEQ ID NO: 163811 - DNA, 20 bp, Artificial Sequence
  Description of Artificial Sequence: Synthetic oligonucleotide
  Target: ATXN1; (-) strand; PAM type: YTN; PAM sequence: CTG
aatcaactatgtgcttcctg

SEQ ID NO: 163812 - DNA, 20 bp, Artificial Sequence
  Description of Artificial Sequence: Synthetic oligonucleotide
  Target: ATXN1; (-) strand; PAM type: YTN; PAM sequence: CTA
acatgacactgaatcaacta

SEQ ID NO: 163813 - DNA, 20 bp, Artificial Sequence
  Description of Artificial Sequence: Synthetic oligonucleotide
  Target: ATXN1; (-) strand; PAM type: YTN; PAM sequence: TTA
gcccggtctaacatgacact

SEQ ID NO: 163814 - DNA, 20 bp, Artificial Sequence
  Description of Artificial Sequence: Synthetic oligonucleotide
  Target: ATXN1; (-) strand; PAM type: YTN; PAM sequence: TTA
tcaaatgccagttagcccgg

SEQ ID NO: 163815 - DNA, 20 bp, Artificial Sequence
  Description of Artificial Sequence: Synthetic oligonucleotide
  Target: ATXN1; (-) strand; PAM type: YTN; PAM sequence: CTA
aagtcacgagttatcaaatg

SEQ ID NO: 163816 - DNA, 20 bp, Artificial Sequence
  Description of Artificial Sequence: Synthetic oligonucleotide
  Target: ATXN1; (-) strand; PAM type: YTN; PAM sequence: TTC
ctaaagtcacgagttatcaa

SEQ ID NO: 163817 - DNA, 20 bp, Artificial Sequence
  Description of Artificial Sequence: Synthetic oligonucleotide
  Target: ATXN1; (-) strand; PAM type: YTN; PAM sequence: TTT
cctaaagtcacgagttatca

SEQ ID NO: 163818 - DNA, 20 bp, Artificial Sequence
  Description of Artificial Sequence: Synthetic oligonucleotide
  Target: ATXN1; (-) strand; PAM type: YTN; PAM sequence: CTT
tcctaaagtcacgagttatc

SEQ ID NO: 163819 - DNA, 20 bp, Artificial Sequence
  Description of Artificial Sequence: Synthetic oligonucleotide
  Target: ATXN1; (-) strand; PAM type: YTN; PAM sequence: TTG
aaagactttcctaaagtcac

SEQ ID NO: 163820 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagtgagacccgg

SEQ ID NO: 163821 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgacagagtga

SEQ ID NO: 163822 - DNA, 20 bp, Artificial Sequence
  Description of Artificial Sequence: Synthetic oligonucleotide
  Target: ATXN1; (-) strand; PAM type: YTN; PAM sequence: CTA
cactccagcctgggtgacag

SEQ ID NO: 163823 - DNA, 20 bp, Artificial Sequence
  Description of Artificial Sequence: Synthetic oligonucleotide
  Target: ATXN1; (-) strand; PAM type: YTN; PAM sequence: CTC
actacactccagcctgggtg

SEQ ID NO: 163824 - DNA, 20 bp, Artificial Sequence
  Description of Artificial Sequence: Synthetic oligonucleotide
  Target: ATXN1; (-) strand; PAM type: YTN; PAM sequence: CTC
tcactacactccagcctggg

SEQ ID NO: 163825 - DNA, 20 bp, Artificial Sequence
  Description of Artificial Sequence: Synthetic oligonucleotide
  Target: ATXN1; (-) strand; PAM type: YTN; PAM sequence: CTG
tcacctctcactacactcca

SEQ ID NO: 163826 - DNA, 20 bp, Artificial Sequence
  Description of Artificial Sequence: Synthetic oligonucleotide
  Target: ATXN1; (-) strand; PAM type: YTN; PAM sequence: CTG
ccagtatgctgtcacctctc

SEQ ID NO: 163827 - DNA, 20 bp, Artificial Sequence
  Description of Artificial Sequence: Synthetic oligonucleotide
  Target: ATXN1; (-) strand; PAM type: YTN; PAM sequence: CTG
tgagggctgccagtatgctg

SEQ ID NO: 163828 - DNA, 20 bp, Artificial Sequence
  Description of Artificial Sequence: Synthetic oligonucleotide
  Target: ATXN1; (-) strand; PAM type: YTN; PAM sequence: CTC
aagagccgccaaagtgggag

SEQ ID NO: 163829 - DNA, 20 bp, Artificial Sequence
  Description of Artificial Sequence: Synthetic oligonucleotide
  Target: ATXN1; (-) strand; PAM type: YTN; PAM sequence: CTC
ctcaagagccgccaaagtgg

SEQ ID NO: 163830 - DNA, 20 bp, Artificial Sequence
  Description of Artificial Sequence: Synthetic oligonucleotide
  Target: ATXN1; (-) strand; PAM type: YTN; PAM sequence: TTG
gccagcccagaaagaggtcc

SEQ ID NO: 163831 - DNA, 20 bp, Artificial Sequence
  Description of Artificial Sequence: Synthetic oligonucleotide
  Target: ATXN1; (-) strand; PAM type: YTN; PAM sequence: CTT
ggccagcccagaaagaggtc

SEQ ID NO: 163832 - DNA, 20 bp, Artificial Sequence
  Description of Artificial Sequence: Synthetic oligonucleotide
  Target: ATXN1; (-) strand; PAM type: YTN; PAM sequence: CTG
gccttggccagcccagaaag

SEQ ID NO: 163833 - DNA, 20 bp, Artificial Sequence
  Description of Artificial Sequence: Synthetic oligonucleotide
  Target: ATXN1; (-) strand; PAM type: YTN; PAM sequence: CTC
tggccttggccagcccagaa

SEQ ID NO: 163834 - DNA, 20 bp, Artificial Sequence
  Description of Artificial Sequence: Synthetic oligonucleotide
  Target: ATXN1; (-) strand; PAM type: YTN; PAM sequence: CTG
agggagccggctctggcctt

SEQ ID NO: 163835 - DNA, 20 bp, Artificial Sequence
  Description of Artificial Sequence: Synthetic oligonucleotide
  Target: ATXN1; (-) strand; PAM type: YTN; PAM sequence: CTC
cgcgcaagctgagggagccg

SEQ ID NO: 163836 - DNA, 20 bp, Artificial Sequence
  Description of Artificial Sequence: Synthetic oligonucleotide
  Target: ATXN1; (-) strand; PAM type: YTN; PAM sequence: TTC
cacacctccgcgcaagctga

SEQ ID NO: 163837 - DNA, 20 bp, Artificial Sequence
  Description of Artificial Sequence: Synthetic oligonucleotide
  Target: ATXN1; (-) strand; PAM type: YTN; PAM sequence: CTT
ccacacctccgcgcaagctg

SEQ ID NO: 163838 - DNA, 20 bp, Artificial Sequence
  Description of Artificial Sequence: Synthetic oligonucleotide
  Target: ATXN1; (-) strand; PAM type: YTN; PAM sequence: CTC
cttccacacctccgcgcaag

SEQ ID NO: 163839 - DNA, 20 bp, Artificial Sequence
  Description of Artificial Sequence: Synthetic oligonucleotide
  Target: ATXN1; (-) strand; PAM type: YTN; PAM sequence: CTC
tccttccacacctccgcgca

SEQ ID NO: 163840 - DNA, 20 bp, Artificial Sequence
  Description of Artificial Sequence: Synthetic oligonucleotide
  Target: ATXN1; (-) strand; PAM type: YTN; PAM sequence: TTC
ccacccacgcctctccttcc

SEQ ID NO: 163841 - DNA, 20 bp, Artificial Sequence
  Description of Artificial Sequence: Synthetic oligonucleotide
  Target: ATXN1; (-) strand; PAM type: YTN; PAM sequence: CTG
gcccacaagcaacgcgcgca

SEQ ID NO: 163842 - DNA, 20 bp, Artificial Sequence
  Description of Artificial Sequence: Synthetic oligonucleotide
  Target: ATXN1; (-) strand; PAM type: YTN; PAM sequence: CTG
gaacgcgcgctggcccacaa

SEQ ID NO: 163843 - DNA, 20 bp, Artificial Sequence
  Description of Artificial Sequence: Synthetic oligonucleotide
  Target: ATXN1; (-) strand; PAM type: YTN; PAM sequence: CTC
cgagtgcggggcccacggag

SEQ ID NO: 163844 - DNA, 20 bp, Artificial Sequence
  Description of Artificial Sequence: Synthetic oligonucleotide
  Target: ATXN1; (-) strand; PAM type: YTN; PAM sequence: CTG
ctccgagtgcggggcccacg

SEQ ID NO: 163845 - DNA, 20 bp, Artificial Sequence
  Description of Artificial Sequence: Synthetic oligonucleotide
  Target: ATXN1; (-) strand; PAM type: YTN; PAM sequence: CTA
gggccggcggggtccgccgc

SEQ ID NO: 163846 - DNA, 20 bp, Artificial Sequence
  Description of Artificial Sequence: Synthetic oligonucleotide
  Target: ATXN1; (-) strand; PAM type: YTN; PAM sequence: CTG
ccctagggccggcggggtcc

SEQ ID NO: 163847 - DNA, 20 bp, Artificial Sequence
  Description of Artificial Sequence: Synthetic oligonucleotide
  Target: ATXN1; (-) strand; PAM type: YTN; PAM sequence: CTC
actgccctagggccggcggg

SEQ ID NO: 163848 - DNA, 20 bp, Artificial Sequence
  Description of Artificial Sequence: Synthetic oligonucleotide
  Target: ATXN1; (-) strand; PAM type: YTN; PAM sequence: CTA
agcccctcactgccctaggg

SEQ ID NO: 163849 - DNA, 20 bp, Artificial Sequence
  Description of Artificial Sequence: Synthetic oligonucleotide
  Target: ATXN1; (-) strand; PAM type: YTN; PAM sequence: CTG
ctaagcccctcactgcccta

SEQ ID NO: 163850 - DNA, 20 bp, Artificial Sequence
  Description of Artificial Sequence: Synthetic oligonucleotide
  Target: ATXN1; (-) strand; PAM type: YTN; PAM sequence: CTG
gcccaactgctaagcccctc

SEQ ID NO: 163851 - DNA, 20 bp, Artificial Sequence
  Description of Artificial Sequence: Synthetic oligonucleotide
  Target: ATXN1; (-) strand; PAM type: YTN; PAM sequence: CTG
ctggcccaactgctaagccc

SEQ ID NO: 163852 - DNA, 20 bp, Artificial Sequence
  Description of Artificial Sequence: Synthetic oligonucleotide
  Target: ATXN1; (-) strand; PAM type: YTN; PAM sequence: TTG
agcacagcggctgctggccc

SEQ ID NO: 163853 - DNA, 20 bp, Artificial Sequence
  Description of Artificial Sequence: Synthetic oligonucleotide
  Target: ATXN1; (-) strand; PAM type: YTN; PAM sequence: CTG
gcgagaaattgagcacagcg

SEQ ID NO: 163854 - DNA, 20 bp, Artificial Sequence
  Description of Artificial Sequence: Synthetic oligonucleotide
  Target: ATXN1; (-) strand; PAM type: YTN; PAM sequence: CTA
aggcctggcgagaaattgag

SEQ ID NO: 163855 - DNA, 20 bp, Artificial Sequence
  Description of Artificial Sequence: Synthetic oligonucleotide
  Target: ATXN1; (-) strand; PAM type: YTN; PAM sequence: CTG
cccgccagaaggcagctaag

SEQ ID NO: 163856 - DNA, 20 bp, Artificial Sequence
  Description of Artificial Sequence: Synthetic oligonucleotide
  Target: ATXN1; (-) strand; PAM type: YTN; PAM sequence: CTG
caggtcccgagccctgcccg

SEQ ID NO: 163857 - DNA, 20 bp, Artificial Sequence
  Description of Artificial Sequence: Synthetic oligonucleotide
  Target: ATXN1; (-) strand; PAM type: YTN; PAM sequence: TTC
aggcatggcgggctgcaggt

SEQ ID NO: 163858 - DNA, 20 bp, Artificial Sequence
  Description of Artificial Sequence: Synthetic oligonucleotide
  Target: ATXN1; (-) strand; PAM type: YTN; PAM sequence: CTG
cacaggagcccacggagggg

SEQ ID NO: 163859 - DNA, 20 bp, Artificial Sequence
  Description of Artificial Sequence: Synthetic oligonucleotide
  Target: ATXN1; (-) strand; PAM type: YTN; PAM sequence: CTG
gctgcacaggagcccacgga

SEQ ID NO: 163860 - DNA, 20 bp, Artificial Sequence
  Description of Artificial Sequence: Synthetic oligonucleotide
  Target: ATXN1; (-) strand; PAM type: YTN; PAM sequence: CTC
tggctgcacaggagcccacg

SEQ ID NO: 163861 - DNA, 20 bp, Artificial Sequence
  Description of Artificial Sequence: Synthetic oligonucleotide
  Target: ATXN1; (-) strand; PAM type: YTN; PAM sequence: CTC
gtcggggaggctctggctgc

SEQ ID NO: 163862 - DNA, 20 bp, Artificial Sequence
  Description of Artificial Sequence: Synthetic oligonucleotide
  Target: ATXN1; (-) strand; PAM type: YTN; PAM sequence: CTG
tggagcagggggcggcgctc

SEQ ID NO: 163863 - DNA, 20 bp, Artificial Sequence
  Description of Artificial Sequence: Synthetic oligonucleotide
  Target: ATXN1; (-) strand; PAM type: YTN; PAM sequence: CTG
ggcgctgtggagcagggggc

SEQ ID NO: 163864 - DNA, 20 bp, Artificial Sequence
  Description of Artificial Sequence: Synthetic oligonucleotide
  Target: ATXN1; (-) strand; PAM type: YTN; PAM sequence: TTG
ggtggtcgatgggactgggc

SEQ ID NO: 163865 - DNA, 20 bp, Artificial Sequence
  Description of Artificial Sequence: Synthetic oligonucleotide
  Target: ATXN1; (-) strand; PAM type: YTN; PAM sequence: CTT
gggtggtcgatgggactggg

SEQ ID NO: 163866 - DNA, 20 bp, Artificial Sequence
  Description of Artificial Sequence: Synthetic oligonucleotide
  Target: ATXN1; (-) strand; PAM type: YTN; PAM sequence: CTC
agtccttgggtggtcgatgg

SEQ ID NO: 163867 - DNA, 20 bp, Artificial Sequence
  Description of Artificial Sequence: Synthetic oligonucleotide
  Target: ATXN1; (-) strand; PAM type: YTN; PAM sequence: CTC
ctcagtccttgggtggtcga

SEQ ID NO: 163868 - DNA, 20 bp, Artificial Sequence
  Description of Artificial Sequence: Synthetic oligonucleotide
  Target: ATXN1; (-) strand; PAM type: YTN; PAM sequence: CTG
ccagtgccgtgcgcccgcac

SEQ ID NO: 163869 - DNA, 20 bp, Artificial Sequence
  Description of Artificial Sequence: Synthetic oligonucleotide
  Target: ATXN1; (-) strand; PAM type: YTN; PAM sequence: CTG
cctgccagtgccgtgcgccc

SEQ ID NO: 163870 - DNA, 20 bp, Artificial Sequence
  Description of Artificial Sequence: Synthetic oligonucleotide
  Target: ATXN1; (-) strand; PAM type: YTN; PAM sequence: TTC
acagaggcagtaggtggagc

SEQ ID NO: 163871 - DNA, 20 bp, Artificial Sequence
  Description of Artificial Sequence: Synthetic oligonucleotide
  Target: ATXN1; (-) strand; PAM type: YTN; PAM sequence: CTT
cacagaggcagtaggtggag

SEQ ID NO: 163872 - DNA, 20 bp, Artificial Sequence
  Description of Artificial Sequence: Synthetic oligonucleotide
  Target: ATXN1; (-) strand; PAM type: YTN; PAM sequence: CTA
gtggatcttcacagaggcag

SEQ ID NO: 163873 - DNA, 20 bp, Artificial Sequence
  Description of Artificial Sequence: Synthetic oligonucleotide
  Target: ATXN1; (-) strand; PAM type: YTN; PAM sequence: TTC
acctagtggatcttcacaga

SEQ ID NO: 163874 - DNA, 20 bp, Artificial Sequence
  Description of Artificial Sequence: Synthetic oligonucleotide
  Target: ATXN1; (-) strand; PAM type: YTN; PAM sequence: CTT
cacctagtggatcttcacag

SEQ ID NO: 163875 - DNA, 20 bp, Artificial Sequence
  Description of Artificial Sequence: Synthetic oligonucleotide
  Target: ATXN1; (-) strand; PAM type: YTN; PAM sequence: CTG
gcttcacctagtggatcttc

SEQ ID NO: 163876 - DNA, 20 bp, Artificial Sequence
  Description of Artificial Sequence: Synthetic oligonucleotide
  Target: ATXN1; (-) strand; PAM type: YTN; PAM sequence: CTC
aggagcccagctggcttcac

SEQ ID NO: 163877 - DNA, 20 bp, Artificial Sequence
  Description of Artificial Sequence: Synthetic oligonucleotide
  Target: ATXN1; (-) strand; PAM type: YTN; PAM sequence: CTC
caaggccccaccagactcag

SEQ ID NO: 163878 - DNA, 20 bp, Artificial Sequence
  Description of Artificial Sequence: Synthetic oligonucleotide
  Target: ATXN1; (-) strand; PAM type: YTN; PAM sequence: TTC
tccaaggccccaccagactc

SEQ ID NO: 163879 - DNA, 20 bp, Artificial Sequence
  Description of Artificial Sequence: Synthetic oligonucleotide
  Target: ATXN1; (-) strand; PAM type: YTN; PAM sequence: CTA
gacataaaggttctccaagg

SEQ ID NO: 163880 - DNA, 20 bp, Artificial Sequence
  Description of Artificial Sequence: Synthetic oligonucleotide
  Target: ATXN1; (-) strand; PAM type: YTN; PAM sequence: TTA
gctagacataaaggttctcc

SEQ ID NO: 163881 - DNA, 20 bp, Artificial Sequence
  Description of Artificial Sequence: Synthetic oligonucleotide
  Target: ATXN1; (-) strand; PAM type: YTN; PAM sequence: CTT
agctagacataaaggttctc

SEQ ID NO: 163882 - DNA, 20 bp, Artificial Sequence
  Description of Artificial Sequence: Synthetic oligonucleotide
  Target: ATXN1; (-) strand; PAM type: YTN; PAM sequence: TTA
aaatcccttagctagacata

SEQ ID NO: 163883 - DNA, 20 bp, Artificial Sequence
  Description of Artificial Sequence: Synthetic oligonucleotide
  Target: ATXN1; (-) strand; PAM type: YTN; PAM sequence: TTT
aaaatcccttagctagacat

SEQ ID NO: 163884 - DNA, 20 bp, Artificial Sequence
  Description of Artificial Sequence: Synthetic oligonucleotide
  Target: ATXN1; (-) strand; PAM type: YTN; PAM sequence: TTG
gtgtatttaaaatcccttag

SEQ ID NO: 163885 - DNA, 20 bp, Artificial Sequence
  Description of Artificial Sequence: Synthetic oligonucleotide
  Target: ATXN1; (-) strand; PAM type: YTN; PAM sequence: CTG
attggtgtatttaaaatccc

SEQ ID NO: 163886 - DNA, 20 bp, Artificial Sequence
  Description of Artificial Sequence: Synthetic oligonucleotide
  Target: ATXN1; (-) strand; PAM type: YTN; PAM sequence: CTA
gatatagagtgctgattggt

SEQ ID NO: 163887 - DNA, 20 bp, Artificial Sequence
  Description of Artificial Sequence: Synthetic oligonucleotide
  Target: ATXN1; (-) strand; PAM type: YTN; PAM sequence: TTG
agctagatatagagtgctga

SEQ ID NO: 163888 - DNA, 20 bp, Artificial Sequence
  Description of Artificial Sequence: Synthetic oligonucleotide
  Target: ATXN1; (-) strand; PAM type: YTN; PAM sequence: CTT
gagctagatatagagtgctg

SEQ ID NO: 163889 - DNA, 20 bp, Artificial Sequence
  Description of Artificial Sequence: Synthetic oligonucleotide
  Target: ATXN1; (-) strand; PAM type: YTN; PAM sequence: TTA
caaaccttgagctagatata

SEQ ID NO: 163890 - DNA, 20 bp, Artificial Sequence
  Description of Artificial Sequence: Synthetic oligonucleotide
  Target: ATXN1; (-) strand; PAM type: YTN; PAM sequence: TTT
acaaaccttgagctagatat

SEQ ID NO: 163891 - DNA, 20 bp, Artificial Sequence
  Description of Artificial Sequence: Synthetic oligonucleotide
  Target: ATXN1; (-) strand; PAM type: YTN; PAM sequence: TTG
gtgtgtttacaaaccttgag

SEQ ID NO: 163892 - DNA, 20 bp, Artificial Sequence
  Description of Artificial Sequence: Synthetic oligonucleotide
  Target: ATXN1; (-) strand; PAM type: YTN; PAM sequence: CTG
attggtgtgtttacaaacct

SEQ ID NO: 163893 - DNA, 20 bp, Artificial Sequence
  Description of Artificial Sequence: Synthetic oligonucleotide
  Target: ATXN1; (-) strand; PAM type: YTN; PAM sequence: CTA
gacacagggtgctgattggt

SEQ ID NO: 163894 - DNA, 20 bp, Artificial Sequence
  Description of Artificial Sequence: Synthetic oligonucleotide
  Target: ATXN1; (-) strand; PAM type: YTN; PAM sequence: CTG
agctagacacagggtgctga

SEQ ID NO: 163895 - DNA, 20 bp, Artificial Sequence
  Description of Artificial Sequence: Synthetic oligonucleotide
  Target: ATXN1; (-) strand; PAM type: YTN; PAM sequence: TTC
acaaaccctgagctagacac

SEQ ID NO: 163896 - DNA, 20 bp, Artificial Sequence
  Description of Artificial Sequence: Synthetic oligonucleotide
  Target: ATXN1; (-) strand; PAM type: YTN; PAM sequence: TTG
gtgcattcacaaaccctgag

SEQ ID NO: 163897 - DNA, 20 bp, Artificial Sequence
  Description of Artificial Sequence: Synthetic oligonucleotide
  Target: ATXN1; (-) strand; PAM type: YTN; PAM sequence: TTA
cagagtgtggattggtgcat

SEQ ID NO: 163898 - DNA, 20 bp, Artificial Sequence
  Description of Artificial Sequence: Synthetic oligonucleotide
  Target: ATXN1; (-) strand; PAM type: YTN; PAM sequence: CTA
gttacagagtgtggattggt

SEQ ID NO: 163899 - DNA, 20 bp, Artificial Sequence
  Description of Artificial Sequence: Synthetic oligonucleotide
  Target: ATXN1; (-) strand; PAM type: YTN; PAM sequence: CTC
caagtccccaccagagtagc

SEQ ID NO: 163900 - DNA, 20 bp, Artificial Sequence
  Description of Artificial Sequence: Synthetic oligonucleotide
  Target: ATXN1; (-) strand; PAM type: YTN; PAM sequence: TTC
tccaagtccccaccagagta

SEQ ID NO: 163901 - DNA, 20 bp, Artificial Sequence
  Description of Artificial Sequence: Synthetic oligonucleotide
  Target: ATXN1; (-) strand; PAM type: YTN; PAM sequence: CTA
gacataaaggttctccaagt

SEQ ID NO: 163902 - DNA, 20 bp, Artificial Sequence
  Description of Artificial Sequence: Synthetic oligonucleotide
  Target: ATXN1; (-) strand; PAM type: YTN; PAM sequence: TTA
gctagacataaaggttctcc

SEQ ID NO: 163903 - DNA, 20 bp, Artificial Sequence
  Description of Artificial Sequence: Synthetic oligonucleotide
  Target: ATXN1; (-) strand; PAM type: YTN; PAM sequence: CTT
agctagacataaaggttctc

SEQ ID NO: 163904 - DNA, 20 bp, Artificial Sequence
  Description of Artificial Sequence: Synthetic oligonucleotide
  Target: ATXN1; (-) strand; PAM type: YTN; PAM sequence: TTA
caatcccttagctagacata

SEQ ID NO: 163905 - DNA, 20 bp, Artificial Sequence
  Description of Artificial Sequence: Synthetic oligonucleotide
  Target: ATXN1; (-) strand; PAM type: YTN; PAM sequence: TTT
acaatcccttagctagacat

SEQ ID NO: 163906 - DNA, 20 bp, Artificial Sequence
  Description of Artificial Sequence: Synthetic oligonucleotide
  Target: ATXN1; (-) strand; PAM type: YTN; PAM sequence: TTG
gtgtatttacaatcccttag

SEQ ID NO: 163907 - DNA, 20 bp, Artificial Sequence
  Description of Artificial Sequence: Synthetic oligonucleotide
  Target: ATXN1; (-) strand; PAM type: YTN; PAM sequence: CTA
gatacagagtgccgattggt

SEQ ID NO: 163908 - DNA, 20 bp, Artificial Sequence
  Description of Artificial Sequence: Synthetic oligonucleotide
  Target: ATXN1; (-) strand; PAM type: YTN; PAM sequence: TTG
agctagatacagagtgccga

SEQ ID NO: 163909 - DNA, 20 bp, Artificial Sequence
  Description of Artificial Sequence: Synthetic oligonucleotide
  Target: ATXN1; (-) strand; PAM type: YTN; PAM sequence: CTT
gagctagatacagagtgccg

SEQ ID NO: 163910 - DNA, 20 bp, Artificial Sequence
  Description of Artificial Sequence: Synthetic oligonucleotide
  Target: ATXN1; (-) strand; PAM type: YTN; PAM sequence: TTA
caaaccttgagctagataca

SEQ ID NO: 163911 - DNA, 20 bp, Artificial Sequence
  Description of Artificial Sequence: Synthetic oligonucleotide
  Target: ATXN1; (-) strand; PAM type: YTN; PAM sequence: TTT
acaaaccttgagctagatac

SEQ ID NO: 163912 - DNA, 20 bp, Artificial Sequence
  Description of Artificial Sequence: Synthetic oligonucleotide
  Target: ATXN1; (-) strand; PAM type: YTN; PAM sequence: TTG
gtgtgtttacaaaccttgag

SEQ ID NO: 163913 - DNA, 20 bp, Artificial Sequence
  Description of Artificial Sequence: Synthetic oligonucleotide
  Target: ATXN1; (-) strand; PAM type: YTN; PAM sequence: CTG
attggtgtgtttacaaacct

SEQ ID NO: 163914 - DNA, 20 bp, Artificial Sequence
  Description of Artificial Sequence: Synthetic oligonucleotide
  Target: ATXN1; (-) strand; PAM type: YTN; PAM sequence: CTA
gacacagggtgctgattggt

SEQ ID NO: 163915 - DNA, 20 bp, Artificial Sequence
  Description of Artificial Sequence: Synthetic oligonucleotide
  Target: ATXN1; (-) strand; PAM type: YTN; PAM sequence: CTG
agctagacacagggtgctga

SEQ ID NO: 163916 - DNA, 20 bp, Artificial Sequence
  Description of Artificial Sequence: Synthetic oligonucleotide
  Target: ATXN1; (-) strand; PAM type: YTN; PAM sequence: TTC
acaaaccctgagctagacac

SEQ ID NO: 163917 - DNA, 20 bp, Artificial Sequence
  Description of Artificial Sequence: Synthetic oligonucleotide
  Target: ATXN1; (-) strand; PAM type: YTN; PAM sequence: TTG
gtgcattcacaaaccctgag

SEQ ID NO: 163918 - DNA, 20 bp, Artificial Sequence
  Description of Artificial Sequence: Synthetic oligonucleotide
  Target: ATXN1; (-) strand; PAM type: YTN; PAM sequence: CTA
gatacagagtgtggattggt

SEQ ID NO: 163919 - DNA, 20 bp, Artificial Sequence
  Description of Artificial Sequence: Synthetic oligonucleotide
  Target: ATXN1; (-) strand; PAM type: YTN; PAM sequence: CTC
caagtccccaccagagtagc

SEQ ID NO: 163920 - DNA, 20 bp, Artificial Sequence
  Description of Artificial Sequence: Synthetic oligonucleotide
  Target: ATXN1; (-) strand; PAM type: YTN; PAM sequence: TTC
tccaagtccccaccagagta

SEQ ID NO: 163921 - DNA, 20 bp, Artificial Sequence
  Description of Artificial Sequence: Synthetic oligonucleotide
  Target: ATXN1; (-) strand; PAM type: YTN; PAM sequence: CTA
aataaagagtgtcgacacaa

SEQ ID NO: 163922 - DNA, 20 bp, Artificial Sequence
  Description of Artificial Sequence: Synthetic oligonucleotide
  Target: ATXN1; (-) strand; PAM type: YTN; PAM sequence: TTA
gctaaataaagagtgtcgac

SEQ ID NO: 163923 - DNA, 20 bp, Artificial Sequence
  Description of Artificial Sequence: Synthetic oligonucleotide
  Target: ATXN1; (-) strand; PAM type: YTN; PAM sequence: CTA
gattagctaaataaagagtg

SEQ ID NO: 163924 - DNA, 20 bp, Artificial Sequence
  Description of Artificial Sequence: Synthetic oligonucleotide
  Target: ATXN1; (-) strand; PAM type: YTN; PAM sequence: CTC
cagggccccactagattagc

SEQ ID NO: 163925 - DNA, 20 bp, Artificial Sequence
  Description of Artificial Sequence: Synthetic oligonucleotide
  Target: ATXN1; (-) strand; PAM type: YTN; PAM sequence: TTC
tccagggccccactagatta

SEQ ID NO: 163926 - DNA, 20 bp, Artificial Sequence
  Description of Artificial Sequence: Synthetic oligonucleotide
  Target: ATXN1; (-) strand; PAM type: YTN; PAM sequence: CTA
gacacaaaggttctccaggg

SEQ ID NO: 163927 - DNA, 20 bp, Artificial Sequence
  Description of Artificial Sequence: Synthetic oligonucleotide
  Target: ATXN1; (-) strand; PAM type: YTN; PAM sequence: CTG
agctagacacaaaggttctc

SEQ ID NO: 163928 - DNA, 20 bp, Artificial Sequence
  Description of Artificial Sequence: Synthetic oligonucleotide
  Target: ATXN1; (-) strand; PAM type: YTN; PAM sequence: TTA
caatccctgagctagacaca

SEQ ID NO: 163929 - DNA, 20 bp, Artificial Sequence
  Description of Artificial Sequence: Synthetic oligonucleotide
  Target: ATXN1; (-) strand; PAM type: YTN; PAM sequence: TTT
acaatccctgagctagacac

SEQ ID NO: 163930 - DNA, 20 bp, Artificial Sequence
  Description of Artificial Sequence: Synthetic oligonucleotide
  Target: ATXN1; (-) strand; PAM type: YTN; PAM sequence: TTG
gtgcatttacaatccctgag

SEQ ID NO: 163931 - DNA, 20 bp, Artificial Sequence
  Description of Artificial Sequence: Synthetic oligonucleotide
  Target: ATXN1; (-) strand; PAM type: YTN; PAM sequence: CTG
attggtgcatttacaatccc

SEQ ID NO: 163932 - DNA, 20 bp, Artificial Sequence
  Description of Artificial Sequence: Synthetic oligonucleotide
  Target: ATXN1; (-) strand; PAM type: YTN; PAM sequence: TTG
acagggtactgattggtgca

SEQ ID NO: 163933 - DNA, 20 bp, Artificial Sequence
  Description of Artificial Sequence: Synthetic oligonucleotide
  Target: ATXN1; (-) strand; PAM type: YTN; PAM sequence: TTT
gacagggtactgattggtgc

SEQ ID NO: 163934 - DNA, 20 bp, Artificial Sequence
  Description of Artificial Sequence: Synthetic oligonucleotide
  Target: ATXN1; (-) strand; PAM type: YTN; PAM sequence: TTT
tgacagggtactgattggtg

SEQ ID NO: 163935 - DNA, 20 bp, Artificial Sequence
  Description of Artificial Sequence: Synthetic oligonucleotide
  Target: ATXN1; (-) strand; PAM type: YTN; PAM sequence: CTG
ttttgacagggtactgattg

SEQ ID NO: 163936 - DNA, 20 bp, Artificial Sequence
  Description of Artificial Sequence: Synthetic oligonucleotide
  Target: ATXN1; (-) strand; PAM type: YTN; PAM sequence: TTA
cagagagcccagtggtctgt

SEQ ID NO: 163937 - DNA, 20 bp, Artificial Sequence
  Description of Artificial Sequence: Synthetic oligonucleotide
  Target: ATXN1; (-) strand; PAM type: YTN; PAM sequence: TTT
acagagagcccagtggtctg

SEQ ID NO: 163938 - DNA, 20 bp, Artificial Sequence
  Description of Artificial Sequence: Synthetic oligonucleotide
  Target: ATXN1; (-) strand; PAM type: YTN; PAM sequence: TTT
tacagagagcccagtggtct

SEQ ID NO: 163939 - DNA, 20 bp, Artificial Sequence
  Description of Artificial Sequence: Synthetic oligonucleotide
  Target: ATXN1; (-) strand; PAM type: YTN; PAM sequence: TTG
gtccattttacagagagccc

SEQ ID NO: 163940 - DNA, 20 bp, Artificial Sequence
  Description of Artificial Sequence: Synthetic oligonucleotide
  Target: ATXN1; (-) strand; PAM type: YTN; PAM sequence: CTG
attggtccattttacagaga

SEQ ID NO: 163941 - DNA, 20 bp, Artificial Sequence
  Description of Artificial Sequence: Synthetic oligonucleotide
  Target: ATXN1; (-) strand; PAM type: YTN; PAM sequence: CTG
ctgattggtccattttacag

SEQ ID NO: 163942 - DNA, 20 bp, Artificial Sequence
  Description of Artificial Sequence: Synthetic oligonucleotide
  Target: ATXN1; (-) strand; PAM type: YTN; PAM sequence: TTC
tgctgattggtccattttac

SEQ ID NO: 163943 - DNA, 20 bp, Artificial Sequence
  Description of Artificial Sequence: Synthetic oligonucleotide
  Target: ATXN1; (-) strand; PAM type: YTN; PAM sequence: CTA
cccatgttctgctgattggt

SEQ ID NO: 163944 - DNA, 20 bp, Artificial Sequence
  Description of Artificial Sequence: Synthetic oligonucleotide
  Target: ATXN1; (-) strand; PAM type: YTN; PAM sequence: CTG
gccctacccatgttctgctg

SEQ ID NO: 163945 - DNA, 20 bp, Artificial Sequence
  Description of Artificial Sequence: Synthetic oligonucleotide
  Target: ATXN1; (-) strand; PAM type: YTN; PAM sequence: TTA
tctggccctacccatgttct

SEQ ID NO: 163946 - DNA, 20 bp, Artificial Sequence
  Description of Artificial Sequence: Synthetic oligonucleotide
  Target: ATXN1; (-) strand; PAM type: YTN; PAM sequence: CTT
atctggccctacccatgttc

SEQ ID NO: 163947 - DNA, 20 bp, Artificial Sequence
  Description of Artificial Sequence: Synthetic oligonucleotide
  Target: ATXN1; (-) strand; PAM type: YTN; PAM sequence: CTC
ttatctggccctacccatgt

SEQ ID NO: 163948 - DNA, 20 bp, Artificial Sequence
  Description of Artificial Sequence: Synthetic oligonucleotide
  Target: ATXN1; (-) strand; PAM type: YTN; PAM sequence: TTC
tcttatctggccctacccat

SEQ ID NO: 163949 - DNA, 20 bp, Artificial Sequence
  Description of Artificial Sequence: Synthetic oligonucleotide
  Target: ATXN1; (-) strand; PAM type: YTN; PAM sequence: TTA
ttctcttatctggccctacc

SEQ ID NO: 163950 - DNA, 20 bp, Artificial Sequence
  Description of Artificial Sequence: Synthetic oligonucleotide
  Target: ATXN1; (-) strand; PAM type: YTN; PAM sequence: TTT
attctcttatctggccctac

SEQ ID NO: 163951 - DNA, 20 bp, Artificial Sequence
  Description of Artificial Sequence: Synthetic oligonucleotide
  Target: ATXN1; (-) strand; PAM type: YTN; PAM sequence: TTT
tattctcttatctggcccta

SEQ ID NO: 163952 - DNA, 20 bp, Artificial Sequence
  Description of Artificial Sequence: Synthetic oligonucleotide
  Target: ATXN1; (-) strand; PAM type: YTN; PAM sequence: CTT
ttattctcttatctggccct

SEQ ID NO: 163953 - DNA, 20 bp, Artificial Sequence
  Description of Artificial Sequence: Synthetic oligonucleotide
  Target: ATXN1; (-) strand; PAM type: YTN; PAM sequence: CTG
cttttattctcttatctggc

SEQ ID NO: 163954 - DNA, 20 bp, Artificial Sequence
  Description of Artificial Sequence: Synthetic oligonucleotide
  Target: ATXN1; (-) strand; PAM type: YTN; PAM sequence: CTC
gggcagcctgcttttattct

SEQ ID NO: 163955 - DNA, 20 bp, Artificial Sequence
  Description of Artificial Sequence: Synthetic oligonucleotide
  Target: ATXN1; (-) strand; PAM type: YTN; PAM sequence: CTG
gctcgggcagcctgctttta

SEQ ID NO: 163956 - DNA, 20 bp, Artificial Sequence
  Description of Artificial Sequence: Synthetic oligonucleotide
  Target: ATXN1; (-) strand; PAM type: YTN; PAM sequence: CTG
ctggctcgggcagcctgctt

SEQ ID NO: 163957 - DNA, 20 bp, Artificial Sequence
  Description of Artificial Sequence: Synthetic oligonucleotide
  Target: ATXN1; (-) strand; PAM type: YTN; PAM sequence: TTA
ccactgctggctcgggcagc

SEQ ID NO: 163958 - DNA, 20 bp, Artificial Sequence
  Description of Artificial Sequence: Synthetic oligonucleotide
  Target: ATXN1; (-) strand; PAM type: YTN; PAM sequence: TTC
cacagtgtggaaagggatcg

SEQ ID NO: 163959 - DNA, 20 bp, Artificial Sequence
  Description of Artificial Sequence: Synthetic oligonucleotide
  Target: ATXN1; (-) strand; PAM type: YTN; PAM sequence: CTT
ccacagtgtggaaagggatc

SEQ ID NO: 163960 - DNA, 20 bp, Artificial Sequence
  Description of Artificial Sequence: Synthetic oligonucleotide
  Target: ATXN1; (-) strand; PAM type: YTN; PAM sequence: TTG
caaagacaaaaagaacaaag

SEQ ID NO: 163961 - DNA, 20 bp, Artificial Sequence
  Description of Artificial Sequence: Synthetic oligonucleotide
  Target: ATXN1; (-) strand; PAM type: YTN; PAM sequence: TTA
ttgcaaagacaaaaagaaca

SEQ ID NO: 163962 - DNA, 20 bp, Artificial Sequence
  Description of Artificial Sequence: Synthetic oligonucleotide
  Target: ATXN1; (-) strand; PAM type: YTN; PAM sequence: TTT
attgcaaagacaaaaagaac

SEQ ID NO: 163963 - DNA, 20 bp, Artificial Sequence
  Description of Artificial Sequence: Synthetic oligonucleotide
  Target: ATXN1; (-) strand; PAM type: YTN; PAM sequence: CTC
atacaggcagtatagatcca

SEQ ID NO: 163964 - DNA, 20 bp, Artificial Sequence
  Description of Artificial Sequence: Synthetic oligonucleotide
  Target: ATXN1; (-) strand; PAM type: YTN; PAM sequence: TTA
tagctcatacaggcagtata

SEQ ID NO: 163965 - DNA, 20 bp, Artificial Sequence
  Description of Artificial Sequence: Synthetic oligonucleotide
  Target: ATXN1; (-) strand; PAM type: YTN; PAM sequence: TTC
cggtgagtgttatagctcat

SEQ ID NO: 163966 - DNA, 20 bp, Artificial Sequence
  Description of Artificial Sequence: Synthetic oligonucleotide
  Target: ATXN1; (-) strand; PAM type: YTN; PAM sequence: TTT
ccggtgagtgttatagctca

SEQ ID NO: 163967 - DNA, 20 bp, Artificial Sequence
  Description of Artificial Sequence: Synthetic oligonucleotide
  Target: ATXN1; (-) strand; PAM type: YTN; PAM sequence: CTT
tccggtgagtgttatagctc

SEQ ID NO: 163968 - DNA, 20 bp, Artificial Sequence
  Description of Artificial Sequence: Synthetic oligonucleotide
  Target: ATXN1; (-) strand; PAM type: YTN; PAM sequence: CTG
cagacctttccggtgagtgt

SEQ ID NO: 163969 - DNA, 20 bp, Artificial Sequence
  Description of Artificial Sequence: Synthetic oligonucleotide
  Target: ATXN1; (-) strand; PAM type: YTN; PAM sequence: TTC
aggaatgaagctgcagacct

SEQ ID NO: 163970 - DNA, 20 bp, Artificial Sequence
  Description of Artificial Sequence: Synthetic oligonucleotide
  Target: ATXN1; (-) strand; PAM type: YTN; PAM sequence: CTT
caggaatgaagctgcagacc

SEQ ID NO: 163971 - DNA, 20 bp, Artificial Sequence
  Description of Artificial Sequence: Synthetic oligonucleotide
  Target: ATXN1; (-) strand; PAM type: YTN; PAM sequence: CTG
gcttcaggaatgaagctgca

SEQ ID NO: 163972 - DNA, 20 bp, Artificial Sequence
  Description of Artificial Sequence: Synthetic oligonucleotide
  Target: ATXN1; (-) strand; PAM type: YTN; PAM sequence: CTC
actggcttcaggaatgaagc

SEQ ID NO: 163973 - DNA, 20 bp, Artificial Sequence
  Description of Artificial Sequence: Synthetic oligonucleotide
  Target: ATXN1; (-) strand; PAM type: YTN; PAM sequence: TTC
atggtctcactggcttcagg

SEQ ID NO: 163974 - DNA, 20 bp, Artificial Sequence
  Description of Artificial Sequence: Synthetic oligonucleotide
  Target: ATXN1; (-) strand; PAM type: YTN; PAM sequence: CTG
tgggttcatggtctcactgg

SEQ ID NO: 163975 - DNA, 20 bp, Artificial Sequence
  Description of Artificial Sequence: Synthetic oligonucleotide
  Target: ATXN1; (-) strand; PAM type: YTN; PAM sequence: CTC
cctgtgggttcatggtctca

SEQ ID NO: 163976 - DNA, 20 bp, Artificial Sequence
  Description of Artificial Sequence: Synthetic oligonucleotide
  Target: ATXN1; (-) strand; PAM type: YTN; PAM sequence: TTC
ctccctgtgggttcatggtc

SEQ ID NO: 163977 - DNA, 20 bp, Artificial Sequence
  Description of Artificial Sequence: Synthetic oligonucleotide
  Target: ATXN1; (-) strand; PAM type: YTN; PAM sequence: TTC
attcctccctgtgggttcat

SEQ ID NO: 163978 - DNA, 20 bp, Artificial Sequence
  Description of Artificial Sequence: Synthetic oligonucleotide
  Target: ATXN1; (-) strand; PAM type: YTN; PAM sequence: TTG
ttcattcctccctgtgggtt

SEQ ID NO: 163979 - DNA, 20 bp, Artificial Sequence
  Description of Artificial Sequence: Synthetic oligonucleotide
  Target: ATXN1; (-) strand; PAM type: YTN; PAM sequence: CTG
gagttgttcattcctccctg

SEQ ID NO: 163980 - DNA, 20 bp, Artificial Sequence
  Description of Artificial Sequence: Synthetic oligonucleotide
  Target: ATXN1; (-) strand; PAM type: YTN; PAM sequence: TTA
aagcggcatgtctggagttg

SEQ ID NO: 163981 - DNA, 20 bp, Artificial Sequence
  Description of Artificial Sequence: Synthetic oligonucleotide
  Target: ATXN1; (-) strand; PAM type: YTN; PAM sequence: CTT
aaagcggcatgtctggagtt

SEQ ID NO: 163982 - DNA, 20 bp, Artificial Sequence
  Description of Artificial Sequence: Synthetic oligonucleotide
  Target: ATXN1; (-) strand; PAM type: YTN; PAM sequence: TTC
ttaaagcggcatgtctggag

SEQ ID NO: 163983 - DNA, 20 bp, Artificial Sequence
  Description of Artificial Sequence: Synthetic oligonucleotide
  Target: ATXN1; (-) strand; PAM type: YTN; PAM sequence: TTA
cagttcttaaagcggcatgt

SEQ ID NO: 163984 - DNA, 20 bp, Artificial Sequence
  Description of Artificial Sequence: Synthetic oligonucleotide
  Target: ATXN1; (-) strand; PAM type: YTN; PAM sequence: TTG
cggtgagtgttacagttctt

SEQ ID NO: 163985 - DNA, 20 bp, Artificial Sequence
  Description of Artificial Sequence: Synthetic oligonucleotide
  Target: ATXN1; (-) strand; PAM type: YTN; PAM sequence: CTT
gcggtgagtgttacagttct

SEQ ID NO: 163986 - DNA, 20 bp, Artificial Sequence
  Description of Artificial Sequence: Synthetic oligonucleotide
  Target: ATXN1; (-) strand; PAM type: YTN; PAM sequence: TTA
agccgtggacccttgcggtg

SEQ ID NO: 163987 - DNA, 20 bp, Artificial Sequence
  Description of Artificial Sequence: Synthetic oligonucleotide
  Target: ATXN1; (-) strand; PAM type: YTN; PAM sequence: TTC
aagaattaagccgtggaccc

SEQ ID NO: 163988 - DNA, 20 bp, Artificial Sequence
  Description of Artificial Sequence: Synthetic oligonucleotide
  Target: ATXN1; (-) strand; PAM type: YTN; PAM sequence: CTT
caagaattaagccgtggacc

SEQ ID NO: 163989 - DNA, 20 bp, Artificial Sequence
  Description of Artificial Sequence: Synthetic oligonucleotide
  Target: ATXN1; (-) strand; PAM type: YTN; PAM sequence: CTG
acttcaagaattaagccgtg

SEQ ID NO: 163990 - DNA, 20 bp, Artificial Sequence
  Description of Artificial Sequence: Synthetic oligonucleotide
  Target: ATXN1; (-) strand; PAM type: YTN; PAM sequence: CTC
actgacttcaagaattaagc

SEQ ID NO: 163991 - DNA, 20 bp, Artificial Sequence
  Description of Artificial Sequence: Synthetic oligonucleotide
  Target: ATXN1; (-) strand; PAM type: YTN; PAM sequence: TTG
gtctcactgacttcaagaat

SEQ ID NO: 163992 - DNA, 20 bp, Artificial Sequence
  Description of Artificial Sequence: Synthetic oligonucleotide
  Target: ATXN1; (-) strand; PAM type: YTN; PAM sequence: CTT
ggtctcactgacttcaagaa

SEQ ID NO: 163993 - DNA, 20 bp, Artificial Sequence
  Description of Artificial Sequence: Synthetic oligonucleotide
  Target: ATXN1; (-) strand; PAM type: YTN; PAM sequence: TTC
ttggtctcactgacttcaag

SEQ ID NO: 163994 - DNA, 20 bp, Artificial Sequence
  Description of Artificial Sequence: Synthetic oligonucleotide
  Target: ATXN1; (-) strand; PAM type: YTN; PAM sequence: TTA
ggtgcgttcttggtctcact

SEQ ID NO: 163995 - DNA, 20 bp, Artificial Sequence
  Description of Artificial Sequence: Synthetic oligonucleotide
  Target: ATXN1; (-) strand; PAM type: YTN; PAM sequence: CTG
tgtccagaattaggtgcgtt

SEQ ID NO: 163996 - DNA, 20 bp, Artificial Sequence
  Description of Artificial Sequence: Synthetic oligonucleotide
  Target: ATXN1; (-) strand; PAM type: YTN; PAM sequence: CTA
ctgtgtccagaattaggtgc

SEQ ID NO: 163997 - DNA, 20 bp, Artificial Sequence
  Description of Artificial Sequence: Synthetic oligonucleotide
  Target: ATXN1; (-) strand; PAM type: YTN; PAM sequence: TTG
tgctactgtgtccagaatta

SEQ ID NO: 163998 - DNA, 20 bp, Artificial Sequence
  Description of Artificial Sequence: Synthetic oligonucleotide
  Target: ATXN1; (-) strand; PAM type: YTN; PAM sequence: CTA
tggttgtgctactgtgtcca

SEQ ID NO: 163999 - DNA, 20 bp, Artificial Sequence
  Description of Artificial Sequence: Synthetic oligonucleotide
  Target: ATXN1; (-) strand; PAM type: YTN; PAM sequence: CTA
cagtaaactatggttgtgct

SEQ ID NO: 164000 - DNA, 20 bp, Artificial Sequence
  Description of Artificial Sequence: Synthetic oligonucleotide
  Target: ATXN1; (-) strand; PAM type: YTN; PAM sequence: TTG
agcacagggaggtcgaggct

SEQ ID NO: 164001 - DNA, 20 bp, Artificial Sequence
  Description of Artificial Sequence: Synthetic oligonucleotide
  Target: ATXN1; (-) strand; PAM type: YTN; PAM sequence: CTT
gagcacagggaggtcgaggc

SEQ ID NO: 164002 - DNA, 20 bp, Artificial Sequence
  Description of Artificial Sequence: Synthetic oligonucleotide
  Target: ATXN1; (-) strand; PAM type: YTN; PAM sequence: CTG
aggatcacttgagcacaggg

SEQ ID NO: 164003 - DNA, 20 bp, Artificial Sequence
  Description of Artificial Sequence: Synthetic oligonucleotide
  Target: ATXN1; (-) strand; PAM type: YTN; PAM sequence: CTA
aggaagctgaggatcacttg

SEQ ID NO: 164004 - DNA, 20 bp, Artificial Sequence
  Description of Artificial Sequence: Synthetic oligonucleotide
  Target: ATXN1; (-) strand; PAM type: YTN; PAM sequence: CTA
ctaaggaagctgaggatcac

SEQ ID NO: 164005 - DNA, 20 bp, Artificial Sequence
  Description of Artificial Sequence: Synthetic oligonucleotide
  Target: ATXN1; (-) strand; PAM type: YTN; PAM sequence: CTG
taatcccagctactaaggaa

SEQ ID NO: 164006 - DNA, 20 bp, Artificial Sequence
  Description of Artificial Sequence: Synthetic oligonucleotide
  Target: ATXN1; (-) strand; PAM type: YTN; PAM sequence: CTA
gatgtggcggcacaagtctg

SEQ ID NO: 164007 - DNA, 20 bp, Artificial Sequence
  Description of Artificial Sequence: Synthetic oligonucleotide
  Target: ATXN1; (-) strand; PAM type: YTN; PAM sequence: TTA
aaatgtagctagatgtggcg

SEQ ID NO: 164008 - DNA, 20 bp, Artificial Sequence
  Description of Artificial Sequence: Synthetic oligonucleotide
  Target: ATXN1; (-) strand; PAM type: YTN; PAM sequence: TTT
aaaatgtagctagatgtggc

SEQ ID NO: 164009 - DNA, 20 bp, Artificial Sequence
  Description of Artificial Sequence: Synthetic oligonucleotide
  Target: ATXN1; (-) strand; PAM type: YTN; PAM sequence: CTG
aataaaaaagtttaaaatgt

SEQ ID NO: 164010 - DNA, 20 bp, Artificial Sequence
  Description of Artificial Sequence: Synthetic oligonucleotide
  Target: ATXN1; (-) strand; PAM type: YTN; PAM sequence: CTA
tctgaataaaaaagtttaaa

SEQ ID NO: 164011 - DNA, 20 bp, Artificial Sequence
  Description of Artificial Sequence: Synthetic oligonucleotide
  Target: ATXN1; (-) strand; PAM type: YTN; PAM sequence: CTG
cacagcgtgatgaaacccta

SEQ ID NO: 164012 - DNA, 20 bp, Artificial Sequence
  Description of Artificial Sequence: Synthetic oligonucleotide
  Target: ATXN1; (-) strand; PAM type: YTN; PAM sequence: TTG
agaccagcctgcacagcgtg

SEQ ID NO: 164013 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctgcacagcgt

SEQ ID NO: 164014 - DNA, 20 bp, Artificial Sequence
  Description of Artificial Sequence: Synthetic oligonucleotide
  Target: ATXN1; (-) strand; PAM type: YTN; PAM sequence: TTA
agcccaggagtttgagacca

SEQ ID NO: 164015 - DNA, 20 bp, Artificial Sequence
  Description of Artificial Sequence: Synthetic oligonucleotide
  Target: ATXN1; (-) strand; PAM type: YTN; PAM sequence: CTT
aagcccaggagtttgagacc

SEQ ID NO: 164016 - DNA, 20 bp, Artificial Sequence
  Description of Artificial Sequence: Synthetic oligonucleotide
  Target: ATXN1; (-) strand; PAM type: YTN; PAM sequence: CTA
tggaaagccaaaatgggagg

SEQ ID NO: 164017 - DNA, 20 bp, Artificial Sequence
  Description of Artificial Sequence: Synthetic oligonucleotide
  Target: ATXN1; (-) strand; PAM type: YTN; PAM sequence: CTA
acactatggaaagccaaaat

SEQ ID NO: 164018 - DNA, 20 bp, Artificial Sequence
  Description of Artificial Sequence: Synthetic oligonucleotide
  Target: ATXN1; (-) strand; PAM type: YTN; PAM sequence: TTC
taacactatggaaagccaaa

SEQ ID NO: 164019 - DNA, 20 bp, Artificial Sequence
  Description of Artificial Sequence: Synthetic oligonucleotide
  Target: ATXN1; (-) strand; PAM type: YTN; PAM sequence: CTG
taattctaacactatggaaa

SEQ ID NO: 164020 - DNA, 20 bp, Artificial Sequence
  Description of Artificial Sequence: Synthetic oligonucleotide
  Target: ATXN1; (-) strand; PAM type: YTN; PAM sequence: CTC
atatctgtaattctaacact

SEQ ID NO: 164021 - DNA, 20 bp, Artificial Sequence
  Description of Artificial Sequence: Synthetic oligonucleotide
  Target: ATXN1; (-) strand; PAM type: YTN; PAM sequence: CTG
tggctcatatctgtaattct

SEQ ID NO: 164022 - DNA, 20 bp, Artificial Sequence
  Description of Artificial Sequence: Synthetic oligonucleotide
  Target: ATXN1; (-) strand; PAM type: YTN; PAM sequence: TTG
aatgggcccggtgctgtggc

SEQ ID NO: 164023 - DNA, 20 bp, Artificial Sequence
  Description of Artificial Sequence: Synthetic oligonucleotide
  Target: ATXN1; (-) strand; PAM type: YTN; PAM sequence: TTA
gaaagttgaatgggcccggt

SEQ ID NO: 164024 - DNA, 20 bp, Artificial Sequence
  Description of Artificial Sequence: Synthetic oligonucleotide
  Target: ATXN1; (-) strand; PAM type: YTN; PAM sequence: CTT
agaaagttgaatgggcccgg

SEQ ID NO: 164025 - DNA, 20 bp, Artificial Sequence
  Description of Artificial Sequence: Synthetic oligonucleotide
  Target: ATXN1; (-) strand; PAM type: YTN; PAM sequence: TTA
aagaggaaatcaaagcttag

SEQ ID NO: 164026 - DNA, 20 bp, Artificial Sequence
  Description of Artificial Sequence: Synthetic oligonucleotide
  Target: ATXN1; (-) strand; PAM type: YTN; PAM sequence: CTT
aaagaggaaatcaaagctta

SEQ ID NO: 164027 - DNA, 20 bp, Artificial Sequence
  Description of Artificial Sequence: Synthetic oligonucleotide
  Target: ATXN1; (-) strand; PAM type: YTN; PAM sequence: TTC
ttaaagaggaaatcaaagct

SEQ ID NO: 164028 - DNA, 20 bp, Artificial Sequence
  Description of Artificial Sequence: Synthetic oligonucleotide
  Target: ATXN1; (-) strand; PAM type: YTN; PAM sequence: TTT
cttaaagaggaaatcaaagc

SEQ ID NO: 164029 - DNA, 20 bp, Artificial Sequence
  Description of Artificial Sequence: Synthetic oligonucleotide
  Target: ATXN1; (-) strand; PAM type: YTN; PAM sequence: TTT
tcttaaagaggaaatcaaag

SEQ ID NO: 164030 - DNA, 20 bp, Artificial Sequence
  Description of Artificial Sequence: Synthetic oligonucleotide
  Target: ATXN1; (-) strand; PAM type: YTN; PAM sequence: TTC
attttcttaaagaggaaatc

SEQ ID NO: 164031 - DNA, 20 bp, Artificial Sequence
  Description of Artificial Sequence: Synthetic oligonucleotide
  Target: ATXN1; (-) strand; PAM type: YTN; PAM sequence: CTT
cattttcttaaagaggaaat

SEQ ID NO: 164032 - DNA, 20 bp, Artificial Sequence
  Description of Artificial Sequence: Synthetic oligonucleotide
  Target: ATXN1; (-) strand; PAM type: YTN; PAM sequence: CTA
tcttcattttcttaaagagg

SEQ ID NO: 164033 - DNA, 20 bp, Artificial Sequence
  Description of Artificial Sequence: Synthetic oligonucleotide
  Target: ATXN1; (-) strand; PAM type: YTN; PAM sequence: CTC
gccatactatcttcattttc

SEQ ID NO: 164034 - DNA, 20 bp, Artificial Sequence
  Description of Artificial Sequence: Synthetic oligonucleotide
  Target: ATXN1; (-) strand; PAM type: YTN; PAM sequence: TTA
tatgtgtgagccaccgtgcc

SEQ ID NO: 164035 - DNA, 20 bp, Artificial Sequence
  Description of Artificial Sequence: Synthetic oligonucleotide
  Target: ATXN1; (-) strand; PAM type: YTN; PAM sequence: CTG
ggattatatgtgtgagccac

SEQ ID NO: 164036 - DNA, 20 bp, Artificial Sequence
  Description of Artificial Sequence: Synthetic oligonucleotide
  Target: ATXN1; (-) strand; PAM type: YTN; PAM sequence: CTG
aaagtgctgggattatatgt

SEQ ID NO: 164037 - DNA, 20 bp, Artificial Sequence
  Description of Artificial Sequence: Synthetic oligonucleotide
  Target: ATXN1; (-) strand; PAM type: YTN; PAM sequence: CTC
tgaaagtgctgggattatat

SEQ ID NO: 164038 - DNA, 20 bp, Artificial Sequence
  Description of Artificial Sequence: Synthetic oligonucleotide
  Target: ATXN1; (-) strand; PAM type: YTN; PAM sequence: CTC
ggcctctgaaagtgctggga

SEQ ID NO: 164039 - DNA, 20 bp, Artificial Sequence
  Description of Artificial Sequence: Synthetic oligonucleotide
  Target: ATXN1; (-) strand; PAM type: YTN; PAM sequence: CTG
ccccccctcggcctctgaaa

SEQ ID NO: 164040 - DNA, 20 bp, Artificial Sequence
  Description of Artificial Sequence: Synthetic oligonucleotide
  Target: ATXN1; (-) strand; PAM type: YTN; PAM sequence: CTC
acatgatctgccccccctcg

SEQ ID NO: 164041 - DNA, 20 bp, Artificial Sequence
  Description of Artificial Sequence: Synthetic oligonucleotide
  Target: ATXN1; (-) strand; PAM type: YTN; PAM sequence: CTG
gatctcacatgatctgcccc

SEQ ID NO: 164042 - DNA, 20 bp, Artificial Sequence
  Description of Artificial Sequence: Synthetic oligonucleotide
  Target: ATXN1; (-) strand; PAM type: YTN; PAM sequence: CTC
tggatctcacatgatctgcc

SEQ ID NO: 164043 - DNA, 20 bp, Artificial Sequence
  Description of Artificial Sequence: Synthetic oligonucleotide
  Target: ATXN1; (-) strand; PAM type: YTN; PAM sequence: CTC
gaactctggatctcacatga

SEQ ID NO: 164044 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactctggatctca

SEQ ID NO: 164045 - DNA, 20 bp, Artificial Sequence
  Description of Artificial Sequence: Synthetic oligonucleotide
  Target: ATXN1; (-) strand; PAM type: YTN; PAM sequence: TTG
accaggctggtctcgaactc

SEQ ID NO: 164046 - DNA, 20 bp, Artificial Sequence
  Description of Artificial Sequence: Synthetic oligonucleotide
  Target: ATXN1; (-) strand; PAM type: YTN; PAM sequence: TTG
ccacattgaccaggctggtc

SEQ ID NO: 164047 - DNA, 20 bp, Artificial Sequence
  Description of Artificial Sequence: Synthetic oligonucleotide
  Target: ATXN1; (-) strand; PAM type: YTN; PAM sequence: TTT
gccacattgaccaggctggt

SEQ ID NO: 164048 - DNA, 20 bp, Artificial Sequence
  Description of Artificial Sequence: Synthetic oligonucleotide
  Target: ATXN1; (-) strand; PAM type: YTN; PAM sequence: CTT
tgccacattgaccaggctgg

SEQ ID NO: 164049 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggctttgcca

SEQ ID NO: 164050 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggctttgcc

SEQ ID NO: 164051 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggctttgc

SEQ ID NO: 164052 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggggctttg

SEQ ID NO: 164053 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacgggg

SEQ ID NO: 164054 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacggg

SEQ ID NO: 164055 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 164056 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagacg

SEQ ID NO: 164057 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttagtagagac

SEQ ID NO: 164058 - DNA, 20 bp, Artificial Sequence
  Description of Artificial Sequence: Synthetic oligonucleotide
  Target: ATXN1; (-) strand; PAM type: YTN; PAM sequence: TTT
ttttgtatttttagtagaga

SEQ ID NO: 164059 - DNA, 20 bp, Artificial Sequence
  Description of Artificial Sequence: Synthetic oligonucleotide
  Target: ATXN1; (-) strand; PAM type: YTN; PAM sequence: TTT
tttttgtatttttagtagag

SEQ ID NO: 164060 - DNA, 20 bp, Artificial Sequence
  Description of Artificial Sequence: Synthetic oligonucleotide
  Target: ATXN1; (-) strand; PAM type: YTN; PAM sequence: CTA
attttttttgtatttttagt

SEQ ID NO: 164061 - DNA, 20 bp, Artificial Sequence
  Description of Artificial Sequence: Synthetic oligonucleotide
  Target: ATXN1; (-) strand; PAM type: YTN; PAM sequence: CTC
accaccaagcccggctaatt

SEQ ID NO: 164062 - DNA, 20 bp, Artificial Sequence
  Description of Artificial Sequence: Synthetic oligonucleotide
  Target: ATXN1; (-) strand; PAM type: YTN; PAM sequence: TTA
caggcactcaccaccaagcc

SEQ ID NO: 164063 - DNA, 20 bp, Artificial Sequence
  Description of Artificial Sequence: Synthetic oligonucleotide
  Target: ATXN1; (-) strand; PAM type: YTN; PAM sequence: CTG
gaattacaggcactcaccac

SEQ ID NO: 164064 - DNA, 20 bp, Artificial Sequence
  Description of Artificial Sequence: Synthetic oligonucleotide
  Target: ATXN1; (-) strand; PAM type: YTN; PAM sequence: CTC
cctggaattacaggcactca

SEQ ID NO: 164065 - DNA, 20 bp, Artificial Sequence
  Description of Artificial Sequence: Synthetic oligonucleotide
  Target: ATXN1; (-) strand; PAM type: YTN; PAM sequence: CTC
agcctccctggaattacagg

SEQ ID NO: 164066 - DNA, 20 bp, Artificial Sequence
  Description of Artificial Sequence: Synthetic oligonucleotide
  Target: ATXN1; (-) strand; PAM type: YTN; PAM sequence: CTG
cctcagcctccctggaatta

SEQ ID NO: 164067 - DNA, 20 bp, Artificial Sequence
  Description of Artificial Sequence: Synthetic oligonucleotide
  Target: ATXN1; (-) strand; PAM type: YTN; PAM sequence: TTC
tgcctcagcctccctggaat

SEQ ID NO: 164068 - DNA, 20 bp, Artificial Sequence
  Description of Artificial Sequence: Synthetic oligonucleotide
  Target: ATXN1; (-) strand; PAM type: YTN; PAM sequence: CTT
ctgcctcagcctccctggaa

SEQ ID NO: 164069 - DNA, 20 bp, Artificial Sequence
  Description of Artificial Sequence: Synthetic oligonucleotide
  Target: ATXN1; (-) strand; PAM type: YTN; PAM sequence: TTC
ttctgcctcagcctccctgg

SEQ ID NO: 164070 - DNA, 20 bp, Artificial Sequence
  Description of Artificial Sequence: Synthetic oligonucleotide
  Target: ATXN1; (-) strand; PAM type: YTN; PAM sequence: TTC
aagtgattcttctgcctcag

SEQ ID NO: 164071 - DNA, 20 bp, Artificial Sequence
  Description of Artificial Sequence: Synthetic oligonucleotide
  Target: ATXN1; (-) strand; PAM type: YTN; PAM sequence: CTC
gcgggttcaagtgattcttc

SEQ ID NO: 164072 - DNA, 20 bp, Artificial Sequence
  Description of Artificial Sequence: Synthetic oligonucleotide
  Target: ATXN1; (-) strand; PAM type: YTN; PAM sequence: CTC
cacctcgcgggttcaagtga

SEQ ID NO: 164073 - DNA, 20 bp, Artificial Sequence
  Description of Artificial Sequence: Synthetic oligonucleotide
  Target: ATXN1; (-) strand; PAM type: YTN; PAM sequence: CTG
caacctccacctcgcgggtt

SEQ ID NO: 164074 - DNA, 20 bp, Artificial Sequence
  Description of Artificial Sequence: Synthetic oligonucleotide
  Target: ATXN1; (-) strand; PAM type: YTN; PAM sequence: TTC
gctgcaacctccacctcgcg

SEQ ID NO: 164075 - DNA, 20 bp, Artificial Sequence
  Description of Artificial Sequence: Synthetic oligonucleotide
  Target: ATXN1; (-) strand; PAM type: YTN; PAM sequence: TTG
gttcgctgcaacctccacct

SEQ ID NO: 164076 - DNA, 20 bp, Artificial Sequence
  Description of Artificial Sequence: Synthetic oligonucleotide
  Target: ATXN1; (-) strand; PAM type: YTN; PAM sequence: CTT
ggttcgctgcaacctccacc

SEQ ID NO: 164077 - DNA, 20 bp, Artificial Sequence
  Description of Artificial Sequence: Synthetic oligonucleotide
  Target: ATXN1; (-) strand; PAM type: YTN; PAM sequence: CTA
gagtgcaatggtacaatctt

SEQ ID NO: 164078 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggctagagtgcaa

SEQ ID NO: 164079 - DNA, 20 bp, Artificial Sequence
  Description of Artificial Sequence: Synthetic oligonucleotide
  Target: ATXN1; (-) strand; PAM type: YTN; PAM sequence: CTC
ctgtcgcccaggctagagtg

SEQ ID NO: 164080 - DNA, 20 bp, Artificial Sequence
  Description of Artificial Sequence: Synthetic oligonucleotide
  Target: ATXN1; (-) strand; PAM type: YTN; PAM sequence: TTC
actcctgtcgcccaggctag

SEQ ID NO: 164081 - DNA, 20 bp, Artificial Sequence
  Description of Artificial Sequence: Synthetic oligonucleotide
  Target: ATXN1; (-) strand; PAM type: YTN; PAM sequence: TTT
cactcctgtcgcccaggcta

SEQ ID NO: 164082 - DNA, 20 bp, Artificial Sequence
  Description of Artificial Sequence: Synthetic oligonucleotide
  Target: ATXN1; (-) strand; PAM type: YTN; PAM sequence: CTA
aggcagagtttcactcctgt

SEQ ID NO: 164083 - DNA, 20 bp, Artificial Sequence
  Description of Artificial Sequence: Synthetic oligonucleotide
  Target: ATXN1; (-) strand; PAM type: YTN; PAM sequence: TTC
taaggcagagtttcactcct

SEQ ID NO: 164084 - DNA, 20 bp, Artificial Sequence
  Description of Artificial Sequence: Synthetic oligonucleotide
  Target: ATXN1; (-) strand; PAM type: YTN; PAM sequence: TTT
ctaaggcagagtttcactcc

SEQ ID NO: 164085 - DNA, 20 bp, Artificial Sequence
  Description of Artificial Sequence: Synthetic oligonucleotide
  Target: ATXN1; (-) strand; PAM type: YTN; PAM sequence: TTT
tctaaggcagagtttcactc

SEQ ID NO: 164086 - DNA, 20 bp, Artificial Sequence
  Description of Artificial Sequence: Synthetic oligonucleotide
  Target: ATXN1; (-) strand; PAM type: YTN; PAM sequence: TTT
ttctaaggcagagtttcact

SEQ ID NO: 164087 - DNA, 20 bp, Artificial Sequence
  Description of Artificial Sequence: Synthetic oligonucleotide
  Target: ATXN1; (-) strand; PAM type: YTN; PAM sequence: TTT
tttctaaggcagagtttcac

SEQ ID NO: 164088 - DNA, 20 bp, Artificial Sequence
  Description of Artificial Sequence: Synthetic oligonucleotide
  Target: ATXN1; (-) strand; PAM type: YTN; PAM sequence: TTT
ttttctaaggcagagtttca

SEQ ID NO: 164089 - DNA, 20 bp, Artificial Sequence
  Description of Artificial Sequence: Synthetic oligonucleotide
  Target: ATXN1; (-) strand; PAM type: YTN; PAM sequence: TTT
tttttctaaggcagagtttc

SEQ ID NO: 164090 - DNA, 20 bp, Artificial Sequence
  Description of Artificial Sequence: Synthetic oligonucleotide
  Target: ATXN1; (-) strand; PAM type: YTN; PAM sequence: TTT
ttttttctaaggcagagttt

SEQ ID NO: 164091 - DNA, 20 bp, Artificial Sequence
  Description of Artificial Sequence: Synthetic oligonucleotide
  Target: ATXN1; (-) strand; PAM type: YTN; PAM sequence: TTT
tttttttctaaggcagagtt

SEQ ID NO: 164092 - DNA, 20 bp, Artificial Sequence
  Description of Artificial Sequence: Synthetic oligonucleotide
  Target: ATXN1; (-) strand; PAM type: YTN; PAM sequence: TTT
ttttttttctaaggcagagt

SEQ ID NO: 164093 - DNA, 20 bp, Artificial Sequence
  Description of Artificial Sequence: Synthetic oligonucleotide
  Target: ATXN1; (-) strand; PAM type: YTN; PAM sequence: TTC
atttttttttttctaaggca

SEQ ID NO: 164094 - DNA, 20 bp, Artificial Sequence
  Description of Artificial Sequence: Synthetic oligonucleotide
  Target: ATXN1; (-) strand; PAM type: YTN; PAM sequence: CTT
catttttttttttctaaggc

SEQ ID NO: 164095 - DNA, 20 bp, Artificial Sequence
  Description of Artificial Sequence: Synthetic oligonucleotide
  Target: ATXN1; (-) strand; PAM type: YTN; PAM sequence: CTA
tcttcatttttttttttcta

SEQ ID NO: 164096 - DNA, 20 bp, Artificial Sequence
  Description of Artificial Sequence: Synthetic oligonucleotide
  Target: ATXN1; (-) strand; PAM type: YTN; PAM sequence: TTA
ctatcttcattttttttttt

SEQ ID NO: 164097 - DNA, 20 bp, Artificial Sequence
  Description of Artificial Sequence: Synthetic oligonucleotide
  Target: ATXN1; (-) strand; PAM type: YTN; PAM sequence: TTC
atgaaataaggcgtattact

SEQ ID NO: 164098 - DNA, 20 bp, Artificial Sequence
  Description of Artificial Sequence: Synthetic oligonucleotide
  Target: ATXN1; (-) strand; PAM type: YTN; PAM sequence: CTT
catgaaataaggcgtattac

SEQ ID NO: 164099 - DNA, 20 bp, Artificial Sequence
  Description of Artificial Sequence: Synthetic oligonucleotide
  Target: ATXN1; (-) strand; PAM type: YTN; PAM sequence: CTC
ataacaacttcatgaaataa

SEQ ID NO: 164100 - DNA, 20 bp, Artificial Sequence
  Description of Artificial Sequence: Synthetic oligonucleotide
  Target: ATXN1; (-) strand; PAM type: YTN; PAM sequence: TTC
tcataacaacttcatgaaat

SEQ ID NO: 164101 - DNA, 20 bp, Artificial Sequence
  Description of Artificial Sequence: Synthetic oligonucleotide
  Target: ATXN1; (-) strand; PAM type: YTN; PAM sequence: TTG
tcccatgcaattctcataac

SEQ ID NO: 164102 - DNA, 20 bp, Artificial Sequence
  Description of Artificial Sequence: Synthetic oligonucleotide
  Target: ATXN1; (-) strand; PAM type: YTN; PAM sequence: CTG
aattgtcccatgcaattctc

SEQ ID NO: 164103 - DNA, 20 bp, Artificial Sequence
  Description of Artificial Sequence: Synthetic oligonucleotide
  Target: ATXN1; (-) strand; PAM type: YTN; PAM sequence: CTA
ggcactgaattgtcccatgc

SEQ ID NO: 164104 - DNA, 20 bp, Artificial Sequence
  Description of Artificial Sequence: Synthetic oligonucleotide
  Target: ATXN1; (-) strand; PAM type: YTN; PAM sequence: TTG
catgctaggcactgaattgt

SEQ ID NO: 164105 - DNA, 20 bp, Artificial Sequence
  Description of Artificial Sequence: Synthetic oligonucleotide
  Target: ATXN1; (-) strand; PAM type: YTN; PAM sequence: CTT
gcatgctaggcactgaattg

SEQ ID NO: 164106 - DNA, 20 bp, Artificial Sequence
  Description of Artificial Sequence: Synthetic oligonucleotide
  Target: ATXN1; (-) strand; PAM type: YTN; PAM sequence: CTG
cttgcatgctaggcactgaa

SEQ ID NO: 164107 - DNA, 20 bp, Artificial Sequence
  Description of Artificial Sequence: Synthetic oligonucleotide
  Target: ATXN1; (-) strand; PAM type: YTN; PAM sequence: CTG
cctgcttgcatgctaggcac

SEQ ID NO: 164108 - DNA, 20 bp, Artificial Sequence
  Description of Artificial Sequence: Synthetic oligonucleotide
  Target: ATXN1; (-) strand; PAM type: YTN; PAM sequence: CTA
ctgcctgcttgcatgctagg

SEQ ID NO: 164109 - DNA, 20 bp, Artificial Sequence
  Description of Artificial Sequence: Synthetic oligonucleotide
  Target: ATXN1; (-) strand; PAM type: YTN; PAM sequence: TTG
aggcactactgcctgcttgc

SEQ ID NO: 164110 - DNA, 20 bp, Artificial Sequence
  Description of Artificial Sequence: Synthetic oligonucleotide
  Target: ATXN1; (-) strand; PAM type: YTN; PAM sequence: TTT
gaggcactactgcctgcttg

SEQ ID NO: 164111 - DNA, 20 bp, Artificial Sequence
  Description of Artificial Sequence: Synthetic oligonucleotide
  Target: ATXN1; (-) strand; PAM type: YTN; PAM sequence: TTT
tgaggcactactgcctgctt

SEQ ID NO: 164112 - DNA, 20 bp, Artificial Sequence
  Description of Artificial Sequence: Synthetic oligonucleotide
  Target: ATXN1; (-) strand; PAM type: YTN; PAM sequence: TTT
ttgaggcactactgcctgct

SEQ ID NO: 164113 - DNA, 20 bp, Artificial Sequence
  Description of Artificial Sequence: Synthetic oligonucleotide
  Target: ATXN1; (-) strand; PAM type: YTN; PAM sequence: TTT
tttgaggcactactgcctgc

SEQ ID NO: 164114 - DNA, 20 bp, Artificial Sequence
  Description of Artificial Sequence: Synthetic oligonucleotide
  Target: ATXN1; (-) strand; PAM type: YTN; PAM sequence: TTC
atcatgagaggtagcatttt

SEQ ID NO: 164115 - DNA, 20 bp, Artificial Sequence
  Description of Artificial Sequence: Synthetic oligonucleotide
  Target: ATXN1; (-) strand; PAM type: YTN; PAM sequence: CTG
gaaagcagttcatcatgaga

SEQ ID NO: 164116 - DNA, 20 bp, Artificial Sequence
  Description of Artificial Sequence: Synthetic oligonucleotide
  Target: ATXN1; (-) strand; PAM type: YTN; PAM sequence: TTG
aactggaaagcagttcatca

SEQ ID NO: 164117 - DNA, 20 bp, Artificial Sequence
  Description of Artificial Sequence: Synthetic oligonucleotide
  Target: ATXN1; (-) strand; PAM type: YTN; PAM sequence: TTT
gaactggaaagcagttcatc

SEQ ID NO: 164118 - DNA, 20 bp, Artificial Sequence
  Description of Artificial Sequence: Synthetic oligonucleotide
  Target: ATXN1; (-) strand; PAM type: YTN; PAM sequence: CTG
cagcagtcataggaggtagt

SEQ ID NO: 164119 - DNA, 20 bp, Artificial Sequence
  Description of Artificial Sequence: Synthetic oligonucleotide
  Target: ATXN1; (-) strand; PAM type: YTN; PAM sequence: TTG
ctgcagcagtcataggaggt

SEQ ID NO: 164120 - DNA, 20 bp, Artificial Sequence
  Description of Artificial Sequence: Synthetic oligonucleotide
  Target: ATXN1; (-) strand; PAM type: YTN; PAM sequence: TTT
gctgcagcagtcataggagg

SEQ ID NO: 164121 - DNA, 20 bp, Artificial Sequence
  Description of Artificial Sequence: Synthetic oligonucleotide
  Target: ATXN1; (-) strand; PAM type: YTN; PAM sequence: CTG
tttgctgcagcagtcatagg

SEQ ID NO: 164122 - DNA, 20 bp, Artificial Sequence
  Description of Artificial Sequence: Synthetic oligonucleotide
  Target: ATXN1; (-) strand; PAM type: YTN; PAM sequence: CTG
tgctgtttgctgcagcagtc

SEQ ID NO: 164123 - DNA, 20 bp, Artificial Sequence
  Description of Artificial Sequence: Synthetic oligonucleotide
  Target: ATXN1; (-) strand; PAM type: YTN; PAM sequence: CTA
gatcccaggcctgtgctgtt

SEQ ID NO: 164124 - DNA, 20 bp, Artificial Sequence
  Description of Artificial Sequence: Synthetic oligonucleotide
  Target: ATXN1; (-) strand; PAM type: YTN; PAM sequence: TTC
caaatcaggtggcctagatc

SEQ ID NO: 164125 - DNA, 20 bp, Artificial Sequence
  Description of Artificial Sequence: Synthetic oligonucleotide
  Target: ATXN1; (-) strand; PAM type: YTN; PAM sequence: CTG
aggagtaaggccaccaggat

SEQ ID NO: 164126 - DNA, 20 bp, Artificial Sequence
  Description of Artificial Sequence: Synthetic oligonucleotide
  Target: ATXN1; (-) strand; PAM type: YTN; PAM sequence: TTG
catcagatatacacagctga

SEQ ID NO: 164127 - DNA, 20 bp, Artificial Sequence
  Description of Artificial Sequence: Synthetic oligonucleotide
  Target: ATXN1; (-) strand; PAM type: YTN; PAM sequence: CTT
gcatcagatatacacagctg

SEQ ID NO: 164128 - DNA, 20 bp, Artificial Sequence
  Description of Artificial Sequence: Synthetic oligonucleotide
  Target: ATXN1; (-) strand; PAM type: YTN; PAM sequence: TTA
acttgcatcagatatacaca

SEQ ID NO: 164129 - DNA, 20 bp, Artificial Sequence
  Description of Artificial Sequence: Synthetic oligonucleotide
  Target: ATXN1; (-) strand; PAM type: YTN; PAM sequence: TTA
attaacttgcatcagatata

SEQ ID NO: 164130 - DNA, 20 bp, Artificial Sequence
  Description of Artificial Sequence: Synthetic oligonucleotide
  Target: ATXN1; (-) strand; PAM type: YTN; PAM sequence: TTA
gatcagagaaattaattaac

SEQ ID NO: 164131 - DNA, 20 bp, Artificial Sequence
  Description of Artificial Sequence: Synthetic oligonucleotide
  Target: ATXN1; (-) strand; PAM type: YTN; PAM sequence: CTT
agatcagagaaattaattaa

SEQ ID NO: 164132 - DNA, 20 bp, Artificial Sequence
  Description of Artificial Sequence: Synthetic oligonucleotide
  Target: ATXN1; (-) strand; PAM type: YTN; PAM sequence: TTA
gtacttagatcagagaaatt

SEQ ID NO: 164133 - DNA, 20 bp, Artificial Sequence
  Description of Artificial Sequence: Synthetic oligonucleotide
  Target: ATXN1; (-) strand; PAM type: YTN; PAM sequence: CTG
gttagtacttagatcagaga

SEQ ID NO: 164134 - DNA, 20 bp, Artificial Sequence
  Description of Artificial Sequence: Synthetic oligonucleotide
  Target: ATXN1; (-) strand; PAM type: YTN; PAM sequence: TTA
ggcctggttagtacttagat

SEQ ID NO: 164135 - DNA, 20 bp, Artificial Sequence
  Description of Artificial Sequence: Synthetic oligonucleotide
  Target: ATXN1; (-) strand; PAM type: YTN; PAM sequence: TTA
gttaggcctggttagtactt

SEQ ID NO: 164136 - DNA, 20 bp, Artificial Sequence
  Description of Artificial Sequence: Synthetic oligonucleotide
  Target: ATXN1; (-) strand; PAM type: YTN; PAM sequence: CTG
aggcacagagaaatgaatta

SEQ ID NO: 164137 - DNA, 20 bp, Artificial Sequence
  Description of Artificial Sequence: Synthetic oligonucleotide
  Target: ATXN1; (-) strand; PAM type: YTN; PAM sequence: TTG
gagatgagcaaactgaggca

SEQ ID NO: 164138 - DNA, 20 bp, Artificial Sequence
  Description of Artificial Sequence: Synthetic oligonucleotide
  Target: ATXN1; (-) strand; PAM type: YTN; PAM sequence: TTT
ggagatgagcaaactgaggc

SEQ ID NO: 164139 - DNA, 20 bp, Artificial Sequence
  Description of Artificial Sequence: Synthetic oligonucleotide
  Target: ATXN1; (-) strand; PAM type: YTN; PAM sequence: CTT
tggagatgagcaaactgagg

SEQ ID NO: 164140 - DNA, 20 bp, Artificial Sequence
  Description of Artificial Sequence: Synthetic oligonucleotide
  Target: ATXN1; (-) strand; PAM type: YTN; PAM sequence: TTC
ccactttggagatgagcaaa

SEQ ID NO: 164141 - DNA, 20 bp, Artificial Sequence
  Description of Artificial Sequence: Synthetic oligonucleotide
  Target: ATXN1; (-) strand; PAM type: YTN; PAM sequence: TTA
ttcccactttggagatgagc

SEQ ID NO: 164142 - DNA, 20 bp, Artificial Sequence
  Description of Artificial Sequence: Synthetic oligonucleotide
  Target: ATXN1; (-) strand; PAM type: YTN; PAM sequence: CTA
gtattattcccactttggag

SEQ ID NO: 164143 - DNA, 20 bp, Artificial Sequence
  Description of Artificial Sequence: Synthetic oligonucleotide
  Target: ATXN1; (-) strand; PAM type: YTN; PAM sequence: CTG
tggggtaggaactagtatta

SEQ ID NO: 164144 - DNA, 20 bp, Artificial Sequence
  Description of Artificial Sequence: Synthetic oligonucleotide
  Target: ATXN1; (-) strand; PAM type: YTN; PAM sequence: CTC
acagcaagcctgtggggtag

SEQ ID NO: 164145 - DNA, 20 bp, Artificial Sequence
  Description of Artificial Sequence: Synthetic oligonucleotide
  Target: ATXN1; (-) strand; PAM type: YTN; PAM sequence: TTA
tgtgtgaactcacagcaagc

SEQ ID NO: 164146 - DNA, 20 bp, Artificial Sequence
  Description of Artificial Sequence: Synthetic oligonucleotide
  Target: ATXN1; (-) strand; PAM type: YTN; PAM sequence: CTT
atgtgtgaactcacagcaag

SEQ ID NO: 164147 - DNA, 20 bp, Artificial Sequence
  Description of Artificial Sequence: Synthetic oligonucleotide
  Target: ATXN1; (-) strand; PAM type: YTN; PAM sequence: TTC
ttatgtgtgaactcacagca

SEQ ID NO: 164148 - DNA, 20 bp, Artificial Sequence
  Description of Artificial Sequence: Synthetic oligonucleotide
  Target: ATXN1; (-) strand; PAM type: YTN; PAM sequence: CTT
cttatgtgtgaactcacagc

SEQ ID NO: 164149 - DNA, 20 bp, Artificial Sequence
  Description of Artificial Sequence: Synthetic oligonucleotide
  Target: ATXN1; (-) strand; PAM type: YTN; PAM sequence: TTC
ttcttatgtgtgaactcaca

SEQ ID NO: 164150 - DNA, 20 bp, Artificial Sequence
  Description of Artificial Sequence: Synthetic oligonucleotide
  Target: ATXN1; (-) strand; PAM type: YTN; PAM sequence: CTA
aattcttcttatgtgtgaac

SEQ ID NO: 164151 - DNA, 20 bp, Artificial Sequence
  Description of Artificial Sequence: Synthetic oligonucleotide
  Target: ATXN1; (-) strand; PAM type: YTN; PAM sequence: CTC
atctaaattcttcttatgtg

SEQ ID NO: 164152 - DNA, 20 bp, Artificial Sequence
  Description of Artificial Sequence: Synthetic oligonucleotide
  Target: ATXN1; (-) strand; PAM type: YTN; PAM sequence: TTG
agtacgccaggccctcatct

SEQ ID NO: 164153 - DNA, 20 bp, Artificial Sequence
  Description of Artificial Sequence: Synthetic oligonucleotide
  Target: ATXN1; (-) strand; PAM type: YTN; PAM sequence: CTT
gagtacgccaggccctcatc

SEQ ID NO: 164154 - DNA, 20 bp, Artificial Sequence
  Description of Artificial Sequence: Synthetic oligonucleotide
  Target: ATXN1; (-) strand; PAM type: YTN; PAM sequence: TTG
taggtcttgagtacgccagg

SEQ ID NO: 164155 - DNA, 20 bp, Artificial Sequence
  Description of Artificial Sequence: Synthetic oligonucleotide
  Target: ATXN1; (-) strand; PAM type: YTN; PAM sequence: TTA
gaaaataatcggaacaacca

SEQ ID NO: 164156 - DNA, 20 bp, Artificial Sequence
  Description of Artificial Sequence: Synthetic oligonucleotide
  Target: ATXN1; (-) strand; PAM type: YTN; PAM sequence: CTT
agaaaataatcggaacaacc

SEQ ID NO: 164157 - DNA, 20 bp, Artificial Sequence
  Description of Artificial Sequence: Synthetic oligonucleotide
  Target: ATXN1; (-) strand; PAM type: YTN; PAM sequence: TTC
ttagaaaataatcggaacaa

SEQ ID NO: 164158 - DNA, 20 bp, Artificial Sequence
  Description of Artificial Sequence: Synthetic oligonucleotide
  Target: ATXN1; (-) strand; PAM type: YTN; PAM sequence: TTT
cttagaaaataatcggaaca

SEQ ID NO: 164159 - DNA, 20 bp, Artificial Sequence
  Description of Artificial Sequence: Synthetic oligonucleotide
  Target: ATXN1; (-) strand; PAM type: YTN; PAM sequence: CTT
tcttagaaaataatcggaac

SEQ ID NO: 164160 - DNA, 20 bp, Artificial Sequence
  Description of Artificial Sequence: Synthetic oligonucleotide
  Target: ATXN1; (-) strand; PAM type: YTN; PAM sequence: TTA
tgcagatgaaaataggacca

SEQ ID NO: 164161 - DNA, 20 bp, Artificial Sequence
  Description of Artificial Sequence: Synthetic oligonucleotide
  Target: ATXN1; (-) strand; PAM type: YTN; PAM sequence: TTT
atgcagatgaaaataggacc

SEQ ID NO: 164162 - DNA, 20 bp, Artificial Sequence
  Description of Artificial Sequence: Synthetic oligonucleotide
  Target: ATXN1; (-) strand; PAM type: YTN; PAM sequence: TTT
tatgcagatgaaaataggac

SEQ ID NO: 164163 - DNA, 20 bp, Artificial Sequence
  Description of Artificial Sequence: Synthetic oligonucleotide
  Target: ATXN1; (-) strand; PAM type: YTN; PAM sequence: TTT
ttatgcagatgaaaatagga

SEQ ID NO: 164164 - DNA, 20 bp, Artificial Sequence
  Description of Artificial Sequence: Synthetic oligonucleotide
  Target: ATXN1; (-) strand; PAM type: YTN; PAM sequence: TTT
tttatgcagatgaaaatagg

SEQ ID NO: 164165 - DNA, 20 bp, Artificial Sequence
  Description of Artificial Sequence: Synthetic oligonucleotide
  Target: ATXN1; (-) strand; PAM type: YTN; PAM sequence: TTT
ttttatgcagatgaaaatag

SEQ ID NO: 164166 - DNA, 20 bp, Artificial Sequence
  Description of Artificial Sequence: Synthetic oligonucleotide
  Target: ATXN1; (-) strand; PAM type: YTN; PAM sequence: CTG
aaaatgtgatttttttatgc

SEQ ID NO: 164167 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccatgcc

SEQ ID NO: 164168 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 164169 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 164170 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 164171 - DNA, 20 bp, Artificial Sequence
  Description of Artificial Sequence: Synthetic oligonucleotide
  Target: ATXN1; (-) strand; PAM type: YTN; PAM sequence: CTC
gtgatccaccagcctcagcc

SEQ ID NO: 164172 - DNA, 20 bp, Artificial Sequence
  Description of Artificial Sequence: Synthetic oligonucleotide
  Target: ATXN1; (-) strand; PAM type: YTN; PAM sequence: TTC
atctcgtgatccaccagcct

SEQ ID NO: 164173 - DNA, 20 bp, Artificial Sequence
  Description of Artificial Sequence: Synthetic oligonucleotide
  Target: ATXN1; (-) strand; PAM type: YTN; PAM sequence: CTT
catctcgtgatccaccagcc

SEQ ID NO: 164174 - DNA, 20 bp, Artificial Sequence
  Description of Artificial Sequence: Synthetic oligonucleotide
  Target: ATXN1; (-) strand; PAM type: YTN; PAM sequence: CTC
ttcatctcgtgatccaccag

SEQ ID NO: 164175 - DNA, 20 bp, Artificial Sequence
  Description of Artificial Sequence: Synthetic oligonucleotide
  Target: ATXN1; (-) strand; PAM type: YTN; PAM sequence: CTC
gatctcttcatctcgtgatc

SEQ ID NO: 164176 - DNA, 20 bp, Artificial Sequence
  Description of Artificial Sequence: Synthetic oligonucleotide
  Target: ATXN1; (-) strand; PAM type: YTN; PAM sequence: TTG
gccaggatggtctcgatctc

SEQ ID NO: 164177 - DNA, 20 bp, Artificial Sequence
  Description of Artificial Sequence: Synthetic oligonucleotide
  Target: ATXN1; (-) strand; PAM type: YTN; PAM sequence: TTA
gtagaaacaagatgtcacca

SEQ ID NO: 164178 - DNA, 20 bp, Artificial Sequence
  Description of Artificial Sequence: Synthetic oligonucleotide
  Target: ATXN1; (-) strand; PAM type: YTN; PAM sequence: TTT
agtagaaacaagatgtcacc

SEQ ID NO: 164179 - DNA, 20 bp, Artificial Sequence
  Description of Artificial Sequence: Synthetic oligonucleotide
  Target: ATXN1; (-) strand; PAM type: YTN; PAM sequence: TTT
tagtagaaacaagatgtcac

SEQ ID NO: 164180 - DNA, 20 bp, Artificial Sequence
  Description of Artificial Sequence: Synthetic oligonucleotide
  Target: ATXN1; (-) strand; PAM type: YTN; PAM sequence: TTT
ttagtagaaacaagatgtca

SEQ ID NO: 164181 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagaaacaaga

SEQ ID NO: 164182 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagaaacaag

SEQ ID NO: 164183 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagaaacaa

SEQ ID NO: 164184 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagaaaca

SEQ ID NO: 164185 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 164186 - DNA, 20 bp, Artificial Sequence
  Description of Artificial Sequence: Synthetic oligonucleotide
  Target: ATXN1; (-) strand; PAM type: YTN; PAM sequence: CTA
caggcacgtgccaccatgcc

SEQ ID NO: 164187 - DNA, 20 bp, Artificial Sequence
  Description of Artificial Sequence: Synthetic oligonucleotide
  Target: ATXN1; (-) strand; PAM type: YTN; PAM sequence: CTG
gaactacaggcacgtgccac

SEQ ID NO: 164188 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctggaactacag

SEQ ID NO: 164189 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctggaa

SEQ ID NO: 164190 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 164191 - DNA, 20 bp, Artificial Sequence
  Description of Artificial Sequence: Synthetic oligonucleotide
  Target: ATXN1; (-) strand; PAM type: YTN; PAM sequence: TTC
tgcctcagcctcccgagtag

SEQ ID NO: 164192 - DNA, 20 bp, Artificial Sequence
  Description of Artificial Sequence: Synthetic oligonucleotide
  Target: ATXN1; (-) strand; PAM type: YTN; PAM sequence: CTT
ctgcctcagcctcccgagta

SEQ ID NO: 164193 - DNA, 20 bp, Artificial Sequence
  Description of Artificial Sequence: Synthetic oligonucleotide
  Target: ATXN1; (-) strand; PAM type: YTN; PAM sequence: TTC
ttctgcctcagcctcccgag

SEQ ID NO: 164194 - DNA, 20 bp, Artificial Sequence
  Description of Artificial Sequence: Synthetic oligonucleotide
  Target: ATXN1; (-) strand; PAM type: YTN; PAM sequence: TTC
aagtgattcttctgcctcag

SEQ ID NO: 164195 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagtgattcttc

SEQ ID NO: 164196 - DNA, 20 bp, Artificial Sequence
  Description of Artificial Sequence: Synthetic oligonucleotide
  Target: ATXN1; (-) strand; PAM type: YTN; PAM sequence: CTG
cctcccgggttcaagtgatt

SEQ ID NO: 164197 - DNA, 20 bp, Artificial Sequence
  Description of Artificial Sequence: Synthetic oligonucleotide
  Target: ATXN1; (-) strand; PAM type: YTN; PAM sequence: CTC
tgcctcccgggttcaagtga

SEQ ID NO: 164198 - DNA, 20 bp, Artificial Sequence
  Description of Artificial Sequence: Synthetic oligonucleotide
  Target: ATXN1; (-) strand; PAM type: YTN; PAM sequence: CTG
caacctctgcctcccgggtt

SEQ ID NO: 164199 - DNA, 20 bp, Artificial Sequence
  Description of Artificial Sequence: Synthetic oligonucleotide
  Target: ATXN1; (-) strand; PAM type: YTN; PAM sequence: CTC
actgcaacctctgcctcccg

SEQ ID NO: 164200 - DNA, 20 bp, Artificial Sequence
  Description of Artificial Sequence: Synthetic oligonucleotide
  Target: ATXN1; (-) strand; PAM type: YTN; PAM sequence: CTC
agctcactgcaacctctgcc

SEQ ID NO: 164201 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcatgatctc

SEQ ID NO: 164202 - DNA, 20 bp, Artificial Sequence
  Description of Artificial Sequence: Synthetic oligonucleotide
  Target: ATXN1; (-) strand; PAM type: YTN; PAM sequence: CTG
tcaccaggctggagtgcagt

SEQ ID NO: 164203 - DNA, 20 bp, Artificial Sequence
  Description of Artificial Sequence: Synthetic oligonucleotide
  Target: ATXN1; (-) strand; PAM type: YTN; PAM sequence: CTC
tgtcaccaggctggagtgca

SEQ ID NO: 164204 - DNA, 20 bp, Artificial Sequence
  Description of Artificial Sequence: Synthetic oligonucleotide
  Target: ATXN1; (-) strand; PAM type: YTN; PAM sequence: CTC
gctctgtcaccaggctggag

SEQ ID NO: 164205 - DNA, 20 bp, Artificial Sequence
  Description of Artificial Sequence: Synthetic oligonucleotide
  Target: ATXN1; (-) strand; PAM type: YTN; PAM sequence: TTG
agacacagtctcgctctgtc

SEQ ID NO: 164206 - DNA, 20 bp, Artificial Sequence
  Description of Artificial Sequence: Synthetic oligonucleotide
  Target: ATXN1; (-) strand; PAM type: YTN; PAM sequence: TTT
gagacacagtctcgctctgt

SEQ ID NO: 164207 - DNA, 20 bp, Artificial Sequence
  Description of Artificial Sequence: Synthetic oligonucleotide
  Target: ATXN1; (-) strand; PAM type: YTN; PAM sequence: TTT
tgagacacagtctcgctctg

SEQ ID NO: 164208 - DNA, 20 bp, Artificial Sequence
  Description of Artificial Sequence: Synthetic oligonucleotide
  Target: ATXN1; (-) strand; PAM type: YTN; PAM sequence: TTT
ttgagacacagtctcgctct

SEQ ID NO: 164209 - DNA, 20 bp, Artificial Sequence
  Description of Artificial Sequence: Synthetic oligonucleotide
  Target: ATXN1; (-) strand; PAM type: YTN; PAM sequence: TTT
tttgagacacagtctcgctc

SEQ ID NO: 164210 - DNA, 20 bp, Artificial Sequence
  Description of Artificial Sequence: Synthetic oligonucleotide
  Target: ATXN1; (-) strand; PAM type: YTN; PAM sequence: CTT
ttttgagacacagtctcgct

SEQ ID NO: 164211 - DNA, 20 bp, Artificial Sequence
  Description of Artificial Sequence: Synthetic oligonucleotide
  Target: ATXN1; (-) strand; PAM type: YTN; PAM sequence: TTC
ttttttgagacacagtctcg

SEQ ID NO: 164212 - DNA, 20 bp, Artificial Sequence
  Description of Artificial Sequence: Synthetic oligonucleotide
  Target: ATXN1; (-) strand; PAM type: YTN; PAM sequence: TTT
cttttttgagacacagtctc

SEQ ID NO: 164213 - DNA, 20 bp, Artificial Sequence
  Description of Artificial Sequence: Synthetic oligonucleotide
  Target: ATXN1; (-) strand; PAM type: YTN; PAM sequence: CTT
tcttttttgagacacagtct

SEQ ID NO: 164214 - DNA, 20 bp, Artificial Sequence
  Description of Artificial Sequence: Synthetic oligonucleotide
  Target: ATXN1; (-) strand; PAM type: YTN; PAM sequence: TTC
tttcttttttgagacacagt

SEQ ID NO: 164215 - DNA, 20 bp, Artificial Sequence
  Description of Artificial Sequence: Synthetic oligonucleotide
  Target: ATXN1; (-) strand; PAM type: YTN; PAM sequence: TTT
ctttcttttttgagacacag

SEQ ID NO: 164216 - DNA, 20 bp, Artificial Sequence
  Description of Artificial Sequence: Synthetic oligonucleotide
  Target: ATXN1; (-) strand; PAM type: YTN; PAM sequence: CTT
tctttcttttttgagacaca

SEQ ID NO: 164217 - DNA, 20 bp, Artificial Sequence
  Description of Artificial Sequence: Synthetic oligonucleotide
  Target: ATXN1; (-) strand; PAM type: YTN; PAM sequence: TTC
tttctttcttttttgagaca

SEQ ID NO: 164218 - DNA, 20 bp, Artificial Sequence
  Description of Artificial Sequence: Synthetic oligonucleotide
  Target: ATXN1; (-) strand; PAM type: YTN; PAM sequence: TTT
ctttctttcttttttgagac

SEQ ID NO: 164219 - DNA, 20 bp, Artificial Sequence
  Description of Artificial Sequence: Synthetic oligonucleotide
  Target: ATXN1; (-) strand; PAM type: YTN; PAM sequence: TTT
tctttctttcttttttgaga

SEQ ID NO: 164220 - DNA, 20 bp, Artificial Sequence
  Description of Artificial Sequence: Synthetic oligonucleotide
  Target: ATXN1; (-) strand; PAM type: YTN; PAM sequence: TTT
ttctttctttcttttttgag

SEQ ID NO: 164221 - DNA, 20 bp, Artificial Sequence
  Description of Artificial Sequence: Synthetic oligonucleotide
  Target: ATXN1; (-) strand; PAM type: YTN; PAM sequence: TTT
tttctttctttcttttttga

SEQ ID NO: 164222 - DNA, 20 bp, Artificial Sequence
  Description of Artificial Sequence: Synthetic oligonucleotide
  Target: ATXN1; (-) strand; PAM type: YTN; PAM sequence: TTT
ttttctttctttcttttttg

SEQ ID NO: 164223 - DNA, 20 bp, Artificial Sequence
  Description of Artificial Sequence: Synthetic oligonucleotide
  Target: ATXN1; (-) strand; PAM type: YTN; PAM sequence: TTT
tttttctttctttctttttt

SEQ ID NO: 164224 - DNA, 20 bp, Artificial Sequence
  Description of Artificial Sequence: Synthetic oligonucleotide
  Target: ATXN1; (-) strand; PAM type: YTN; PAM sequence: TTT
ttttttctttctttcttttt

SEQ ID NO: 164225 - DNA, 20 bp, Artificial Sequence
  Description of Artificial Sequence: Synthetic oligonucleotide
  Target: ATXN1; (-) strand; PAM type: YTN; PAM sequence: TTT
tttttttctttctttctttt

SEQ ID NO: 164226 - DNA, 20 bp, Artificial Sequence
  Description of Artificial Sequence: Synthetic oligonucleotide
  Target: ATXN1; (-) strand; PAM type: YTN; PAM sequence: TTT
ttttttttctttctttcttt

SEQ ID NO: 164227 - DNA, 20 bp, Artificial Sequence
  Description of Artificial Sequence: Synthetic oligonucleotide
  Target: ATXN1; (-) strand; PAM type: YTN; PAM sequence: TTT
tttttttttctttctttctt

SEQ ID NO: 164228 - DNA, 20 bp, Artificial Sequence
  Description of Artificial Sequence: Synthetic oligonucleotide
  Target: ATXN1; (-) strand; PAM type: YTN; PAM sequence: CTA
gggaggaaaatgtgtttttt

SEQ ID NO: 164229 - DNA, 20 bp, Artificial Sequence
  Description of Artificial Sequence: Synthetic oligonucleotide
  Target: ATXN1; (-) strand; PAM type: YTN; PAM sequence: TTC
tagggaggaaaatgtgtttt

SEQ ID NO: 164230 - DNA, 20 bp, Artificial Sequence
  Description of Artificial Sequence: Synthetic oligonucleotide
  Target: ATXN1; (-) strand; PAM type: YTN; PAM sequence: CTG
agaaagaattctagggagga

SEQ ID NO: 164231 - DNA, 20 bp, Artificial Sequence
  Description of Artificial Sequence: Synthetic oligonucleotide
  Target: ATXN1; (-) strand; PAM type: YTN; PAM sequence: CTA
tgatgcaggaagtaacctga

SEQ ID NO: 164232 - DNA, 20 bp, Artificial Sequence
  Description of Artificial Sequence: Synthetic oligonucleotide
  Target: ATXN1; (-) strand; PAM type: YTN; PAM sequence: CTG
gtgtctatgatgcaggaagt

SEQ ID NO: 164233 - DNA, 20 bp, Artificial Sequence
  Description of Artificial Sequence: Synthetic oligonucleotide
  Target: ATXN1; (-) strand; PAM type: YTN; PAM sequence: CTG
actggtgtctatgatgcagg

SEQ ID NO: 164234 - DNA, 20 bp, Artificial Sequence
  Description of Artificial Sequence: Synthetic oligonucleotide
  Target: ATXN1; (-) strand; PAM type: YTN; PAM sequence: CTG
gagctgactggtgtctatga

SEQ ID NO: 164235 - DNA, 20 bp, Artificial Sequence
  Description of Artificial Sequence: Synthetic oligonucleotide
  Target: ATXN1; (-) strand; PAM type: YTN; PAM sequence: TTG
ctggagctgactggtgtcta

SEQ ID NO: 164236 - DNA, 20 bp, Artificial Sequence
  Description of Artificial Sequence: Synthetic oligonucleotide
  Target: ATXN1; (-) strand; PAM type: YTN; PAM sequence: TTT
gctggagctgactggtgtct

SEQ ID NO: 164237 - DNA, 20 bp, Artificial Sequence
  Description of Artificial Sequence: Synthetic oligonucleotide
  Target: ATXN1; (-) strand; PAM type: YTN; PAM sequence: CTT
tgctggagctgactggtgtc

SEQ ID NO: 164238 - DNA, 20 bp, Artificial Sequence
  Description of Artificial Sequence: Synthetic oligonucleotide
  Target: ATXN1; (-) strand; PAM type: YTN; PAM sequence: TTC
accatctttgctggagctga

SEQ ID NO: 164239 - DNA, 20 bp, Artificial Sequence
  Description of Artificial Sequence: Synthetic oligonucleotide
  Target: ATXN1; (-) strand; PAM type: YTN; PAM sequence: TTC
cattcaccatctttgctgga

SEQ ID NO: 164240 - DNA, 20 bp, Artificial Sequence
  Description of Artificial Sequence: Synthetic oligonucleotide
  Target: ATXN1; (-) strand; PAM type: YTN; PAM sequence: TTA
ttccattcaccatctttgct

SEQ ID NO: 164241 - DNA, 20 bp, Artificial Sequence
  Description of Artificial Sequence: Synthetic oligonucleotide
  Target: ATXN1; (-) strand; PAM type: YTN; PAM sequence: TTA
atgagagattattccattca

SEQ ID NO: 164242 - DNA, 20 bp, Artificial Sequence
  Description of Artificial Sequence: Synthetic oligonucleotide
  Target: ATXN1; (-) strand; PAM type: YTN; PAM sequence: TTT
aatgagagattattccattc

SEQ ID NO: 164243 - DNA, 20 bp, Artificial Sequence
  Description of Artificial Sequence: Synthetic oligonucleotide
  Target: ATXN1; (-) strand; PAM type: YTN; PAM sequence: TTT
taatgagagattattccatt

SEQ ID NO: 164244 - DNA, 20 bp, Artificial Sequence
  Description of Artificial Sequence: Synthetic oligonucleotide
  Target: ATXN1; (-) strand; PAM type: YTN; PAM sequence: CTT
ttaatgagagattattccat

SEQ ID NO: 164245 - DNA, 20 bp, Artificial Sequence
  Description of Artificial Sequence: Synthetic oligonucleotide
  Target: ATXN1; (-) strand; PAM type: YTN; PAM sequence: CTC
atgaagggaagtgaggcagg

SEQ ID NO: 164246 - DNA, 20 bp, Artificial Sequence
  Description of Artificial Sequence: Synthetic oligonucleotide
  Target: ATXN1; (-) strand; PAM type: YTN; PAM sequence: TTG
aaatgcctcatgaagggaag

SEQ ID NO: 164247 - DNA, 20 bp, Artificial Sequence
  Description of Artificial Sequence: Synthetic oligonucleotide
  Target: ATXN1; (-) strand; PAM type: YTN; PAM sequence: CTT
gaaatgcctcatgaagggaa

SEQ ID NO: 164248 - DNA, 20 bp, Artificial Sequence
  Description of Artificial Sequence: Synthetic oligonucleotide
  Target: ATXN1; (-) strand; PAM type: YTN; PAM sequence: CTG
aaccggtaagacttgaaatg

SEQ ID NO: 164249 - DNA, 20 bp, Artificial Sequence
  Description of Artificial Sequence: Synthetic oligonucleotide
  Target: ATXN1; (-) strand; PAM type: YTN; PAM sequence: TTC
tgaaccggtaagacttgaaa

SEQ ID NO: 164250 - DNA, 20 bp, Artificial Sequence
  Description of Artificial Sequence: Synthetic oligonucleotide
  Target: ATXN1; (-) strand; PAM type: YTN; PAM sequence: TTT
ctgaaccggtaagacttgaa

SEQ ID NO: 164251 - DNA, 20 bp, Artificial Sequence
  Description of Artificial Sequence: Synthetic oligonucleotide
  Target: ATXN1; (-) strand; PAM type: YTN; PAM sequence: CTT
tctgaaccggtaagacttga

SEQ ID NO: 164252 - DNA, 20 bp, Artificial Sequence
  Description of Artificial Sequence: Synthetic oligonucleotide
  Target: ATXN1; (-) strand; PAM type: YTN; PAM sequence: TTA
gtaaactttctgaaccggta

SEQ ID NO: 164253 - DNA, 20 bp, Artificial Sequence
  Description of Artificial Sequence: Synthetic oligonucleotide
  Target: ATXN1; (-) strand; PAM type: YTN; PAM sequence: CTT
agtaaactttctgaaccggt

SEQ ID NO: 164254 - DNA, 20 bp, Artificial Sequence
  Description of Artificial Sequence: Synthetic oligonucleotide
  Target: ATXN1; (-) strand; PAM type: YTN; PAM sequence: TTA
gagacttagtaaactttctg

SEQ ID NO: 164255 - DNA, 20 bp, Artificial Sequence
  Description of Artificial Sequence: Synthetic oligonucleotide
  Target: ATXN1; (-) strand; PAM type: YTN; PAM sequence: TTT
agagacttagtaaactttct

SEQ ID NO: 164256 - DNA, 20 bp, Artificial Sequence
  Description of Artificial Sequence: Synthetic oligonucleotide
  Target: ATXN1; (-) strand; PAM type: YTN; PAM sequence: TTT
tagagacttagtaaactttc

SEQ ID NO: 164257 - DNA, 20 bp, Artificial Sequence
  Description of Artificial Sequence: Synthetic oligonucleotide
  Target: ATXN1; (-) strand; PAM type: YTN; PAM sequence: CTA
aaagaagacaattttagaga

SEQ ID NO: 164258 - DNA, 20 bp, Artificial Sequence
  Description of Artificial Sequence: Synthetic oligonucleotide
  Target: ATXN1; (-) strand; PAM type: YTN; PAM sequence: TTC
taaaagaagacaattttaga

SEQ ID NO: 164259 - DNA, 20 bp, Artificial Sequence
  Description of Artificial Sequence: Synthetic oligonucleotide
  Target: ATXN1; (-) strand; PAM type: YTN; PAM sequence: TTT
ctaaaagaagacaattttag

SEQ ID NO: 164260 - DNA, 20 bp, Artificial Sequence
  Description of Artificial Sequence: Synthetic oligonucleotide
  Target: ATXN1; (-) strand; PAM type: YTN; PAM sequence: TTT
tctaaaagaagacaatttta

SEQ ID NO: 164261 - DNA, 20 bp, Artificial Sequence
  Description of Artificial Sequence: Synthetic oligonucleotide
  Target: ATXN1; (-) strand; PAM type: YTN; PAM sequence: CTA
gtgtggagtattttctaaaa

SEQ ID NO: 164262 - DNA, 20 bp, Artificial Sequence
  Description of Artificial Sequence: Synthetic oligonucleotide
  Target: ATXN1; (-) strand; PAM type: YTN; PAM sequence: TTA
gggggaaaaaaaaatcagtg

SEQ ID NO: 164263 - DNA, 20 bp, Artificial Sequence
  Description of Artificial Sequence: Synthetic oligonucleotide
  Target: ATXN1; (-) strand; PAM type: YTN; PAM sequence: TTT
agggggaaaaaaaaatcagt

SEQ ID NO: 164264 - DNA, 20 bp, Artificial Sequence
  Description of Artificial Sequence: Synthetic oligonucleotide
  Target: ATXN1; (-) strand; PAM type: YTN; PAM sequence: TTG
gtccagtttagggggaaaaa

SEQ ID NO: 164265 - DNA, 20 bp, Artificial Sequence
  Description of Artificial Sequence: Synthetic oligonucleotide
  Target: ATXN1; (-) strand; PAM type: YTN; PAM sequence: TTT
ggtccagtttagggggaaaa

SEQ ID NO: 164266 - DNA, 20 bp, Artificial Sequence
  Description of Artificial Sequence: Synthetic oligonucleotide
  Target: ATXN1; (-) strand; PAM type: YTN; PAM sequence: CTT
tggtccagtttagggggaaa

SEQ ID NO: 164267 - DNA, 20 bp, Artificial Sequence
  Description of Artificial Sequence: Synthetic oligonucleotide
  Target: ATXN1; (-) strand; PAM type: YTN; PAM sequence: CTG
caaacaaggctttggtccag

SEQ ID NO: 164268 - DNA, 20 bp, Artificial Sequence
  Description of Artificial Sequence: Synthetic oligonucleotide
  Target: ATXN1; (-) strand; PAM type: YTN; PAM sequence: TTC
tgcaaacaaggctttggtcc

SEQ ID NO: 164269 - DNA, 20 bp, Artificial Sequence
  Description of Artificial Sequence: Synthetic oligonucleotide
  Target: ATXN1; (-) strand; PAM type: YTN; PAM sequence: TTG
ttctgcaaacaaggctttgg

SEQ ID NO: 164270 - DNA, 20 bp, Artificial Sequence
  Description of Artificial Sequence: Synthetic oligonucleotide
  Target: ATXN1; (-) strand; PAM type: YTN; PAM sequence: TTT
gttctgcaaacaaggctttg

SEQ ID NO: 164271 - DNA, 20 bp, Artificial Sequence
  Description of Artificial Sequence: Synthetic oligonucleotide
  Target: ATXN1; (-) strand; PAM type: YTN; PAM sequence: TTG
accatttgttctgcaaacaa

SEQ ID NO: 164272 - DNA, 20 bp, Artificial Sequence
  Description of Artificial Sequence: Synthetic oligonucleotide
  Target: ATXN1; (-) strand; PAM type: YTN; PAM sequence: TTG
aatgtagatgtaattgacca

SEQ ID NO: 164273 - DNA, 20 bp, Artificial Sequence
  Description of Artificial Sequence: Synthetic oligonucleotide
  Target: ATXN1; (-) strand; PAM type: YTN; PAM sequence: TTT
gaatgtagatgtaattgacc

SEQ ID NO: 164274 - DNA, 20 bp, Artificial Sequence
  Description of Artificial Sequence: Synthetic oligonucleotide
  Target: ATXN1; (-) strand; PAM type: YTN; PAM sequence: TTT
tgaatgtagatgtaattgac

SEQ ID NO: 164275 - DNA, 20 bp, Artificial Sequence
  Description of Artificial Sequence: Synthetic oligonucleotide
  Target: ATXN1; (-) strand; PAM type: YTN; PAM sequence: TTT
ttgaatgtagatgtaattga

SEQ ID NO: 164276 - DNA, 20 bp, Artificial Sequence
  Description of Artificial Sequence: Synthetic oligonucleotide
  Target: ATXN1; (-) strand; PAM type: YTN; PAM sequence: TTA
tttttgaatgtagatgtaat

SEQ ID NO: 164277 - DNA, 20 bp, Artificial Sequence
  Description of Artificial Sequence: Synthetic oligonucleotide
  Target: ATXN1; (-) strand; PAM type: YTN; PAM sequence: TTT
atttttgaatgtagatgtaa

SEQ ID NO: 164278 - DNA, 20 bp, Artificial Sequence
  Description of Artificial Sequence: Synthetic oligonucleotide
  Target: ATXN1; (-) strand; PAM type: YTN; PAM sequence: TTT
tatttttgaatgtagatgta

SEQ ID NO: 164279 - DNA, 20 bp, Artificial Sequence
  Description of Artificial Sequence: Synthetic oligonucleotide
  Target: ATXN1; (-) strand; PAM type: YTN; PAM sequence: TTG
aattttatttttgaatgtag

SEQ ID NO: 164280 - DNA, 20 bp, Artificial Sequence
  Description of Artificial Sequence: Synthetic oligonucleotide
  Target: ATXN1; (-) strand; PAM type: YTN; PAM sequence: TTT
gaattttatttttgaatgta

SEQ ID NO: 164281 - DNA, 20 bp, Artificial Sequence
  Description of Artificial Sequence: Synthetic oligonucleotide
  Target: ATXN1; (-) strand; PAM type: YTN; PAM sequence: TTG
aaaacatgagcacatttgaa

SEQ ID NO: 164282 - DNA, 20 bp, Artificial Sequence
  Description of Artificial Sequence: Synthetic oligonucleotide
  Target: ATXN1; (-) strand; PAM type: YTN; PAM sequence: TTA
aattgaaaacatgagcacat

SEQ ID NO: 164283 - DNA, 20 bp, Artificial Sequence
  Description of Artificial Sequence: Synthetic oligonucleotide
  Target: ATXN1; (-) strand; PAM type: YTN; PAM sequence: CTT
aaattgaaaacatgagcaca

SEQ ID NO: 164284 - DNA, 20 bp, Artificial Sequence
  Description of Artificial Sequence: Synthetic oligonucleotide
  Target: ATXN1; (-) strand; PAM type: YTN; PAM sequence: TTA
taccaaaggaataaacagca

SEQ ID NO: 164285 - DNA, 20 bp, Artificial Sequence
  Description of Artificial Sequence: Synthetic oligonucleotide
  Target: ATXN1; (-) strand; PAM type: YTN; PAM sequence: TTT
ataccaaaggaataaacagc

SEQ ID NO: 164286 - DNA, 20 bp, Artificial Sequence
  Description of Artificial Sequence: Synthetic oligonucleotide
  Target: ATXN1; (-) strand; PAM type: YTN; PAM sequence: CTA
tttataccaaaggaataaac

SEQ ID NO: 164287 - DNA, 20 bp, Artificial Sequence
  Description of Artificial Sequence: Synthetic oligonucleotide
  Target: ATXN1; (-) strand; PAM type: YTN; PAM sequence: TTC
tatttataccaaaggaataa

SEQ ID NO: 164288 - DNA, 20 bp, Artificial Sequence
  Description of Artificial Sequence: Synthetic oligonucleotide
  Target: ATXN1; (-) strand; PAM type: YTN; PAM sequence: CTT
ctatttataccaaaggaata

SEQ ID NO: 164289 - DNA, 20 bp, Artificial Sequence
  Description of Artificial Sequence: Synthetic oligonucleotide
  Target: ATXN1; (-) strand; PAM type: YTN; PAM sequence: TTC
aaataagccagaaagcttct

SEQ ID NO: 164290 - DNA, 20 bp, Artificial Sequence
  Description of Artificial Sequence: Synthetic oligonucleotide
  Target: ATXN1; (-) strand; PAM type: YTN; PAM sequence: CTG
cgttcaaataagccagaaag

SEQ ID NO: 164291 - DNA, 20 bp, Artificial Sequence
  Description of Artificial Sequence: Synthetic oligonucleotide
  Target: ATXN1; (-) strand; PAM type: YTN; PAM sequence: TTC
tgcgttcaaataagccagaa

SEQ ID NO: 164292 - DNA, 20 bp, Artificial Sequence
  Description of Artificial Sequence: Synthetic oligonucleotide
  Target: ATXN1; (-) strand; PAM type: YTN; PAM sequence: CTA
tgtgttctgcgttcaaataa

SEQ ID NO: 164293 - DNA, 20 bp, Artificial Sequence
  Description of Artificial Sequence: Synthetic oligonucleotide
  Target: ATXN1; (-) strand; PAM type: YTN; PAM sequence: CTA
aacagtgtactatgtgttct

SEQ ID NO: 164294 - DNA, 20 bp, Artificial Sequence
  Description of Artificial Sequence: Synthetic oligonucleotide
  Target: ATXN1; (-) strand; PAM type: YTN; PAM sequence: TTG
tatctaaacagtgtactatg

SEQ ID NO: 164295 - DNA, 20 bp, Artificial Sequence
  Description of Artificial Sequence: Synthetic oligonucleotide
  Target: ATXN1; (-) strand; PAM type: YTN; PAM sequence: TTA
taatgaataattgtatctaa

SEQ ID NO: 164296 - DNA, 20 bp, Artificial Sequence
  Description of Artificial Sequence: Synthetic oligonucleotide
  Target: ATXN1; (-) strand; PAM type: YTN; PAM sequence: TTT
ataatgaataattgtatcta

SEQ ID NO: 164297 - DNA, 20 bp, Artificial Sequence
  Description of Artificial Sequence: Synthetic oligonucleotide
  Target: ATXN1; (-) strand; PAM type: YTN; PAM sequence: TTA
atttataatgaataattgta

SEQ ID NO: 164298 - DNA, 20 bp, Artificial Sequence
  Description of Artificial Sequence: Synthetic oligonucleotide
  Target: ATXN1; (-) strand; PAM type: YTN; PAM sequence: TTT
aatttataatgaataattgt

SEQ ID NO: 164299 - DNA, 20 bp, Artificial Sequence
  Description of Artificial Sequence: Synthetic oligonucleotide
  Target: ATXN1; (-) strand; PAM type: YTN; PAM sequence: TTG
atttaatttataatgaataa

SEQ ID NO: 164300 - DNA, 20 bp, Artificial Sequence
  Description of Artificial Sequence: Synthetic oligonucleotide
  Target: ATXN1; (-) strand; PAM type: YTN; PAM sequence: CTA
aaaaggaaaagcattgattt

SEQ ID NO: 164301 - DNA, 20 bp, Artificial Sequence
  Description of Artificial Sequence: Synthetic oligonucleotide
  Target: ATXN1; (-) strand; PAM type: YTN; PAM sequence: TTC
taaaaaggaaaagcattgat

SEQ ID NO: 164302 - DNA, 20 bp, Artificial Sequence
  Description of Artificial Sequence: Synthetic oligonucleotide
  Target: ATXN1; (-) strand; PAM type: YTN; PAM sequence: TTA
gggcatggtattctaaaaag

SEQ ID NO: 164303 - DNA, 20 bp, Artificial Sequence
  Description of Artificial Sequence: Synthetic oligonucleotide
  Target: ATXN1; (-) strand; PAM type: YTN; PAM sequence: CTA
gttagggcatggtattctaa

SEQ ID NO: 164304 - DNA, 20 bp, Artificial Sequence
  Description of Artificial Sequence: Synthetic oligonucleotide
  Target: ATXN1; (-) strand; PAM type: YTN; PAM sequence: TTC
tagttagggcatggtattct

SEQ ID NO: 164305 - DNA, 20 bp, Artificial Sequence
  Description of Artificial Sequence: Synthetic oligonucleotide
  Target: ATXN1; (-) strand; PAM type: YTN; PAM sequence: TTG
tagagattctagttagggca

SEQ ID NO: 164306 - DNA, 20 bp, Artificial Sequence
  Description of Artificial Sequence: Synthetic oligonucleotide
  Target: ATXN1; (-) strand; PAM type: YTN; PAM sequence: TTA
taatgttgtagagattctag

SEQ ID NO: 164307 - DNA, 20 bp, Artificial Sequence
  Description of Artificial Sequence: Synthetic oligonucleotide
  Target: ATXN1; (-) strand; PAM type: YTN; PAM sequence: TTT
ataatgttgtagagattcta

SEQ ID NO: 164308 - DNA, 20 bp, Artificial Sequence
  Description of Artificial Sequence: Synthetic oligonucleotide
  Target: ATXN1; (-) strand; PAM type: YTN; PAM sequence: TTT
tataatgttgtagagattct

SEQ ID NO: 164309 - DNA, 20 bp, Artificial Sequence
  Description of Artificial Sequence: Synthetic oligonucleotide
  Target: ATXN1; (-) strand; PAM type: YTN; PAM sequence: TTT
ttataatgttgtagagattc

SEQ ID NO: 164310 - DNA, 20 bp, Artificial Sequence
  Description of Artificial Sequence: Synthetic oligonucleotide
  Target: ATXN1; (-) strand; PAM type: YTN; PAM sequence: TTA
tgtttttataatgttgtaga

SEQ ID NO: 164311 - DNA, 20 bp, Artificial Sequence
  Description of Artificial Sequence: Synthetic oligonucleotide
  Target: ATXN1; (-) strand; PAM type: YTN; PAM sequence: TTT
atgtttttataatgttgtag

SEQ ID NO: 164312 - DNA, 20 bp, Artificial Sequence
  Description of Artificial Sequence: Synthetic oligonucleotide
  Target: ATXN1; (-) strand; PAM type: YTN; PAM sequence: TTT
tatgtttttataatgttgta

SEQ ID NO: 164313 - DNA, 20 bp, Artificial Sequence
  Description of Artificial Sequence: Synthetic oligonucleotide
  Target: ATXN1; (-) strand; PAM type: YTN; PAM sequence: TTA
gtcatattttatgtttttat

SEQ ID NO: 164314 - DNA, 20 bp, Artificial Sequence
  Description of Artificial Sequence: Synthetic oligonucleotide
  Target: ATXN1; (-) strand; PAM type: YTN; PAM sequence: TTA
aatcgttagtcatattttat

SEQ ID NO: 164315 - DNA, 20 bp, Artificial Sequence
  Description of Artificial Sequence: Synthetic oligonucleotide
  Target: ATXN1; (-) strand; PAM type: YTN; PAM sequence: TTA
aattaaatcgttagtcatat

SEQ ID NO: 164316 - DNA, 20 bp, Artificial Sequence
  Description of Artificial Sequence: Synthetic oligonucleotide
  Target: ATXN1; (-) strand; PAM type: YTN; PAM sequence: CTT
aaattaaatcgttagtcata

SEQ ID NO: 164317 - DNA, 20 bp, Artificial Sequence
  Description of Artificial Sequence: Synthetic oligonucleotide
  Target: ATXN1; (-) strand; PAM type: YTN; PAM sequence: TTA
gggccttaaattaaatcgtt

SEQ ID NO: 164318 - DNA, 20 bp, Artificial Sequence
  Description of Artificial Sequence: Synthetic oligonucleotide
  Target: ATXN1; (-) strand; PAM type: YTN; PAM sequence: TTG
ggaattagggccttaaatta

SEQ ID NO: 164319 - DNA, 20 bp, Artificial Sequence
  Description of Artificial Sequence: Synthetic oligonucleotide
  Target: ATXN1; (-) strand; PAM type: YTN; PAM sequence: TTC
attgggaattagggccttaa

SEQ ID NO: 164320 - DNA, 20 bp, Artificial Sequence
  Description of Artificial Sequence: Synthetic oligonucleotide
  Target: ATXN1; (-) strand; PAM type: YTN; PAM sequence: TTT
cattgggaattagggcctta

SEQ ID NO: 164321 - DNA, 20 bp, Artificial Sequence
  Description of Artificial Sequence: Synthetic oligonucleotide
  Target: ATXN1; (-) strand; PAM type: YTN; PAM sequence: CTT
tcattgggaattagggcctt

SEQ ID NO: 164322 - DNA, 20 bp, Artificial Sequence
  Description of Artificial Sequence: Synthetic oligonucleotide
  Target: ATXN1; (-) strand; PAM type: YTN; PAM sequence: TTA
tctttcattgggaattaggg

SEQ ID NO: 164323 - DNA, 20 bp, Artificial Sequence
  Description of Artificial Sequence: Synthetic oligonucleotide
  Target: ATXN1; (-) strand; PAM type: YTN; PAM sequence: TTT
atctttcattgggaattagg

SEQ ID NO: 164324 - DNA, 20 bp, Artificial Sequence
  Description of Artificial Sequence: Synthetic oligonucleotide
  Target: ATXN1; (-) strand; PAM type: YTN; PAM sequence: TTA
tttatctttcattgggaatt

SEQ ID NO: 164325 - DNA, 20 bp, Artificial Sequence
  Description of Artificial Sequence: Synthetic oligonucleotide
  Target: ATXN1; (-) strand; PAM type: YTN; PAM sequence: CTA
cagcagcattatttatcttt

SEQ ID NO: 164326 - DNA, 20 bp, Artificial Sequence
  Description of Artificial Sequence: Synthetic oligonucleotide
  Target: ATXN1; (-) strand; PAM type: YTN; PAM sequence: TTG
gtgcctacagcagcattatt

SEQ ID NO: 164327 - DNA, 20 bp, Artificial Sequence
  Description of Artificial Sequence: Synthetic oligonucleotide
  Target: ATXN1; (-) strand; PAM type: YTN; PAM sequence: TTA
cagtcattggtgcctacagc

SEQ ID NO: 164328 - DNA, 20 bp, Artificial Sequence
  Description of Artificial Sequence: Synthetic oligonucleotide
  Target: ATXN1; (-) strand; PAM type: YTN; PAM sequence: TTA
gattacagtcattggtgcct

SEQ ID NO: 164329 - DNA, 20 bp, Artificial Sequence
  Description of Artificial Sequence: Synthetic oligonucleotide
  Target: ATXN1; (-) strand; PAM type: YTN; PAM sequence: TTT
agattacagtcattggtgcc

SEQ ID NO: 164330 - DNA, 20 bp, Artificial Sequence
  Description of Artificial Sequence: Synthetic oligonucleotide
  Target: ATXN1; (-) strand; PAM type: YTN; PAM sequence: CTG
tttagattacagtcattggt

SEQ ID NO: 164331 - DNA, 20 bp, Artificial Sequence
  Description of Artificial Sequence: Synthetic oligonucleotide
  Target: ATXN1; (-) strand; PAM type: YTN; PAM sequence: TTG
cctgtttagattacagtcat

SEQ ID NO: 164332 - DNA, 20 bp, Artificial Sequence
  Description of Artificial Sequence: Synthetic oligonucleotide
  Target: ATXN1; (-) strand; PAM type: YTN; PAM sequence: TTA
ttgcctgtttagattacagt

SEQ ID NO: 164333 - DNA, 20 bp, Artificial Sequence
  Description of Artificial Sequence: Synthetic oligonucleotide
  Target: ATXN1; (-) strand; PAM type: YTN; PAM sequence: TTT
attgcctgtttagattacag

SEQ ID NO: 164334 - DNA, 20 bp, Artificial Sequence
  Description of Artificial Sequence: Synthetic oligonucleotide
  Target: ATXN1; (-) strand; PAM type: YTN; PAM sequence: TTT
tattgcctgtttagattaca

SEQ ID NO: 164335 - DNA, 20 bp, Artificial Sequence
  Description of Artificial Sequence: Synthetic oligonucleotide
  Target: ATXN1; (-) strand; PAM type: YTN; PAM sequence: TTA
aatattttattgcctgttta

SEQ ID NO: 164336 - DNA, 20 bp, Artificial Sequence
  Description of Artificial Sequence: Synthetic oligonucleotide
  Target: ATXN1; (-) strand; PAM type: YTN; PAM sequence: TTG
tccattaaatattttattgc

SEQ ID NO: 164337 - DNA, 20 bp, Artificial Sequence
  Description of Artificial Sequence: Synthetic oligonucleotide
  Target: ATXN1; (-) strand; PAM type: YTN; PAM sequence: CTT
gtccattaaatattttattg

SEQ ID NO: 164338 - DNA, 20 bp, Artificial Sequence
  Description of Artificial Sequence: Synthetic oligonucleotide
  Target: ATXN1; (-) strand; PAM type: YTN; PAM sequence: TTC
cgcttgtccattaaatattt

SEQ ID NO: 164339 - DNA, 20 bp, Artificial Sequence
  Description of Artificial Sequence: Synthetic oligonucleotide
  Target: ATXN1; (-) strand; PAM type: YTN; PAM sequence: TTT
ccgcttgtccattaaatatt

SEQ ID NO: 164340 - DNA, 20 bp, Artificial Sequence
  Description of Artificial Sequence: Synthetic oligonucleotide
  Target: ATXN1; (-) strand; PAM type: YTN; PAM sequence: TTG
catttccgcttgtccattaa

SEQ ID NO: 164341 - DNA, 20 bp, Artificial Sequence
  Description of Artificial Sequence: Synthetic oligonucleotide
  Target: ATXN1; (-) strand; PAM type: YTN; PAM sequence: TTT
gcatttccgcttgtccatta

SEQ ID NO: 164342 - DNA, 20 bp, Artificial Sequence
  Description of Artificial Sequence: Synthetic oligonucleotide
  Target: ATXN1; (-) strand; PAM type: YTN; PAM sequence: TTT
tgcatttccgcttgtccatt

SEQ ID NO: 164343 - DNA, 20 bp, Artificial Sequence
  Description of Artificial Sequence: Synthetic oligonucleotide
  Target: ATXN1; (-) strand; PAM type: YTN; PAM sequence: TTT
ttgcatttccgcttgtccat

SEQ ID NO: 164344 - DNA, 20 bp, Artificial Sequence
  Description of Artificial Sequence: Synthetic oligonucleotide
  Target: ATXN1; (-) strand; PAM type: YTN; PAM sequence: TTT
tttgcatttccgcttgtcca

SEQ ID NO: 164345 - DNA, 20 bp, Artificial Sequence
  Description of Artificial Sequence: Synthetic oligonucleotide
  Target: ATXN1; (-) strand; PAM type: YTN; PAM sequence: TTT
ttttgcatttccgcttgtcc

SEQ ID NO: 164346 - DNA, 20 bp, Artificial Sequence
  Description of Artificial Sequence: Synthetic oligonucleotide
  Target: ATXN1; (-) strand; PAM type: YTN; PAM sequence: CTT
tttttgcatttccgcttgtc

SEQ ID NO: 164347 - DNA, 20 bp, Artificial Sequence
  Description of Artificial Sequence: Synthetic oligonucleotide
  Target: ATXN1; (-) strand; PAM type: YTN; PAM sequence: TTA
ctttttttgcatttccgctt

SEQ ID NO: 164348 - DNA, 20 bp, Artificial Sequence
  Description of Artificial Sequence: Synthetic oligonucleotide
  Target: ATXN1; (-) strand; PAM type: YTN; PAM sequence: CTT
actttttttgcatttccgct

SEQ ID NO: 164349 - DNA, 20 bp, Artificial Sequence
  Description of Artificial Sequence: Synthetic oligonucleotide
  Target: ATXN1; (-) strand; PAM type: YTN; PAM sequence: CTG
ccttactttttttgcatttc

SEQ ID NO: 164350 - DNA, 20 bp, Artificial Sequence
  Description of Artificial Sequence: Synthetic oligonucleotide
  Target: ATXN1; (-) strand; PAM type: YTN; PAM sequence: TTG
taaacaggagactgccttac

SEQ ID NO: 164351 - DNA, 20 bp, Artificial Sequence
  Description of Artificial Sequence: Synthetic oligonucleotide
  Target: ATXN1; (-) strand; PAM type: YTN; PAM sequence: TTG
ttgtaaacaggagactgcct

SEQ ID NO: 164352 - DNA, 20 bp, Artificial Sequence
  Description of Artificial Sequence: Synthetic oligonucleotide
  Target: ATXN1; (-) strand; PAM type: YTN; PAM sequence: TTT
gttgtaaacaggagactgcc

SEQ ID NO: 164353 - DNA, 20 bp, Artificial Sequence
  Description of Artificial Sequence: Synthetic oligonucleotide
  Target: ATXN1; (-) strand; PAM type: YTN; PAM sequence: CTT
tgttgtaaacaggagactgc

SEQ ID NO: 164354 - DNA, 20 bp, Artificial Sequence
  Description of Artificial Sequence: Synthetic oligonucleotide
  Target: ATXN1; (-) strand; PAM type: YTN; PAM sequence: CTA
gtatagaaaatgagctttgt

SEQ ID NO: 164355 - DNA, 20 bp, Artificial Sequence
  Description of Artificial Sequence: Synthetic oligonucleotide
  Target: ATXN1; (-) strand; PAM type: YTN; PAM sequence: TTC
cacgtccacagtgctagtat

SEQ ID NO: 164356 - DNA, 20 bp, Artificial Sequence
  Description of Artificial Sequence: Synthetic oligonucleotide
  Target: ATXN1; (-) strand; PAM type: YTN; PAM sequence: CTT
ccacgtccacagtgctagta

SEQ ID NO: 164357 - DNA, 20 bp, Artificial Sequence
  Description of Artificial Sequence: Synthetic oligonucleotide
  Target: ATXN1; (-) strand; PAM type: YTN; PAM sequence: CTG
catcttccacgtccacagtg

SEQ ID NO: 164358 - DNA, 20 bp, Artificial Sequence
  Description of Artificial Sequence: Synthetic oligonucleotide
  Target: ATXN1; (-) strand; PAM type: YTN; PAM sequence: TTA
actgcatcttccacgtccac

SEQ ID NO: 164359 - DNA, 20 bp, Artificial Sequence
  Description of Artificial Sequence: Synthetic oligonucleotide
  Target: ATXN1; (-) strand; PAM type: YTN; PAM sequence: TTA
cagaggttaactgcatcttc

SEQ ID NO: 164360 - DNA, 20 bp, Artificial Sequence
  Description of Artificial Sequence: Synthetic oligonucleotide
  Target: ATXN1; (-) strand; PAM type: YTN; PAM sequence: CTT
acagaggttaactgcatctt

SEQ ID NO: 164361 - DNA, 20 bp, Artificial Sequence
  Description of Artificial Sequence: Synthetic oligonucleotide
  Target: ATXN1; (-) strand; PAM type: YTN; PAM sequence: CTG
aggcttacagaggttaactg

SEQ ID NO: 164362 - DNA, 20 bp, Artificial Sequence
  Description of Artificial Sequence: Synthetic oligonucleotide
  Target: ATXN1; (-) strand; PAM type: YTN; PAM sequence: TTC
cagatgaggaaactgaggct

SEQ ID NO: 164363 - DNA, 20 bp, Artificial Sequence
  Description of Artificial Sequence: Synthetic oligonucleotide
  Target: ATXN1; (-) strand; PAM type: YTN; PAM sequence: TTC
acatattccagatgaggaaa

SEQ ID NO: 164364 - DNA, 20 bp, Artificial Sequence
  Description of Artificial Sequence: Synthetic oligonucleotide
  Target: ATXN1; (-) strand; PAM type: YTN; PAM sequence: TTA
tcatcattcacatattccag

SEQ ID NO: 164365 - DNA, 20 bp, Artificial Sequence
  Description of Artificial Sequence: Synthetic oligonucleotide
  Target: ATXN1; (-) strand; PAM type: YTN; PAM sequence: TTG
aaaacgtattatcatcattc

SEQ ID NO: 164366 - DNA, 20 bp, Artificial Sequence
  Description of Artificial Sequence: Synthetic oligonucleotide
  Target: ATXN1; (-) strand; PAM type: YTN; PAM sequence: TTT
gaaaacgtattatcatcatt

SEQ ID NO: 164367 - DNA, 20 bp, Artificial Sequence
  Description of Artificial Sequence: Synthetic oligonucleotide
  Target: ATXN1; (-) strand; PAM type: YTN; PAM sequence: TTT
tgaaaacgtattatcatcat

SEQ ID NO: 164368 - DNA, 20 bp, Artificial Sequence
  Description of Artificial Sequence: Synthetic oligonucleotide
  Target: ATXN1; (-) strand; PAM type: YTN; PAM sequence: CTT
ttgaaaacgtattatcatca

SEQ ID NO: 164369 - DNA, 20 bp, Artificial Sequence
  Description of Artificial Sequence: Synthetic oligonucleotide
  Target: ATXN1; (-) strand; PAM type: YTN; PAM sequence: CTC
aacaatcttttgaaaacgta

SEQ ID NO: 164370 - DNA, 20 bp, Artificial Sequence
  Description of Artificial Sequence: Synthetic oligonucleotide
  Target: ATXN1; (-) strand; PAM type: YTN; PAM sequence: TTC
atctcaacaatcttttgaaa

SEQ ID NO: 164371 - DNA, 20 bp, Artificial Sequence
  Description of Artificial Sequence: Synthetic oligonucleotide
  Target: ATXN1; (-) strand; PAM type: YTN; PAM sequence: TTT
catctcaacaatcttttgaa

SEQ ID NO: 164372 - DNA, 20 bp, Artificial Sequence
  Description of Artificial Sequence: Synthetic oligonucleotide
  Target: ATXN1; (-) strand; PAM type: YTN; PAM sequence: TTA
tttcatctcaacaatctttt

SEQ ID NO: 164373 - DNA, 20 bp, Artificial Sequence
  Description of Artificial Sequence: Synthetic oligonucleotide
  Target: ATXN1; (-) strand; PAM type: YTN; PAM sequence: TTT
atttcatctcaacaatcttt

SEQ ID NO: 164374 - DNA, 20 bp, Artificial Sequence
  Description of Artificial Sequence: Synthetic oligonucleotide
  Target: ATXN1; (-) strand; PAM type: YTN; PAM sequence: TTT
tatttcatctcaacaatctt

SEQ ID NO: 164375 - DNA, 20 bp, Artificial Sequence
  Description of Artificial Sequence: Synthetic oligonucleotide
  Target: ATXN1; (-) strand; PAM type: YTN; PAM sequence: CTT
ttatttcatctcaacaatct

SEQ ID NO: 164376 - DNA, 20 bp, Artificial Sequence
  Description of Artificial Sequence: Synthetic oligonucleotide
  Target: ATXN1; (-) strand; PAM type: YTN; PAM sequence: TTG
cttttatttcatctcaacaa

SEQ ID NO: 164377 - DNA, 20 bp, Artificial Sequence
  Description of Artificial Sequence: Synthetic oligonucleotide
  Target: ATXN1; (-) strand; PAM type: YTN; PAM sequence: TTA
tagttgcttttatttcatct

SEQ ID NO: 164378 - DNA, 20 bp, Artificial Sequence
  Description of Artificial Sequence: Synthetic oligonucleotide
  Target: ATXN1; (-) strand; PAM type: YTN; PAM sequence: CTA
ggcattatagttgcttttat

SEQ ID NO: 164379 - DNA, 20 bp, Artificial Sequence
  Description of Artificial Sequence: Synthetic oligonucleotide
  Target: ATXN1; (-) strand; PAM type: YTN; PAM sequence: TTA
tgctaggcattatagttgct

SEQ ID NO: 164380 - DNA, 20 bp, Artificial Sequence
  Description of Artificial Sequence: Synthetic oligonucleotide
  Target: ATXN1; (-) strand; PAM type: YTN; PAM sequence: CTT
atgctaggcattatagttgc

SEQ ID NO: 164381 - DNA, 20 bp, Artificial Sequence
  Description of Artificial Sequence: Synthetic oligonucleotide
  Target: ATXN1; (-) strand; PAM type: YTN; PAM sequence: TTC
ttatgctaggcattatagtt

SEQ ID NO: 164382 - DNA, 20 bp, Artificial Sequence
  Description of Artificial Sequence: Synthetic oligonucleotide
  Target: ATXN1; (-) strand; PAM type: YTN; PAM sequence: TTT
cttatgctaggcattatagt

SEQ ID NO: 164383 - DNA, 20 bp, Artificial Sequence
  Description of Artificial Sequence: Synthetic oligonucleotide
  Target: ATXN1; (-) strand; PAM type: YTN; PAM sequence: TTT
tcttatgctaggcattatag

SEQ ID NO: 164384 - DNA, 20 bp, Artificial Sequence
  Description of Artificial Sequence: Synthetic oligonucleotide
  Target: ATXN1; (-) strand; PAM type: YTN; PAM sequence: TTT
ttcttatgctaggcattata

SEQ ID NO: 164385 - DNA, 20 bp, Artificial Sequence
  Description of Artificial Sequence: Synthetic oligonucleotide
  Target: ATXN1; (-) strand; PAM type: YTN; PAM sequence: TTT
tttcttatgctaggcattat

SEQ ID NO: 164386 - DNA, 20 bp, Artificial Sequence
  Description of Artificial Sequence: Synthetic oligonucleotide
  Target: ATXN1; (-) strand; PAM type: YTN; PAM sequence: TTT
ttttcttatgctaggcatta

SEQ ID NO: 164387 - DNA, 20 bp, Artificial Sequence
  Description of Artificial Sequence: Synthetic oligonucleotide
  Target: ATXN1; (-) strand; PAM type: YTN; PAM sequence: TTT
tttttcttatgctaggcatt

SEQ ID NO: 164388 - DNA, 20 bp, Artificial Sequence
  Description of Artificial Sequence: Synthetic oligonucleotide
  Target: ATXN1; (-) strand; PAM type: YTN; PAM sequence: CTG
gattttttttcttatgctag

SEQ ID NO: 164389 - DNA, 20 bp, Artificial Sequence
  Description of Artificial Sequence: Synthetic oligonucleotide
  Target: ATXN1; (-) strand; PAM type: YTN; PAM sequence: TTC
aggaagaagaacacacctgg

SEQ ID NO: 164390 - DNA, 20 bp, Artificial Sequence
  Description of Artificial Sequence: Synthetic oligonucleotide
  Target: ATXN1; (-) strand; PAM type: YTN; PAM sequence: CTG
aagttcaggaagaagaacac

SEQ ID NO: 164391 - DNA, 20 bp, Artificial Sequence
  Description of Artificial Sequence: Synthetic oligonucleotide
  Target: ATXN1; (-) strand; PAM type: YTN; PAM sequence: CTG
agactgaagttcaggaagaa

SEQ ID NO: 164392 - DNA, 20 bp, Artificial Sequence
  Description of Artificial Sequence: Synthetic oligonucleotide
  Target: ATXN1; (-) strand; PAM type: YTN; PAM sequence: TTG
agctgagactgaagttcagg

SEQ ID NO: 164393 - DNA, 20 bp, Artificial Sequence
  Description of Artificial Sequence: Synthetic oligonucleotide
  Target: ATXN1; (-) strand; PAM type: YTN; PAM sequence: CTT
gagctgagactgaagttcag

SEQ ID NO: 164394 - DNA, 20 bp, Artificial Sequence
  Description of Artificial Sequence: Synthetic oligonucleotide
  Target: ATXN1; (-) strand; PAM type: YTN; PAM sequence: CTC
ttgagctgagactgaagttc

SEQ ID NO: 164395 - DNA, 20 bp, Artificial Sequence
  Description of Artificial Sequence: Synthetic oligonucleotide
  Target: ATXN1; (-) strand; PAM type: YTN; PAM sequence: CTC
acagactcttgagctgagac

SEQ ID NO: 164396 - DNA, 20 bp, Artificial Sequence
  Description of Artificial Sequence: Synthetic oligonucleotide
  Target: ATXN1; (-) strand; PAM type: YTN; PAM sequence: TTC
ctcacagactcttgagctga

SEQ ID NO: 164397 - DNA, 20 bp, Artificial Sequence
  Description of Artificial Sequence: Synthetic oligonucleotide
  Target: ATXN1; (-) strand; PAM type: YTN; PAM sequence: TTG
agaggggtggtaagcatcca

SEQ ID NO: 164398 - DNA, 20 bp, Artificial Sequence
  Description of Artificial Sequence: Synthetic oligonucleotide
  Target: ATXN1; (-) strand; PAM type: YTN; PAM sequence: TTT
gagaggggtggtaagcatcc

SEQ ID NO: 164399 - DNA, 20 bp, Artificial Sequence
  Description of Artificial Sequence: Synthetic oligonucleotide
  Target: ATXN1; (-) strand; PAM type: YTN; PAM sequence: CTG
atttgagaggggtggtaagc

SEQ ID NO: 164400 - DNA, 20 bp, Artificial Sequence
  Description of Artificial Sequence: Synthetic oligonucleotide
  Target: ATXN1; (-) strand; PAM type: YTN; PAM sequence: TTA
gcagaaatatggaaccggag

SEQ ID NO: 164401 - DNA, 20 bp, Artificial Sequence
  Description of Artificial Sequence: Synthetic oligonucleotide
  Target: ATXN1; (-) strand; PAM type: YTN; PAM sequence: TTG
gagaaatggtgcaaaaccgt

SEQ ID NO: 164402 - DNA, 20 bp, Artificial Sequence
  Description of Artificial Sequence: Synthetic oligonucleotide
  Target: ATXN1; (-) strand; PAM type: YTN; PAM sequence: CTT
ggagaaatggtgcaaaaccg

SEQ ID NO: 164403 - DNA, 20 bp, Artificial Sequence
  Description of Artificial Sequence: Synthetic oligonucleotide
  Target: ATXN1; (-) strand; PAM type: YTN; PAM sequence: CTA
tgcttggagaaatggtgcaa

SEQ ID NO: 164404 - DNA, 20 bp, Artificial Sequence
  Description of Artificial Sequence: Synthetic oligonucleotide
  Target: ATXN1; (-) strand; PAM type: YTN; PAM sequence: CTG
gcctatgcttggagaaatgg

SEQ ID NO: 164405 - DNA, 20 bp, Artificial Sequence
  Description of Artificial Sequence: Synthetic oligonucleotide
  Target: ATXN1; (-) strand; PAM type: YTN; PAM sequence: CTC
tggcctatgcttggagaaat

SEQ ID NO: 164406 - DNA, 20 bp, Artificial Sequence
  Description of Artificial Sequence: Synthetic oligonucleotide
  Target: ATXN1; (-) strand; PAM type: YTN; PAM sequence: CTG
gatataggagtgaagtgcga

SEQ ID NO: 164407 - DNA, 20 bp, Artificial Sequence
  Description of Artificial Sequence: Synthetic oligonucleotide
  Target: ATXN1; (-) strand; PAM type: YTN; PAM sequence: TTA
ggggagtcgctggatatagg

SEQ ID NO: 164408 - DNA, 20 bp, Artificial Sequence
  Description of Artificial Sequence: Synthetic oligonucleotide
  Target: ATXN1; (-) strand; PAM type: YTN; PAM sequence: CTG
acacaattaggggagtcgct

SEQ ID NO: 164409 - DNA, 20 bp, Artificial Sequence
  Description of Artificial Sequence: Synthetic oligonucleotide
  Target: ATXN1; (-) strand; PAM type: YTN; PAM sequence: TTG
aagaaagactgacacaatta

SEQ ID NO: 164410 - DNA, 20 bp, Artificial Sequence
  Description of Artificial Sequence: Synthetic oligonucleotide
  Target: ATXN1; (-) strand; PAM type: YTN; PAM sequence: TTT
gaagaaagactgacacaatt

SEQ ID NO: 164411 - DNA, 20 bp, Artificial Sequence
  Description of Artificial Sequence: Synthetic oligonucleotide
  Target: ATXN1; (-) strand; PAM type: YTN; PAM sequence: TTT
tgaagaaagactgacacaat

SEQ ID NO: 164412 - DNA, 20 bp, Artificial Sequence
  Description of Artificial Sequence: Synthetic oligonucleotide
  Target: ATXN1; (-) strand; PAM type: YTN; PAM sequence: TTG
agacattttgaagaaagact

SEQ ID NO: 164413 - DNA, 20 bp, Artificial Sequence
  Description of Artificial Sequence: Synthetic oligonucleotide
  Target: ATXN1; (-) strand; PAM type: YTN; PAM sequence: TTC
accccaagagttgagacatt

SEQ ID NO: 164414 - DNA, 20 bp, Artificial Sequence
  Description of Artificial Sequence: Synthetic oligonucleotide
  Target: ATXN1; (-) strand; PAM type: YTN; PAM sequence: CTT
caccccaagagttgagacat

SEQ ID NO: 164415 - DNA, 20 bp, Artificial Sequence
  Description of Artificial Sequence: Synthetic oligonucleotide
  Target: ATXN1; (-) strand; PAM type: YTN; PAM sequence: TTC
aagcttcaccccaagagttg

SEQ ID NO: 164416 - DNA, 20 bp, Artificial Sequence
  Description of Artificial Sequence: Synthetic oligonucleotide
  Target: ATXN1; (-) strand; PAM type: YTN; PAM sequence: CTT
caagcttcaccccaagagtt

SEQ ID NO: 164417 - DNA, 20 bp, Artificial Sequence
  Description of Artificial Sequence: Synthetic oligonucleotide
  Target: ATXN1; (-) strand; PAM type: YTN; PAM sequence: CTA
cacagtaaatatgggaaaaa

SEQ ID NO: 164418 - DNA, 20 bp, Artificial Sequence
  Description of Artificial Sequence: Synthetic oligonucleotide
  Target: ATXN1; (-) strand; PAM type: YTN; PAM sequence: TTC
ctacacagtaaatatgggaa

SEQ ID NO: 164419 - DNA, 20 bp, Artificial Sequence
  Description of Artificial Sequence: Synthetic oligonucleotide
  Target: ATXN1; (-) strand; PAM type: YTN; PAM sequence: TTT
cctacacagtaaatatggga

SEQ ID NO: 164420 - DNA, 20 bp, Artificial Sequence
  Description of Artificial Sequence: Synthetic oligonucleotide
  Target: ATXN1; (-) strand; PAM type: YTN; PAM sequence: CTT
tcctacacagtaaatatggg

SEQ ID NO: 164421 - DNA, 20 bp, Artificial Sequence
  Description of Artificial Sequence: Synthetic oligonucleotide
  Target: ATXN1; (-) strand; PAM type: YTN; PAM sequence: TTC
tttcctacacagtaaatatg

SEQ ID NO: 164422 - DNA, 20 bp, Artificial Sequence
  Description of Artificial Sequence: Synthetic oligonucleotide
  Target: ATXN1; (-) strand; PAM type: YTN; PAM sequence: TTG
gccaaagccaaattctttcc

SEQ ID NO: 164423 - DNA, 20 bp, Artificial Sequence
  Description of Artificial Sequence: Synthetic oligonucleotide
  Target: ATXN1; (-) strand; PAM type: YTN; PAM sequence: TTT
ggccaaagccaaattctttc

SEQ ID NO: 164424 - DNA, 20 bp, Artificial Sequence
  Description of Artificial Sequence: Synthetic oligonucleotide
  Target: ATXN1; (-) strand; PAM type: YTN; PAM sequence: CTT
tggccaaagccaaattcttt

SEQ ID NO: 164425 - DNA, 20 bp, Artificial Sequence
  Description of Artificial Sequence: Synthetic oligonucleotide
  Target: ATXN1; (-) strand; PAM type: YTN; PAM sequence: TTC
ccaggagccaagggcaaagg

SEQ ID NO: 164426 - DNA, 20 bp, Artificial Sequence
  Description of Artificial Sequence: Synthetic oligonucleotide
  Target: ATXN1; (-) strand; PAM type: YTN; PAM sequence: TTT
cccaggagccaagggcaaag

SEQ ID NO: 164427 - DNA, 20 bp, Artificial Sequence
  Description of Artificial Sequence: Synthetic oligonucleotide
  Target: ATXN1; (-) strand; PAM type: YTN; PAM sequence: CTA
tcagatatcacatagatcat

SEQ ID NO: 164428 - DNA, 20 bp, Artificial Sequence
  Description of Artificial Sequence: Synthetic oligonucleotide
  Target: ATXN1; (-) strand; PAM type: YTN; PAM sequence: CTC
cccacaaatagggacaccac

SEQ ID NO: 164429 - DNA, 20 bp, Artificial Sequence
  Description of Artificial Sequence: Synthetic oligonucleotide
  Target: ATXN1; (-) strand; PAM type: YTN; PAM sequence: TTC
cctccccacaaatagggaca

SEQ ID NO: 164430 - DNA, 20 bp, Artificial Sequence
  Description of Artificial Sequence: Synthetic oligonucleotide
  Target: ATXN1; (-) strand; PAM type: YTN; PAM sequence: CTT
ccctccccacaaatagggac

SEQ ID NO: 164431 - DNA, 20 bp, Artificial Sequence
  Description of Artificial Sequence: Synthetic oligonucleotide
  Target: ATXN1; (-) strand; PAM type: YTN; PAM sequence: CTG
aaaatccttccctccccaca

SEQ ID NO: 164432 - DNA, 20 bp, Artificial Sequence
  Description of Artificial Sequence: Synthetic oligonucleotide
  Target: ATXN1; (-) strand; PAM type: YTN; PAM sequence: CTG
tgactgaaaatccttccctc

SEQ ID NO: 164433 - DNA, 20 bp, Artificial Sequence
  Description of Artificial Sequence: Synthetic oligonucleotide
  Target: ATXN1; (-) strand; PAM type: YTN; PAM sequence: TTG
ctgtgactgaaaatccttcc

SEQ ID NO: 164434 - DNA, 20 bp, Artificial Sequence
  Description of Artificial Sequence: Synthetic oligonucleotide
  Target: ATXN1; (-) strand; PAM type: YTN; PAM sequence: TTT
gctgtgactgaaaatccttc

SEQ ID NO: 164435 - DNA, 20 bp, Artificial Sequence
  Description of Artificial Sequence: Synthetic oligonucleotide
  Target: ATXN1; (-) strand; PAM type: YTN; PAM sequence: TTC
ggtgatttgctgtgactgaa

SEQ ID NO: 164436 - DNA, 20 bp, Artificial Sequence
  Description of Artificial Sequence: Synthetic oligonucleotide
  Target: ATXN1; (-) strand; PAM type: YTN; PAM sequence: TTG
ggttcggtgatttgctgtga

SEQ ID NO: 164437 - DNA, 20 bp, Artificial Sequence
  Description of Artificial Sequence: Synthetic oligonucleotide
  Target: ATXN1; (-) strand; PAM type: YTN; PAM sequence: CTT
gggttcggtgatttgctgtg

SEQ ID NO: 164438 - DNA, 20 bp, Artificial Sequence
  Description of Artificial Sequence: Synthetic oligonucleotide
  Target: ATXN1; (-) strand; PAM type: YTN; PAM sequence: TTA
aaatgaggaaaccaaggctt

SEQ ID NO: 164439 - DNA, 20 bp, Artificial Sequence
  Description of Artificial Sequence: Synthetic oligonucleotide
  Target: ATXN1; (-) strand; PAM type: YTN; PAM sequence: TTT
aaaatgaggaaaccaaggct

SEQ ID NO: 164440 - DNA, 20 bp, Artificial Sequence
  Description of Artificial Sequence: Synthetic oligonucleotide
  Target: ATXN1; (-) strand; PAM type: YTN; PAM sequence: TTT
taaaatgaggaaaccaaggc

SEQ ID NO: 164441 - DNA, 20 bp, Artificial Sequence
  Description of Artificial Sequence: Synthetic oligonucleotide
  Target: ATXN1; (-) strand; PAM type: YTN; PAM sequence: TTC
ccattttaaaatgaggaaac

SEQ ID NO: 164442 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccaccacacc

SEQ ID NO: 164443 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgtgagccac

SEQ ID NO: 164444 - DNA, 20 bp, Artificial Sequence
  Description of Artificial Sequence: Synthetic oligonucleotide
  Target: ATXN1; (-) strand; PAM type: YTN; PAM sequence: CTG
aagtgctgggattacaggtg

SEQ ID NO: 164445 - DNA, 20 bp, Artificial Sequence
  Description of Artificial Sequence: Synthetic oligonucleotide
  Target: ATXN1; (-) strand; PAM type: YTN; PAM sequence: CTC
ctgaagtgctgggattacag

SEQ ID NO: 164446 - DNA, 20 bp, Artificial Sequence
  Description of Artificial Sequence: Synthetic oligonucleotide
  Target: ATXN1; (-) strand; PAM type: YTN; PAM sequence: CTC
ggcctcctgaagtgctggga

SEQ ID NO: 164447 - DNA, 20 bp, Artificial Sequence
  Description of Artificial Sequence: Synthetic oligonucleotide
  Target: ATXN1; (-) strand; PAM type: YTN; PAM sequence: CTG
cctcggcctcctgaagtgct

SEQ ID NO: 164448 - DNA, 20 bp, Artificial Sequence
  Description of Artificial Sequence: Synthetic oligonucleotide
  Target: ATXN1; (-) strand; PAM type: YTN; PAM sequence: CTC
ctgcctcggcctcctgaagt

SEQ ID NO: 164449 - DNA, 20 bp, Artificial Sequence
  Description of Artificial Sequence: Synthetic oligonucleotide
  Target: ATXN1; (-) strand; PAM type: YTN; PAM sequence: CTC
acatagtcctcctgcctcgg

SEQ ID NO: 164450 - DNA, 20 bp, Artificial Sequence
  Description of Artificial Sequence: Synthetic oligonucleotide
  Target: ATXN1; (-) strand; PAM type: YTN; PAM sequence: CTG
gcctcacatagtcctcctgc

SEQ ID NO: 164451 - DNA, 20 bp, Artificial Sequence
  Description of Artificial Sequence: Synthetic oligonucleotide
  Target: ATXN1; (-) strand; PAM type: YTN; PAM sequence: TTC
ctggcctcacatagtcctcc

SEQ ID NO: 164452 - DNA, 20 bp, Artificial Sequence
  Description of Artificial Sequence: Synthetic oligonucleotide
  Target: ATXN1; (-) strand; PAM type: YTN; PAM sequence: CTC
gaattcctggcctcacatag

SEQ ID NO: 164453 - DNA, 20 bp, Artificial Sequence
  Description of Artificial Sequence: Synthetic oligonucleotide
  Target: ATXN1; (-) strand; PAM type: YTN; PAM sequence: CTG
gtctcgaattcctggcctca

SEQ ID NO: 164454 - DNA, 20 bp, Artificial Sequence
  Description of Artificial Sequence: Synthetic oligonucleotide
  Target: ATXN1; (-) strand; PAM type: YTN; PAM sequence: TTA
cccaggctggtctcgaattc

SEQ ID NO: 164455 - DNA, 20 bp, Artificial Sequence
  Description of Artificial Sequence: Synthetic oligonucleotide
  Target: ATXN1; (-) strand; PAM type: YTN; PAM sequence: TTG
ttacccaggctggtctcgaa

SEQ ID NO: 164456 - DNA, 20 bp, Artificial Sequence
  Description of Artificial Sequence: Synthetic oligonucleotide
  Target: ATXN1; (-) strand; PAM type: YTN; PAM sequence: TTT
gttacccaggctggtctcga

SEQ ID NO: 164457 - DNA, 20 bp, Artificial Sequence
  Description of Artificial Sequence: Synthetic oligonucleotide
  Target: ATXN1; (-) strand; PAM type: YTN; PAM sequence: CTT
tgttacccaggctggtctcg

SEQ ID NO: 164458 - DNA, 20 bp, Artificial Sequence
  Description of Artificial Sequence: Synthetic oligonucleotide
  Target: ATXN1; (-) strand; PAM type: YTN; PAM sequence: CTC
actttgttacccaggctggt

SEQ ID NO: 164459 - DNA, 20 bp, Artificial Sequence
  Description of Artificial Sequence: Synthetic oligonucleotide
  Target: ATXN1; (-) strand; PAM type: YTN; PAM sequence: TTG
tagagacaggcctcactttg

SEQ ID NO: 164460 - DNA, 20 bp, Artificial Sequence
  Description of Artificial Sequence: Synthetic oligonucleotide
  Target: ATXN1; (-) strand; PAM type: YTN; PAM sequence: TTT
gtagagacaggcctcacttt

SEQ ID NO: 164461 - DNA, 20 bp, Artificial Sequence
  Description of Artificial Sequence: Synthetic oligonucleotide
  Target: ATXN1; (-) strand; PAM type: YTN; PAM sequence: TTT
tgtagagacaggcctcactt

SEQ ID NO: 164462 - DNA, 20 bp, Artificial Sequence
  Description of Artificial Sequence: Synthetic oligonucleotide
  Target: ATXN1; (-) strand; PAM type: YTN; PAM sequence: TTA
ttttgtagagacaggcctca

SEQ ID NO: 164463 - DNA, 20 bp, Artificial Sequence
  Description of Artificial Sequence: Synthetic oligonucleotide
  Target: ATXN1; (-) strand; PAM type: YTN; PAM sequence: TTA
ttattttgtagagacaggcc

SEQ ID NO: 164464 - DNA, 20 bp, Artificial Sequence
  Description of Artificial Sequence: Synthetic oligonucleotide
  Target: ATXN1; (-) strand; PAM type: YTN; PAM sequence: TTT
attattttgtagagacaggc

SEQ ID NO: 164465 - DNA, 20 bp, Artificial Sequence
  Description of Artificial Sequence: Synthetic oligonucleotide
  Target: ATXN1; (-) strand; PAM type: YTN; PAM sequence: TTT
tattattttgtagagacagg

SEQ ID NO: 164466 - DNA, 20 bp, Artificial Sequence
  Description of Artificial Sequence: Synthetic oligonucleotide
  Target: ATXN1; (-) strand; PAM type: YTN; PAM sequence: TTT
ttattattttgtagagacag

SEQ ID NO: 164467 - DNA, 20 bp, Artificial Sequence
  Description of Artificial Sequence: Synthetic oligonucleotide
  Target: ATXN1; (-) strand; PAM type: YTN; PAM sequence: TTT
tttattattttgtagagaca

SEQ ID NO: 164468 - DNA, 20 bp, Artificial Sequence
  Description of Artificial Sequence: Synthetic oligonucleotide
  Target: ATXN1; (-) strand; PAM type: YTN; PAM sequence: TTT
ttttattattttgtagagac

SEQ ID NO: 164469 - DNA, 20 bp, Artificial Sequence
  Description of Artificial Sequence: Synthetic oligonucleotide
  Target: ATXN1; (-) strand; PAM type: YTN; PAM sequence: CTA
aatttttttattattttgta

SEQ ID NO: 164470 - DNA, 20 bp, Artificial Sequence
  Description of Artificial Sequence: Synthetic oligonucleotide
  Target: ATXN1; (-) strand; PAM type: YTN; PAM sequence: CTG
cctaaatttttttattattt

SEQ ID NO: 164471 - DNA, 20 bp, Artificial Sequence
  Description of Artificial Sequence: Synthetic oligonucleotide
  Target: ATXN1; (-) strand; PAM type: YTN; PAM sequence: CTG
caagcatgcaccaccacacc

SEQ ID NO: 164472 - DNA, 20 bp, Artificial Sequence
  Description of Artificial Sequence: Synthetic oligonucleotide
  Target: ATXN1; (-) strand; PAM type: YTN; PAM sequence: CTG
ggactgcaagcatgcaccac

SEQ ID NO: 164473 - DNA, 20 bp, Artificial Sequence
  Description of Artificial Sequence: Synthetic oligonucleotide
  Target: ATXN1; (-) strand; PAM type: YTN; PAM sequence: TTG
ctgggactgcaagcatgcac

SEQ ID NO: 164474 - DNA, 20 bp, Artificial Sequence
  Description of Artificial Sequence: Synthetic oligonucleotide
  Target: ATXN1; (-) strand; PAM type: YTN; PAM sequence: CTC
ccaagttgctgggactgcaa

SEQ ID NO: 164475 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagttgctggga

SEQ ID NO: 164476 - DNA, 20 bp, Artificial Sequence
  Description of Artificial Sequence: Synthetic oligonucleotide
  Target: ATXN1; (-) strand; PAM type: YTN; PAM sequence: CTC
ccacctcagcctcccaagtt

SEQ ID NO: 164477 - DNA, 20 bp, Artificial Sequence
  Description of Artificial Sequence: Synthetic oligonucleotide
  Target: ATXN1; (-) strand; PAM type: YTN; PAM sequence: CTC
aagcaatcctcccacctcag

SEQ ID NO: 164478 - DNA, 20 bp, Artificial Sequence
  Description of Artificial Sequence: Synthetic oligonucleotide
  Target: ATXN1; (-) strand; PAM type: YTN; PAM sequence: CTA
ggctcaagcaatcctcccac

SEQ ID NO: 164479 - DNA, 20 bp, Artificial Sequence
  Description of Artificial Sequence: Synthetic oligonucleotide
  Target: ATXN1; (-) strand; PAM type: YTN; PAM sequence: CTC
ccaggctaggctcaagcaat

SEQ ID NO: 164480 - DNA, 20 bp, Artificial Sequence
  Description of Artificial Sequence: Synthetic oligonucleotide
  Target: ATXN1; (-) strand; PAM type: YTN; PAM sequence: TTG
atctcccaggctaggctcaa

SEQ ID NO: 164481 - DNA, 20 bp, Artificial Sequence
  Description of Artificial Sequence: Synthetic oligonucleotide
  Target: ATXN1; (-) strand; PAM type: YTN; PAM sequence: TTT
gatctcccaggctaggctca

SEQ ID NO: 164482 - DNA, 20 bp, Artificial Sequence
  Description of Artificial Sequence: Synthetic oligonucleotide
  Target: ATXN1; (-) strand; PAM type: YTN; PAM sequence: CTT
tgatctcccaggctaggctc

SEQ ID NO: 164483 - DNA, 20 bp, Artificial Sequence
  Description of Artificial Sequence: Synthetic oligonucleotide
  Target: ATXN1; (-) strand; PAM type: YTN; PAM sequence: CTC
aatgcagctttgatctccca

SEQ ID NO: 164484 - DNA, 20 bp, Artificial Sequence
  Description of Artificial Sequence: Synthetic oligonucleotide
  Target: ATXN1; (-) strand; PAM type: YTN; PAM sequence: CTC
agctcaatgcagctttgatc

SEQ ID NO: 164485 - DNA, 20 bp, Artificial Sequence
  Description of Artificial Sequence: Synthetic oligonucleotide
  Target: ATXN1; (-) strand; PAM type: YTN; PAM sequence: TTG
gagtgcagtgccgcgatctc

SEQ ID NO: 164486 - DNA, 20 bp, Artificial Sequence
  Description of Artificial Sequence: Synthetic oligonucleotide
  Target: ATXN1; (-) strand; PAM type: YTN; PAM sequence: CTC
ccaggttggagtgcagtgcc

SEQ ID NO: 164487 - DNA, 20 bp, Artificial Sequence
  Description of Artificial Sequence: Synthetic oligonucleotide
  Target: ATXN1; (-) strand; PAM type: YTN; PAM sequence: CTG
tctcccaggttggagtgcag

SEQ ID NO: 164488 - DNA, 20 bp, Artificial Sequence
  Description of Artificial Sequence: Synthetic oligonucleotide
  Target: ATXN1; (-) strand; PAM type: YTN; PAM sequence: TTC
tgtctcccaggttggagtgc

SEQ ID NO: 164489 - DNA, 20 bp, Artificial Sequence
  Description of Artificial Sequence: Synthetic oligonucleotide
  Target: ATXN1; (-) strand; PAM type: YTN; PAM sequence: TTG
ttctgtctcccaggttggag

SEQ ID NO: 164490 - DNA, 20 bp, Artificial Sequence
  Description of Artificial Sequence: Synthetic oligonucleotide
  Target: ATXN1; (-) strand; PAM type: YTN; PAM sequence: CTT
gttctgtctcccaggttgga

SEQ ID NO: 164491 - DNA, 20 bp, Artificial Sequence
  Description of Artificial Sequence: Synthetic oligonucleotide
  Target: ATXN1; (-) strand; PAM type: YTN; PAM sequence: TTG
agacagggtcttgttctgtc

SEQ ID NO: 164492 - DNA, 20 bp, Artificial Sequence
  Description of Artificial Sequence: Synthetic oligonucleotide
  Target: ATXN1; (-) strand; PAM type: YTN; PAM sequence: TTT
gagacagggtcttgttctgt

SEQ ID NO: 164493 - DNA, 20 bp, Artificial Sequence
  Description of Artificial Sequence: Synthetic oligonucleotide
  Target: ATXN1; (-) strand; PAM type: YTN; PAM sequence: TTT
tgagacagggtcttgttctg

SEQ ID NO: 164494 - DNA, 20 bp, Artificial Sequence
  Description of Artificial Sequence: Synthetic oligonucleotide
  Target: ATXN1; (-) strand; PAM type: YTN; PAM sequence: TTT
ttgagacagggtcttgttct

SEQ ID NO: 164495 - DNA, 20 bp, Artificial Sequence
  Description of Artificial Sequence: Synthetic oligonucleotide
  Target: ATXN1; (-) strand; PAM type: YTN; PAM sequence: TTT
tttgagacagggtcttgttc

SEQ ID NO: 164496 - DNA, 20 bp, Artificial Sequence
  Description of Artificial Sequence: Synthetic oligonucleotide
  Target: ATXN1; (-) strand; PAM type: YTN; PAM sequence: TTA
ttttttgagacagggtcttg

SEQ ID NO: 164497 - DNA, 20 bp, Artificial Sequence
  Description of Artificial Sequence: Synthetic oligonucleotide
  Target: ATXN1; (-) strand; PAM type: YTN; PAM sequence: TTT
attttttgagacagggtctt

SEQ ID NO: 164498 - DNA, 20 bp, Artificial Sequence
  Description of Artificial Sequence: Synthetic oligonucleotide
  Target: ATXN1; (-) strand; PAM type: YTN; PAM sequence: CTT
tattttttgagacagggtct

SEQ ID NO: 164499 - DNA, 20 bp, Artificial Sequence
  Description of Artificial Sequence: Synthetic oligonucleotide
  Target: ATXN1; (-) strand; PAM type: YTN; PAM sequence: TTC
tttattttttgagacagggt

SEQ ID NO: 164500 - DNA, 20 bp, Artificial Sequence
  Description of Artificial Sequence: Synthetic oligonucleotide
  Target: ATXN1; (-) strand; PAM type: YTN; PAM sequence: TTT
ctttattttttgagacaggg

SEQ ID NO: 164501 - DNA, 20 bp, Artificial Sequence
  Description of Artificial Sequence: Synthetic oligonucleotide
  Target: ATXN1; (-) strand; PAM type: YTN; PAM sequence: TTT
tctttattttttgagacagg

SEQ ID NO: 164502 - DNA, 20 bp, Artificial Sequence
  Description of Artificial Sequence: Synthetic oligonucleotide
  Target: ATXN1; (-) strand; PAM type: YTN; PAM sequence: CTC
cattttctttattttttgag

SEQ ID NO: 164503 - DNA, 20 bp, Artificial Sequence
  Description of Artificial Sequence: Synthetic oligonucleotide
  Target: ATXN1; (-) strand; PAM type: YTN; PAM sequence: TTA
tctccattttctttattttt

SEQ ID NO: 164504 - DNA, 20 bp, Artificial Sequence
  Description of Artificial Sequence: Synthetic oligonucleotide
  Target: ATXN1; (-) strand; PAM type: YTN; PAM sequence: TTA
ttatctccattttctttatt

SEQ ID NO: 164505 - DNA, 20 bp, Artificial Sequence
  Description of Artificial Sequence: Synthetic oligonucleotide
  Target: ATXN1; (-) strand; PAM type: YTN; PAM sequence: CTG
tagggtacgtgttattatct

SEQ ID NO: 164506 - DNA, 20 bp, Artificial Sequence
  Description of Artificial Sequence: Synthetic oligonucleotide
  Target: ATXN1; (-) strand; PAM type: YTN; PAM sequence: CTA
accctgtagggtacgtgtta

SEQ ID NO: 164507 - DNA, 20 bp, Artificial Sequence
  Description of Artificial Sequence: Synthetic oligonucleotide
  Target: ATXN1; (-) strand; PAM type: YTN; PAM sequence: TTA
gtcatcaccctaaccctgta

SEQ ID NO: 164508 - DNA, 20 bp, Artificial Sequence
  Description of Artificial Sequence: Synthetic oligonucleotide
  Target: ATXN1; (-) strand; PAM type: YTN; PAM sequence: TTT
agtcatcaccctaaccctgt

SEQ ID NO: 164509 - DNA, 20 bp, Artificial Sequence
  Description of Artificial Sequence: Synthetic oligonucleotide
  Target: ATXN1; (-) strand; PAM type: YTN; PAM sequence: CTC
atttagtcatcaccctaacc

SEQ ID NO: 164510 - DNA, 20 bp, Artificial Sequence
  Description of Artificial Sequence: Synthetic oligonucleotide
  Target: ATXN1; (-) strand; PAM type: YTN; PAM sequence: TTG
aatgcatctcatttagtcat

SEQ ID NO: 164511 - DNA, 20 bp, Artificial Sequence
  Description of Artificial Sequence: Synthetic oligonucleotide
  Target: ATXN1; (-) strand; PAM type: YTN; PAM sequence: TTG
ttgaatgcatctcatttagt

SEQ ID NO: 164512 - DNA, 20 bp, Artificial Sequence
  Description of Artificial Sequence: Synthetic oligonucleotide
  Target: ATXN1; (-) strand; PAM type: YTN; PAM sequence: TTT
gttgaatgcatctcatttag

SEQ ID NO: 164513 - DNA, 20 bp, Artificial Sequence
  Description of Artificial Sequence: Synthetic oligonucleotide
  Target: ATXN1; (-) strand; PAM type: YTN; PAM sequence: CTC
acatttgttgaatgcatctc

SEQ ID NO: 164514 - DNA, 20 bp, Artificial Sequence
  Description of Artificial Sequence: Synthetic oligonucleotide
  Target: ATXN1; (-) strand; PAM type: YTN; PAM sequence: CTA
cctcacatttgttgaatgca

SEQ ID NO: 164515 - DNA, 20 bp, Artificial Sequence
  Description of Artificial Sequence: Synthetic oligonucleotide
  Target: ATXN1; (-) strand; PAM type: YTN; PAM sequence: TTC
tacctcacatttgttgaatg

SEQ ID NO: 164516 - DNA, 20 bp, Artificial Sequence
  Description of Artificial Sequence: Synthetic oligonucleotide
  Target: ATXN1; (-) strand; PAM type: YTN; PAM sequence: TTT
ctacctcacatttgttgaat

SEQ ID NO: 164517 - DNA, 20 bp, Artificial Sequence
  Description of Artificial Sequence: Synthetic oligonucleotide
  Target: ATXN1; (-) strand; PAM type: YTN; PAM sequence: TTT
tctacctcacatttgttgaa

SEQ ID NO: 164518 - DNA, 20 bp, Artificial Sequence
  Description of Artificial Sequence: Synthetic oligonucleotide
  Target: ATXN1; (-) strand; PAM type: YTN; PAM sequence: TTT
ttctacctcacatttgttga

SEQ ID NO: 164519 - DNA, 20 bp, Artificial Sequence
  Description of Artificial Sequence: Synthetic oligonucleotide
  Target: ATXN1; (-) strand; PAM type: YTN; PAM sequence: TTT
tttctacctcacatttgttg

SEQ ID NO: 164520 - DNA, 20 bp, Artificial Sequence
  Description of Artificial Sequence: Synthetic oligonucleotide
  Target: ATXN1; (-) strand; PAM type: YTN; PAM sequence: CTG
aataagagaagttttttcta

SEQ ID NO: 164521 - DNA, 20 bp, Artificial Sequence
  Description of Artificial Sequence: Synthetic oligonucleotide
  Target: ATXN1; (-) strand; PAM type: YTN; PAM sequence: CTG
ctgaataagagaagtttttt

SEQ ID NO: 164522 - DNA, 20 bp, Artificial Sequence
  Description of Artificial Sequence: Synthetic oligonucleotide
  Target: ATXN1; (-) strand; PAM type: YTN; PAM sequence: TTC
ctgctgaataagagaagttt

SEQ ID NO: 164523 - DNA, 20 bp, Artificial Sequence
  Description of Artificial Sequence: Synthetic oligonucleotide
  Target: ATXN1; (-) strand; PAM type: YTN; PAM sequence: TTG
ataaagttcctgctgaataa

SEQ ID NO: 164524 - DNA, 20 bp, Artificial Sequence
  Description of Artificial Sequence: Synthetic oligonucleotide
  Target: ATXN1; (-) strand; PAM type: YTN; PAM sequence: TTA
taaaagaaaaagaaatgaac

SEQ ID NO: 164525 - DNA, 20 bp, Artificial Sequence
  Description of Artificial Sequence: Synthetic oligonucleotide
  Target: ATXN1; (-) strand; PAM type: YTN; PAM sequence: CTC
ataattataaaagaaaaaga

SEQ ID NO: 164526 - DNA, 20 bp, Artificial Sequence
  Description of Artificial Sequence: Synthetic oligonucleotide
  Target: ATXN1; (-) strand; PAM type: YTN; PAM sequence: TTC
tcataattataaaagaaaaa

SEQ ID NO: 164527 - DNA, 20 bp, Artificial Sequence
  Description of Artificial Sequence: Synthetic oligonucleotide
  Target: ATXN1; (-) strand; PAM type: YTN; PAM sequence: TTC
atgttctcataattataaaa

SEQ ID NO: 164528 - DNA, 20 bp, Artificial Sequence
  Description of Artificial Sequence: Synthetic oligonucleotide
  Target: ATXN1; (-) strand; PAM type: YTN; PAM sequence: CTT
catgttctcataattataaa

SEQ ID NO: 164529 - DNA, 20 bp, Artificial Sequence
  Description of Artificial Sequence: Synthetic oligonucleotide
  Target: ATXN1; (-) strand; PAM type: YTN; PAM sequence: TTC
cttcatgttctcataattat

SEQ ID NO: 164530 - DNA, 20 bp, Artificial Sequence
  Description of Artificial Sequence: Synthetic oligonucleotide
  Target: ATXN1; (-) strand; PAM type: YTN; PAM sequence: TTT
ccttcatgttctcataatta

SEQ ID NO: 164531 - DNA, 20 bp, Artificial Sequence
  Description of Artificial Sequence: Synthetic oligonucleotide
  Target: ATXN1; (-) strand; PAM type: YTN; PAM sequence: CTG
cccatttccttcatgttctc

SEQ ID NO: 164532 - DNA, 20 bp, Artificial Sequence
  Description of Artificial Sequence: Synthetic oligonucleotide
  Target: ATXN1; (-) strand; PAM type: YTN; PAM sequence: CTC
tgcccatttccttcatgttc

SEQ ID NO: 164533 - DNA, 20 bp, Artificial Sequence
  Description of Artificial Sequence: Synthetic oligonucleotide
  Target: ATXN1; (-) strand; PAM type: YTN; PAM sequence: CTG
gaatcctctgcccatttcct

SEQ ID NO: 164534 - DNA, 20 bp, Artificial Sequence
  Description of Artificial Sequence: Synthetic oligonucleotide
  Target: ATXN1; (-) strand; PAM type: YTN; PAM sequence: CTG
ctggaatcctctgcccattt

SEQ ID NO: 164535 - DNA, 20 bp, Artificial Sequence
  Description of Artificial Sequence: Synthetic oligonucleotide
  Target: ATXN1; (-) strand; PAM type: YTN; PAM sequence: TTC
tgctggaatcctctgcccat

SEQ ID NO: 164536 - DNA, 20 bp, Artificial Sequence
  Description of Artificial Sequence: Synthetic oligonucleotide
  Target: ATXN1; (-) strand; PAM type: YTN; PAM sequence: TTG
gcagaattctgctggaatcc

SEQ ID NO: 164537 - DNA, 20 bp, Artificial Sequence
  Description of Artificial Sequence: Synthetic oligonucleotide
  Target: ATXN1; (-) strand; PAM type: YTN; PAM sequence: CTT
ggcagaattctgctggaatc

SEQ ID NO: 164538 - DNA, 20 bp, Artificial Sequence
  Description of Artificial Sequence: Synthetic oligonucleotide
  Target: ATXN1; (-) strand; PAM type: YTN; PAM sequence: CTG
aaaatcttggcagaattctg

SEQ ID NO: 164539 - DNA, 20 bp, Artificial Sequence
  Description of Artificial Sequence: Synthetic oligonucleotide
  Target: ATXN1; (-) strand; PAM type: YTN; PAM sequence: CTG
ccaatcaggaaaagactgaa

SEQ ID NO: 164540 - DNA, 20 bp, Artificial Sequence
  Description of Artificial Sequence: Synthetic oligonucleotide
  Target: ATXN1; (-) strand; PAM type: YTN; PAM sequence: CTG
ctgccaatcaggaaaagact

SEQ ID NO: 164541 - DNA, 20 bp, Artificial Sequence
  Description of Artificial Sequence: Synthetic oligonucleotide
  Target: ATXN1; (-) strand; PAM type: YTN; PAM sequence: CTC
tgctgccaatcaggaaaaga

SEQ ID NO: 164542 - DNA, 20 bp, Artificial Sequence
  Description of Artificial Sequence: Synthetic oligonucleotide
  Target: ATXN1; (-) strand; PAM type: YTN; PAM sequence: CTC
aaaatgaaaatggaaatgct

SEQ ID NO: 164543 - DNA, 20 bp, Artificial Sequence
  Description of Artificial Sequence: Synthetic oligonucleotide
  Target: ATXN1; (-) strand; PAM type: YTN; PAM sequence: TTA
gtagaagaataccagcaaaa

SEQ ID NO: 164544 - DNA, 20 bp, Artificial Sequence
  Description of Artificial Sequence: Synthetic oligonucleotide
  Target: ATXN1; (-) strand; PAM type: YTN; PAM sequence: CTT
agtagaagaataccagcaaa

SEQ ID NO: 164545 - DNA, 20 bp, Artificial Sequence
  Description of Artificial Sequence: Synthetic oligonucleotide
  Target: ATXN1; (-) strand; PAM type: YTN; PAM sequence: TTC
ttagtagaagaataccagca

SEQ ID NO: 164546 - DNA, 20 bp, Artificial Sequence
  Description of Artificial Sequence: Synthetic oligonucleotide
  Target: ATXN1; (-) strand; PAM type: YTN; PAM sequence: TTT
cttagtagaagaataccagc

SEQ ID NO: 164547 - DNA, 20 bp, Artificial Sequence
  Description of Artificial Sequence: Synthetic oligonucleotide
  Target: ATXN1; (-) strand; PAM type: YTN; PAM sequence: TTG
gtttcttagtagaagaatac

SEQ ID NO: 164548 - DNA, 20 bp, Artificial Sequence
  Description of Artificial Sequence: Synthetic oligonucleotide
  Target: ATXN1; (-) strand; PAM type: YTN; PAM sequence: CTG
ggggaaaaattggtttctta

SEQ ID NO: 164549 - DNA, 20 bp, Artificial Sequence
  Description of Artificial Sequence: Synthetic oligonucleotide
  Target: ATXN1; (-) strand; PAM type: YTN; PAM sequence: TTC
actgggggaaaaattggttt

SEQ ID NO: 164550 - DNA, 20 bp, Artificial Sequence
  Description of Artificial Sequence: Synthetic oligonucleotide
  Target: ATXN1; (-) strand; PAM type: YTN; PAM sequence: TTA
aaaaaacattcactggggga

SEQ ID NO: 164551 - DNA, 20 bp, Artificial Sequence
  Description of Artificial Sequence: Synthetic oligonucleotide
  Target: ATXN1; (-) strand; PAM type: YTN; PAM sequence: CTG
aaattaaaaaaacattcact

SEQ ID NO: 164552 - DNA, 20 bp, Artificial Sequence
  Description of Artificial Sequence: Synthetic oligonucleotide
  Target: ATXN1; (-) strand; PAM type: YTN; PAM sequence: TTC
aaaaaaaaaaaaaaaccctg

SEQ ID NO: 164553 - DNA, 20 bp, Artificial Sequence
  Description of Artificial Sequence: Synthetic oligonucleotide
  Target: ATXN1; (-) strand; PAM type: YTN; PAM sequence: TTT
caaaaaaaaaaaaaaaccct

SEQ ID NO: 164554 - DNA, 20 bp, Artificial Sequence
  Description of Artificial Sequence: Synthetic oligonucleotide
  Target: ATXN1; (-) strand; PAM type: YTN; PAM sequence: TTG
tttcaaaaaaaaaaaaaaac

SEQ ID NO: 164555 - DNA, 20 bp, Artificial Sequence
  Description of Artificial Sequence: Synthetic oligonucleotide
  Target: ATXN1; (-) strand; PAM type: YTN; PAM sequence: CTT
gtttcaaaaaaaaaaaaaaa

SEQ ID NO: 164556 - DNA, 20 bp, Artificial Sequence
  Description of Artificial Sequence: Synthetic oligonucleotide
  Target: ATXN1; (-) strand; PAM type: YTN; PAM sequence: CTG
tatgacagagtgagaccttg

SEQ ID NO: 164557 - DNA, 20 bp, Artificial Sequence
  Description of Artificial Sequence: Synthetic oligonucleotide
  Target: ATXN1; (-) strand; PAM type: YTN; PAM sequence: CTC
cagcctgtatgacagagtga

SEQ ID NO: 164558 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgtatgacag

SEQ ID NO: 164559 - DNA, 20 bp, Artificial Sequence
  Description of Artificial Sequence: Synthetic oligonucleotide
  Target: ATXN1; (-) strand; PAM type: YTN; PAM sequence: TTG
ggccactgcactccagcctg

SEQ ID NO: 164560 - DNA, 20 bp, Artificial Sequence
  Description of Artificial Sequence: Synthetic oligonucleotide
  Target: ATXN1; (-) strand; PAM type: YTN; PAM sequence: CTA
cagtgagccaagattgggcc

SEQ ID NO: 164561 - DNA, 20 bp, Artificial Sequence
  Description of Artificial Sequence: Synthetic oligonucleotide
  Target: ATXN1; (-) strand; PAM type: YTN; PAM sequence: CTG
ggaggtcgaagctacagtga

SEQ ID NO: 164562 - DNA, 20 bp, Artificial Sequence
  Description of Artificial Sequence: Synthetic oligonucleotide
  Target: ATXN1; (-) strand; PAM type: YTN; PAM sequence: TTG
agcctgggaggtcgaagcta

SEQ ID NO: 164563 - DNA, 20 bp, Artificial Sequence
  Description of Artificial Sequence: Synthetic oligonucleotide
  Target: ATXN1; (-) strand; PAM type: YTN; PAM sequence: CTT
gagcctgggaggtcgaagct

SEQ ID NO: 164564 - DNA, 20 bp, Artificial Sequence
  Description of Artificial Sequence: Synthetic oligonucleotide
  Target: ATXN1; (-) strand; PAM type: YTN; PAM sequence: CTC
aagaggcagaggtgggtgga

SEQ ID NO: 164565 - DNA, 20 bp, Artificial Sequence
  Description of Artificial Sequence: Synthetic oligonucleotide
  Target: ATXN1; (-) strand; PAM type: YTN; PAM sequence: CTG
tagtcccagcaactcaagag

SEQ ID NO: 164566 - DNA, 20 bp, Artificial Sequence
  Description of Artificial Sequence: Synthetic oligonucleotide
  Target: ATXN1; (-) strand; PAM type: YTN; PAM sequence: CTG
ggcgtggtggcatgcgcctg

SEQ ID NO: 164567 - DNA, 20 bp, Artificial Sequence
  Description of Artificial Sequence: Synthetic oligonucleotide
  Target: ATXN1; (-) strand; PAM type: YTN; PAM sequence: TTA
gctgggcgtggtggcatgcg

SEQ ID NO: 164568 - DNA, 20 bp, Artificial Sequence
  Description of Artificial Sequence: Synthetic oligonucleotide
  Target: ATXN1; (-) strand; PAM type: YTN; PAM sequence: CTA
caaaaattagctgggcgtgg

SEQ ID NO: 164569 - DNA, 20 bp, Artificial Sequence
  Description of Artificial Sequence: Synthetic oligonucleotide
  Target: ATXN1; (-) strand; PAM type: YTN; PAM sequence: CTA
caaaaactacaaaaattagc

SEQ ID NO: 164570 - DNA, 20 bp, Artificial Sequence
  Description of Artificial Sequence: Synthetic oligonucleotide
  Target: ATXN1; (-) strand; PAM type: YTN; PAM sequence: CTC
tacaaaaactacaaaaatta

SEQ ID NO: 164571 - DNA, 20 bp, Artificial Sequence
  Description of Artificial Sequence: Synthetic oligonucleotide
  Target: ATXN1; (-) strand; PAM type: YTN; PAM sequence: CTG
gacaacatggtgaaaccccg

SEQ ID NO: 164572 - DNA, 20 bp, Artificial Sequence
  Description of Artificial Sequence: Synthetic oligonucleotide
  Target: ATXN1; (-) strand; PAM type: YTN; PAM sequence: TTC
aagacaagcctggacaacat

SEQ ID NO: 164573 - DNA, 20 bp, Artificial Sequence
  Description of Artificial Sequence: Synthetic oligonucleotide
  Target: ATXN1; (-) strand; PAM type: YTN; PAM sequence: TTG
agcccaagagttcaagacaa

SEQ ID NO: 164574 - DNA, 20 bp, Artificial Sequence
  Description of Artificial Sequence: Synthetic oligonucleotide
  Target: ATXN1; (-) strand; PAM type: YTN; PAM sequence: CTT
gagcccaagagttcaagaca

SEQ ID NO: 164575 - DNA, 20 bp, Artificial Sequence
  Description of Artificial Sequence: Synthetic oligonucleotide
  Target: ATXN1; (-) strand; PAM type: YTN; PAM sequence: CTC
ttgagcccaagagttcaaga

SEQ ID NO: 164576 - DNA, 20 bp, Artificial Sequence
  Description of Artificial Sequence: Synthetic oligonucleotide
  Target: ATXN1; (-) strand; PAM type: YTN; PAM sequence: CTG
agacaggcagatctcttgag

SEQ ID NO: 164577 - DNA, 20 bp, Artificial Sequence
  Description of Artificial Sequence: Synthetic oligonucleotide
  Target: ATXN1; (-) strand; PAM type: YTN; PAM sequence: TTG
ggaggctgagacaggcagat

SEQ ID NO: 164578 - DNA, 20 bp, Artificial Sequence
  Description of Artificial Sequence: Synthetic oligonucleotide
  Target: ATXN1; (-) strand; PAM type: YTN; PAM sequence: TTT
gggaggctgagacaggcaga

SEQ ID NO: 164579 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgagacaggcag

SEQ ID NO: 164580 - DNA, 20 bp, Artificial Sequence
  Description of Artificial Sequence: Synthetic oligonucleotide
  Target: ATXN1; (-) strand; PAM type: YTN; PAM sequence: TTA
tcccaacactttgggaggct

SEQ ID NO: 164581 - DNA, 20 bp, Artificial Sequence
  Description of Artificial Sequence: Synthetic oligonucleotide
  Target: ATXN1; (-) strand; PAM type: YTN; PAM sequence: CTG
ttatcccaacactttgggag

SEQ ID NO: 164582 - DNA, 20 bp, Artificial Sequence
  Description of Artificial Sequence: Synthetic oligonucleotide
  Target: ATXN1; (-) strand; PAM type: YTN; PAM sequence: CTC
atgcctgttatcccaacact

SEQ ID NO: 164583 - DNA, 20 bp, Artificial Sequence
  Description of Artificial Sequence: Synthetic oligonucleotide
  Target: ATXN1; (-) strand; PAM type: YTN; PAM sequence: CTG
ggtgtggtagctcatgcctg

SEQ ID NO: 164584 - DNA, 20 bp, Artificial Sequence
  Description of Artificial Sequence: Synthetic oligonucleotide
  Target: ATXN1; (-) strand; PAM type: YTN; PAM sequence: CTC
aagaatgggctgggtgtggt

SEQ ID NO: 164585 - DNA, 20 bp, Artificial Sequence
  Description of Artificial Sequence: Synthetic oligonucleotide
  Target: ATXN1; (-) strand; PAM type: YTN; PAM sequence: TTG
atccagcatactcaagaatg

SEQ ID NO: 164586 - DNA, 20 bp, Artificial Sequence
  Description of Artificial Sequence: Synthetic oligonucleotide
  Target: ATXN1; (-) strand; PAM type: YTN; PAM sequence: TTA
caaggagaaatattgatcca

SEQ ID NO: 164587 - DNA, 20 bp, Artificial Sequence
  Description of Artificial Sequence: Synthetic oligonucleotide
  Target: ATXN1; (-) strand; PAM type: YTN; PAM sequence: TTA
cattacaaggagaaatattg

SEQ ID NO: 164588 - DNA, 20 bp, Artificial Sequence
  Description of Artificial Sequence: Synthetic oligonucleotide
  Target: ATXN1; (-) strand; PAM type: YTN; PAM sequence: TTG
gaattacattacaaggagaa

SEQ ID NO: 164589 - DNA, 20 bp, Artificial Sequence
  Description of Artificial Sequence: Synthetic oligonucleotide
  Target: ATXN1; (-) strand; PAM type: YTN; PAM sequence: CTG
ttggaattacattacaagga

SEQ ID NO: 164590 - DNA, 20 bp, Artificial Sequence
  Description of Artificial Sequence: Synthetic oligonucleotide
  Target: ATXN1; (-) strand; PAM type: YTN; PAM sequence: TTC
tgttggaattacattacaag

SEQ ID NO: 164591 - DNA, 20 bp, Artificial Sequence
  Description of Artificial Sequence: Synthetic oligonucleotide
  Target: ATXN1; (-) strand; PAM type: YTN; PAM sequence: CTT
ctgttggaattacattacaa

SEQ ID NO: 164592 - DNA, 20 bp, Artificial Sequence
  Description of Artificial Sequence: Synthetic oligonucleotide
  Target: ATXN1; (-) strand; PAM type: YTN; PAM sequence: TTC
ccttctgttggaattacatt

SEQ ID NO: 164593 - DNA, 20 bp, Artificial Sequence
  Description of Artificial Sequence: Synthetic oligonucleotide
  Target: ATXN1; (-) strand; PAM type: YTN; PAM sequence: TTT
cccttctgttggaattacat

SEQ ID NO: 164594 - DNA, 20 bp, Artificial Sequence
  Description of Artificial Sequence: Synthetic oligonucleotide
  Target: ATXN1; (-) strand; PAM type: YTN; PAM sequence: CTG
gtttcccttctgttggaatt

SEQ ID NO: 164595 - DNA, 20 bp, Artificial Sequence
  Description of Artificial Sequence: Synthetic oligonucleotide
  Target: ATXN1; (-) strand; PAM type: YTN; PAM sequence: CTG
aaaggaggcctggtttccct

SEQ ID NO: 164596 - DNA, 20 bp, Artificial Sequence
  Description of Artificial Sequence: Synthetic oligonucleotide
  Target: ATXN1; (-) strand; PAM type: YTN; PAM sequence: CTG
cgatactgaaaggaggcctg

SEQ ID NO: 164597 - DNA, 20 bp, Artificial Sequence
  Description of Artificial Sequence: Synthetic oligonucleotide
  Target: ATXN1; (-) strand; PAM type: YTN; PAM sequence: CTC
aagctgcgatactgaaagga

SEQ ID NO: 164598 - DNA, 20 bp, Artificial Sequence
  Description of Artificial Sequence: Synthetic oligonucleotide
  Target: ATXN1; (-) strand; PAM type: YTN; PAM sequence: CTG
acaggctcaagctgcgatac

SEQ ID NO: 164599 - DNA, 20 bp, Artificial Sequence
  Description of Artificial Sequence: Synthetic oligonucleotide
  Target: ATXN1; (-) strand; PAM type: YTN; PAM sequence: CTG
aaatcaggggatgctgacag

SEQ ID NO: 164600 - DNA, 20 bp, Artificial Sequence
  Description of Artificial Sequence: Synthetic oligonucleotide
  Target: ATXN1; (-) strand; PAM type: YTN; PAM sequence: TTC
tgaaatcaggggatgctgac

SEQ ID NO: 164601 - DNA, 20 bp, Artificial Sequence
  Description of Artificial Sequence: Synthetic oligonucleotide
  Target: ATXN1; (-) strand; PAM type: YTN; PAM sequence: CTA
cgttctgaaatcaggggatg

SEQ ID NO: 164602 - DNA, 20 bp, Artificial Sequence
  Description of Artificial Sequence: Synthetic oligonucleotide
  Target: ATXN1; (-) strand; PAM type: YTN; PAM sequence: TTG
tagcctacgttctgaaatca

SEQ ID NO: 164603 - DNA, 20 bp, Artificial Sequence
  Description of Artificial Sequence: Synthetic oligonucleotide
  Target: ATXN1; (-) strand; PAM type: YTN; PAM sequence: TTT
gtagcctacgttctgaaatc

SEQ ID NO: 164604 - DNA, 20 bp, Artificial Sequence
  Description of Artificial Sequence: Synthetic oligonucleotide
  Target: ATXN1; (-) strand; PAM type: YTN; PAM sequence: CTG
tttgtagcctacgttctgaa

SEQ ID NO: 164605 - DNA, 20 bp, Artificial Sequence
  Description of Artificial Sequence: Synthetic oligonucleotide
  Target: ATXN1; (-) strand; PAM type: YTN; PAM sequence: CTG
ggactgtttgtagcctacgt

SEQ ID NO: 164606 - DNA, 20 bp, Artificial Sequence
  Description of Artificial Sequence: Synthetic oligonucleotide
  Target: ATXN1; (-) strand; PAM type: YTN; PAM sequence: CTG
tgaaagaccaggaatgtagt

SEQ ID NO: 164607 - DNA, 20 bp, Artificial Sequence
  Description of Artificial Sequence: Synthetic oligonucleotide
  Target: ATXN1; (-) strand; PAM type: YTN; PAM sequence: TTC
ccaatccaaagtaaatgctg

SEQ ID NO: 164608 - DNA, 20 bp, Artificial Sequence
  Description of Artificial Sequence: Synthetic oligonucleotide
  Target: ATXN1; (-) strand; PAM type: YTN; PAM sequence: TTT
cccaatccaaagtaaatgct

SEQ ID NO: 164609 - DNA, 20 bp, Artificial Sequence
  Description of Artificial Sequence: Synthetic oligonucleotide
  Target: ATXN1; (-) strand; PAM type: YTN; PAM sequence: TTC
ccatttcccaatccaaagta

SEQ ID NO: 164610 - DNA, 20 bp, Artificial Sequence
  Description of Artificial Sequence: Synthetic oligonucleotide
  Target: ATXN1; (-) strand; PAM type: YTN; PAM sequence: CTT
cccatttcccaatccaaagt

SEQ ID NO: 164611 - DNA, 20 bp, Artificial Sequence
  Description of Artificial Sequence: Synthetic oligonucleotide
  Target: ATXN1; (-) strand; PAM type: YTN; PAM sequence: CTC
acttcccatttcccaatcca

SEQ ID NO: 164612 - DNA, 20 bp, Artificial Sequence
  Description of Artificial Sequence: Synthetic oligonucleotide
  Target: ATXN1; (-) strand; PAM type: YTN; PAM sequence: CTG
aaagagagacctcacttccc

SEQ ID NO: 164613 - DNA, 20 bp, Artificial Sequence
  Description of Artificial Sequence: Synthetic oligonucleotide
  Target: ATXN1; (-) strand; PAM type: YTN; PAM sequence: CTC
atactgaaagagagacctca

SEQ ID NO: 164614 - DNA, 20 bp, Artificial Sequence
  Description of Artificial Sequence: Synthetic oligonucleotide
  Target: ATXN1; (-) strand; PAM type: YTN; PAM sequence: CTA
agaaataatctcatactgaa

SEQ ID NO: 164615 - DNA, 20 bp, Artificial Sequence
  Description of Artificial Sequence: Synthetic oligonucleotide
  Target: ATXN1; (-) strand; PAM type: YTN; PAM sequence: TTC
taagaaataatctcatactg

SEQ ID NO: 164616 - DNA, 20 bp, Artificial Sequence
  Description of Artificial Sequence: Synthetic oligonucleotide
  Target: ATXN1; (-) strand; PAM type: YTN; PAM sequence: CTG
ttctaagaaataatctcata

SEQ ID NO: 164617 - DNA, 20 bp, Artificial Sequence
  Description of Artificial Sequence: Synthetic oligonucleotide
  Target: ATXN1; (-) strand; PAM type: YTN; PAM sequence: CTA
acctgttctaagaaataatc

SEQ ID NO: 164618 - DNA, 20 bp, Artificial Sequence
  Description of Artificial Sequence: Synthetic oligonucleotide
  Target: ATXN1; (-) strand; PAM type: YTN; PAM sequence: TTA
gcaaaggccaaactaacctg

SEQ ID NO: 164619 - DNA, 20 bp, Artificial Sequence
  Description of Artificial Sequence: Synthetic oligonucleotide
  Target: ATXN1; (-) strand; PAM type: YTN; PAM sequence: TTT
agcaaaggccaaactaacct

SEQ ID NO: 164620 - DNA, 20 bp, Artificial Sequence
  Description of Artificial Sequence: Synthetic oligonucleotide
  Target: ATXN1; (-) strand; PAM type: YTN; PAM sequence: TTT
tagcaaaggccaaactaacc

SEQ ID NO: 164621 - DNA, 20 bp, Artificial Sequence
  Description of Artificial Sequence: Synthetic oligonucleotide
  Target: ATXN1; (-) strand; PAM type: YTN; PAM sequence: TTA
tattttagcaaaggccaaac

SEQ ID NO: 164622 - DNA, 20 bp, Artificial Sequence
  Description of Artificial Sequence: Synthetic oligonucleotide
  Target: ATXN1; (-) strand; PAM type: YTN; PAM sequence: TTT
atattttagcaaaggccaaa

SEQ ID NO: 164623 - DNA, 20 bp, Artificial Sequence
  Description of Artificial Sequence: Synthetic oligonucleotide
  Target: ATXN1; (-) strand; PAM type: YTN; PAM sequence: TTA
tttatattttagcaaaggcc

SEQ ID NO: 164624 - DNA, 20 bp, Artificial Sequence
  Description of Artificial Sequence: Synthetic oligonucleotide
  Target: ATXN1; (-) strand; PAM type: YTN; PAM sequence: CTT
atttatattttagcaaaggc

SEQ ID NO: 164625 - DNA, 20 bp, Artificial Sequence
  Description of Artificial Sequence: Synthetic oligonucleotide
  Target: ATXN1; (-) strand; PAM type: YTN; PAM sequence: CTG
cttatttatattttagcaaa

SEQ ID NO: 164626 - DNA, 20 bp, Artificial Sequence
  Description of Artificial Sequence: Synthetic oligonucleotide
  Target: ATXN1; (-) strand; PAM type: YTN; PAM sequence: CTC
tgcttatttatattttagca

SEQ ID NO: 164627 - DNA, 20 bp, Artificial Sequence
  Description of Artificial Sequence: Synthetic oligonucleotide
  Target: ATXN1; (-) strand; PAM type: YTN; PAM sequence: CTG
atggaagcctctgcttattt

SEQ ID NO: 164628 - DNA, 20 bp, Artificial Sequence
  Description of Artificial Sequence: Synthetic oligonucleotide
  Target: ATXN1; (-) strand; PAM type: YTN; PAM sequence: TTC
tgatggaagcctctgcttat

SEQ ID NO: 164629 - DNA, 20 bp, Artificial Sequence
  Description of Artificial Sequence: Synthetic oligonucleotide
  Target: ATXN1; (-) strand; PAM type: YTN; PAM sequence: TTT
ctgatggaagcctctgctta

SEQ ID NO: 164630 - DNA, 20 bp, Artificial Sequence
  Description of Artificial Sequence: Synthetic oligonucleotide
  Target: ATXN1; (-) strand; PAM type: YTN; PAM sequence: TTT
tctgatggaagcctctgctt

SEQ ID NO: 164631 - DNA, 20 bp, Artificial Sequence
  Description of Artificial Sequence: Synthetic oligonucleotide
  Target: ATXN1; (-) strand; PAM type: YTN; PAM sequence: TTT
ttctgatggaagcctctgct

SEQ ID NO: 164632 - DNA, 20 bp, Artificial Sequence
  Description of Artificial Sequence: Synthetic oligonucleotide
  Target: ATXN1; (-) strand; PAM type: YTN; PAM sequence: CTC
agatgtttttctgatggaag

SEQ ID NO: 164633 - DNA, 20 bp, Artificial Sequence
  Description of Artificial Sequence: Synthetic oligonucleotide
  Target: ATXN1; (-) strand; PAM type: YTN; PAM sequence: TTA
acactcagatgtttttctga

SEQ ID NO: 164634 - DNA, 20 bp, Artificial Sequence
  Description of Artificial Sequence: Synthetic oligonucleotide
  Target: ATXN1; (-) strand; PAM type: YTN; PAM sequence: CTT
aacactcagatgtttttctg

SEQ ID NO: 164635 - DNA, 20 bp, Artificial Sequence
  Description of Artificial Sequence: Synthetic oligonucleotide
  Target: ATXN1; (-) strand; PAM type: YTN; PAM sequence: CTA
cttaacactcagatgttttt

SEQ ID NO: 164636 - DNA, 20 bp, Artificial Sequence
  Description of Artificial Sequence: Synthetic oligonucleotide
  Target: ATXN1; (-) strand; PAM type: YTN; PAM sequence: TTA
tctacttaacactcagatgt

SEQ ID NO: 164637 - DNA, 20 bp, Artificial Sequence
  Description of Artificial Sequence: Synthetic oligonucleotide
  Target: ATXN1; (-) strand; PAM type: YTN; PAM sequence: TTT
atctacttaacactcagatg

SEQ ID NO: 164638 - DNA, 20 bp, Artificial Sequence
  Description of Artificial Sequence: Synthetic oligonucleotide
  Target: ATXN1; (-) strand; PAM type: YTN; PAM sequence: TTG
aagggatgcatttatctact

SEQ ID NO: 164639 - DNA, 20 bp, Artificial Sequence
  Description of Artificial Sequence: Synthetic oligonucleotide
  Target: ATXN1; (-) strand; PAM type: YTN; PAM sequence: CTC
aatgttgaagggatgcattt

SEQ ID NO: 164640 - DNA, 20 bp, Artificial Sequence
  Description of Artificial Sequence: Synthetic oligonucleotide
  Target: ATXN1; (-) strand; PAM type: YTN; PAM sequence: CTG
atgaaaaaataagagtgcat

SEQ ID NO: 164641 - DNA, 20 bp, Artificial Sequence
  Description of Artificial Sequence: Synthetic oligonucleotide
  Target: ATXN1; (-) strand; PAM type: YTN; PAM sequence: CTG
gaacgtgtcctgatgaaaaa

SEQ ID NO: 164642 - DNA, 20 bp, Artificial Sequence
  Description of Artificial Sequence: Synthetic oligonucleotide
  Target: ATXN1; (-) strand; PAM type: YTN; PAM sequence: TTC
tggaacgtgtcctgatgaaa

SEQ ID NO: 164643 - DNA, 20 bp, Artificial Sequence
  Description of Artificial Sequence: Synthetic oligonucleotide
  Target: ATXN1; (-) strand; PAM type: YTN; PAM sequence: TTT
ctggaacgtgtcctgatgaa

SEQ ID NO: 164644 - DNA, 20 bp, Artificial Sequence
  Description of Artificial Sequence: Synthetic oligonucleotide
  Target: ATXN1; (-) strand; PAM type: YTN; PAM sequence: CTA
tagcagggaaaaagatccaa

SEQ ID NO: 164645 - DNA, 20 bp, Artificial Sequence
  Description of Artificial Sequence: Synthetic oligonucleotide
  Target: ATXN1; (-) strand; PAM type: YTN; PAM sequence: TTC
gcgaaactatagcagggaaa

SEQ ID NO: 164646 - DNA, 20 bp, Artificial Sequence
  Description of Artificial Sequence: Synthetic oligonucleotide
  Target: ATXN1; (-) strand; PAM type: YTN; PAM sequence: TTA
ttcgcgaaactatagcaggg

SEQ ID NO: 164647 - DNA, 20 bp, Artificial Sequence
  Description of Artificial Sequence: Synthetic oligonucleotide
  Target: ATXN1; (-) strand; PAM type: YTN; PAM sequence: CTA
tattattcgcgaaactatag

SEQ ID NO: 164648 - DNA, 20 bp, Artificial Sequence
  Description of Artificial Sequence: Synthetic oligonucleotide
  Target: ATXN1; (-) strand; PAM type: YTN; PAM sequence: TTA
accagagcaaaatagaagca

SEQ ID NO: 164649 - DNA, 20 bp, Artificial Sequence
  Description of Artificial Sequence: Synthetic oligonucleotide
  Target: ATXN1; (-) strand; PAM type: YTN; PAM sequence: TTG
ggttaaccagagcaaaatag

SEQ ID NO: 164650 - DNA, 20 bp, Artificial Sequence
  Description of Artificial Sequence: Synthetic oligonucleotide
  Target: ATXN1; (-) strand; PAM type: YTN; PAM sequence: CTT
gggttaaccagagcaaaata

SEQ ID NO: 164651 - DNA, 20 bp, Artificial Sequence
  Description of Artificial Sequence: Synthetic oligonucleotide
  Target: ATXN1; (-) strand; PAM type: YTN; PAM sequence: TTC
atcatcccacccaccatccc

SEQ ID NO: 164652 - DNA, 20 bp, Artificial Sequence
  Description of Artificial Sequence: Synthetic oligonucleotide
  Target: ATXN1; (-) strand; PAM type: YTN; PAM sequence: TTT
catcatcccacccaccatcc

SEQ ID NO: 164653 - DNA, 20 bp, Artificial Sequence
  Description of Artificial Sequence: Synthetic oligonucleotide
  Target: ATXN1; (-) strand; PAM type: YTN; PAM sequence: TTT
tcatcatcccacccaccatc

SEQ ID NO: 164654 - DNA, 20 bp, Artificial Sequence
  Description of Artificial Sequence: Synthetic oligonucleotide
  Target: ATXN1; (-) strand; PAM type: YTN; PAM sequence: CTT
ttcatcatcccacccaccat

SEQ ID NO: 164655 - DNA, 20 bp, Artificial Sequence
  Description of Artificial Sequence: Synthetic oligonucleotide
  Target: ATXN1; (-) strand; PAM type: YTN; PAM sequence: CTG
cttttcatcatcccacccac

SEQ ID NO: 164656 - DNA, 20 bp, Artificial Sequence
  Description of Artificial Sequence: Synthetic oligonucleotide
  Target: ATXN1; (-) strand; PAM type: YTN; PAM sequence: TTG
ctgcttttcatcatcccacc

SEQ ID NO: 164657 - DNA, 20 bp, Artificial Sequence
  Description of Artificial Sequence: Synthetic oligonucleotide
  Target: ATXN1; (-) strand; PAM type: YTN; PAM sequence: TTA
ttgctgcttttcatcatccc

SEQ ID NO: 164658 - DNA, 20 bp, Artificial Sequence
  Description of Artificial Sequence: Synthetic oligonucleotide
  Target: ATXN1; (-) strand; PAM type: YTN; PAM sequence: CTT
attgctgcttttcatcatcc

SEQ ID NO: 164659 - DNA, 20 bp, Artificial Sequence
  Description of Artificial Sequence: Synthetic oligonucleotide
  Target: ATXN1; (-) strand; PAM type: YTN; PAM sequence: CTG
ccttattgctgcttttcatc

SEQ ID NO: 164660 - DNA, 20 bp, Artificial Sequence
  Description of Artificial Sequence: Synthetic oligonucleotide
  Target: ATXN1; (-) strand; PAM type: YTN; PAM sequence: CTC
agtcactgccttattgctgc

SEQ ID NO: 164661 - DNA, 20 bp, Artificial Sequence
  Description of Artificial Sequence: Synthetic oligonucleotide
  Target: ATXN1; (-) strand; PAM type: YTN; PAM sequence: TTG
agactcagtcactgccttat

SEQ ID NO: 164662 - DNA, 20 bp, Artificial Sequence
  Description of Artificial Sequence: Synthetic oligonucleotide
  Target: ATXN1; (-) strand; PAM type: YTN; PAM sequence: TTA
tagattgagactcagtcact

SEQ ID NO: 164663 - DNA, 20 bp, Artificial Sequence
  Description of Artificial Sequence: Synthetic oligonucleotide
  Target: ATXN1; (-) strand; PAM type: YTN; PAM sequence: TTG
gaaacgttatagattgagac

SEQ ID NO: 164664 - DNA, 20 bp, Artificial Sequence
  Description of Artificial Sequence: Synthetic oligonucleotide
  Target: ATXN1; (-) strand; PAM type: YTN; PAM sequence: CTA
cgttggaaacgttatagatt

SEQ ID NO: 164665 - DNA, 20 bp, Artificial Sequence
  Description of Artificial Sequence: Synthetic oligonucleotide
  Target: ATXN1; (-) strand; PAM type: YTN; PAM sequence: TTC
tacgttggaaacgttataga

SEQ ID NO: 164666 - DNA, 20 bp, Artificial Sequence
  Description of Artificial Sequence: Synthetic oligonucleotide
  Target: ATXN1; (-) strand; PAM type: YTN; PAM sequence: CTT
ctacgttggaaacgttatag

SEQ ID NO: 164667 - DNA, 20 bp, Artificial Sequence
  Description of Artificial Sequence: Synthetic oligonucleotide
  Target: ATXN1; (-) strand; PAM type: YTN; PAM sequence: TTA
tcttctacgttggaaacgtt

SEQ ID NO: 164668 - DNA, 20 bp, Artificial Sequence
  Description of Artificial Sequence: Synthetic oligonucleotide
  Target: ATXN1; (-) strand; PAM type: YTN; PAM sequence: TTT
atcttctacgttggaaacgt

SEQ ID NO: 164669 - DNA, 20 bp, Artificial Sequence
  Description of Artificial Sequence: Synthetic oligonucleotide
  Target: ATXN1; (-) strand; PAM type: YTN; PAM sequence: TTT
tatcttctacgttggaaacg

SEQ ID NO: 164670 - DNA, 20 bp, Artificial Sequence
  Description of Artificial Sequence: Synthetic oligonucleotide
  Target: ATXN1; (-) strand; PAM type: YTN; PAM sequence: TTC
attttatcttctacgttgga

SEQ ID NO: 164671 - DNA, 20 bp, Artificial Sequence
  Description of Artificial Sequence: Synthetic oligonucleotide
  Target: ATXN1; (-) strand; PAM type: YTN; PAM sequence: TTA
tgggttcattttatcttcta

SEQ ID NO: 164672 - DNA, 20 bp, Artificial Sequence
  Description of Artificial Sequence: Synthetic oligonucleotide
  Target: ATXN1; (-) strand; PAM type: YTN; PAM sequence: TTA
ttatgggttcattttatctt

SEQ ID NO: 164673 - DNA, 20 bp, Artificial Sequence
  Description of Artificial Sequence: Synthetic oligonucleotide
  Target: ATXN1; (-) strand; PAM type: YTN; PAM sequence: TTT
attatgggttcattttatct

SEQ ID NO: 164674 - DNA, 20 bp, Artificial Sequence
  Description of Artificial Sequence: Synthetic oligonucleotide
  Target: ATXN1; (-) strand; PAM type: YTN; PAM sequence: TTC
ccaaatatgtttattatggg

SEQ ID NO: 164675 - DNA, 20 bp, Artificial Sequence
  Description of Artificial Sequence: Synthetic oligonucleotide
  Target: ATXN1; (-) strand; PAM type: YTN; PAM sequence: TTT
cccaaatatgtttattatgg

SEQ ID NO: 164676 - DNA, 20 bp, Artificial Sequence
  Description of Artificial Sequence: Synthetic oligonucleotide
  Target: ATXN1; (-) strand; PAM type: YTN; PAM sequence: TTT
tcccaaatatgtttattatg

SEQ ID NO: 164677 - DNA, 20 bp, Artificial Sequence
  Description of Artificial Sequence: Synthetic oligonucleotide
  Target: ATXN1; (-) strand; PAM type: YTN; PAM sequence: TTG
tatattttcccaaatatgtt

SEQ ID NO: 164678 - DNA, 20 bp, Artificial Sequence
  Description of Artificial Sequence: Synthetic oligonucleotide
  Target: ATXN1; (-) strand; PAM type: YTN; PAM sequence: TTT
gtatattttcccaaatatgt

SEQ ID NO: 164679 - DNA, 20 bp, Artificial Sequence
  Description of Artificial Sequence: Synthetic oligonucleotide
  Target: ATXN1; (-) strand; PAM type: YTN; PAM sequence: CTT
tgtatattttcccaaatatg

SEQ ID NO: 164680 - DNA, 20 bp, Artificial Sequence
  Description of Artificial Sequence: Synthetic oligonucleotide
  Target: ATXN1; (-) strand; PAM type: YTN; PAM sequence: TTC
tttgtatattttcccaaata

SEQ ID NO: 164681 - DNA, 20 bp, Artificial Sequence
  Description of Artificial Sequence: Synthetic oligonucleotide
  Target: ATXN1; (-) strand; PAM type: YTN; PAM sequence: CTG
tgaagttctttgtatatttt

SEQ ID NO: 164682 - DNA, 20 bp, Artificial Sequence
  Description of Artificial Sequence: Synthetic oligonucleotide
  Target: ATXN1; (-) strand; PAM type: YTN; PAM sequence: TTC
tgtgaagttctttgtatatt

SEQ ID NO: 164683 - DNA, 20 bp, Artificial Sequence
  Description of Artificial Sequence: Synthetic oligonucleotide
  Target: ATXN1; (-) strand; PAM type: YTN; PAM sequence: TTT
ctgtgaagttctttgtatat

SEQ ID NO: 164684 - DNA, 20 bp, Artificial Sequence
  Description of Artificial Sequence: Synthetic oligonucleotide
  Target: ATXN1; (-) strand; PAM type: YTN; PAM sequence: CTT
tctgtgaagttctttgtata

SEQ ID NO: 164685 - DNA, 20 bp, Artificial Sequence
  Description of Artificial Sequence: Synthetic oligonucleotide
  Target: ATXN1; (-) strand; PAM type: YTN; PAM sequence: TTG
agagctttctgtgaagttct

SEQ ID NO: 164686 - DNA, 20 bp, Artificial Sequence
  Description of Artificial Sequence: Synthetic oligonucleotide
  Target: ATXN1; (-) strand; PAM type: YTN; PAM sequence: CTC
cgttgagagctttctgtgaa

SEQ ID NO: 164687 - DNA, 20 bp, Artificial Sequence
  Description of Artificial Sequence: Synthetic oligonucleotide
  Target: ATXN1; (-) strand; PAM type: YTN; PAM sequence: CTC
tccgttgagagctttctgtg

SEQ ID NO: 164688 - DNA, 20 bp, Artificial Sequence
  Description of Artificial Sequence: Synthetic oligonucleotide
  Target: ATXN1; (-) strand; PAM type: YTN; PAM sequence: TTC
aggctctccgttgagagctt

SEQ ID NO: 164689 - DNA, 20 bp, Artificial Sequence
  Description of Artificial Sequence: Synthetic oligonucleotide
  Target: ATXN1; (-) strand; PAM type: YTN; PAM sequence: CTT
caggctctccgttgagagct

SEQ ID NO: 164690 - DNA, 20 bp, Artificial Sequence
  Description of Artificial Sequence: Synthetic oligonucleotide
  Target: ATXN1; (-) strand; PAM type: YTN; PAM sequence: CTG
gtcccttcaggctctccgtt

SEQ ID NO: 164691 - DNA, 20 bp, Artificial Sequence
  Description of Artificial Sequence: Synthetic oligonucleotide
  Target: ATXN1; (-) strand; PAM type: YTN; PAM sequence: CTG
gctggtcccttcaggctctc

SEQ ID NO: 164692 - DNA, 20 bp, Artificial Sequence
  Description of Artificial Sequence: Synthetic oligonucleotide
  Target: ATXN1; (-) strand; PAM type: YTN; PAM sequence: CTC
cctggctggtcccttcaggc

SEQ ID NO: 164693 - DNA, 20 bp, Artificial Sequence
  Description of Artificial Sequence: Synthetic oligonucleotide
  Target: ATXN1; (-) strand; PAM type: YTN; PAM sequence: TTA
gactccctggctggtccctt

SEQ ID NO: 164694 - DNA, 20 bp, Artificial Sequence
  Description of Artificial Sequence: Synthetic oligonucleotide
  Target: ATXN1; (-) strand; PAM type: YTN; PAM sequence: TTG
cattagactccctggctggt

SEQ ID NO: 164695 - DNA, 20 bp, Artificial Sequence
  Description of Artificial Sequence: Synthetic oligonucleotide
  Target: ATXN1; (-) strand; PAM type: YTN; PAM sequence: CTT
gcattagactccctggctgg

SEQ ID NO: 164696 - DNA, 20 bp, Artificial Sequence
  Description of Artificial Sequence: Synthetic oligonucleotide
  Target: ATXN1; (-) strand; PAM type: YTN; PAM sequence: CTG
gcttgcattagactccctgg

SEQ ID NO: 164697 - DNA, 20 bp, Artificial Sequence
  Description of Artificial Sequence: Synthetic oligonucleotide
  Target: ATXN1; (-) strand; PAM type: YTN; PAM sequence: TTC
ctggcttgcattagactccc

SEQ ID NO: 164698 - DNA, 20 bp, Artificial Sequence
  Description of Artificial Sequence: Synthetic oligonucleotide
  Target: ATXN1; (-) strand; PAM type: YTN; PAM sequence: CTG
ttcctggcttgcattagact

SEQ ID NO: 164699 - DNA, 20 bp, Artificial Sequence
  Description of Artificial Sequence: Synthetic oligonucleotide
  Target: ATXN1; (-) strand; PAM type: YTN; PAM sequence: CTG
gctgttcctggcttgcatta

SEQ ID NO: 164700 - DNA, 20 bp, Artificial Sequence
  Description of Artificial Sequence: Synthetic oligonucleotide
  Target: ATXN1; (-) strand; PAM type: YTN; PAM sequence: CTC
atgcctggctgttcctggct

SEQ ID NO: 164701 - DNA, 20 bp, Artificial Sequence
  Description of Artificial Sequence: Synthetic oligonucleotide
  Target: ATXN1; (-) strand; PAM type: YTN; PAM sequence: TTA
ctcatgcctggctgttcctg

SEQ ID NO: 164702 - DNA, 20 bp, Artificial Sequence
  Description of Artificial Sequence: Synthetic oligonucleotide
  Target: ATXN1; (-) strand; PAM type: YTN; PAM sequence: CTA
aggcattactcatgcctggc

SEQ ID NO: 164703 - DNA, 20 bp, Artificial Sequence
  Description of Artificial Sequence: Synthetic oligonucleotide
  Target: ATXN1; (-) strand; PAM type: YTN; PAM sequence: CTG
tgaaagaaaacaaaacccac

SEQ ID NO: 164704 - DNA, 20 bp, Artificial Sequence
  Description of Artificial Sequence: Synthetic oligonucleotide
  Target: ATXN1; (-) strand; PAM type: YTN; PAM sequence: TTC
aaatcagctgtgaaagaaaa

SEQ ID NO: 164705 - DNA, 20 bp, Artificial Sequence
  Description of Artificial Sequence: Synthetic oligonucleotide
  Target: ATXN1; (-) strand; PAM type: YTN; PAM sequence: TTT
caaatcagctgtgaaagaaa

SEQ ID NO: 164706 - DNA, 20 bp, Artificial Sequence
  Description of Artificial Sequence: Synthetic oligonucleotide
  Target: ATXN1; (-) strand; PAM type: YTN; PAM sequence: TTG
agggaagtttcaaatcagct

SEQ ID NO: 164707 - DNA, 20 bp, Artificial Sequence
  Description of Artificial Sequence: Synthetic oligonucleotide
  Target: ATXN1; (-) strand; PAM type: YTN; PAM sequence: CTA
cagtgtcattgagggaagtt

SEQ ID NO: 164708 - DNA, 20 bp, Artificial Sequence
  Description of Artificial Sequence: Synthetic oligonucleotide
  Target: ATXN1; (-) strand; PAM type: YTN; PAM sequence: TTC
tacagtgtcattgagggaag

SEQ ID NO: 164709 - DNA, 20 bp, Artificial Sequence
  Description of Artificial Sequence: Synthetic oligonucleotide
  Target: ATXN1; (-) strand; PAM type: YTN; PAM sequence: CTT
ctacagtgtcattgagggaa

SEQ ID NO: 164710 - DNA, 20 bp, Artificial Sequence
  Description of Artificial Sequence: Synthetic oligonucleotide
  Target: ATXN1; (-) strand; PAM type: YTN; PAM sequence: TTA
tcttctacagtgtcattgag

SEQ ID NO: 164711 - DNA, 20 bp, Artificial Sequence
  Description of Artificial Sequence: Synthetic oligonucleotide
  Target: ATXN1; (-) strand; PAM type: YTN; PAM sequence: TTA
aaacattatcttctacagtg

SEQ ID NO: 164712 - DNA, 20 bp, Artificial Sequence
  Description of Artificial Sequence: Synthetic oligonucleotide
  Target: ATXN1; (-) strand; PAM type: YTN; PAM sequence: TTG
ttaaaacattatcttctaca

SEQ ID NO: 164713 - DNA, 20 bp, Artificial Sequence
  Description of Artificial Sequence: Synthetic oligonucleotide
  Target: ATXN1; (-) strand; PAM type: YTN; PAM sequence: TTT
gttaaaacattatcttctac

SEQ ID NO: 164714 - DNA, 20 bp, Artificial Sequence
  Description of Artificial Sequence: Synthetic oligonucleotide
  Target: ATXN1; (-) strand; PAM type: YTN; PAM sequence: TTT
tgttaaaacattatcttcta

SEQ ID NO: 164715 - DNA, 20 bp, Artificial Sequence
  Description of Artificial Sequence: Synthetic oligonucleotide
  Target: ATXN1; (-) strand; PAM type: YTN; PAM sequence: TTG
taaatccatgcgttttgtta

SEQ ID NO: 164716 - DNA, 20 bp, Artificial Sequence
  Description of Artificial Sequence: Synthetic oligonucleotide
  Target: ATXN1; (-) strand; PAM type: YTN; PAM sequence: CTT
gtaaatccatgcgttttgtt

SEQ ID NO: 164717 - DNA, 20 bp, Artificial Sequence
  Description of Artificial Sequence: Synthetic oligonucleotide
  Target: ATXN1; (-) strand; PAM type: YTN; PAM sequence: TTG
agtgtgaggaagcttgtaaa

SEQ ID NO: 164718 - DNA, 20 bp, Artificial Sequence
  Description of Artificial Sequence: Synthetic oligonucleotide
  Target: ATXN1; (-) strand; PAM type: YTN; PAM sequence: CTT
gagtgtgaggaagcttgtaa

SEQ ID NO: 164719 - DNA, 20 bp, Artificial Sequence
  Description of Artificial Sequence: Synthetic oligonucleotide
  Target: ATXN1; (-) strand; PAM type: YTN; PAM sequence: CTG
tcggcttgagtgtgaggaag

SEQ ID NO: 164720 - DNA, 20 bp, Artificial Sequence
  Description of Artificial Sequence: Synthetic oligonucleotide
  Target: ATXN1; (-) strand; PAM type: YTN; PAM sequence: CTC
tgtcggcttgagtgtgagga

SEQ ID NO: 164721 - DNA, 20 bp, Artificial Sequence
  Description of Artificial Sequence: Synthetic oligonucleotide
  Target: ATXN1; (-) strand; PAM type: YTN; PAM sequence: CTC
gtgtgatgctctgtcggctt

SEQ ID NO: 164722 - DNA, 20 bp, Artificial Sequence
  Description of Artificial Sequence: Synthetic oligonucleotide
  Target: ATXN1; (-) strand; PAM type: YTN; PAM sequence: CTA
ccagacagagcctcgtgtga

SEQ ID NO: 164723 - DNA, 20 bp, Artificial Sequence
  Description of Artificial Sequence: Synthetic oligonucleotide
  Target: ATXN1; (-) strand; PAM type: YTN; PAM sequence: CTG
agatgtggagactaccagac

SEQ ID NO: 164724 - DNA, 20 bp, Artificial Sequence
  Description of Artificial Sequence: Synthetic oligonucleotide
  Target: ATXN1; (-) strand; PAM type: YTN; PAM sequence: TTC
catccagcccagcctgagat

SEQ ID NO: 164725 - DNA, 20 bp, Artificial Sequence
  Description of Artificial Sequence: Synthetic oligonucleotide
  Target: ATXN1; (-) strand; PAM type: YTN; PAM sequence: CTT
ccatccagcccagcctgaga

SEQ ID NO: 164726 - DNA, 20 bp, Artificial Sequence
  Description of Artificial Sequence: Synthetic oligonucleotide
  Target: ATXN1; (-) strand; PAM type: YTN; PAM sequence: TTC
cttccatccagcccagcctg

SEQ ID NO: 164727 - DNA, 20 bp, Artificial Sequence
  Description of Artificial Sequence: Synthetic oligonucleotide
  Target: ATXN1; (-) strand; PAM type: YTN; PAM sequence: TTT
ccttccatccagcccagcct

SEQ ID NO: 164728 - DNA, 20 bp, Artificial Sequence
  Description of Artificial Sequence: Synthetic oligonucleotide
  Target: ATXN1; (-) strand; PAM type: YTN; PAM sequence: CTG
tgatcatttccttccatcca

SEQ ID NO: 164729 - DNA, 20 bp, Artificial Sequence
  Description of Artificial Sequence: Synthetic oligonucleotide
  Target: ATXN1; (-) strand; PAM type: YTN; PAM sequence: TTG
ctgtgatcatttccttccat

SEQ ID NO: 164730 - DNA, 20 bp, Artificial Sequence
  Description of Artificial Sequence: Synthetic oligonucleotide
  Target: ATXN1; (-) strand; PAM type: YTN; PAM sequence: CTT
gctgtgatcatttccttcca

SEQ ID NO: 164731 - DNA, 20 bp, Artificial Sequence
  Description of Artificial Sequence: Synthetic oligonucleotide
  Target: ATXN1; (-) strand; PAM type: YTN; PAM sequence: TTC
ccttgctgtgatcatttcct

SEQ ID NO: 164732 - DNA, 20 bp, Artificial Sequence
  Description of Artificial Sequence: Synthetic oligonucleotide
  Target: ATXN1; (-) strand; PAM type: YTN; PAM sequence: TTA
aattcccttgctgtgatcat

SEQ ID NO: 164733 - DNA, 20 bp, Artificial Sequence
  Description of Artificial Sequence: Synthetic oligonucleotide
  Target: ATXN1; (-) strand; PAM type: YTN; PAM sequence: TTT
aaattcccttgctgtgatca

SEQ ID NO: 164734 - DNA, 20 bp, Artificial Sequence
  Description of Artificial Sequence: Synthetic oligonucleotide
  Target: ATXN1; (-) strand; PAM type: YTN; PAM sequence: CTT
taaattcccttgctgtgatc

SEQ ID NO: 164735 - DNA, 20 bp, Artificial Sequence
  Description of Artificial Sequence: Synthetic oligonucleotide
  Target: ATXN1; (-) strand; PAM type: YTN; PAM sequence: TTC
ctttaaattcccttgctgtg

SEQ ID NO: 164736 - DNA, 20 bp, Artificial Sequence
  Description of Artificial Sequence: Synthetic oligonucleotide
  Target: ATXN1; (-) strand; PAM type: YTN; PAM sequence: TTT
cctttaaattcccttgctgt

SEQ ID NO: 164737 - DNA, 20 bp, Artificial Sequence
  Description of Artificial Sequence: Synthetic oligonucleotide
  Target: ATXN1; (-) strand; PAM type: YTN; PAM sequence: CTG
tggtcatttcctttaaattc

SEQ ID NO: 164738 - DNA, 20 bp, Artificial Sequence
  Description of Artificial Sequence: Synthetic oligonucleotide
  Target: ATXN1; (-) strand; PAM type: YTN; PAM sequence: TTG
ctgtggtcatttcctttaaa

SEQ ID NO: 164739 - DNA, 20 bp, Artificial Sequence
  Description of Artificial Sequence: Synthetic oligonucleotide
  Target: ATXN1; (-) strand; PAM type: YTN; PAM sequence: CTT
gctgtggtcatttcctttaa

SEQ ID NO: 164740 - DNA, 20 bp, Artificial Sequence
  Description of Artificial Sequence: Synthetic oligonucleotide
  Target: ATXN1; (-) strand; PAM type: YTN; PAM sequence: CTC
gatgtgccttgctgtggtca

SEQ ID NO: 164741 - DNA, 20 bp, Artificial Sequence
  Description of Artificial Sequence: Synthetic oligonucleotide
  Target: ATXN1; (-) strand; PAM type: YTN; PAM sequence: TTG
agccacaaagggagccctcg

SEQ ID NO: 164742 - DNA, 20 bp, Artificial Sequence
  Description of Artificial Sequence: Synthetic oligonucleotide
  Target: ATXN1; (-) strand; PAM type: YTN; PAM sequence: TTT
gagccacaaagggagccctc

SEQ ID NO: 164743 - DNA, 20 bp, Artificial Sequence
  Description of Artificial Sequence: Synthetic oligonucleotide
  Target: ATXN1; (-) strand; PAM type: YTN; PAM sequence: TTT
tgagccacaaagggagccct

SEQ ID NO: 164744 - DNA, 20 bp, Artificial Sequence
  Description of Artificial Sequence: Synthetic oligonucleotide
  Target: ATXN1; (-) strand; PAM type: YTN; PAM sequence: CTT
ttgagccacaaagggagccc

SEQ ID NO: 164745 - DNA, 20 bp, Artificial Sequence
  Description of Artificial Sequence: Synthetic oligonucleotide
  Target: ATXN1; (-) strand; PAM type: YTN; PAM sequence: TTC
ttttgagccacaaagggagc

SEQ ID NO: 164746 - DNA, 20 bp, Artificial Sequence
  Description of Artificial Sequence: Synthetic oligonucleotide
  Target: ATXN1; (-) strand; PAM type: YTN; PAM sequence: CTT
cttttgagccacaaagggag

SEQ ID NO: 164747 - DNA, 20 bp, Artificial Sequence
  Description of Artificial Sequence: Synthetic oligonucleotide
  Target: ATXN1; (-) strand; PAM type: YTN; PAM sequence: CTG
ccatgatgcttcttttgagc

SEQ ID NO: 164748 - DNA, 20 bp, Artificial Sequence
  Description of Artificial Sequence: Synthetic oligonucleotide
  Target: ATXN1; (-) strand; PAM type: YTN; PAM sequence: CTC
tgccatgatgcttcttttga

SEQ ID NO: 164749 - DNA, 20 bp, Artificial Sequence
  Description of Artificial Sequence: Synthetic oligonucleotide
  Target: ATXN1; (-) strand; PAM type: YTN; PAM sequence: CTG
acaataactctgccatgatg

SEQ ID NO: 164750 - DNA, 20 bp, Artificial Sequence
  Description of Artificial Sequence: Synthetic oligonucleotide
  Target: ATXN1; (-) strand; PAM type: YTN; PAM sequence: CTG
aaatctgacaataactctgc

SEQ ID NO: 164751 - DNA, 20 bp, Artificial Sequence
  Description of Artificial Sequence: Synthetic oligonucleotide
  Target: ATXN1; (-) strand; PAM type: YTN; PAM sequence: TTG
tactgaaatctgacaataac

SEQ ID NO: 164752 - DNA, 20 bp, Artificial Sequence
  Description of Artificial Sequence: Synthetic oligonucleotide
  Target: ATXN1; (-) strand; PAM type: YTN; PAM sequence: CTA
ttgtactgaaatctgacaat

SEQ ID NO: 164753 - DNA, 20 bp, Artificial Sequence
  Description of Artificial Sequence: Synthetic oligonucleotide
  Target: ATXN1; (-) strand; PAM type: YTN; PAM sequence: CTC
atggataaggcggggactat

SEQ ID NO: 164754 - DNA, 20 bp, Artificial Sequence
  Description of Artificial Sequence: Synthetic oligonucleotide
  Target: ATXN1; (-) strand; PAM type: YTN; PAM sequence: TTC
ctcatggataaggcggggac

SEQ ID NO: 164755 - DNA, 20 bp, Artificial Sequence
  Description of Artificial Sequence: Synthetic oligonucleotide
  Target: ATXN1; (-) strand; PAM type: YTN; PAM sequence: CTA
ttcctcatggataaggcggg

SEQ ID NO: 164756 - DNA, 20 bp, Artificial Sequence
  Description of Artificial Sequence: Synthetic oligonucleotide
  Target: ATXN1; (-) strand; PAM type: YTN; PAM sequence: TTG
gaacctattcctcatggata

SEQ ID NO: 164757 - DNA, 20 bp, Artificial Sequence
  Description of Artificial Sequence: Synthetic oligonucleotide
  Target: ATXN1; (-) strand; PAM type: YTN; PAM sequence: CTT
ggaacctattcctcatggat

SEQ ID NO: 164758 - DNA, 20 bp, Artificial Sequence
  Description of Artificial Sequence: Synthetic oligonucleotide
  Target: ATXN1; (-) strand; PAM type: YTN; PAM sequence: CTG
ggggtcttggaacctattcc

SEQ ID NO: 164759 - DNA, 20 bp, Artificial Sequence
  Description of Artificial Sequence: Synthetic oligonucleotide
  Target: ATXN1; (-) strand; PAM type: YTN; PAM sequence: TTC
aggaacccactgggggtctt

SEQ ID NO: 164760 - DNA, 20 bp, Artificial Sequence
  Description of Artificial Sequence: Synthetic oligonucleotide
  Target: ATXN1; (-) strand; PAM type: YTN; PAM sequence: TTT
caggaacccactgggggtct

SEQ ID NO: 164761 - DNA, 20 bp, Artificial Sequence
  Description of Artificial Sequence: Synthetic oligonucleotide
  Target: ATXN1; (-) strand; PAM type: YTN; PAM sequence: CTA
tccagtgggtttcaggaacc

SEQ ID NO: 164762 - DNA, 20 bp, Artificial Sequence
  Description of Artificial Sequence: Synthetic oligonucleotide
  Target: ATXN1; (-) strand; PAM type: YTN; PAM sequence: TTG
gtactatccagtgggtttca

SEQ ID NO: 164763 - DNA, 20 bp, Artificial Sequence
  Description of Artificial Sequence: Synthetic oligonucleotide
  Target: ATXN1; (-) strand; PAM type: YTN; PAM sequence: TTT
ggtactatccagtgggtttc

SEQ ID NO: 164764 - DNA, 20 bp, Artificial Sequence
  Description of Artificial Sequence: Synthetic oligonucleotide
  Target: ATXN1; (-) strand; PAM type: YTN; PAM sequence: TTA
tcgtaggtatgtatatatag

SEQ ID NO: 164765 - DNA, 20 bp, Artificial Sequence
  Description of Artificial Sequence: Synthetic oligonucleotide
  Target: ATXN1; (-) strand; PAM type: YTN; PAM sequence: TTT
atcgtaggtatgtatatata

SEQ ID NO: 164766 - DNA, 20 bp, Artificial Sequence
  Description of Artificial Sequence: Synthetic oligonucleotide
  Target: ATXN1; (-) strand; PAM type: YTN; PAM sequence: CTT
tatcgtaggtatgtatatat

SEQ ID NO: 164767 - DNA, 20 bp, Artificial Sequence
  Description of Artificial Sequence: Synthetic oligonucleotide
  Target: ATXN1; (-) strand; PAM type: YTN; PAM sequence: CTA
atgtataaatcaaactttat

SEQ ID NO: 164768 - DNA, 20 bp, Artificial Sequence
  Description of Artificial Sequence: Synthetic oligonucleotide
  Target: ATXN1; (-) strand; PAM type: YTN; PAM sequence: CTG
tgcctaatgtataaatcaaa

SEQ ID NO: 164769 - DNA, 20 bp, Artificial Sequence
  Description of Artificial Sequence: Synthetic oligonucleotide
  Target: ATXN1; (-) strand; PAM type: YTN; PAM sequence: CTC
atactgtgcctaatgtataa

SEQ ID NO: 164770 - DNA, 20 bp, Artificial Sequence
  Description of Artificial Sequence: Synthetic oligonucleotide
  Target: ATXN1; (-) strand; PAM type: YTN; PAM sequence: TTA
atctcatactgtgcctaatg

SEQ ID NO: 164771 - DNA, 20 bp, Artificial Sequence
  Description of Artificial Sequence: Synthetic oligonucleotide
  Target: ATXN1; (-) strand; PAM type: YTN; PAM sequence: TTA
tcattaatctcatactgtgc

SEQ ID NO: 164772 - DNA, 20 bp, Artificial Sequence
  Description of Artificial Sequence: Synthetic oligonucleotide
  Target: ATXN1; (-) strand; PAM type: YTN; PAM sequence: CTA
ttatcattaatctcatactg

SEQ ID NO: 164773 - DNA, 20 bp, Artificial Sequence
  Description of Artificial Sequence: Synthetic oligonucleotide
  Target: ATXN1; (-) strand; PAM type: YTN; PAM sequence: TTA
gctattatcattaatctcat

SEQ ID NO: 164774 - DNA, 20 bp, Artificial Sequence
  Description of Artificial Sequence: Synthetic oligonucleotide
  Target: ATXN1; (-) strand; PAM type: YTN; PAM sequence: TTA
ttagctattatcattaatct

SEQ ID NO: 164775 - DNA, 20 bp, Artificial Sequence
  Description of Artificial Sequence: Synthetic oligonucleotide
  Target: ATXN1; (-) strand; PAM type: YTN; PAM sequence: TTA
ttattagctattatcattaa

SEQ ID NO: 164776 - DNA, 20 bp, Artificial Sequence
  Description of Artificial Sequence: Synthetic oligonucleotide
  Target: ATXN1; (-) strand; PAM type: YTN; PAM sequence: TTT
attattagctattatcatta

SEQ ID NO: 164777 - DNA, 20 bp, Artificial Sequence
  Description of Artificial Sequence: Synthetic oligonucleotide
  Target: ATXN1; (-) strand; PAM type: YTN; PAM sequence: TTT
tattattagctattatcatt

SEQ ID NO: 164778 - DNA, 20 bp, Artificial Sequence
  Description of Artificial Sequence: Synthetic oligonucleotide
  Target: ATXN1; (-) strand; PAM type: YTN; PAM sequence: CTA
ttttattattagctattatc

SEQ ID NO: 164779 - DNA, 20 bp, Artificial Sequence
  Description of Artificial Sequence: Synthetic oligonucleotide
  Target: ATXN1; (-) strand; PAM type: YTN; PAM sequence: TTC
tattttattattagctatta

SEQ ID NO: 164780 - DNA, 20 bp, Artificial Sequence
  Description of Artificial Sequence: Synthetic oligonucleotide
  Target: ATXN1; (-) strand; PAM type: YTN; PAM sequence: TTA
caatcgttctattttattat

SEQ ID NO: 164781 - DNA, 20 bp, Artificial Sequence
  Description of Artificial Sequence: Synthetic oligonucleotide
  Target: ATXN1; (-) strand; PAM type: YTN; PAM sequence: CTG
ttacaatcgttctattttat

SEQ ID NO: 164782 - DNA, 20 bp, Artificial Sequence
  Description of Artificial Sequence: Synthetic oligonucleotide
  Target: ATXN1; (-) strand; PAM type: YTN; PAM sequence: CTG
gcatactgttacaatcgttc

SEQ ID NO: 164783 - DNA, 20 bp, Artificial Sequence
  Description of Artificial Sequence: Synthetic oligonucleotide
  Target: ATXN1; (-) strand; PAM type: YTN; PAM sequence: TTA
gtgatgctggcatactgtta

SEQ ID NO: 164784 - DNA, 20 bp, Artificial Sequence
  Description of Artificial Sequence: Synthetic oligonucleotide
  Target: ATXN1; (-) strand; PAM type: YTN; PAM sequence: CTT
agtgatgctggcatactgtt

SEQ ID NO: 164785 - DNA, 20 bp, Artificial Sequence
  Description of Artificial Sequence: Synthetic oligonucleotide
  Target: ATXN1; (-) strand; PAM type: YTN; PAM sequence: TTA
atgatggtcccaaagcactt

SEQ ID NO: 164786 - DNA, 20 bp, Artificial Sequence
  Description of Artificial Sequence: Synthetic oligonucleotide
  Target: ATXN1; (-) strand; PAM type: YTN; PAM sequence: CTT
aatgatggtcccaaagcact

SEQ ID NO: 164787 - DNA, 20 bp, Artificial Sequence
  Description of Artificial Sequence: Synthetic oligonucleotide
  Target: ATXN1; (-) strand; PAM type: YTN; PAM sequence: TTA
cttaatgatggtcccaaagc

SEQ ID NO: 164788 - DNA, 20 bp, Artificial Sequence
  Description of Artificial Sequence: Synthetic oligonucleotide
  Target: ATXN1; (-) strand; PAM type: YTN; PAM sequence: TTT
acttaatgatggtcccaaag

SEQ ID NO: 164789 - DNA, 20 bp, Artificial Sequence
  Description of Artificial Sequence: Synthetic oligonucleotide
  Target: ATXN1; (-) strand; PAM type: YTN; PAM sequence: TTT
tacttaatgatggtcccaaa

SEQ ID NO: 164790 - DNA, 20 bp, Artificial Sequence
  Description of Artificial Sequence: Synthetic oligonucleotide
  Target: ATXN1; (-) strand; PAM type: YTN; PAM sequence: TTA
ttttacttaatgatggtccc

SEQ ID NO: 164791 - DNA, 20 bp, Artificial Sequence
  Description of Artificial Sequence: Synthetic oligonucleotide
  Target: ATXN1; (-) strand; PAM type: YTN; PAM sequence: TTT
attttacttaatgatggtcc

SEQ ID NO: 164792 - DNA, 20 bp, Artificial Sequence
  Description of Artificial Sequence: Synthetic oligonucleotide
  Target: ATXN1; (-) strand; PAM type: YTN; PAM sequence: CTT
tattttacttaatgatggtc

SEQ ID NO: 164793 - DNA, 20 bp, Artificial Sequence
  Description of Artificial Sequence: Synthetic oligonucleotide
  Target: ATXN1; (-) strand; PAM type: YTN; PAM sequence: TTC
aagtcacctttattttactt

SEQ ID NO: 164794 - DNA, 20 bp, Artificial Sequence
  Description of Artificial Sequence: Synthetic oligonucleotide
  Target: ATXN1; (-) strand; PAM type: YTN; PAM sequence: TTG
tgttcaagtcacctttattt

SEQ ID NO: 164795 - DNA, 20 bp, Artificial Sequence
  Description of Artificial Sequence: Synthetic oligonucleotide
  Target: ATXN1; (-) strand; PAM type: YTN; PAM sequence: CTT
gtgttcaagtcacctttatt

SEQ ID NO: 164796 - DNA, 20 bp, Artificial Sequence
  Description of Artificial Sequence: Synthetic oligonucleotide
  Target: ATXN1; (-) strand; PAM type: YTN; PAM sequence: CTG
tggtgggatggaagtgcttg

SEQ ID NO: 164797 - DNA, 20 bp, Artificial Sequence
  Description of Artificial Sequence: Synthetic oligonucleotide
  Target: ATXN1; (-) strand; PAM type: YTN; PAM sequence: TTA
gatccactgtggtgggatgg

SEQ ID NO: 164798 - DNA, 20 bp, Artificial Sequence
  Description of Artificial Sequence: Synthetic oligonucleotide
  Target: ATXN1; (-) strand; PAM type: YTN; PAM sequence: CTT
agatccactgtggtgggatg

SEQ ID NO: 164799 - DNA, 20 bp, Artificial Sequence
  Description of Artificial Sequence: Synthetic oligonucleotide
  Target: ATXN1; (-) strand; PAM type: YTN; PAM sequence: TTG
gtgcttagatccactgtggt

SEQ ID NO: 164800 - DNA, 20 bp, Artificial Sequence
  Description of Artificial Sequence: Synthetic oligonucleotide
  Target: ATXN1; (-) strand; PAM type: YTN; PAM sequence: CTT
ggtgcttagatccactgtgg

SEQ ID NO: 164801 - DNA, 20 bp, Artificial Sequence
  Description of Artificial Sequence: Synthetic oligonucleotide
  Target: ATXN1; (-) strand; PAM type: YTN; PAM sequence: CTA
gcggccatcttggtgcttag

SEQ ID NO: 164802 - DNA, 20 bp, Artificial Sequence
  Description of Artificial Sequence: Synthetic oligonucleotide
  Target: ATXN1; (-) strand; PAM type: YTN; PAM sequence: CTC
cccgccggtgagtcacctag

SEQ ID NO: 164803 - DNA, 20 bp, Artificial Sequence
  Description of Artificial Sequence: Synthetic oligonucleotide
  Target: ATXN1; (-) strand; PAM type: YTN; PAM sequence: CTG
cgcagcgctccccgccggtg

SEQ ID NO: 164804 - DNA, 20 bp, Artificial Sequence
  Description of Artificial Sequence: Synthetic oligonucleotide
  Target: ATXN1; (-) strand; PAM type: YTN; PAM sequence: TTG
tccgctgcgcagcgctcccc

SEQ ID NO: 164805 - DNA, 20 bp, Artificial Sequence
  Description of Artificial Sequence: Synthetic oligonucleotide
  Target: ATXN1; (-) strand; PAM type: YTN; PAM sequence: CTT
gtccgctgcgcagcgctccc

SEQ ID NO: 164806 - DNA, 20 bp, Artificial Sequence
  Description of Artificial Sequence: Synthetic oligonucleotide
  Target: ATXN1; (-) strand; PAM type: YTN; PAM sequence: CTC
cagcttgtccgctgcgcagc

SEQ ID NO: 164807 - DNA, 20 bp, Artificial Sequence
  Description of Artificial Sequence: Synthetic oligonucleotide
  Target: ATXN1; (-) strand; PAM type: YTN; PAM sequence: TTC
tccagcttgtccgctgcgca

SEQ ID NO: 164808 - DNA, 20 bp, Artificial Sequence
  Description of Artificial Sequence: Synthetic oligonucleotide
  Target: ATXN1; (-) strand; PAM type: YTN; PAM sequence: TTT
ctccagcttgtccgctgcgc

SEQ ID NO: 164809 - DNA, 20 bp, Artificial Sequence
  Description of Artificial Sequence: Synthetic oligonucleotide
  Target: ATXN1; (-) strand; PAM type: YTN; PAM sequence: CTT
tctccagcttgtccgctgcg

SEQ ID NO: 164810 - DNA, 20 bp, Artificial Sequence
  Description of Artificial Sequence: Synthetic oligonucleotide
  Target: ATXN1; (-) strand; PAM type: YTN; PAM sequence: CTA
acgcagacgtgaatcgtccc

SEQ ID NO: 164811 - DNA, 20 bp, Artificial Sequence
  Description of Artificial Sequence: Synthetic oligonucleotide
  Target: ATXN1; (-) strand; PAM type: YTN; PAM sequence: TTA
ccccatcctaacgcagacgt

SEQ ID NO: 164812 - DNA, 20 bp, Artificial Sequence
  Description of Artificial Sequence: Synthetic oligonucleotide
  Target: ATXN1; (-) strand; PAM type: YTN; PAM sequence: CTT
accccatcctaacgcagacg

SEQ ID NO: 164813 - DNA, 20 bp, Artificial Sequence
  Description of Artificial Sequence: Synthetic oligonucleotide
  Target: ATXN1; (-) strand; PAM type: YTN; PAM sequence: CTC
acgccttaccccatcctaac

SEQ ID NO: 164814 - DNA, 20 bp, Artificial Sequence
  Description of Artificial Sequence: Synthetic oligonucleotide
  Target: ATXN1; (-) strand; PAM type: YTN; PAM sequence: CTC
agtagcatgataaaatctca

SEQ ID NO: 164815 - DNA, 20 bp, Artificial Sequence
  Description of Artificial Sequence: Synthetic oligonucleotide
  Target: ATXN1; (-) strand; PAM type: YTN; PAM sequence: TTC
tcagtagcatgataaaatct

SEQ ID NO: 164816 - DNA, 20 bp, Artificial Sequence
  Description of Artificial Sequence: Synthetic oligonucleotide
  Target: ATXN1; (-) strand; PAM type: YTN; PAM sequence: CTG
ttctcagtagcatgataaaa

SEQ ID NO: 164817 - DNA, 20 bp, Artificial Sequence
  Description of Artificial Sequence: Synthetic oligonucleotide
  Target: ATXN1; (-) strand; PAM type: YTN; PAM sequence: TTG
cgtgctgttctcagtagcat

SEQ ID NO: 164818 - DNA, 20 bp, Artificial Sequence
  Description of Artificial Sequence: Synthetic oligonucleotide
  Target: ATXN1; (-) strand; PAM type: YTN; PAM sequence: TTA
agttgcgtgctgttctcagt

SEQ ID NO: 164819 - DNA, 20 bp, Artificial Sequence
  Description of Artificial Sequence: Synthetic oligonucleotide
  Target: ATXN1; (-) strand; PAM type: YTN; PAM sequence: TTT
aagttgcgtgctgttctcag

SEQ ID NO: 164820 - DNA, 20 bp, Artificial Sequence
  Description of Artificial Sequence: Synthetic oligonucleotide
  Target: ATXN1; (-) strand; PAM type: YTN; PAM sequence: TTT
taagttgcgtgctgttctca

SEQ ID NO: 164821 - DNA, 20 bp, Artificial Sequence
  Description of Artificial Sequence: Synthetic oligonucleotide
  Target: ATXN1; (-) strand; PAM type: YTN; PAM sequence: CTA
agttttaagttgcgtgctgt

SEQ ID NO: 164822 - DNA, 20 bp, Artificial Sequence
  Description of Artificial Sequence: Synthetic oligonucleotide
  Target: ATXN1; (-) strand; PAM type: YTN; PAM sequence: TTC
ctaagttttaagttgcgtgc

SEQ ID NO: 164823 - DNA, 20 bp, Artificial Sequence
  Description of Artificial Sequence: Synthetic oligonucleotide
  Target: ATXN1; (-) strand; PAM type: YTN; PAM sequence: TTC
cagaaataaacagttcctaa

SEQ ID NO: 164824 - DNA, 20 bp, Artificial Sequence
  Description of Artificial Sequence: Synthetic oligonucleotide
  Target: ATXN1; (-) strand; PAM type: YTN; PAM sequence: CTG
aaagtatgaaatggaaaatt

SEQ ID NO: 164825 - DNA, 20 bp, Artificial Sequence
  Description of Artificial Sequence: Synthetic oligonucleotide
  Target: ATXN1; (-) strand; PAM type: YTN; PAM sequence: CTG
cagactgaaagtatgaaatg

SEQ ID NO: 164826 - DNA, 20 bp, Artificial Sequence
  Description of Artificial Sequence: Synthetic oligonucleotide
  Target: ATXN1; (-) strand; PAM type: YTN; PAM sequence: CTG
aggccaactgcagactgaaa

SEQ ID NO: 164827 - DNA, 20 bp, Artificial Sequence
  Description of Artificial Sequence: Synthetic oligonucleotide
  Target: ATXN1; (-) strand; PAM type: YTN; PAM sequence: TTC
tgaggccaactgcagactga

SEQ ID NO: 164828 - DNA, 20 bp, Artificial Sequence
  Description of Artificial Sequence: Synthetic oligonucleotide
  Target: ATXN1; (-) strand; PAM type: YTN; PAM sequence: TTT
ctgaggccaactgcagactg

SEQ ID NO: 164829 - DNA, 20 bp, Artificial Sequence
  Description of Artificial Sequence: Synthetic oligonucleotide
  Target: ATXN1; (-) strand; PAM type: YTN; PAM sequence: TTG
atttctgaggccaactgcag

SEQ ID NO: 164830 - DNA, 20 bp, Artificial Sequence
  Description of Artificial Sequence: Synthetic oligonucleotide
  Target: ATXN1; (-) strand; PAM type: YTN; PAM sequence: TTA
tccgcaggttgatttctgag

SEQ ID NO: 164831 - DNA, 20 bp, Artificial Sequence
  Description of Artificial Sequence: Synthetic oligonucleotide
  Target: ATXN1; (-) strand; PAM type: YTN; PAM sequence: CTA
gaacaccgcagccagacgtc

SEQ ID NO: 164832 - DNA, 20 bp, Artificial Sequence
  Description of Artificial Sequence: Synthetic oligonucleotide
  Target: ATXN1; (-) strand; PAM type: YTN; PAM sequence: TTC
ctagaacaccgcagccagac

SEQ ID NO: 164833 - DNA, 20 bp, Artificial Sequence
  Description of Artificial Sequence: Synthetic oligonucleotide
  Target: ATXN1; (-) strand; PAM type: YTN; PAM sequence: TTT
cctagaacaccgcagccaga

SEQ ID NO: 164834 - DNA, 20 bp, Artificial Sequence
  Description of Artificial Sequence: Synthetic oligonucleotide
  Target: ATXN1; (-) strand; PAM type: YTN; PAM sequence: TTT
tcctagaacaccgcagccag

SEQ ID NO: 164835 - DNA, 20 bp, Artificial Sequence
  Description of Artificial Sequence: Synthetic oligonucleotide
  Target: ATXN1; (-) strand; PAM type: YTN; PAM sequence: TTA
gtgtggagtattttcctaga

SEQ ID NO: 164836 - DNA, 20 bp, Artificial Sequence
  Description of Artificial Sequence: Synthetic oligonucleotide
  Target: ATXN1; (-) strand; PAM type: YTN; PAM sequence: TTT
agtgtggagtattttcctag

SEQ ID NO: 164837 - DNA, 20 bp, Artificial Sequence
  Description of Artificial Sequence: Synthetic oligonucleotide
  Target: ATXN1; (-) strand; PAM type: YTN; PAM sequence: TTA
gtttagtgtggagtattttc

SEQ ID NO: 164838 - DNA, 20 bp, Artificial Sequence
  Description of Artificial Sequence: Synthetic oligonucleotide
  Target: ATXN1; (-) strand; PAM type: YTN; PAM sequence: TTT
agtttagtgtggagtatttt

SEQ ID NO: 164839 - DNA, 20 bp, Artificial Sequence
  Description of Artificial Sequence: Synthetic oligonucleotide
  Target: ATXN1; (-) strand; PAM type: YTN; PAM sequence: CTT
tagtttagtgtggagtattt

SEQ ID NO: 164840 - DNA, 20 bp, Artificial Sequence
  Description of Artificial Sequence: Synthetic oligonucleotide
  Target: ATXN1; (-) strand; PAM type: YTN; PAM sequence: CTC
ctttagtttagtgtggagta

SEQ ID NO: 164841 - DNA, 20 bp, Artificial Sequence
  Description of Artificial Sequence: Synthetic oligonucleotide
  Target: ATXN1; (-) strand; PAM type: YTN; PAM sequence: TTG
agacacctcctttagtttag

SEQ ID NO: 164842 - DNA, 20 bp, Artificial Sequence
  Description of Artificial Sequence: Synthetic oligonucleotide
  Target: ATXN1; (-) strand; PAM type: YTN; PAM sequence: TTG
ttgagacacctcctttagtt

SEQ ID NO: 164843 - DNA, 20 bp, Artificial Sequence
  Description of Artificial Sequence: Synthetic oligonucleotide
  Target: ATXN1; (-) strand; PAM type: YTN; PAM sequence: CTT
gttgagacacctcctttagt

SEQ ID NO: 164844 - DNA, 20 bp, Artificial Sequence
  Description of Artificial Sequence: Synthetic oligonucleotide
  Target: ATXN1; (-) strand; PAM type: YTN; PAM sequence: CTC
agccttgttgagacacctcc

SEQ ID NO: 164845 - DNA, 20 bp, Artificial Sequence
  Description of Artificial Sequence: Synthetic oligonucleotide
  Target: ATXN1; (-) strand; PAM type: YTN; PAM sequence: TTC
tcagccttgttgagacacct

SEQ ID NO: 164846 - DNA, 20 bp, Artificial Sequence
  Description of Artificial Sequence: Synthetic oligonucleotide
  Target: ATXN1; (-) strand; PAM type: YTN; PAM sequence: CTC
gttctcagccttgttgagac

SEQ ID NO: 164847 - DNA, 20 bp, Artificial Sequence
  Description of Artificial Sequence: Synthetic oligonucleotide
  Target: ATXN1; (-) strand; PAM type: YTN; PAM sequence: CTG
tcatagacctcgttctcagc

SEQ ID NO: 164848 - DNA, 20 bp, Artificial Sequence
  Description of Artificial Sequence: Synthetic oligonucleotide
  Target: ATXN1; (-) strand; PAM type: YTN; PAM sequence: TTC
tgtcatagacctcgttctca

SEQ ID NO: 164849 - DNA, 20 bp, Artificial Sequence
  Description of Artificial Sequence: Synthetic oligonucleotide
  Target: ATXN1; (-) strand; PAM type: YTN; PAM sequence: TTT
ctgtcatagacctcgttctc

SEQ ID NO: 164850 - DNA, 20 bp, Artificial Sequence
  Description of Artificial Sequence: Synthetic oligonucleotide
  Target: ATXN1; (-) strand; PAM type: YTN; PAM sequence: TTG
gcacatttctgtcatagacc

SEQ ID NO: 164851 - DNA, 20 bp, Artificial Sequence
  Description of Artificial Sequence: Synthetic oligonucleotide
  Target: ATXN1; (-) strand; PAM type: YTN; PAM sequence: CTT
ggcacatttctgtcatagac

SEQ ID NO: 164852 - DNA, 20 bp, Artificial Sequence
  Description of Artificial Sequence: Synthetic oligonucleotide
  Target: ATXN1; (-) strand; PAM type: YTN; PAM sequence: TTC
ttggcacatttctgtcatag

SEQ ID NO: 164853 - DNA, 20 bp, Artificial Sequence
  Description of Artificial Sequence: Synthetic oligonucleotide
  Target: ATXN1; (-) strand; PAM type: YTN; PAM sequence: TTT
cttggcacatttctgtcata

SEQ ID NO: 164854 - DNA, 20 bp, Artificial Sequence
  Description of Artificial Sequence: Synthetic oligonucleotide
  Target: ATXN1; (-) strand; PAM type: YTN; PAM sequence: CTT
tcttggcacatttctgtcat

SEQ ID NO: 164855 - DNA, 20 bp, Artificial Sequence
  Description of Artificial Sequence: Synthetic oligonucleotide
  Target: ATXN1; (-) strand; PAM type: YTN; PAM sequence: CTG
ctttcttggcacatttctgt

SEQ ID NO: 164856 - DNA, 20 bp, Artificial Sequence
  Description of Artificial Sequence: Synthetic oligonucleotide
  Target: ATXN1; (-) strand; PAM type: YTN; PAM sequence: TTC
tgctttcttggcacatttct

SEQ ID NO: 164857 - DNA, 20 bp, Artificial Sequence
  Description of Artificial Sequence: Synthetic oligonucleotide
  Target: ATXN1; (-) strand; PAM type: YTN; PAM sequence: TTT
ctgctttcttggcacatttc

SEQ ID NO: 164858 - DNA, 20 bp, Artificial Sequence
  Description of Artificial Sequence: Synthetic oligonucleotide
  Target: ATXN1; (-) strand; PAM type: YTN; PAM sequence: CTT
tctgctttcttggcacattt

SEQ ID NO: 164859 - DNA, 20 bp, Artificial Sequence
  Description of Artificial Sequence: Synthetic oligonucleotide
  Target: ATXN1; (-) strand; PAM type: YTN; PAM sequence: TTC
ctttctgctttcttggcaca

SEQ ID NO: 164860 - DNA, 20 bp, Artificial Sequence
  Description of Artificial Sequence: Synthetic oligonucleotide
  Target: ATXN1; (-) strand; PAM type: YTN; PAM sequence: TTT
cctttctgctttcttggcac

SEQ ID NO: 164861 - DNA, 20 bp, Artificial Sequence
  Description of Artificial Sequence: Synthetic oligonucleotide
  Target: ATXN1; (-) strand; PAM type: YTN; PAM sequence: TTT
tcctttctgctttcttggca

SEQ ID NO: 164862 - DNA, 20 bp, Artificial Sequence
  Description of Artificial Sequence: Synthetic oligonucleotide
  Target: ATXN1; (-) strand; PAM type: YTN; PAM sequence: CTT
ttcctttctgctttcttggc

SEQ ID NO: 164863 - DNA, 20 bp, Artificial Sequence
  Description of Artificial Sequence: Synthetic oligonucleotide
  Target: ATXN1; (-) strand; PAM type: YTN; PAM sequence: CTA
tgagcgcttttcctttctgc

SEQ ID NO: 164864 - DNA, 20 bp, Artificial Sequence
  Description of Artificial Sequence: Synthetic oligonucleotide
  Target: ATXN1; (-) strand; PAM type: YTN; PAM sequence: TTC
tatgagcgcttttcctttct

SEQ ID NO: 164865 - DNA, 20 bp, Artificial Sequence
  Description of Artificial Sequence: Synthetic oligonucleotide
  Target: ATXN1; (-) strand; PAM type: YTN; PAM sequence: TTC
cccattctatgagcgctttt

SEQ ID NO: 164866 - DNA, 20 bp, Artificial Sequence
  Description of Artificial Sequence: Synthetic oligonucleotide
  Target: ATXN1; (-) strand; PAM type: YTN; PAM sequence: CTA
accaaccagcagcattcccc

SEQ ID NO: 164867 - DNA, 20 bp, Artificial Sequence
  Description of Artificial Sequence: Synthetic oligonucleotide
  Target: ATXN1; (-) strand; PAM type: YTN; PAM sequence: CTG
aagccactaaccaaccagca

SEQ ID NO: 164868 - DNA, 20 bp, Artificial Sequence
  Description of Artificial Sequence: Synthetic oligonucleotide
  Target: ATXN1; (-) strand; PAM type: YTN; PAM sequence: TTC
tgaagccactaaccaaccag

SEQ ID NO: 164869 - DNA, 20 bp, Artificial Sequence
  Description of Artificial Sequence: Synthetic oligonucleotide
  Target: ATXN1; (-) strand; PAM type: YTN; PAM sequence: TTT
ctgaagccactaaccaacca

SEQ ID NO: 164870 - DNA, 20 bp, Artificial Sequence
  Description of Artificial Sequence: Synthetic oligonucleotide
  Target: ATXN1; (-) strand; PAM type: YTN; PAM sequence: CTT
tctgaagccactaaccaacc

SEQ ID NO: 164871 - DNA, 20 bp, Artificial Sequence
  Description of Artificial Sequence: Synthetic oligonucleotide
  Target: ATXN1; (-) strand; PAM type: YTN; PAM sequence: TTA
agagaatcagacacctttct

SEQ ID NO: 164872 - DNA, 20 bp, Artificial Sequence
  Description of Artificial Sequence: Synthetic oligonucleotide
  Target: ATXN1; (-) strand; PAM type: YTN; PAM sequence: TTG
ttaagagaatcagacacctt

SEQ ID NO: 164873 - DNA, 20 bp, Artificial Sequence
  Description of Artificial Sequence: Synthetic oligonucleotide
  Target: ATXN1; (-) strand; PAM type: YTN; PAM sequence: CTT
gttaagagaatcagacacct

SEQ ID NO: 164874 - DNA, 20 bp, Artificial Sequence
  Description of Artificial Sequence: Synthetic oligonucleotide
  Target: ATXN1; (-) strand; PAM type: YTN; PAM sequence: TTG
cttgttaagagaatcagaca

SEQ ID NO: 164875 - DNA, 20 bp, Artificial Sequence
  Description of Artificial Sequence: Synthetic oligonucleotide
  Target: ATXN1; (-) strand; PAM type: YTN; PAM sequence: CTG
taattgcttgttaagagaat

SEQ ID NO: 164876 - DNA, 20 bp, Artificial Sequence
  Description of Artificial Sequence: Synthetic oligonucleotide
  Target: ATXN1; (-) strand; PAM type: YTN; PAM sequence: CTC
ctgtaattgcttgttaagag

SEQ ID NO: 164877 - DNA, 20 bp, Artificial Sequence
  Description of Artificial Sequence: Synthetic oligonucleotide
  Target: ATXN1; (-) strand; PAM type: YTN; PAM sequence: CTA
caggtgtgagccaccatgcc

SEQ ID NO: 164878 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgtgagccac

SEQ ID NO: 164879 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggactacag

SEQ ID NO: 164880 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 164881 - DNA, 20 bp, Artificial Sequence
  Description of Artificial Sequence: Synthetic oligonucleotide
  Target: ATXN1; (-) strand; PAM type: YTN; PAM sequence: CTG
accccaagatccgcccacct

SEQ ID NO: 164882 - DNA, 20 bp, Artificial Sequence
  Description of Artificial Sequence: Synthetic oligonucleotide
  Target: ATXN1; (-) strand; PAM type: YTN; PAM sequence: CTC
ctgaccccaagatccgccca

SEQ ID NO: 164883 - DNA, 20 bp, Artificial Sequence
  Description of Artificial Sequence: Synthetic oligonucleotide
  Target: ATXN1; (-) strand; PAM type: YTN; PAM sequence: CTC
gaactcctgaccccaagatc

SEQ ID NO: 164884 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctgacccca

SEQ ID NO: 164885 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtctcgaactc

SEQ ID NO: 164886 - DNA, 20 bp, Artificial Sequence
  Description of Artificial Sequence: Synthetic oligonucleotide
  Target: ATXN1; (-) strand; PAM type: YTN; PAM sequence: TTG
gcatgttggccaggctggtc

SEQ ID NO: 164887 - DNA, 20 bp, Artificial Sequence
  Description of Artificial Sequence: Synthetic oligonucleotide
  Target: ATXN1; (-) strand; PAM type: YTN; PAM sequence: TTT
ggcatgttggccaggctggt

SEQ ID NO: 164888 - DNA, 20 bp, Artificial Sequence
  Description of Artificial Sequence: Synthetic oligonucleotide
  Target: ATXN1; (-) strand; PAM type: YTN; PAM sequence: TTT
tggcatgttggccaggctgg

SEQ ID NO: 164889 - DNA, 20 bp, Artificial Sequence
  Description of Artificial Sequence: Synthetic oligonucleotide
  Target: ATXN1; (-) strand; PAM type: YTN; PAM sequence: TTA
gtagagacgggggttttggc

SEQ ID NO: 164890 - DNA, 20 bp, Artificial Sequence
  Description of Artificial Sequence: Synthetic oligonucleotide
  Target: ATXN1; (-) strand; PAM type: YTN; PAM sequence: TTT
agtagagacgggggttttgg

SEQ ID NO: 164891 - DNA, 20 bp, Artificial Sequence
  Description of Artificial Sequence: Synthetic oligonucleotide
  Target: ATXN1; (-) strand; PAM type: YTN; PAM sequence: TTT
tagtagagacgggggttttg

SEQ ID NO: 164892 - DNA, 20 bp, Artificial Sequence
  Description of Artificial Sequence: Synthetic oligonucleotide
  Target: ATXN1; (-) strand; PAM type: YTN; PAM sequence: TTG
tagttttagtagagacgggg

SEQ ID NO: 164893 - DNA, 20 bp, Artificial Sequence
  Description of Artificial Sequence: Synthetic oligonucleotide
  Target: ATXN1; (-) strand; PAM type: YTN; PAM sequence: TTT
gtagttttagtagagacggg

SEQ ID NO: 164894 - DNA, 20 bp, Artificial Sequence
  Description of Artificial Sequence: Synthetic oligonucleotide
  Target: ATXN1; (-) strand; PAM type: YTN; PAM sequence: TTT
tgtagttttagtagagacgg

SEQ ID NO: 164895 - DNA, 20 bp, Artificial Sequence
  Description of Artificial Sequence: Synthetic oligonucleotide
  Target: ATXN1; (-) strand; PAM type: YTN; PAM sequence: TTT
ttgtagttttagtagagacg

SEQ ID NO: 164896 - DNA, 20 bp, Artificial Sequence
  Description of Artificial Sequence: Synthetic oligonucleotide
  Target: ATXN1; (-) strand; PAM type: YTN; PAM sequence: CTA
atttttgtagttttagtaga

SEQ ID NO: 164897 - DNA, 20 bp, Artificial Sequence
  Description of Artificial Sequence: Synthetic oligonucleotide
  Target: ATXN1; (-) strand; PAM type: YTN; PAM sequence: CTG
gctaatttttgtagttttag

SEQ ID NO: 164898 - DNA, 20 bp, Artificial Sequence
  Description of Artificial Sequence: Synthetic oligonucleotide
  Target: ATXN1; (-) strand; PAM type: YTN; PAM sequence: TTA
caggcacaagccaccatgcc

SEQ ID NO: 164899 - DNA, 20 bp, Artificial Sequence
  Description of Artificial Sequence: Synthetic oligonucleotide
  Target: ATXN1; (-) strand; PAM type: YTN; PAM sequence: CTG
agtagcagggattacaggca

SEQ ID NO: 164900 - DNA, 20 bp, Artificial Sequence
  Description of Artificial Sequence: Synthetic oligonucleotide
  Target: ATXN1; (-) strand; PAM type: YTN; PAM sequence: CTC
ctgagtagcagggattacag

SEQ ID NO: 164901 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagcaggga

SEQ ID NO: 164902 - DNA, 20 bp, Artificial Sequence
  Description of Artificial Sequence: Synthetic oligonucleotide
  Target: ATXN1; (-) strand; PAM type: YTN; PAM sequence: CTC
atgcctcagcctcctgagta

SEQ ID NO: 164903 - DNA, 20 bp, Artificial Sequence
  Description of Artificial Sequence: Synthetic oligonucleotide
  Target: ATXN1; (-) strand; PAM type: YTN; PAM sequence: TTC
tcatgcctcagcctcctgag

SEQ ID NO: 164904 - DNA, 20 bp, Artificial Sequence
  Description of Artificial Sequence: Synthetic oligonucleotide
  Target: ATXN1; (-) strand; PAM type: YTN; PAM sequence: TTC
aagtgattctcatgcctcag

SEQ ID NO: 164905 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagtgattctca

SEQ ID NO: 164906 - DNA, 20 bp, Artificial Sequence
  Description of Artificial Sequence: Synthetic oligonucleotide
  Target: ATXN1; (-) strand; PAM type: YTN; PAM sequence: CTC
cgcctcccaggttcaagtga

SEQ ID NO: 164907 - DNA, 20 bp, Artificial Sequence
  Description of Artificial Sequence: Synthetic oligonucleotide
  Target: ATXN1; (-) strand; PAM type: YTN; PAM sequence: TTG
caacctccgcctcccaggtt

SEQ ID NO: 164908 - DNA, 20 bp, Artificial Sequence
  Description of Artificial Sequence: Synthetic oligonucleotide
  Target: ATXN1; (-) strand; PAM type: YTN; PAM sequence: CTC
attgcaacctccgcctccca

SEQ ID NO: 164909 - DNA, 20 bp, Artificial Sequence
  Description of Artificial Sequence: Synthetic oligonucleotide
  Target: ATXN1; (-) strand; PAM type: YTN; PAM sequence: CTC
agctcattgcaacctccgcc

SEQ ID NO: 164910 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgcaatctc

SEQ ID NO: 164911 - DNA, 20 bp, Artificial Sequence
  Description of Artificial Sequence: Synthetic oligonucleotide
  Target: ATXN1; (-) strand; PAM type: YTN; PAM sequence: CTG
tcgtccaggctggagtgcag

SEQ ID NO: 164912 - DNA, 20 bp, Artificial Sequence
  Description of Artificial Sequence: Synthetic oligonucleotide
  Target: ATXN1; (-) strand; PAM type: YTN; PAM sequence: CTC
tgtcgtccaggctggagtgc

SEQ ID NO: 164913 - DNA, 20 bp, Artificial Sequence
  Description of Artificial Sequence: Synthetic oligonucleotide
  Target: ATXN1; (-) strand; PAM type: YTN; PAM sequence: TTG
ctctgtcgtccaggctggag

SEQ ID NO: 164914 - DNA, 20 bp, Artificial Sequence
  Description of Artificial Sequence: Synthetic oligonucleotide
  Target: ATXN1; (-) strand; PAM type: YTN; PAM sequence: CTT
gctctgtcgtccaggctgga

SEQ ID NO: 164915 - DNA, 20 bp, Artificial Sequence
  Description of Artificial Sequence: Synthetic oligonucleotide
  Target: ATXN1; (-) strand; PAM type: YTN; PAM sequence: TTG
agacaaggtcttgctctgtc

SEQ ID NO: 164916 - DNA, 20 bp, Artificial Sequence
  Description of Artificial Sequence: Synthetic oligonucleotide
  Target: ATXN1; (-) strand; PAM type: YTN; PAM sequence: TTT
gagacaaggtcttgctctgt

SEQ ID NO: 164917 - DNA, 20 bp, Artificial Sequence
  Description of Artificial Sequence: Synthetic oligonucleotide
  Target: ATXN1; (-) strand; PAM type: YTN; PAM sequence: TTT
tgagacaaggtcttgctctg

SEQ ID NO: 164918 - DNA, 20 bp, Artificial Sequence
  Description of Artificial Sequence: Synthetic oligonucleotide
  Target: ATXN1; (-) strand; PAM type: YTN; PAM sequence: TTT
ttgagacaaggtcttgctct

SEQ ID NO: 164919 - DNA, 20 bp, Artificial Sequence
  Description of Artificial Sequence: Synthetic oligonucleotide
  Target: ATXN1; (-) strand; PAM type: YTN; PAM sequence: TTT
tttgagacaaggtcttgctc

SEQ ID NO: 164920 - DNA, 20 bp, Artificial Sequence
  Description of Artificial Sequence: Synthetic oligonucleotide
  Target: ATXN1; (-) strand; PAM type: YTN; PAM sequence: TTT
ttttgagacaaggtcttgct

SEQ ID NO: 164921 - DNA, 20 bp, Artificial Sequence
  Description of Artificial Sequence: Synthetic oligonucleotide
  Target: ATXN1; (-) strand; PAM type: YTN; PAM sequence: CTT
tttttgagacaaggtcttgc

SEQ ID NO: 164922 - DNA, 20 bp, Artificial Sequence
  Description of Artificial Sequence: Synthetic oligonucleotide
  Target: ATXN1; (-) strand; PAM type: YTN; PAM sequence: TTG
ctttttttgagacaaggtct

SEQ ID NO: 164923 - DNA, 20 bp, Artificial Sequence
  Description of Artificial Sequence: Synthetic oligonucleotide
  Target: ATXN1; (-) strand; PAM type: YTN; PAM sequence: TTT
gctttttttgagacaaggtc

SEQ ID NO: 164924 - DNA, 20 bp, Artificial Sequence
  Description of Artificial Sequence: Synthetic oligonucleotide
  Target: ATXN1; (-) strand; PAM type: YTN; PAM sequence: TTT
tgctttttttgagacaaggt

SEQ ID NO: 164925 - DNA, 20 bp, Artificial Sequence
  Description of Artificial Sequence: Synthetic oligonucleotide
  Target: ATXN1; (-) strand; PAM type: YTN; PAM sequence: TTT
ttgctttttttgagacaagg

SEQ ID NO: 164926 - DNA, 20 bp, Artificial Sequence
  Description of Artificial Sequence: Synthetic oligonucleotide
  Target: ATXN1; (-) strand; PAM type: YTN; PAM sequence: TTT
tttgctttttttgagacaag

SEQ ID NO: 164927 - DNA, 20 bp, Artificial Sequence
  Description of Artificial Sequence: Synthetic oligonucleotide
  Target: ATXN1; (-) strand; PAM type: YTN; PAM sequence: TTG
ttttttgctttttttgagac

SEQ ID NO: 164928 - DNA, 20 bp, Artificial Sequence
  Description of Artificial Sequence: Synthetic oligonucleotide
  Target: ATXN1; (-) strand; PAM type: YTN; PAM sequence: TTT
gttttttgctttttttgaga

SEQ ID NO: 164929 - DNA, 20 bp, Artificial Sequence
  Description of Artificial Sequence: Synthetic oligonucleotide
  Target: ATXN1; (-) strand; PAM type: YTN; PAM sequence: TTT
tgttttttgctttttttgag

SEQ ID NO: 164930 - DNA, 20 bp, Artificial Sequence
  Description of Artificial Sequence: Synthetic oligonucleotide
  Target: ATXN1; (-) strand; PAM type: YTN; PAM sequence: TTT
ttgttttttgctttttttga

SEQ ID NO: 164931 - DNA, 20 bp, Artificial Sequence
  Description of Artificial Sequence: Synthetic oligonucleotide
  Target: ATXN1; (-) strand; PAM type: YTN; PAM sequence: TTT
tttgttttttgctttttttg

SEQ ID NO: 164932 - DNA, 20 bp, Artificial Sequence
  Description of Artificial Sequence: Synthetic oligonucleotide
  Target: ATXN1; (-) strand; PAM type: YTN; PAM sequence: TTG
tggttttttgttttttgctt

SEQ ID NO: 164933 - DNA, 20 bp, Artificial Sequence
  Description of Artificial Sequence: Synthetic oligonucleotide
  Target: ATXN1; (-) strand; PAM type: YTN; PAM sequence: TTG
taattgtggttttttgtttt

SEQ ID NO: 164934 - DNA, 20 bp, Artificial Sequence
  Description of Artificial Sequence: Synthetic oligonucleotide
  Target: ATXN1; (-) strand; PAM type: YTN; PAM sequence: TTT
gtaattgtggttttttgttt

SEQ ID NO: 164935 - DNA, 20 bp, Artificial Sequence
  Description of Artificial Sequence: Synthetic oligonucleotide
  Target: ATXN1; (-) strand; PAM type: YTN; PAM sequence: TTA
atggccaagtgtgtttgtaa

SEQ ID NO: 164936 - DNA, 20 bp, Artificial Sequence
  Description of Artificial Sequence: Synthetic oligonucleotide
  Target: ATXN1; (-) strand; PAM type: YTN; PAM sequence: TTT
aatggccaagtgtgtttgta

SEQ ID NO: 164937 - DNA, 20 bp, Artificial Sequence
  Description of Artificial Sequence: Synthetic oligonucleotide
  Target: ATXN1; (-) strand; PAM type: YTN; PAM sequence: TTC
aagtttaatggccaagtgtg

SEQ ID NO: 164938 - DNA, 20 bp, Artificial Sequence
  Description of Artificial Sequence: Synthetic oligonucleotide
  Target: ATXN1; (-) strand; PAM type: YTN; PAM sequence: CTT
caagtttaatggccaagtgt

SEQ ID NO: 164939 - DNA, 20 bp, Artificial Sequence
  Description of Artificial Sequence: Synthetic oligonucleotide
  Target: ATXN1; (-) strand; PAM type: YTN; PAM sequence: CTG
cttcaagtttaatggccaag

SEQ ID NO: 164940 - DNA, 20 bp, Artificial Sequence
  Description of Artificial Sequence: Synthetic oligonucleotide
  Target: ATXN1; (-) strand; PAM type: YTN; PAM sequence: TTC
actgcttcaagtttaatggc

SEQ ID NO: 164941 - DNA, 20 bp, Artificial Sequence
  Description of Artificial Sequence: Synthetic oligonucleotide
  Target: ATXN1; (-) strand; PAM type: YTN; PAM sequence: TTT
cactgcttcaagtttaatgg

SEQ ID NO: 164942 - DNA, 20 bp, Artificial Sequence
  Description of Artificial Sequence: Synthetic oligonucleotide
  Target: ATXN1; (-) strand; PAM type: YTN; PAM sequence: TTT
tcactgcttcaagtttaatg

SEQ ID NO: 164943 - DNA, 20 bp, Artificial Sequence
  Description of Artificial Sequence: Synthetic oligonucleotide
  Target: ATXN1; (-) strand; PAM type: YTN; PAM sequence: TTT
ttcactgcttcaagtttaat

SEQ ID NO: 164944 - DNA, 20 bp, Artificial Sequence
  Description of Artificial Sequence: Synthetic oligonucleotide
  Target: ATXN1; (-) strand; PAM type: YTN; PAM sequence: CTG
tttttcactgcttcaagttt

SEQ ID NO: 164945 - DNA, 20 bp, Artificial Sequence
  Description of Artificial Sequence: Synthetic oligonucleotide
  Target: ATXN1; (-) strand; PAM type: YTN; PAM sequence: CTC
gtagacgaagctgtttttca

SEQ ID NO: 164946 - DNA, 20 bp, Artificial Sequence
  Description of Artificial Sequence: Synthetic oligonucleotide
  Target: ATXN1; (-) strand; PAM type: YTN; PAM sequence: TTC
tcgtagacgaagctgttttt

SEQ ID NO: 164947 - DNA, 20 bp, Artificial Sequence
  Description of Artificial Sequence: Synthetic oligonucleotide
  Target: ATXN1; (-) strand; PAM type: YTN; PAM sequence: TTA
ttctcgtagacgaagctgtt

SEQ ID NO: 164948 - DNA, 20 bp, Artificial Sequence
  Description of Artificial Sequence: Synthetic oligonucleotide
  Target: ATXN1; (-) strand; PAM type: YTN; PAM sequence: TTT
attctcgtagacgaagctgt

SEQ ID NO: 164949 - DNA, 20 bp, Artificial Sequence
  Description of Artificial Sequence: Synthetic oligonucleotide
  Target: ATXN1; (-) strand; PAM type: YTN; PAM sequence: TTA
tttattctcgtagacgaagc

SEQ ID NO: 164950 - DNA, 20 bp, Artificial Sequence
  Description of Artificial Sequence: Synthetic oligonucleotide
  Target: ATXN1; (-) strand; PAM type: YTN; PAM sequence: TTT
atttattctcgtagacgaag

SEQ ID NO: 164951 - DNA, 20 bp, Artificial Sequence
  Description of Artificial Sequence: Synthetic oligonucleotide
  Target: ATXN1; (-) strand; PAM type: YTN; PAM sequence: TTA
tttatttattctcgtagacg

SEQ ID NO: 164952 - DNA, 20 bp, Artificial Sequence
  Description of Artificial Sequence: Synthetic oligonucleotide
  Target: ATXN1; (-) strand; PAM type: YTN; PAM sequence: TTT
atttatttattctcgtagac

SEQ ID NO: 164953 - DNA, 20 bp, Artificial Sequence
  Description of Artificial Sequence: Synthetic oligonucleotide
  Target: ATXN1; (-) strand; PAM type: YTN; PAM sequence: TTT
tatttatttattctcgtaga

SEQ ID NO: 164954 - DNA, 20 bp, Artificial Sequence
  Description of Artificial Sequence: Synthetic oligonucleotide
  Target: ATXN1; (-) strand; PAM type: YTN; PAM sequence: TTT
ttatttatttattctcgtag

SEQ ID NO: 164955 - DNA, 20 bp, Artificial Sequence
  Description of Artificial Sequence: Synthetic oligonucleotide
  Target: ATXN1; (-) strand; PAM type: YTN; PAM sequence: CTG
tagcagtttttatttattta

SEQ ID NO: 164956 - DNA, 20 bp, Artificial Sequence
  Description of Artificial Sequence: Synthetic oligonucleotide
  Target: ATXN1; (-) strand; PAM type: YTN; PAM sequence: TTA
aagcataatgcctgtagcag

SEQ ID NO: 164957 - DNA, 20 bp, Artificial Sequence
  Description of Artificial Sequence: Synthetic oligonucleotide
  Target: ATXN1; (-) strand; PAM type: YTN; PAM sequence: CTT
aaagcataatgcctgtagca

SEQ ID NO: 164958 - DNA, 20 bp, Artificial Sequence
  Description of Artificial Sequence: Synthetic oligonucleotide
  Target: ATXN1; (-) strand; PAM type: YTN; PAM sequence: TTG
tgatcttaaagcataatgcc

SEQ ID NO: 164959 - DNA, 20 bp, Artificial Sequence
  Description of Artificial Sequence: Synthetic oligonucleotide
  Target: ATXN1; (-) strand; PAM type: YTN; PAM sequence: CTC
atgcacgattgtgatcttaa

SEQ ID NO: 164960 - DNA, 20 bp, Artificial Sequence
  Description of Artificial Sequence: Synthetic oligonucleotide
  Target: ATXN1; (-) strand; PAM type: YTN; PAM sequence: CTG
taatgtcctcatgcacgatt

SEQ ID NO: 164961 - DNA, 20 bp, Artificial Sequence
  Description of Artificial Sequence: Synthetic oligonucleotide
  Target: ATXN1; (-) strand; PAM type: YTN; PAM sequence: CTC
actgtaatgtcctcatgcac

SEQ ID NO: 164962 - DNA, 20 bp, Artificial Sequence
  Description of Artificial Sequence: Synthetic oligonucleotide
  Target: ATXN1; (-) strand; PAM type: YTN; PAM sequence: CTC
aggggaccctcactgtaatg

SEQ ID NO: 164963 - DNA, 20 bp, Artificial Sequence
  Description of Artificial Sequence: Synthetic oligonucleotide
  Target: ATXN1; (-) strand; PAM type: YTN; PAM sequence: TTA
tcgactcaggggaccctcac

SEQ ID NO: 164964 - DNA, 20 bp, Artificial Sequence
  Description of Artificial Sequence: Synthetic oligonucleotide
  Target: ATXN1; (-) strand; PAM type: YTN; PAM sequence: CTG
attatcgactcaggggaccc

SEQ ID NO: 164965 - DNA, 20 bp, Artificial Sequence
  Description of Artificial Sequence: Synthetic oligonucleotide
  Target: ATXN1; (-) strand; PAM type: YTN; PAM sequence: TTC
tgattatcgactcaggggac

SEQ ID NO: 164966 - DNA, 20 bp, Artificial Sequence
  Description of Artificial Sequence: Synthetic oligonucleotide
  Target: ATXN1; (-) strand; PAM type: YTN; PAM sequence: TTT
ctgattatcgactcagggga

SEQ ID NO: 164967 - DNA, 20 bp, Artificial Sequence
  Description of Artificial Sequence: Synthetic oligonucleotide
  Target: ATXN1; (-) strand; PAM type: YTN; PAM sequence: TTA
cagcatcacatgtatttctg

SEQ ID NO: 164968 - DNA, 20 bp, Artificial Sequence
  Description of Artificial Sequence: Synthetic oligonucleotide
  Target: ATXN1; (-) strand; PAM type: YTN; PAM sequence: TTT
acagcatcacatgtatttct

SEQ ID NO: 164969 - DNA, 20 bp, Artificial Sequence
  Description of Artificial Sequence: Synthetic oligonucleotide
  Target: ATXN1; (-) strand; PAM type: YTN; PAM sequence: TTT
tacagcatcacatgtatttc

SEQ ID NO: 164970 - DNA, 20 bp, Artificial Sequence
  Description of Artificial Sequence: Synthetic oligonucleotide
  Target: ATXN1; (-) strand; PAM type: YTN; PAM sequence: TTT
ttacagcatcacatgtattt

SEQ ID NO: 164971 - DNA, 20 bp, Artificial Sequence
  Description of Artificial Sequence: Synthetic oligonucleotide
  Target: ATXN1; (-) strand; PAM type: YTN; PAM sequence: CTA
cagaggatgtgtatttttac

SEQ ID NO: 164972 - DNA, 20 bp, Artificial Sequence
  Description of Artificial Sequence: Synthetic oligonucleotide
  Target: ATXN1; (-) strand; PAM type: YTN; PAM sequence: TTG
ggaaactacagaggatgtgt

SEQ ID NO: 164973 - DNA, 20 bp, Artificial Sequence
  Description of Artificial Sequence: Synthetic oligonucleotide
  Target: ATXN1; (-) strand; PAM type: YTN; PAM sequence: CTT
gggaaactacagaggatgtg

SEQ ID NO: 164974 - DNA, 20 bp, Artificial Sequence
  Description of Artificial Sequence: Synthetic oligonucleotide
  Target: ATXN1; (-) strand; PAM type: YTN; PAM sequence: CTA
cacaatcttgggaaactaca

SEQ ID NO: 164975 - DNA, 20 bp, Artificial Sequence
  Description of Artificial Sequence: Synthetic oligonucleotide
  Target: ATXN1; (-) strand; PAM type: YTN; PAM sequence: CTA
ggtcccagcccagacctaca

SEQ ID NO: 164976 - DNA, 20 bp, Artificial Sequence
  Description of Artificial Sequence: Synthetic oligonucleotide
  Target: ATXN1; (-) strand; PAM type: YTN; PAM sequence: TTC
ctaggtcccagcccagacct

SEQ ID NO: 164977 - DNA, 20 bp, Artificial Sequence
  Description of Artificial Sequence: Synthetic oligonucleotide
  Target: ATXN1; (-) strand; PAM type: YTN; PAM sequence: TTA
aaatacagattcctaggtcc

SEQ ID NO: 164978 - DNA, 20 bp, Artificial Sequence
  Description of Artificial Sequence: Synthetic oligonucleotide
  Target: ATXN1; (-) strand; PAM type: YTN; PAM sequence: TTT
aaaatacagattcctaggtc

SEQ ID NO: 164979 - DNA, 20 bp, Artificial Sequence
  Description of Artificial Sequence: Synthetic oligonucleotide
  Target: ATXN1; (-) strand; PAM type: YTN; PAM sequence: TTT
taaaatacagattcctaggt

SEQ ID NO: 164980 - DNA, 20 bp, Artificial Sequence
  Description of Artificial Sequence: Synthetic oligonucleotide
  Target: ATXN1; (-) strand; PAM type: YTN; PAM sequence: TTT
ttaaaatacagattcctagg

SEQ ID NO: 164981 - DNA, 20 bp, Artificial Sequence
  Description of Artificial Sequence: Synthetic oligonucleotide
  Target: ATXN1; (-) strand; PAM type: YTN; PAM sequence: CTG
ccaatcagaatcaccaaaag

SEQ ID NO: 164982 - DNA, 20 bp, Artificial Sequence
  Description of Artificial Sequence: Synthetic oligonucleotide
  Target: ATXN1; (-) strand; PAM type: YTN; PAM sequence: CTA
gctgccaatcagaatcacca

SEQ ID NO: 164983 - DNA, 20 bp, Artificial Sequence
  Description of Artificial Sequence: Synthetic oligonucleotide
  Target: ATXN1; (-) strand; PAM type: YTN; PAM sequence: TTC
cccaacctagctgccaatca

SEQ ID NO: 164984 - DNA, 20 bp, Artificial Sequence
  Description of Artificial Sequence: Synthetic oligonucleotide
  Target: ATXN1; (-) strand; PAM type: YTN; PAM sequence: CTA
gtgtagtagttccccaacct

SEQ ID NO: 164985 - DNA, 20 bp, Artificial Sequence
  Description of Artificial Sequence: Synthetic oligonucleotide
  Target: ATXN1; (-) strand; PAM type: YTN; PAM sequence: TTA
agaagcacaggtctagtgta

SEQ ID NO: 164986 - DNA, 20 bp, Artificial Sequence
  Description of Artificial Sequence: Synthetic oligonucleotide
  Target: ATXN1; (-) strand; PAM type: YTN; PAM sequence: CTG
ccaaggttaagaagcacagg

SEQ ID NO: 164987 - DNA, 20 bp, Artificial Sequence
  Description of Artificial Sequence: Synthetic oligonucleotide
  Target: ATXN1; (-) strand; PAM type: YTN; PAM sequence: CTG
tgctgccaaggttaagaagc

SEQ ID NO: 164988 - DNA, 20 bp, Artificial Sequence
  Description of Artificial Sequence: Synthetic oligonucleotide
  Target: ATXN1; (-) strand; PAM type: YTN; PAM sequence: CTC
ctgtgctgccaaggttaaga

SEQ ID NO: 164989 - DNA, 20 bp, Artificial Sequence
  Description of Artificial Sequence: Synthetic oligonucleotide
  Target: ATXN1; (-) strand; PAM type: YTN; PAM sequence: TTC
tcctgtgctgccaaggttaa

SEQ ID NO: 164990 - DNA, 20 bp, Artificial Sequence
  Description of Artificial Sequence: Synthetic oligonucleotide
  Target: ATXN1; (-) strand; PAM type: YTN; PAM sequence: TTC
caggtgattctcctgtgctg

SEQ ID NO: 164991 - DNA, 20 bp, Artificial Sequence
  Description of Artificial Sequence: Synthetic oligonucleotide
  Target: ATXN1; (-) strand; PAM type: YTN; PAM sequence: TTT
ccaggtgattctcctgtgct

SEQ ID NO: 164992 - DNA, 20 bp, Artificial Sequence
  Description of Artificial Sequence: Synthetic oligonucleotide
  Target: ATXN1; (-) strand; PAM type: YTN; PAM sequence: CTT
tccaggtgattctcctgtgc

SEQ ID NO: 164993 - DNA, 20 bp, Artificial Sequence
  Description of Artificial Sequence: Synthetic oligonucleotide
  Target: ATXN1; (-) strand; PAM type: YTN; PAM sequence: TTC
aaaatctttccaggtgattc

SEQ ID NO: 164994 - DNA, 20 bp, Artificial Sequence
  Description of Artificial Sequence: Synthetic oligonucleotide
  Target: ATXN1; (-) strand; PAM type: YTN; PAM sequence: TTT
caaaatctttccaggtgatt

SEQ ID NO: 164995 - DNA, 20 bp, Artificial Sequence
  Description of Artificial Sequence: Synthetic oligonucleotide
  Target: ATXN1; (-) strand; PAM type: YTN; PAM sequence: TTT
tcaaaatctttccaggtgat

SEQ ID NO: 164996 - DNA, 20 bp, Artificial Sequence
  Description of Artificial Sequence: Synthetic oligonucleotide
  Target: ATXN1; (-) strand; PAM type: YTN; PAM sequence: CTT
ttcaaaatctttccaggtga

SEQ ID NO: 164997 - DNA, 20 bp, Artificial Sequence
  Description of Artificial Sequence: Synthetic oligonucleotide
  Target: ATXN1; (-) strand; PAM type: YTN; PAM sequence: CTG
gagtgtggtgtgaccggcaa

SEQ ID NO: 164998 - DNA, 20 bp, Artificial Sequence
  Description of Artificial Sequence: Synthetic oligonucleotide
  Target: ATXN1; (-) strand; PAM type: YTN; PAM sequence: TTC
agtggcctggagtgtggtgt

SEQ ID NO: 164999 - DNA, 20 bp, Artificial Sequence
  Description of Artificial Sequence: Synthetic oligonucleotide
  Target: ATXN1; (-) strand; PAM type: YTN; PAM sequence: CTG
agttcagtggcctggagtgt

SEQ ID NO: 165000 - DNA, 20 bp, Artificial Sequence
  Description of Artificial Sequence: Synthetic oligonucleotide
  Target: ATXN1; (-) strand; PAM type: YTN; PAM sequence: TTC
tgagttcagtggcctggagt

SEQ ID NO: 165001 - DNA, 20 bp, Artificial Sequence
  Description of Artificial Sequence: Synthetic oligonucleotide
  Target: ATXN1; (-) strand; PAM type: YTN; PAM sequence: CTA
taggttctgagttcagtggc

SEQ ID NO: 165002 - DNA, 20 bp, Artificial Sequence
  Description of Artificial Sequence: Synthetic oligonucleotide
  Target: ATXN1; (-) strand; PAM type: YTN; PAM sequence: CTC
cgaccctataggttctgagt

SEQ ID NO: 165003 - DNA, 20 bp, Artificial Sequence
  Description of Artificial Sequence: Synthetic oligonucleotide
  Target: ATXN1; (-) strand; PAM type: YTN; PAM sequence: CTG
atacccactccgaccctata

SEQ ID NO: 165004 - DNA, 20 bp, Artificial Sequence
  Description of Artificial Sequence: Synthetic oligonucleotide
  Target: ATXN1; (-) strand; PAM type: YTN; PAM sequence: TTG
aaatcactgatacccactcc

SEQ ID NO: 165005 - DNA, 20 bp, Artificial Sequence
  Description of Artificial Sequence: Synthetic oligonucleotide
  Target: ATXN1; (-) strand; PAM type: YTN; PAM sequence: CTG
cacattgaaatcactgatac

SEQ ID NO: 165006 - DNA, 20 bp, Artificial Sequence
  Description of Artificial Sequence: Synthetic oligonucleotide
  Target: ATXN1; (-) strand; PAM type: YTN; PAM sequence: CTC
aaccatggctgcacattgaa

SEQ ID NO: 165007 - DNA, 20 bp, Artificial Sequence
  Description of Artificial Sequence: Synthetic oligonucleotide
  Target: ATXN1; (-) strand; PAM type: YTN; PAM sequence: TTC
tcaaccatggctgcacattg

SEQ ID NO: 165008 - DNA, 20 bp, Artificial Sequence
  Description of Artificial Sequence: Synthetic oligonucleotide
  Target: ATXN1; (-) strand; PAM type: YTN; PAM sequence: CTG
attctcaaccatggctgcac

SEQ ID NO: 165009 - DNA, 20 bp, Artificial Sequence
  Description of Artificial Sequence: Synthetic oligonucleotide
  Target: ATXN1; (-) strand; PAM type: YTN; PAM sequence: CTG
cactgattctcaaccatggc

SEQ ID NO: 165010 - DNA, 20 bp, Artificial Sequence
  Description of Artificial Sequence: Synthetic oligonucleotide
  Target: ATXN1; (-) strand; PAM type: YTN; PAM sequence: CTG
agggtccactgcactgattc

SEQ ID NO: 165011 - DNA, 20 bp, Artificial Sequence
  Description of Artificial Sequence: Synthetic oligonucleotide
  Target: ATXN1; (-) strand; PAM type: YTN; PAM sequence: CTC
cgtcagggaactgagggtcc

SEQ ID NO: 165012 - DNA, 20 bp, Artificial Sequence
  Description of Artificial Sequence: Synthetic oligonucleotide
  Target: ATXN1; (-) strand; PAM type: YTN; PAM sequence: TTC
ctccgtcagggaactgaggg

SEQ ID NO: 165013 - DNA, 20 bp, Artificial Sequence
  Description of Artificial Sequence: Synthetic oligonucleotide
  Target: ATXN1; (-) strand; PAM type: YTN; PAM sequence: TTA
gggaggtacatacatgaata

SEQ ID NO: 165014 - DNA, 20 bp, Artificial Sequence
  Description of Artificial Sequence: Synthetic oligonucleotide
  Target: ATXN1; (-) strand; PAM type: YTN; PAM sequence: TTT
agggaggtacatacatgaat

SEQ ID NO: 165015 - DNA, 20 bp, Artificial Sequence
  Description of Artificial Sequence: Synthetic oligonucleotide
  Target: ATXN1; (-) strand; PAM type: YTN; PAM sequence: TTT
tagggaggtacatacatgaa

SEQ ID NO: 165016 - DNA, 20 bp, Artificial Sequence
  Description of Artificial Sequence: Synthetic oligonucleotide
  Target: ATXN1; (-) strand; PAM type: YTN; PAM sequence: CTG
ttttagggaggtacatacat

SEQ ID NO: 165017 - DNA, 20 bp, Artificial Sequence
  Description of Artificial Sequence: Synthetic oligonucleotide
  Target: ATXN1; (-) strand; PAM type: YTN; PAM sequence: TTG
tggagggcactgttttaggg

SEQ ID NO: 165018 - DNA, 20 bp, Artificial Sequence
  Description of Artificial Sequence: Synthetic oligonucleotide
  Target: ATXN1; (-) strand; PAM type: YTN; PAM sequence: TTA
ttgtggagggcactgtttta

SEQ ID NO: 165019 - DNA, 20 bp, Artificial Sequence
  Description of Artificial Sequence: Synthetic oligonucleotide
  Target: ATXN1; (-) strand; PAM type: YTN; PAM sequence: TTT
attgtggagggcactgtttt

SEQ ID NO: 165020 - DNA, 20 bp, Artificial Sequence
  Description of Artificial Sequence: Synthetic oligonucleotide
  Target: ATXN1; (-) strand; PAM type: YTN; PAM sequence: CTT
tattgtggagggcactgttt

SEQ ID NO: 165021 - DNA, 20 bp, Artificial Sequence
  Description of Artificial Sequence: Synthetic oligonucleotide
  Target: ATXN1; (-) strand; PAM type: YTN; PAM sequence: CTG
gctttattgtggagggcact

SEQ ID NO: 165022 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaataagtgaaa

SEQ ID NO: 165023 - DNA, 20 bp, Artificial Sequence
  Description of Artificial Sequence: Synthetic oligonucleotide
  Target: ATXN1; (-) strand; PAM type: YTN; PAM sequence: CTC
catctcaaaaaaaaaaataa

SEQ ID NO: 165024 - DNA, 20 bp, Artificial Sequence
  Description of Artificial Sequence: Synthetic oligonucleotide
  Target: ATXN1; (-) strand; PAM type: YTN; PAM sequence: CTG
ggcgacagagcgagactcca

SEQ ID NO: 165025 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcgacagagcga

SEQ ID NO: 165026 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggcgacag

SEQ ID NO: 165027 - DNA, 20 bp, Artificial Sequence
  Description of Artificial Sequence: Synthetic oligonucleotide
  Target: ATXN1; (-) strand; PAM type: YTN; PAM sequence: TTG
caccactgcactccagcctg

SEQ ID NO: 165028 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagattgcacc

SEQ ID NO: 165029 - DNA, 20 bp, Artificial Sequence
  Description of Artificial Sequence: Synthetic oligonucleotide
  Target: ATXN1; (-) strand; PAM type: YTN; PAM sequence: TTG
aacccaggaggcagaggttg

SEQ ID NO: 165030 - DNA, 20 bp, Artificial Sequence
  Description of Artificial Sequence: Synthetic oligonucleotide
  Target: ATXN1; (-) strand; PAM type: YTN; PAM sequence: CTT
gaacccaggaggcagaggtt

SEQ ID NO: 165031 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcgcttgaa

SEQ ID NO: 165032 - DNA, 20 bp, Artificial Sequence
  Description of Artificial Sequence: Synthetic oligonucleotide
  Target: ATXN1; (-) strand; PAM type: YTN; PAM sequence: CTA
gagaggctgaggcaggagaa

SEQ ID NO: 165033 - DNA, 20 bp, Artificial Sequence
  Description of Artificial Sequence: Synthetic oligonucleotide
  Target: ATXN1; (-) strand; PAM type: YTN; PAM sequence: CTA
ctagagaggctgaggcagga

SEQ ID NO: 165034 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctactagagag

SEQ ID NO: 165035 - DNA, 20 bp, Artificial Sequence
  Description of Artificial Sequence: Synthetic oligonucleotide
  Target: ATXN1; (-) strand; PAM type: YTN; PAM sequence: TTA
gccaggcatggtggcgcaca

SEQ ID NO: 165036 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaaattagcca

SEQ ID NO: 165037 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaaattag

SEQ ID NO: 165038 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaaatt

SEQ ID NO: 165039 - DNA, 20 bp, Artificial Sequence
  Description of Artificial Sequence: Synthetic oligonucleotide
  Target: ATXN1; (-) strand; PAM type: YTN; PAM sequence: CTA
acacagtgaaatcccgtctc

SEQ ID NO: 165040 - DNA, 20 bp, Artificial Sequence
  Description of Artificial Sequence: Synthetic oligonucleotide
  Target: ATXN1; (-) strand; PAM type: YTN; PAM sequence: CTG
gctaacacagtgaaatcccg

SEQ ID NO: 165041 - DNA, 20 bp, Artificial Sequence
  Description of Artificial Sequence: Synthetic oligonucleotide
  Target: ATXN1; (-) strand; PAM type: YTN; PAM sequence: TTG
agaccatcctggctaacaca

SEQ ID NO: 165042 - DNA, 20 bp, Artificial Sequence
  Description of Artificial Sequence: Synthetic oligonucleotide
  Target: ATXN1; (-) strand; PAM type: YTN; PAM sequence: CTG
aggcaggtagatcaggaggt

SEQ ID NO: 165043 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggtagat

SEQ ID NO: 165044 - DNA, 20 bp, Artificial Sequence
  Description of Artificial Sequence: Synthetic oligonucleotide
  Target: ATXN1; (-) strand; PAM type: YTN; PAM sequence: TTT
gggaggctgaggcaggtaga

SEQ ID NO: 165045 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgaggcaggtag

SEQ ID NO: 165046 - DNA, 20 bp, Artificial Sequence
  Description of Artificial Sequence: Synthetic oligonucleotide
  Target: ATXN1; (-) strand; PAM type: YTN; PAM sequence: CTG
taatccccacactttgggag

SEQ ID NO: 165047 - DNA, 20 bp, Artificial Sequence
  Description of Artificial Sequence: Synthetic oligonucleotide
  Target: ATXN1; (-) strand; PAM type: YTN; PAM sequence: TTA
taaaatagaagggtccgagt

SEQ ID NO: 165048 - DNA, 20 bp, Artificial Sequence
  Description of Artificial Sequence: Synthetic oligonucleotide
  Target: ATXN1; (-) strand; PAM type: YTN; PAM sequence: TTT
ataaaatagaagggtccgag

SEQ ID NO: 165049 - DNA, 20 bp, Artificial Sequence
  Description of Artificial Sequence: Synthetic oligonucleotide
  Target: ATXN1; (-) strand; PAM type: YTN; PAM sequence: CTT
tataaaatagaagggtccga

SEQ ID NO: 165050 - DNA, 20 bp, Artificial Sequence
  Description of Artificial Sequence: Synthetic oligonucleotide
  Target: ATXN1; (-) strand; PAM type: YTN; PAM sequence: TTC
catgtgtaacccagctttat

SEQ ID NO: 165051 - DNA, 20 bp, Artificial Sequence
  Description of Artificial Sequence: Synthetic oligonucleotide
  Target: ATXN1; (-) strand; PAM type: YTN; PAM sequence: TTA
atacaaacaaattccatgtg

SEQ ID NO: 165052 - DNA, 20 bp, Artificial Sequence
  Description of Artificial Sequence: Synthetic oligonucleotide
  Target: ATXN1; (-) strand; PAM type: YTN; PAM sequence: TTT
aatacaaacaaattccatgt

SEQ ID NO: 165053 - DNA, 20 bp, Artificial Sequence
  Description of Artificial Sequence: Synthetic oligonucleotide
  Target: ATXN1; (-) strand; PAM type: YTN; PAM sequence: TTG
gtttaatacaaacaaattcc

SEQ ID NO: 165054 - DNA, 20 bp, Artificial Sequence
  Description of Artificial Sequence: Synthetic oligonucleotide
  Target: ATXN1; (-) strand; PAM type: YTN; PAM sequence: CTT
ggtttaatacaaacaaattc

SEQ ID NO: 165055 - DNA, 20 bp, Artificial Sequence
  Description of Artificial Sequence: Synthetic oligonucleotide
  Target: ATXN1; (-) strand; PAM type: YTN; PAM sequence: CTG
ggaaaagcttggtttaatac

SEQ ID NO: 165056 - DNA, 20 bp, Artificial Sequence
  Description of Artificial Sequence: Synthetic oligonucleotide
  Target: ATXN1; (-) strand; PAM type: YTN; PAM sequence: TTC
tgggaaaagcttggtttaat

SEQ ID NO: 165057 - DNA, 20 bp, Artificial Sequence
  Description of Artificial Sequence: Synthetic oligonucleotide
  Target: ATXN1; (-) strand; PAM type: YTN; PAM sequence: TTT
ctgggaaaagcttggtttaa

SEQ ID NO: 165058 - DNA, 20 bp, Artificial Sequence
  Description of Artificial Sequence: Synthetic oligonucleotide
  Target: ATXN1; (-) strand; PAM type: YTN; PAM sequence: TTT
tctgggaaaagcttggttta

SEQ ID NO: 165059 - DNA, 20 bp, Artificial Sequence
  Description of Artificial Sequence: Synthetic oligonucleotide
  Target: ATXN1; (-) strand; PAM type: YTN; PAM sequence: TTG
ttttctgggaaaagcttggt

SEQ ID NO: 165060 - DNA, 20 bp, Artificial Sequence
  Description of Artificial Sequence: Synthetic oligonucleotide
  Target: ATXN1; (-) strand; PAM type: YTN; PAM sequence: TTT
gttttctgggaaaagcttgg

SEQ ID NO: 165061 - DNA, 20 bp, Artificial Sequence
  Description of Artificial Sequence: Synthetic oligonucleotide
  Target: ATXN1; (-) strand; PAM type: YTN; PAM sequence: TTT
tgttttctgggaaaagcttg

SEQ ID NO: 165062 - DNA, 20 bp, Artificial Sequence
  Description of Artificial Sequence: Synthetic oligonucleotide
  Target: ATXN1; (-) strand; PAM type: YTN; PAM sequence: CTC
gattttgttttctgggaaaa

SEQ ID NO: 165063 - DNA, 20 bp, Artificial Sequence
  Description of Artificial Sequence: Synthetic oligonucleotide
  Target: ATXN1; (-) strand; PAM type: YTN; PAM sequence: TTA
aaaggactcgattttgtttt

SEQ ID NO: 165064 - DNA, 20 bp, Artificial Sequence
  Description of Artificial Sequence: Synthetic oligonucleotide
  Target: ATXN1; (-) strand; PAM type: YTN; PAM sequence: TTT
aaaaggactcgattttgttt

SEQ ID NO: 165065 - DNA, 20 bp, Artificial Sequence
  Description of Artificial Sequence: Synthetic oligonucleotide
  Target: ATXN1; (-) strand; PAM type: YTN; PAM sequence: TTG
tttaaaaggactcgattttg

SEQ ID NO: 165066 - DNA, 20 bp, Artificial Sequence
  Description of Artificial Sequence: Synthetic oligonucleotide
  Target: ATXN1; (-) strand; PAM type: YTN; PAM sequence: TTT
gtttaaaaggactcgatttt

SEQ ID NO: 165067 - DNA, 20 bp, Artificial Sequence
  Description of Artificial Sequence: Synthetic oligonucleotide
  Target: ATXN1; (-) strand; PAM type: YTN; PAM sequence: CTT
tgtttaaaaggactcgattt

SEQ ID NO: 165068 - DNA, 20 bp, Artificial Sequence
  Description of Artificial Sequence: Synthetic oligonucleotide
  Target: ATXN1; (-) strand; PAM type: YTN; PAM sequence: CTA
aaaactttgtttaaaaggac

SEQ ID NO: 165069 - DNA, 20 bp, Artificial Sequence
  Description of Artificial Sequence: Synthetic oligonucleotide
  Target: ATXN1; (-) strand; PAM type: YTN; PAM sequence: CTA
aatatctaaaaactttgttt

SEQ ID NO: 165070 - DNA, 20 bp, Artificial Sequence
  Description of Artificial Sequence: Synthetic oligonucleotide
  Target: ATXN1; (-) strand; PAM type: YTN; PAM sequence: CTC
taaatatctaaaaactttgt

SEQ ID NO: 165071 - DNA, 20 bp, Artificial Sequence
  Description of Artificial Sequence: Synthetic oligonucleotide
  Target: ATXN1; (-) strand; PAM type: YTN; PAM sequence: TTA
tcctctaaatatctaaaaac

SEQ ID NO: 165072 - DNA, 20 bp, Artificial Sequence
  Description of Artificial Sequence: Synthetic oligonucleotide
  Target: ATXN1; (-) strand; PAM type: YTN; PAM sequence: TTA
tattatcctctaaatatcta

SEQ ID NO: 165073 - DNA, 20 bp, Artificial Sequence
  Description of Artificial Sequence: Synthetic oligonucleotide
  Target: ATXN1; (-) strand; PAM type: YTN; PAM sequence: CTC
aaagtgtagataattatatt

SEQ ID NO: 165074 - DNA, 20 bp, Artificial Sequence
  Description of Artificial Sequence: Synthetic oligonucleotide
  Target: ATXN1; (-) strand; PAM type: YTN; PAM sequence: CTC
acccctcaaagtgtagataa

SEQ ID NO: 165075 - DNA, 20 bp, Artificial Sequence
  Description of Artificial Sequence: Synthetic oligonucleotide
  Target: ATXN1; (-) strand; PAM type: YTN; PAM sequence: CTC
tcacccctcaaagtgtagat

SEQ ID NO: 165076 - DNA, 20 bp, Artificial Sequence
  Description of Artificial Sequence: Synthetic oligonucleotide
  Target: ATXN1; (-) strand; PAM type: YTN; PAM sequence: TTA
gagctctcacccctcaaagt

SEQ ID NO: 165077 - DNA, 20 bp, Artificial Sequence
  Description of Artificial Sequence: Synthetic oligonucleotide
  Target: ATXN1; (-) strand; PAM type: YTN; PAM sequence: TTT
agagctctcacccctcaaag

SEQ ID NO: 165078 - DNA, 20 bp, Artificial Sequence
  Description of Artificial Sequence: Synthetic oligonucleotide
  Target: ATXN1; (-) strand; PAM type: YTN; PAM sequence: TTT
tagagctctcacccctcaaa

SEQ ID NO: 165079 - DNA, 20 bp, Artificial Sequence
  Description of Artificial Sequence: Synthetic oligonucleotide
  Target: ATXN1; (-) strand; PAM type: YTN; PAM sequence: TTT
ttagagctctcacccctcaa

SEQ ID NO: 165080 - DNA, 20 bp, Artificial Sequence
  Description of Artificial Sequence: Synthetic oligonucleotide
  Target: ATXN1; (-) strand; PAM type: YTN; PAM sequence: CTT
tttagagctctcacccctca

SEQ ID NO: 165081 - DNA, 20 bp, Artificial Sequence
  Description of Artificial Sequence: Synthetic oligonucleotide
  Target: ATXN1; (-) strand; PAM type: YTN; PAM sequence: TTC
tttttagagctctcacccct

SEQ ID NO: 165082 - DNA, 20 bp, Artificial Sequence
  Description of Artificial Sequence: Synthetic oligonucleotide
  Target: ATXN1; (-) strand; PAM type: YTN; PAM sequence: CTA
aggttctttttagagctctc

SEQ ID NO: 165083 - DNA, 20 bp, Artificial Sequence
  Description of Artificial Sequence: Synthetic oligonucleotide
  Target: ATXN1; (-) strand; PAM type: YTN; PAM sequence: CTC
caagcaactaaggttctttt

SEQ ID NO: 165084 - DNA, 20 bp, Artificial Sequence
  Description of Artificial Sequence: Synthetic oligonucleotide
  Target: ATXN1; (-) strand; PAM type: YTN; PAM sequence: TTG
cctccaagcaactaaggttc

SEQ ID NO: 165085 - DNA, 20 bp, Artificial Sequence
  Description of Artificial Sequence: Synthetic oligonucleotide
  Target: ATXN1; (-) strand; PAM type: YTN; PAM sequence: TTG
ttgcctccaagcaactaagg

SEQ ID NO: 165086 - DNA, 20 bp, Artificial Sequence
  Description of Artificial Sequence: Synthetic oligonucleotide
  Target: ATXN1; (-) strand; PAM type: YTN; PAM sequence: CTT
gttgcctccaagcaactaag

SEQ ID NO: 165087 - DNA, 20 bp, Artificial Sequence
  Description of Artificial Sequence: Synthetic oligonucleotide
  Target: ATXN1; (-) strand; PAM type: YTN; PAM sequence: CTA
cttgttgcctccaagcaact

SEQ ID NO: 165088 - DNA, 20 bp, Artificial Sequence
  Description of Artificial Sequence: Synthetic oligonucleotide
  Target: ATXN1; (-) strand; PAM type: YTN; PAM sequence: TTG
atctacttgttgcctccaag

SEQ ID NO: 165089 - DNA, 20 bp, Artificial Sequence
  Description of Artificial Sequence: Synthetic oligonucleotide
  Target: ATXN1; (-) strand; PAM type: YTN; PAM sequence: CTT
gatctacttgttgcctccaa

SEQ ID NO: 165090 - DNA, 20 bp, Artificial Sequence
  Description of Artificial Sequence: Synthetic oligonucleotide
  Target: ATXN1; (-) strand; PAM type: YTN; PAM sequence: CTC
ttgatctacttgttgcctcc

SEQ ID NO: 165091 - DNA, 20 bp, Artificial Sequence
  Description of Artificial Sequence: Synthetic oligonucleotide
  Target: ATXN1; (-) strand; PAM type: YTN; PAM sequence: TTC
ctcttgatctacttgttgcc

SEQ ID NO: 165092 - DNA, 20 bp, Artificial Sequence
  Description of Artificial Sequence: Synthetic oligonucleotide
  Target: ATXN1; (-) strand; PAM type: YTN; PAM sequence: TTT
cctcttgatctacttgttgc

SEQ ID NO: 165093 - DNA, 20 bp, Artificial Sequence
  Description of Artificial Sequence: Synthetic oligonucleotide
  Target: ATXN1; (-) strand; PAM type: YTN; PAM sequence: CTT
tcctcttgatctacttgttg

SEQ ID NO: 165094 - DNA, 20 bp, Artificial Sequence
  Description of Artificial Sequence: Synthetic oligonucleotide
  Target: ATXN1; (-) strand; PAM type: YTN; PAM sequence: TTG
gtctttcctcttgatctact

SEQ ID NO: 165095 - DNA, 20 bp, Artificial Sequence
  Description of Artificial Sequence: Synthetic oligonucleotide
  Target: ATXN1; (-) strand; PAM type: YTN; PAM sequence: CTG
ttggtctttcctcttgatct

SEQ ID NO: 165096 - DNA, 20 bp, Artificial Sequence
  Description of Artificial Sequence: Synthetic oligonucleotide
  Target: ATXN1; (-) strand; PAM type: YTN; PAM sequence: TTG
tacccatcacaaatcagaag

SEQ ID NO: 165097 - DNA, 20 bp, Artificial Sequence
  Description of Artificial Sequence: Synthetic oligonucleotide
  Target: ATXN1; (-) strand; PAM type: YTN; PAM sequence: CTT
gtacccatcacaaatcagaa

SEQ ID NO: 165098 - DNA, 20 bp, Artificial Sequence
  Description of Artificial Sequence: Synthetic oligonucleotide
  Target: ATXN1; (-) strand; PAM type: YTN; PAM sequence: TTC
ttgtacccatcacaaatcag

SEQ ID NO: 165099 - DNA, 20 bp, Artificial Sequence
  Description of Artificial Sequence: Synthetic oligonucleotide
  Target: ATXN1; (-) strand; PAM type: YTN; PAM sequence: TTT
cttgtacccatcacaaatca

SEQ ID NO: 165100 - DNA, 20 bp, Artificial Sequence
  Description of Artificial Sequence: Synthetic oligonucleotide
  Target: ATXN1; (-) strand; PAM type: YTN; PAM sequence: TTG
tgatgaatatttcttgtacc

SEQ ID NO: 165101 - DNA, 20 bp, Artificial Sequence
  Description of Artificial Sequence: Synthetic oligonucleotide
  Target: ATXN1; (-) strand; PAM type: YTN; PAM sequence: TTT
gtgatgaatatttcttgtac

SEQ ID NO: 165102 - DNA, 20 bp, Artificial Sequence
  Description of Artificial Sequence: Synthetic oligonucleotide
  Target: ATXN1; (-) strand; PAM type: YTN; PAM sequence: CTG
acatttgtgatgaatatttc

SEQ ID NO: 165103 - DNA, 20 bp, Artificial Sequence
  Description of Artificial Sequence: Synthetic oligonucleotide
  Target: ATXN1; (-) strand; PAM type: YTN; PAM sequence: CTG
agacctgacatttgtgatga

SEQ ID NO: 165104 - DNA, 20 bp, Artificial Sequence
  Description of Artificial Sequence: Synthetic oligonucleotide
  Target: ATXN1; (-) strand; PAM type: YTN; PAM sequence: TTG
catatcagaaaatctgagac

SEQ ID NO: 165105 - DNA, 20 bp, Artificial Sequence
  Description of Artificial Sequence: Synthetic oligonucleotide
  Target: ATXN1; (-) strand; PAM type: YTN; PAM sequence: CTT
gcatatcagaaaatctgaga

SEQ ID NO: 165106 - DNA, 20 bp, Artificial Sequence
  Description of Artificial Sequence: Synthetic oligonucleotide
  Target: ATXN1; (-) strand; PAM type: YTN; PAM sequence: TTC
ttgcatatcagaaaatctga

SEQ ID NO: 165107 - DNA, 20 bp, Artificial Sequence
  Description of Artificial Sequence: Synthetic oligonucleotide
  Target: ATXN1; (-) strand; PAM type: YTN; PAM sequence: TTT
cttgcatatcagaaaatctg

SEQ ID NO: 165108 - DNA, 20 bp, Artificial Sequence
  Description of Artificial Sequence: Synthetic oligonucleotide
  Target: ATXN1; (-) strand; PAM type: YTN; PAM sequence: CTG
tagagtttcttgcatatcag

SEQ ID NO: 165109 - DNA, 20 bp, Artificial Sequence
  Description of Artificial Sequence: Synthetic oligonucleotide
  Target: ATXN1; (-) strand; PAM type: YTN; PAM sequence: CTC
tgtagagtttcttgcatatc

SEQ ID NO: 165110 - DNA, 20 bp, Artificial Sequence
  Description of Artificial Sequence: Synthetic oligonucleotide
  Target: ATXN1; (-) strand; PAM type: YTN; PAM sequence: CTC
cactctgtagagtttcttgc

SEQ ID NO: 165111 - DNA, 20 bp, Artificial Sequence
  Description of Artificial Sequence: Synthetic oligonucleotide
  Target: ATXN1; (-) strand; PAM type: YTN; PAM sequence: CTG
ctccactctgtagagtttct

SEQ ID NO: 165112 - DNA, 20 bp, Artificial Sequence
  Description of Artificial Sequence: Synthetic oligonucleotide
  Target: ATXN1; (-) strand; PAM type: YTN; PAM sequence: CTG
ctgctccactctgtagagtt

SEQ ID NO: 165113 - DNA, 20 bp, Artificial Sequence
  Description of Artificial Sequence: Synthetic oligonucleotide
  Target: ATXN1; (-) strand; PAM type: YTN; PAM sequence: CTA
caagaccacatggctgctgc

SEQ ID NO: 165114 - DNA, 20 bp, Artificial Sequence
  Description of Artificial Sequence: Synthetic oligonucleotide
  Target: ATXN1; (-) strand; PAM type: YTN; PAM sequence: CTG
accataggctacaagaccac

SEQ ID NO: 165115 - DNA, 20 bp, Artificial Sequence
  Description of Artificial Sequence: Synthetic oligonucleotide
  Target: ATXN1; (-) strand; PAM type: YTN; PAM sequence: CTC
tgaccataggctacaagacc

SEQ ID NO: 165116 - DNA, 20 bp, Artificial Sequence
  Description of Artificial Sequence: Synthetic oligonucleotide
  Target: ATXN1; (-) strand; PAM type: YTN; PAM sequence: CTG
tgctctgaccataggctaca

SEQ ID NO: 165117 - DNA, 20 bp, Artificial Sequence
  Description of Artificial Sequence: Synthetic oligonucleotide
  Target: ATXN1; (-) strand; PAM type: YTN; PAM sequence: TTC
tgtgctctgaccataggcta

SEQ ID NO: 165118 - DNA, 20 bp, Artificial Sequence
  Description of Artificial Sequence: Synthetic oligonucleotide
  Target: ATXN1; (-) strand; PAM type: YTN; PAM sequence: TTT
ctgtgctctgaccataggct

SEQ ID NO: 165119 - DNA, 20 bp, Artificial Sequence
  Description of Artificial Sequence: Synthetic oligonucleotide
  Target: ATXN1; (-) strand; PAM type: YTN; PAM sequence: TTT
tctgtgctctgaccataggc

SEQ ID NO: 165120 - DNA, 20 bp, Artificial Sequence
  Description of Artificial Sequence: Synthetic oligonucleotide
  Target: ATXN1; (-) strand; PAM type: YTN; PAM sequence: CTG
gaggtattttctgtgctctg

SEQ ID NO: 165121 - DNA, 20 bp, Artificial Sequence
  Description of Artificial Sequence: Synthetic oligonucleotide
  Target: ATXN1; (-) strand; PAM type: YTN; PAM sequence: CTA
tgctggaggtattttctgtg

SEQ ID NO: 165122 - DNA, 20 bp, Artificial Sequence
  Description of Artificial Sequence: Synthetic oligonucleotide
  Target: ATXN1; (-) strand; PAM type: YTN; PAM sequence: CTC
cagctatgctggaggtattt

SEQ ID NO: 165123 - DNA, 20 bp, Artificial Sequence
  Description of Artificial Sequence: Synthetic oligonucleotide
  Target: ATXN1; (-) strand; PAM type: YTN; PAM sequence: CTG
gccagtctccagctatgctg

SEQ ID NO: 165124 - DNA, 20 bp, Artificial Sequence
  Description of Artificial Sequence: Synthetic oligonucleotide
  Target: ATXN1; (-) strand; PAM type: YTN; PAM sequence: CTC
tggccagtctccagctatgc

SEQ ID NO: 165125 - DNA, 20 bp, Artificial Sequence
  Description of Artificial Sequence: Synthetic oligonucleotide
  Target: ATXN1; (-) strand; PAM type: YTN; PAM sequence: CTG
tcagggcctctggccagtct

SEQ ID NO: 165126 - DNA, 20 bp, Artificial Sequence
  Description of Artificial Sequence: Synthetic oligonucleotide
  Target: ATXN1; (-) strand; PAM type: YTN; PAM sequence: TTA
caggacacagtgtgcagctg

SEQ ID NO: 165127 - DNA, 20 bp, Artificial Sequence
  Description of Artificial Sequence: Synthetic oligonucleotide
  Target: ATXN1; (-) strand; PAM type: YTN; PAM sequence: CTA
aagtcaaatatgttacagga

SEQ ID NO: 165128 - DNA, 20 bp, Artificial Sequence
  Description of Artificial Sequence: Synthetic oligonucleotide
  Target: ATXN1; (-) strand; PAM type: YTN; PAM sequence: CTC
caccaagagaggagaaaaag

SEQ ID NO: 165129 - DNA, 20 bp, Artificial Sequence
  Description of Artificial Sequence: Synthetic oligonucleotide
  Target: ATXN1; (-) strand; PAM type: YTN; PAM sequence: CTC
tccaccaagagaggagaaaa

SEQ ID NO: 165130 - DNA, 20 bp, Artificial Sequence
  Description of Artificial Sequence: Synthetic oligonucleotide
  Target: ATXN1; (-) strand; PAM type: YTN; PAM sequence: TTA
aaataaatacctctccacca

SEQ ID NO: 165131 - DNA, 20 bp, Artificial Sequence
  Description of Artificial Sequence: Synthetic oligonucleotide
  Target: ATXN1; (-) strand; PAM type: YTN; PAM sequence: TTC
gtaattaaaataaatacctc

SEQ ID NO: 165132 - DNA, 20 bp, Artificial Sequence
  Description of Artificial Sequence: Synthetic oligonucleotide
  Target: ATXN1; (-) strand; PAM type: YTN; PAM sequence: CTT
cgtaattaaaataaatacct

SEQ ID NO: 165133 - DNA, 20 bp, Artificial Sequence
  Description of Artificial Sequence: Synthetic oligonucleotide
  Target: ATXN1; (-) strand; PAM type: YTN; PAM sequence: TTC
accatacataatagaggact

SEQ ID NO: 165134 - DNA, 20 bp, Artificial Sequence
  Description of Artificial Sequence: Synthetic oligonucleotide
  Target: ATXN1; (-) strand; PAM type: YTN; PAM sequence: TTA
aacagttcaccatacataat

SEQ ID NO: 165135 - DNA, 20 bp, Artificial Sequence
  Description of Artificial Sequence: Synthetic oligonucleotide
  Target: ATXN1; (-) strand; PAM type: YTN; PAM sequence: CTG
ccccagagttaaacagttca

SEQ ID NO: 165136 - DNA, 20 bp, Artificial Sequence
  Description of Artificial Sequence: Synthetic oligonucleotide
  Target: ATXN1; (-) strand; PAM type: YTN; PAM sequence: TTC
aactgccccagagttaaaca

SEQ ID NO: 165137 - DNA, 20 bp, Artificial Sequence
  Description of Artificial Sequence: Synthetic oligonucleotide
  Target: ATXN1; (-) strand; PAM type: YTN; PAM sequence: TTG
aggcagttcaactgccccag

SEQ ID NO: 165138 - DNA, 20 bp, Artificial Sequence
  Description of Artificial Sequence: Synthetic oligonucleotide
  Target: ATXN1; (-) strand; PAM type: YTN; PAM sequence: TTT
gaggcagttcaactgcccca

SEQ ID NO: 165139 - DNA, 20 bp, Artificial Sequence
  Description of Artificial Sequence: Synthetic oligonucleotide
  Target: ATXN1; (-) strand; PAM type: YTN; PAM sequence: CTA
gtttgaggcagttcaactgc

SEQ ID NO: 165140 - DNA, 20 bp, Artificial Sequence
  Description of Artificial Sequence: Synthetic oligonucleotide
  Target: ATXN1; (-) strand; PAM type: YTN; PAM sequence: TTA
tgcagcctagtttgaggcag

SEQ ID NO: 165141 - DNA, 20 bp, Artificial Sequence
  Description of Artificial Sequence: Synthetic oligonucleotide
  Target: ATXN1; (-) strand; PAM type: YTN; PAM sequence: TTT
atgcagcctagtttgaggca

SEQ ID NO: 165142 - DNA, 20 bp, Artificial Sequence
  Description of Artificial Sequence: Synthetic oligonucleotide
  Target: ATXN1; (-) strand; PAM type: YTN; PAM sequence: TTT
tatgcagcctagtttgaggc

SEQ ID NO: 165143 - DNA, 20 bp, Artificial Sequence
  Description of Artificial Sequence: Synthetic oligonucleotide
  Target: ATXN1; (-) strand; PAM type: YTN; PAM sequence: CTG
ttttatgcagcctagtttga

SEQ ID NO: 165144 - DNA, 20 bp, Artificial Sequence
  Description of Artificial Sequence: Synthetic oligonucleotide
  Target: ATXN1; (-) strand; PAM type: YTN; PAM sequence: TTC
tgttttatgcagcctagttt

SEQ ID NO: 165145 - DNA, 20 bp, Artificial Sequence
  Description of Artificial Sequence: Synthetic oligonucleotide
  Target: ATXN1; (-) strand; PAM type: YTN; PAM sequence: CTT
ctgttttatgcagcctagtt

SEQ ID NO: 165146 - DNA, 20 bp, Artificial Sequence
  Description of Artificial Sequence: Synthetic oligonucleotide
  Target: ATXN1; (-) strand; PAM type: YTN; PAM sequence: TTC
cttctgttttatgcagccta

SEQ ID NO: 165147 - DNA, 20 bp, Artificial Sequence
  Description of Artificial Sequence: Synthetic oligonucleotide
  Target: ATXN1; (-) strand; PAM type: YTN; PAM sequence: CTT
ccttctgttttatgcagcct

SEQ ID NO: 165148 - DNA, 20 bp, Artificial Sequence
  Description of Artificial Sequence: Synthetic oligonucleotide
  Target: ATXN1; (-) strand; PAM type: YTN; PAM sequence: CTG
tggaccttccttctgtttta

SEQ ID NO: 165149 - DNA, 20 bp, Artificial Sequence
  Description of Artificial Sequence: Synthetic oligonucleotide
  Target: ATXN1; (-) strand; PAM type: YTN; PAM sequence: CTG
aagcaagcccaggccagtcc

SEQ ID NO: 165150 - DNA, 20 bp, Artificial Sequence
  Description of Artificial Sequence: Synthetic oligonucleotide
  Target: ATXN1; (-) strand; PAM type: YTN; PAM sequence: CTC
agcaaactgaagcaagccca

SEQ ID NO: 165151 - DNA, 20 bp, Artificial Sequence
  Description of Artificial Sequence: Synthetic oligonucleotide
  Target: ATXN1; (-) strand; PAM type: YTN; PAM sequence: CTC
tcagcaaactgaagcaagcc

SEQ ID NO: 165152 - DNA, 20 bp, Artificial Sequence
  Description of Artificial Sequence: Synthetic oligonucleotide
  Target: ATXN1; (-) strand; PAM type: YTN; PAM sequence: CTG
ctctcagcaaactgaagcaa

SEQ ID NO: 165153 - DNA, 20 bp, Artificial Sequence
  Description of Artificial Sequence: Synthetic oligonucleotide
  Target: ATXN1; (-) strand; PAM type: YTN; PAM sequence: TTC
tgctctcagcaaactgaagc

SEQ ID NO: 165154 - DNA, 20 bp, Artificial Sequence
  Description of Artificial Sequence: Synthetic oligonucleotide
  Target: ATXN1; (-) strand; PAM type: YTN; PAM sequence: CTG
ggttctgctctcagcaaact

SEQ ID NO: 165155 - DNA, 20 bp, Artificial Sequence
  Description of Artificial Sequence: Synthetic oligonucleotide
  Target: ATXN1; (-) strand; PAM type: YTN; PAM sequence: CTG
tgggcatccaagctgggttc

SEQ ID NO: 165156 - DNA, 20 bp, Artificial Sequence
  Description of Artificial Sequence: Synthetic oligonucleotide
  Target: ATXN1; (-) strand; PAM type: YTN; PAM sequence: TTG
tgcaaaagtacagcggcatc

SEQ ID NO: 165157 - DNA, 20 bp, Artificial Sequence
  Description of Artificial Sequence: Synthetic oligonucleotide
  Target: ATXN1; (-) strand; PAM type: YTN; PAM sequence: TTT
gtgcaaaagtacagcggcat

SEQ ID NO: 165158 - DNA, 20 bp, Artificial Sequence
  Description of Artificial Sequence: Synthetic oligonucleotide
  Target: ATXN1; (-) strand; PAM type: YTN; PAM sequence: CTG
tatgtaagtttgtgcaaaag

SEQ ID NO: 165159 - DNA, 20 bp, Artificial Sequence
  Description of Artificial Sequence: Synthetic oligonucleotide
  Target: ATXN1; (-) strand; PAM type: YTN; PAM sequence: CTC
tgtatgtaagtttgtgcaaa

SEQ ID NO: 165160 - DNA, 20 bp, Artificial Sequence
  Description of Artificial Sequence: Synthetic oligonucleotide
  Target: ATXN1; (-) strand; PAM type: YTN; PAM sequence: TTA
ggtgctctgtatgtaagttt

SEQ ID NO: 165161 - DNA, 20 bp, Artificial Sequence
  Description of Artificial Sequence: Synthetic oligonucleotide
  Target: ATXN1; (-) strand; PAM type: YTN; PAM sequence: TTT
aggtgctctgtatgtaagtt

SEQ ID NO: 165162 - DNA, 20 bp, Artificial Sequence
  Description of Artificial Sequence: Synthetic oligonucleotide
  Target: ATXN1; (-) strand; PAM type: YTN; PAM sequence: TTT
taggtgctctgtatgtaagt

SEQ ID NO: 165163 - DNA, 20 bp, Artificial Sequence
  Description of Artificial Sequence: Synthetic oligonucleotide
  Target: ATXN1; (-) strand; PAM type: YTN; PAM sequence: CTG
gttttaggtgctctgtatgt

SEQ ID NO: 165164 - DNA, 20 bp, Artificial Sequence
  Description of Artificial Sequence: Synthetic oligonucleotide
  Target: ATXN1; (-) strand; PAM type: YTN; PAM sequence: TTA
ggtgcccctggttttaggtg

SEQ ID NO: 165165 - DNA, 20 bp, Artificial Sequence
  Description of Artificial Sequence: Synthetic oligonucleotide
  Target: ATXN1; (-) strand; PAM type: YTN; PAM sequence: TTT
aggtgcccctggttttaggt

SEQ ID NO: 165166 - DNA, 20 bp, Artificial Sequence
  Description of Artificial Sequence: Synthetic oligonucleotide
  Target: ATXN1; (-) strand; PAM type: YTN; PAM sequence: TTT
taggtgcccctggttttagg

SEQ ID NO: 165167 - DNA, 20 bp, Artificial Sequence
  Description of Artificial Sequence: Synthetic oligonucleotide
  Target: ATXN1; (-) strand; PAM type: YTN; PAM sequence: CTG
gttttaggtgcccctggttt

SEQ ID NO: 165168 - DNA, 20 bp, Artificial Sequence
  Description of Artificial Sequence: Synthetic oligonucleotide
  Target: ATXN1; (-) strand; PAM type: YTN; PAM sequence: CTA
ctggttttaggtgcccctgg

SEQ ID NO: 165169 - DNA, 20 bp, Artificial Sequence
  Description of Artificial Sequence: Synthetic oligonucleotide
  Target: ATXN1; (-) strand; PAM type: YTN; PAM sequence: TTA
ccactactggttttaggtgc

SEQ ID NO: 165170 - DNA, 20 bp, Artificial Sequence
  Description of Artificial Sequence: Synthetic oligonucleotide
  Target: ATXN1; (-) strand; PAM type: YTN; PAM sequence: TTG
gattaccactactggtttta

SEQ ID NO: 165171 - DNA, 20 bp, Artificial Sequence
  Description of Artificial Sequence: Synthetic oligonucleotide
  Target: ATXN1; (-) strand; PAM type: YTN; PAM sequence: TTC
cgtaaaattggattaccact

SEQ ID NO: 165172 - DNA, 20 bp, Artificial Sequence
  Description of Artificial Sequence: Synthetic oligonucleotide
  Target: ATXN1; (-) strand; PAM type: YTN; PAM sequence: TTT
ccgtaaaattggattaccac

SEQ ID NO: 165173 - DNA, 20 bp, Artificial Sequence
  Description of Artificial Sequence: Synthetic oligonucleotide
  Target: ATXN1; (-) strand; PAM type: YTN; PAM sequence: TTT
tccgtaaaattggattacca

SEQ ID NO: 165174 - DNA, 20 bp, Artificial Sequence
  Description of Artificial Sequence: Synthetic oligonucleotide
  Target: ATXN1; (-) strand; PAM type: YTN; PAM sequence: CTG
cagttttccgtaaaattgga

SEQ ID NO: 165175 - DNA, 20 bp, Artificial Sequence
  Description of Artificial Sequence: Synthetic oligonucleotide
  Target: ATXN1; (-) strand; PAM type: YTN; PAM sequence: CTG
ctgcagttttccgtaaaatt

SEQ ID NO: 165176 - DNA, 20 bp, Artificial Sequence
  Description of Artificial Sequence: Synthetic oligonucleotide
  Target: ATXN1; (-) strand; PAM type: YTN; PAM sequence: TTC
ctgctgcagttttccgtaaa

SEQ ID NO: 165177 - DNA, 20 bp, Artificial Sequence
  Description of Artificial Sequence: Synthetic oligonucleotide
  Target: ATXN1; (-) strand; PAM type: YTN; PAM sequence: CTG
gggaaaatggaaggtggcag

SEQ ID NO: 165178 - DNA, 20 bp, Artificial Sequence
  Description of Artificial Sequence: Synthetic oligonucleotide
  Target: ATXN1; (-) strand; PAM type: YTN; PAM sequence: TTA
gtgctggggaaaatggaagg

SEQ ID NO: 165179 - DNA, 20 bp, Artificial Sequence
  Description of Artificial Sequence: Synthetic oligonucleotide
  Target: ATXN1; (-) strand; PAM type: YTN; PAM sequence: CTT
agtgctggggaaaatggaag

SEQ ID NO: 165180 - DNA, 20 bp, Artificial Sequence
  Description of Artificial Sequence: Synthetic oligonucleotide
  Target: ATXN1; (-) strand; PAM type: YTN; PAM sequence: TTC
ttagtgctggggaaaatgga

SEQ ID NO: 165181 - DNA, 20 bp, Artificial Sequence
  Description of Artificial Sequence: Synthetic oligonucleotide
  Target: ATXN1; (-) strand; PAM type: YTN; PAM sequence: CTA
aaagtaggtgttcttagtgc

SEQ ID NO: 165182 - DNA, 20 bp, Artificial Sequence
  Description of Artificial Sequence: Synthetic oligonucleotide
  Target: ATXN1; (-) strand; PAM type: YTN; PAM sequence: CTG
tcactaaaagtaggtgttct

SEQ ID NO: 165183 - DNA, 20 bp, Artificial Sequence
  Description of Artificial Sequence: Synthetic oligonucleotide
  Target: ATXN1; (-) strand; PAM type: YTN; PAM sequence: CTA
gaagagtggcagatgagtca

SEQ ID NO: 165184 - DNA, 20 bp, Artificial Sequence
  Description of Artificial Sequence: Synthetic oligonucleotide
  Target: ATXN1; (-) strand; PAM type: YTN; PAM sequence: CTG
ctagaagagtggcagatgag

SEQ ID NO: 165185 - DNA, 20 bp, Artificial Sequence
  Description of Artificial Sequence: Synthetic oligonucleotide
  Target: ATXN1; (-) strand; PAM type: YTN; PAM sequence: TTA
gaagagcctgctagaagagt

SEQ ID NO: 165186 - DNA, 20 bp, Artificial Sequence
  Description of Artificial Sequence: Synthetic oligonucleotide
  Target: ATXN1; (-) strand; PAM type: YTN; PAM sequence: CTT
agaagagcctgctagaagag

SEQ ID NO: 165187 - DNA, 20 bp, Artificial Sequence
  Description of Artificial Sequence: Synthetic oligonucleotide
  Target: ATXN1; (-) strand; PAM type: YTN; PAM sequence: TTC
gcttagaagagcctgctaga

SEQ ID NO: 165188 - DNA, 20 bp, Artificial Sequence
  Description of Artificial Sequence: Synthetic oligonucleotide
  Target: ATXN1; (-) strand; PAM type: YTN; PAM sequence: CTT
cgcttagaagagcctgctag

SEQ ID NO: 165189 - DNA, 20 bp, Artificial Sequence
  Description of Artificial Sequence: Synthetic oligonucleotide
  Target: ATXN1; (-) strand; PAM type: YTN; PAM sequence: TTG
tgtcttcgcttagaagagcc

SEQ ID NO: 165190 - DNA, 20 bp, Artificial Sequence
  Description of Artificial Sequence: Synthetic oligonucleotide
  Target: ATXN1; (-) strand; PAM type: YTN; PAM sequence: TTT
gtgtcttcgcttagaagagc

SEQ ID NO: 165191 - DNA, 20 bp, Artificial Sequence
  Description of Artificial Sequence: Synthetic oligonucleotide
  Target: ATXN1; (-) strand; PAM type: YTN; PAM sequence: TTG
tttgtgtcttcgcttagaag

SEQ ID NO: 165192 - DNA, 20 bp, Artificial Sequence
  Description of Artificial Sequence: Synthetic oligonucleotide
  Target: ATXN1; (-) strand; PAM type: YTN; PAM sequence: CTT
gtttgtgtcttcgcttagaa

SEQ ID NO: 165193 - DNA, 20 bp, Artificial Sequence
  Description of Artificial Sequence: Synthetic oligonucleotide
  Target: ATXN1; (-) strand; PAM type: YTN; PAM sequence: CTC
ttgtttgtgtcttcgcttag

SEQ ID NO: 165194 - DNA, 20 bp, Artificial Sequence
  Description of Artificial Sequence: Synthetic oligonucleotide
  Target: ATXN1; (-) strand; PAM type: YTN; PAM sequence: CTG
ctcttgtttgtgtcttcgct

SEQ ID NO: 165195 - DNA, 20 bp, Artificial Sequence
  Description of Artificial Sequence: Synthetic oligonucleotide
  Target: ATXN1; (-) strand; PAM type: YTN; PAM sequence: CTC
atccatcagggtcgacactg

SEQ ID NO: 165196 - DNA, 20 bp, Artificial Sequence
  Description of Artificial Sequence: Synthetic oligonucleotide
  Target: ATXN1; (-) strand; PAM type: YTN; PAM sequence: CTC
ccccaccaagctcatccatc

SEQ ID NO: 165197 - DNA, 20 bp, Artificial Sequence
  Description of Artificial Sequence: Synthetic oligonucleotide
  Target: ATXN1; (-) strand; PAM type: YTN; PAM sequence: CTC
ctcccccaccaagctcatcc

SEQ ID NO: 165198 - DNA, 20 bp, Artificial Sequence
  Description of Artificial Sequence: Synthetic oligonucleotide
  Target: ATXN1; (-) strand; PAM type: YTN; PAM sequence: TTC
tcctcccccaccaagctcat

SEQ ID NO: 165199 - DNA, 20 bp, Artificial Sequence
  Description of Artificial Sequence: Synthetic oligonucleotide
  Target: ATXN1; (-) strand; PAM type: YTN; PAM sequence: CTT
ctcctcccccaccaagctca

SEQ ID NO: 165200 - DNA, 20 bp, Artificial Sequence
  Description of Artificial Sequence: Synthetic oligonucleotide
  Target: ATXN1; (-) strand; PAM type: YTN; PAM sequence: TTA
tccatggggcttctcctccc

SEQ ID NO: 165201 - DNA, 20 bp, Artificial Sequence
  Description of Artificial Sequence: Synthetic oligonucleotide
  Target: ATXN1; (-) strand; PAM type: YTN; PAM sequence: CTT
atccatggggcttctcctcc

SEQ ID NO: 165202 - DNA, 20 bp, Artificial Sequence
  Description of Artificial Sequence: Synthetic oligonucleotide
  Target: ATXN1; (-) strand; PAM type: YTN; PAM sequence: TTC
ttatccatggggcttctcct

SEQ ID NO: 165203 - DNA, 20 bp, Artificial Sequence
  Description of Artificial Sequence: Synthetic oligonucleotide
  Target: ATXN1; (-) strand; PAM type: YTN; PAM sequence: TTT
cttatccatggggcttctcc

SEQ ID NO: 165204 - DNA, 20 bp, Artificial Sequence
  Description of Artificial Sequence: Synthetic oligonucleotide
  Target: ATXN1; (-) strand; PAM type: YTN; PAM sequence: CTT
tcttatccatggggcttctc

SEQ ID NO: 165205 - DNA, 20 bp, Artificial Sequence
  Description of Artificial Sequence: Synthetic oligonucleotide
  Target: ATXN1; (-) strand; PAM type: YTN; PAM sequence: TTG
agcagagaaaaatgtcatcc

SEQ ID NO: 165206 - DNA, 20 bp, Artificial Sequence
  Description of Artificial Sequence: Synthetic oligonucleotide
  Target: ATXN1; (-) strand; PAM type: YTN; PAM sequence: CTG
caggaaggggaagattgagc

SEQ ID NO: 165207 - DNA, 20 bp, Artificial Sequence
  Description of Artificial Sequence: Synthetic oligonucleotide
  Target: ATXN1; (-) strand; PAM type: YTN; PAM sequence: TTC
ctgcaggaaggggaagattg

SEQ ID NO: 165208 - DNA, 20 bp, Artificial Sequence
  Description of Artificial Sequence: Synthetic oligonucleotide
  Target: ATXN1; (-) strand; PAM type: YTN; PAM sequence: CTC
aaaaaagaaaaaaaaaaaag

SEQ ID NO: 165209 - DNA, 20 bp, Artificial Sequence
  Description of Artificial Sequence: Synthetic oligonucleotide
  Target: ATXN1; (-) strand; PAM type: YTN; PAM sequence: CTC
cgtctcaaaaaagaaaaaaa

SEQ ID NO: 165210 - DNA, 20 bp, Artificial Sequence
  Description of Artificial Sequence: Synthetic oligonucleotide
  Target: ATXN1; (-) strand; PAM type: YTN; PAM sequence: CTG
ggcgacagagcgagactccg

SEQ ID NO: 165211 - DNA, 20 bp, Artificial Sequence
  Description of Artificial Sequence: Synthetic oligonucleotide
  Target: ATXN1; (-) strand; PAM type: YTN; PAM sequence: TTC
acaccggcctgggcgacaga

SEQ ID NO: 165212 - DNA, 20 bp, Artificial Sequence
  Description of Artificial Sequence: Synthetic oligonucleotide
  Target: ATXN1; (-) strand; PAM type: YTN; PAM sequence: CTT
cacaccggcctgggcgacag

SEQ ID NO: 165213 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatcgtgcc

SEQ ID NO: 165214 - DNA, 20 bp, Artificial Sequence
  Description of Artificial Sequence: Synthetic oligonucleotide
  Target: ATXN1; (-) strand; PAM type: YTN; PAM sequence: CTG
ggaggcagaggttgcagtga

SEQ ID NO: 165215 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggcagaggttg

SEQ ID NO: 165216 - DNA, 20 bp, Artificial Sequence
  Description of Artificial Sequence: Synthetic oligonucleotide
  Target: ATXN1; (-) strand; PAM type: YTN; PAM sequence: TTT
gaacctgggaggcagaggtt

SEQ ID NO: 165217 - DNA, 20 bp, Artificial Sequence
  Description of Artificial Sequence: Synthetic oligonucleotide
  Target: ATXN1; (-) strand; PAM type: YTN; PAM sequence: TTG
tttgaacctgggaggcagag

SEQ ID NO: 165218 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaattgtttgaa

SEQ ID NO: 165219 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggcaggagaa

SEQ ID NO: 165220 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgaggcagga

SEQ ID NO: 165221 - DNA, 20 bp, Artificial Sequence
  Description of Artificial Sequence: Synthetic oligonucleotide
  Target: ATXN1; (-) strand; PAM type: YTN; PAM sequence: CTA
taatcccagctactcaggag

SEQ ID NO: 165222 - DNA, 20 bp, Artificial Sequence
  Description of Artificial Sequence: Synthetic oligonucleotide
  Target: ATXN1; (-) strand; PAM type: YTN; PAM sequence: TTA
gccgggcgtggtggcgcatg

SEQ ID NO: 165223 - DNA, 20 bp, Artificial Sequence
  Description of Artificial Sequence: Synthetic oligonucleotide
  Target: ATXN1; (-) strand; PAM type: YTN; PAM sequence: CTA
aaaatagaaaaaaattagcc

SEQ ID NO: 165224 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatagaaaaaaatta

SEQ ID NO: 165225 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatagaaaaaaat

SEQ ID NO: 165226 - DNA, 20 bp, Artificial Sequence
  Description of Artificial Sequence: Synthetic oligonucleotide
  Target: ATXN1; (-) strand; PAM type: YTN; PAM sequence: TTG
ccaatacggtgaaaccccgt

SEQ ID NO: 165227 - DNA, 20 bp, Artificial Sequence
  Description of Artificial Sequence: Synthetic oligonucleotide
  Target: ATXN1; (-) strand; PAM type: YTN; PAM sequence: CTT
gccaatacggtgaaaccccg

SEQ ID NO: 165228 - DNA, 20 bp, Artificial Sequence
  Description of Artificial Sequence: Synthetic oligonucleotide
  Target: ATXN1; (-) strand; PAM type: YTN; PAM sequence: TTC
aagaccagccttgccaatac

SEQ ID NO: 165229 - DNA, 20 bp, Artificial Sequence
  Description of Artificial Sequence: Synthetic oligonucleotide
  Target: ATXN1; (-) strand; PAM type: YTN; PAM sequence: CTG
aggtcaggaattcaagacca

SEQ ID NO: 165230 - DNA, 20 bp, Artificial Sequence
  Description of Artificial Sequence: Synthetic oligonucleotide
  Target: ATXN1; (-) strand; PAM type: YTN; PAM sequence: TTG
ggaggccaaggcgggtggat

SEQ ID NO: 165231 - DNA, 20 bp, Artificial Sequence
  Description of Artificial Sequence: Synthetic oligonucleotide
  Target: ATXN1; (-) strand; PAM type: YTN; PAM sequence: TTT
gggaggccaaggcgggtgga

SEQ ID NO: 165232 - DNA, 20 bp, Artificial Sequence
  Description of Artificial Sequence: Synthetic oligonucleotide
  Target: ATXN1; (-) strand; PAM type: YTN; PAM sequence: CTT
tgggaggccaaggcgggtgg

SEQ ID NO: 165233 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 165234 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcccagcact

SEQ ID NO: 165235 - DNA, 20 bp, Artificial Sequence
  Description of Artificial Sequence: Synthetic oligonucleotide
  Target: ATXN1; (-) strand; PAM type: YTN; PAM sequence: CTG
ggcgtggtgcctcacgcctg

SEQ ID NO: 165236 - DNA, 20 bp, Artificial Sequence
  Description of Artificial Sequence: Synthetic oligonucleotide
  Target: ATXN1; (-) strand; PAM type: YTN; PAM sequence: TTG
cccatcaaaagggtgggtga

SEQ ID NO: 165237 - DNA, 20 bp, Artificial Sequence
  Description of Artificial Sequence: Synthetic oligonucleotide
  Target: ATXN1; (-) strand; PAM type: YTN; PAM sequence: CTC
aagttgcccatcaaaagggt

SEQ ID NO: 165238 - DNA, 20 bp, Artificial Sequence
  Description of Artificial Sequence: Synthetic oligonucleotide
  Target: ATXN1; (-) strand; PAM type: YTN; PAM sequence: TTA
caggaataagcaggagaggg

SEQ ID NO: 165239 - DNA, 20 bp, Artificial Sequence
  Description of Artificial Sequence: Synthetic oligonucleotide
  Target: ATXN1; (-) strand; PAM type: YTN; PAM sequence: TTG
cagttacaggaataagcagg

SEQ ID NO: 165240 - DNA, 20 bp, Artificial Sequence
  Description of Artificial Sequence: Synthetic oligonucleotide
  Target: ATXN1; (-) strand; PAM type: YTN; PAM sequence: TTT
gcagttacaggaataagcag

SEQ ID NO: 165241 - DNA, 20 bp, Artificial Sequence
  Description of Artificial Sequence: Synthetic oligonucleotide
  Target: ATXN1; (-) strand; PAM type: YTN; PAM sequence: TTG
gagcaagacgtgtttgcagt

SEQ ID NO: 165242 - DNA, 20 bp, Artificial Sequence
  Description of Artificial Sequence: Synthetic oligonucleotide
  Target: ATXN1; (-) strand; PAM type: YTN; PAM sequence: TTA
agaagtggtggttggagcaa

SEQ ID NO: 165243 - DNA, 20 bp, Artificial Sequence
  Description of Artificial Sequence: Synthetic oligonucleotide
  Target: ATXN1; (-) strand; PAM type: YTN; PAM sequence: TTT
aagaagtggtggttggagca

SEQ ID NO: 165244 - DNA, 20 bp, Artificial Sequence
  Description of Artificial Sequence: Synthetic oligonucleotide
  Target: ATXN1; (-) strand; PAM type: YTN; PAM sequence: TTT
taagaagtggtggttggagc

SEQ ID NO: 165245 - DNA, 20 bp, Artificial Sequence
  Description of Artificial Sequence: Synthetic oligonucleotide
  Target: ATXN1; (-) strand; PAM type: YTN; PAM sequence: CTG
cagttttaagaagtggtggt

SEQ ID NO: 165246 - DNA, 20 bp, Artificial Sequence
  Description of Artificial Sequence: Synthetic oligonucleotide
  Target: ATXN1; (-) strand; PAM type: YTN; PAM sequence: TTC
atctgcagttttaagaagtg

SEQ ID NO: 165247 - DNA, 20 bp, Artificial Sequence
  Description of Artificial Sequence: Synthetic oligonucleotide
  Target: ATXN1; (-) strand; PAM type: YTN; PAM sequence: CTT
catctgcagttttaagaagt

SEQ ID NO: 165248 - DNA, 20 bp, Artificial Sequence
  Description of Artificial Sequence: Synthetic oligonucleotide
  Target: ATXN1; (-) strand; PAM type: YTN; PAM sequence: CTC
aggaggagaatggtcgcggg

SEQ ID NO: 165249 - DNA, 20 bp, Artificial Sequence
  Description of Artificial Sequence: Synthetic oligonucleotide
  Target: ATXN1; (-) strand; PAM type: YTN; PAM sequence: CTC
tcaggaggagaatggtcgcg

SEQ ID NO: 165250 - DNA, 20 bp, Artificial Sequence
  Description of Artificial Sequence: Synthetic oligonucleotide
  Target: ATXN1; (-) strand; PAM type: YTN; PAM sequence: TTC
agagctctcaggaggagaat

SEQ ID NO: 165251 - DNA, 20 bp, Artificial Sequence
  Description of Artificial Sequence: Synthetic oligonucleotide
  Target: ATXN1; (-) strand; PAM type: YTN; PAM sequence: CTT
cagagctctcaggaggagaa

SEQ ID NO: 165252 - DNA, 20 bp, Artificial Sequence
  Description of Artificial Sequence: Synthetic oligonucleotide
  Target: ATXN1; (-) strand; PAM type: YTN; PAM sequence: TTC
gatgtaatgacttcagagct

SEQ ID NO: 165253 - DNA, 20 bp, Artificial Sequence
  Description of Artificial Sequence: Synthetic oligonucleotide
  Target: ATXN1; (-) strand; PAM type: YTN; PAM sequence: CTT
cgatgtaatgacttcagagc

SEQ ID NO: 165254 - DNA, 20 bp, Artificial Sequence
  Description of Artificial Sequence: Synthetic oligonucleotide
  Target: ATXN1; (-) strand; PAM type: YTN; PAM sequence: TTA
cttcgatgtaatgacttcag

SEQ ID NO: 165255 - DNA, 20 bp, Artificial Sequence
  Description of Artificial Sequence: Synthetic oligonucleotide
  Target: ATXN1; (-) strand; PAM type: YTN; PAM sequence: CTT
acttcgatgtaatgacttca

SEQ ID NO: 165256 - DNA, 20 bp, Artificial Sequence
  Description of Artificial Sequence: Synthetic oligonucleotide
  Target: ATXN1; (-) strand; PAM type: YTN; PAM sequence: TTA
cttacttcgatgtaatgact

SEQ ID NO: 165257 - DNA, 20 bp, Artificial Sequence
  Description of Artificial Sequence: Synthetic oligonucleotide
  Target: ATXN1; (-) strand; PAM type: YTN; PAM sequence: CTA
aattacttacttcgatgtaa

SEQ ID NO: 165258 - DNA, 20 bp, Artificial Sequence
  Description of Artificial Sequence: Synthetic oligonucleotide
  Target: ATXN1; (-) strand; PAM type: YTN; PAM sequence: TTA
gaggcaatgtgtctaaatta

SEQ ID NO: 165259 - DNA, 20 bp, Artificial Sequence
  Description of Artificial Sequence: Synthetic oligonucleotide
  Target: ATXN1; (-) strand; PAM type: YTN; PAM sequence: TTC
acagatgtgagcaagaggaa

SEQ ID NO: 165260 - DNA, 20 bp, Artificial Sequence
  Description of Artificial Sequence: Synthetic oligonucleotide
  Target: ATXN1; (-) strand; PAM type: YTN; PAM sequence: CTT
cacagatgtgagcaagagga

SEQ ID NO: 165261 - DNA, 20 bp, Artificial Sequence
  Description of Artificial Sequence: Synthetic oligonucleotide
  Target: ATXN1; (-) strand; PAM type: YTN; PAM sequence: CTA
aacttcacagatgtgagcaa

SEQ ID NO: 165262 - DNA, 20 bp, Artificial Sequence
  Description of Artificial Sequence: Synthetic oligonucleotide
  Target: ATXN1; (-) strand; PAM type: YTN; PAM sequence: TTG
ctaaacttcacagatgtgag

SEQ ID NO: 165263 - DNA, 20 bp, Artificial Sequence
  Description of Artificial Sequence: Synthetic oligonucleotide
  Target: ATXN1; (-) strand; PAM type: YTN; PAM sequence: TTT
gctaaacttcacagatgtga

SEQ ID NO: 165264 - DNA, 20 bp, Artificial Sequence
  Description of Artificial Sequence: Synthetic oligonucleotide
  Target: ATXN1; (-) strand; PAM type: YTN; PAM sequence: TTA
tttgctaaacttcacagatg

SEQ ID NO: 165265 - DNA, 20 bp, Artificial Sequence
  Description of Artificial Sequence: Synthetic oligonucleotide
  Target: ATXN1; (-) strand; PAM type: YTN; PAM sequence: TTT
atttgctaaacttcacagat

SEQ ID NO: 165266 - DNA, 20 bp, Artificial Sequence
  Description of Artificial Sequence: Synthetic oligonucleotide
  Target: ATXN1; (-) strand; PAM type: YTN; PAM sequence: CTT
tatttgctaaacttcacaga

SEQ ID NO: 165267 - DNA, 20 bp, Artificial Sequence
  Description of Artificial Sequence: Synthetic oligonucleotide
  Target: ATXN1; (-) strand; PAM type: YTN; PAM sequence: TTG
ctttatttgctaaacttcac

SEQ ID NO: 165268 - DNA, 20 bp, Artificial Sequence
  Description of Artificial Sequence: Synthetic oligonucleotide
  Target: ATXN1; (-) strand; PAM type: YTN; PAM sequence: TTT
gctttatttgctaaacttca

SEQ ID NO: 165269 - DNA, 20 bp, Artificial Sequence
  Description of Artificial Sequence: Synthetic oligonucleotide
  Target: ATXN1; (-) strand; PAM type: YTN; PAM sequence: TTC
agacatttgctttatttgct

SEQ ID NO: 165270 - DNA, 20 bp, Artificial Sequence
  Description of Artificial Sequence: Synthetic oligonucleotide
  Target: ATXN1; (-) strand; PAM type: YTN; PAM sequence: CTG
tatgtccagagataggaaat

SEQ ID NO: 165271 - DNA, 20 bp, Artificial Sequence
  Description of Artificial Sequence: Synthetic oligonucleotide
  Target: ATXN1; (-) strand; PAM type: YTN; PAM sequence: TTC
cctgtatgtccagagatagg

SEQ ID NO: 165272 - DNA, 20 bp, Artificial Sequence
  Description of Artificial Sequence: Synthetic oligonucleotide
  Target: ATXN1; (-) strand; PAM type: YTN; PAM sequence: TTT
ccctgtatgtccagagatag

SEQ ID NO: 165273 - DNA, 20 bp, Artificial Sequence
  Description of Artificial Sequence: Synthetic oligonucleotide
  Target: ATXN1; (-) strand; PAM type: YTN; PAM sequence: TTC
agtgtttccctgtatgtcca

SEQ ID NO: 165274 - DNA, 20 bp, Artificial Sequence
  Description of Artificial Sequence: Synthetic oligonucleotide
  Target: ATXN1; (-) strand; PAM type: YTN; PAM sequence: CTT
cagtgtttccctgtatgtcc

SEQ ID NO: 165275 - DNA, 20 bp, Artificial Sequence
  Description of Artificial Sequence: Synthetic oligonucleotide
  Target: ATXN1; (-) strand; PAM type: YTN; PAM sequence: TTC
ttcagtgtttccctgtatgt

SEQ ID NO: 165276 - DNA, 20 bp, Artificial Sequence
  Description of Artificial Sequence: Synthetic oligonucleotide
  Target: ATXN1; (-) strand; PAM type: YTN; PAM sequence: CTT
cttcagtgtttccctgtatg

SEQ ID NO: 165277 - DNA, 20 bp, Artificial Sequence
  Description of Artificial Sequence: Synthetic oligonucleotide
  Target: ATXN1; (-) strand; PAM type: YTN; PAM sequence: TTG
tgcaaagagtgccgtgggca

SEQ ID NO: 165278 - DNA, 20 bp, Artificial Sequence
  Description of Artificial Sequence: Synthetic oligonucleotide
  Target: ATXN1; (-) strand; PAM type: YTN; PAM sequence: TTT
gtgcaaagagtgccgtgggc

SEQ ID NO: 165279 - DNA, 20 bp, Artificial Sequence
  Description of Artificial Sequence: Synthetic oligonucleotide
  Target: ATXN1; (-) strand; PAM type: YTN; PAM sequence: TTT
tgtgcaaagagtgccgtggg

SEQ ID NO: 165280 - DNA, 20 bp, Artificial Sequence
  Description of Artificial Sequence: Synthetic oligonucleotide
  Target: ATXN1; (-) strand; PAM type: YTN; PAM sequence: CTG
aggttttgtgcaaagagtgc

SEQ ID NO: 165281 - DNA, 20 bp, Artificial Sequence
  Description of Artificial Sequence: Synthetic oligonucleotide
  Target: ATXN1; (-) strand; PAM type: YTN; PAM sequence: TTA
ctgaggttttgtgcaaagag

SEQ ID NO: 165282 - DNA, 20 bp, Artificial Sequence
  Description of Artificial Sequence: Synthetic oligonucleotide
  Target: ATXN1; (-) strand; PAM type: YTN; PAM sequence: TTT
actgaggttttgtgcaaaga

SEQ ID NO: 165283 - DNA, 20 bp, Artificial Sequence
  Description of Artificial Sequence: Synthetic oligonucleotide
  Target: ATXN1; (-) strand; PAM type: YTN; PAM sequence: TTT
tactgaggttttgtgcaaag

SEQ ID NO: 165284 - DNA, 20 bp, Artificial Sequence
  Description of Artificial Sequence: Synthetic oligonucleotide
  Target: ATXN1; (-) strand; PAM type: YTN; PAM sequence: TTT
ttactgaggttttgtgcaaa

SEQ ID NO: 165285 - DNA, 20 bp, Artificial Sequence
  Description of Artificial Sequence: Synthetic oligonucleotide
  Target: ATXN1; (-) strand; PAM type: YTN; PAM sequence: TTT
tttactgaggttttgtgcaa

SEQ ID NO: 165286 - DNA, 20 bp, Artificial Sequence
  Description of Artificial Sequence: Synthetic oligonucleotide
  Target: ATXN1; (-) strand; PAM type: YTN; PAM sequence: CTG
tgccacgattttttactgag

SEQ ID NO: 165287 - DNA, 20 bp, Artificial Sequence
  Description of Artificial Sequence: Synthetic oligonucleotide
  Target: ATXN1; (-) strand; PAM type: YTN; PAM sequence: CTG
agtcatagaataagcaggga

SEQ ID NO: 165288 - DNA, 20 bp, Artificial Sequence
  Description of Artificial Sequence: Synthetic oligonucleotide
  Target: ATXN1; (-) strand; PAM type: YTN; PAM sequence: TTC
tgagtcatagaataagcagg

SEQ ID NO: 165289 - DNA, 20 bp, Artificial Sequence
  Description of Artificial Sequence: Synthetic oligonucleotide
  Target: ATXN1; (-) strand; PAM type: YTN; PAM sequence: CTT
ctgagtcatagaataagcag

SEQ ID NO: 165290 - DNA, 20 bp, Artificial Sequence
  Description of Artificial Sequence: Synthetic oligonucleotide
  Target: ATXN1; (-) strand; PAM type: YTN; PAM sequence: TTG
aaccttctgagtcatagaat

SEQ ID NO: 165291 - DNA, 20 bp, Artificial Sequence
  Description of Artificial Sequence: Synthetic oligonucleotide
  Target: ATXN1; (-) strand; PAM type: YTN; PAM sequence: TTT
gaaccttctgagtcatagaa

SEQ ID NO: 165292 - DNA, 20 bp, Artificial Sequence
  Description of Artificial Sequence: Synthetic oligonucleotide
  Target: ATXN1; (-) strand; PAM type: YTN; PAM sequence: CTT
tgaaccttctgagtcataga

SEQ ID NO: 165293 - DNA, 20 bp, Artificial Sequence
  Description of Artificial Sequence: Synthetic oligonucleotide
  Target: ATXN1; (-) strand; PAM type: YTN; PAM sequence: TTG
ctttgaaccttctgagtcat

SEQ ID NO: 165294 - DNA, 20 bp, Artificial Sequence
  Description of Artificial Sequence: Synthetic oligonucleotide
  Target: ATXN1; (-) strand; PAM type: YTN; PAM sequence: TTT
gctttgaaccttctgagtca

SEQ ID NO: 165295 - DNA, 20 bp, Artificial Sequence
  Description of Artificial Sequence: Synthetic oligonucleotide
  Target: ATXN1; (-) strand; PAM type: YTN; PAM sequence: CTT
tgctttgaaccttctgagtc

SEQ ID NO: 165296 - DNA, 20 bp, Artificial Sequence
  Description of Artificial Sequence: Synthetic oligonucleotide
  Target: ATXN1; (-) strand; PAM type: YTN; PAM sequence: TTA
ggtcaaaaacctttgctttg

SEQ ID NO: 165297 - DNA, 20 bp, Artificial Sequence
  Description of Artificial Sequence: Synthetic oligonucleotide
  Target: ATXN1; (-) strand; PAM type: YTN; PAM sequence: TTA
aggccaaattaggtcaaaaa

SEQ ID NO: 165298 - DNA, 20 bp, Artificial Sequence
  Description of Artificial Sequence: Synthetic oligonucleotide
  Target: ATXN1; (-) strand; PAM type: YTN; PAM sequence: CTT
aaggccaaattaggtcaaaa

SEQ ID NO: 165299 - DNA, 20 bp, Artificial Sequence
  Description of Artificial Sequence: Synthetic oligonucleotide
  Target: ATXN1; (-) strand; PAM type: YTN; PAM sequence: CTG
acttaaggccaaattaggtc

SEQ ID NO: 165300 - DNA, 20 bp, Artificial Sequence
  Description of Artificial Sequence: Synthetic oligonucleotide
  Target: ATXN1; (-) strand; PAM type: YTN; PAM sequence: TTC
tgacttaaggccaaattagg

SEQ ID NO: 165301 - DNA, 20 bp, Artificial Sequence
  Description of Artificial Sequence: Synthetic oligonucleotide
  Target: ATXN1; (-) strand; PAM type: YTN; PAM sequence: TTT
ctgacttaaggccaaattag

SEQ ID NO: 165302 - DNA, 20 bp, Artificial Sequence
  Description of Artificial Sequence: Synthetic oligonucleotide
  Target: ATXN1; (-) strand; PAM type: YTN; PAM sequence: TTT
tctgacttaaggccaaatta

SEQ ID NO: 165303 - DNA, 20 bp, Artificial Sequence
  Description of Artificial Sequence: Synthetic oligonucleotide
  Target: ATXN1; (-) strand; PAM type: YTN; PAM sequence: CTT
ttctgacttaaggccaaatt

SEQ ID NO: 165304 - DNA, 20 bp, Artificial Sequence
  Description of Artificial Sequence: Synthetic oligonucleotide
  Target: ATXN1; (-) strand; PAM type: YTN; PAM sequence: CTC
agtgtgagacagcagtggaa

SEQ ID NO: 165305 - DNA, 20 bp, Artificial Sequence
  Description of Artificial Sequence: Synthetic oligonucleotide
  Target: ATXN1; (-) strand; PAM type: YTN; PAM sequence: TTG
aaactcagtgtgagacagca

SEQ ID NO: 165306 - DNA, 20 bp, Artificial Sequence
  Description of Artificial Sequence: Synthetic oligonucleotide
  Target: ATXN1; (-) strand; PAM type: YTN; PAM sequence: TTT
gaaactcagtgtgagacagc

SEQ ID NO: 165307 - DNA, 20 bp, Artificial Sequence
  Description of Artificial Sequence: Synthetic oligonucleotide
  Target: ATXN1; (-) strand; PAM type: YTN; PAM sequence: CTT
tgaaactcagtgtgagacag

SEQ ID NO: 165308 - DNA, 20 bp, Artificial Sequence
  Description of Artificial Sequence: Synthetic oligonucleotide
  Target: ATXN1; (-) strand; PAM type: YTN; PAM sequence: TTG
ctttgaaactcagtgtgaga

SEQ ID NO: 165309 - DNA, 20 bp, Artificial Sequence
  Description of Artificial Sequence: Synthetic oligonucleotide
  Target: ATXN1; (-) strand; PAM type: YTN; PAM sequence: TTT
gctttgaaactcagtgtgag

SEQ ID NO: 165310 - DNA, 20 bp, Artificial Sequence
  Description of Artificial Sequence: Synthetic oligonucleotide
  Target: ATXN1; (-) strand; PAM type: YTN; PAM sequence: CTT
tgctttgaaactcagtgtga

SEQ ID NO: 165311 - DNA, 20 bp, Artificial Sequence
  Description of Artificial Sequence: Synthetic oligonucleotide
  Target: ATXN1; (-) strand; PAM type: YTN; PAM sequence: TTC
tttgctttgaaactcagtgt

SEQ ID NO: 165312 - DNA, 20 bp, Artificial Sequence
  Description of Artificial Sequence: Synthetic oligonucleotide
  Target: ATXN1; (-) strand; PAM type: YTN; PAM sequence: CTT
ctttgctttgaaactcagtg

SEQ ID NO: 165313 - DNA, 20 bp, Artificial Sequence
  Description of Artificial Sequence: Synthetic oligonucleotide
  Target: ATXN1; (-) strand; PAM type: YTN; PAM sequence: TTC
ttctttgctttgaaactcag

SEQ ID NO: 165314 - DNA, 20 bp, Artificial Sequence
  Description of Artificial Sequence: Synthetic oligonucleotide
  Target: ATXN1; (-) strand; PAM type: YTN; PAM sequence: TTT
cttctttgctttgaaactca

SEQ ID NO: 165315 - DNA, 20 bp, Artificial Sequence
  Description of Artificial Sequence: Synthetic oligonucleotide
  Target: ATXN1; (-) strand; PAM type: YTN; PAM sequence: TTC
catttcttctttgctttgaa

SEQ ID NO: 165316 - DNA, 20 bp, Artificial Sequence
  Description of Artificial Sequence: Synthetic oligonucleotide
  Target: ATXN1; (-) strand; PAM type: YTN; PAM sequence: CTG
ttccatttcttctttgcttt

SEQ ID NO: 165317 - DNA, 20 bp, Artificial Sequence
  Description of Artificial Sequence: Synthetic oligonucleotide
  Target: ATXN1; (-) strand; PAM type: YTN; PAM sequence: TTA
aatacagccctgttccattt

SEQ ID NO: 165318 - DNA, 20 bp, Artificial Sequence
  Description of Artificial Sequence: Synthetic oligonucleotide
  Target: ATXN1; (-) strand; PAM type: YTN; PAM sequence: TTC
agaattaaatacagccctgt

SEQ ID NO: 165319 - DNA, 20 bp, Artificial Sequence
  Description of Artificial Sequence: Synthetic oligonucleotide
  Target: ATXN1; (-) strand; PAM type: YTN; PAM sequence: TTA
tattcagaattaaatacagc

SEQ ID NO: 165320 - DNA, 20 bp, Artificial Sequence
  Description of Artificial Sequence: Synthetic oligonucleotide
  Target: ATXN1; (-) strand; PAM type: YTN; PAM sequence: TTG
ccaacagcaaagagattata

SEQ ID NO: 165321 - DNA, 20 bp, Artificial Sequence
  Description of Artificial Sequence: Synthetic oligonucleotide
  Target: ATXN1; (-) strand; PAM type: YTN; PAM sequence: TTC
ccataacattgccaacagca

SEQ ID NO: 165322 - DNA, 20 bp, Artificial Sequence
  Description of Artificial Sequence: Synthetic oligonucleotide
  Target: ATXN1; (-) strand; PAM type: YTN; PAM sequence: CTA
ttcccataacattgccaaca

SEQ ID NO: 165323 - DNA, 20 bp, Artificial Sequence
  Description of Artificial Sequence: Synthetic oligonucleotide
  Target: ATXN1; (-) strand; PAM type: YTN; PAM sequence: TTA
ctattcccataacattgcca

SEQ ID NO: 165324 - DNA, 20 bp, Artificial Sequence
  Description of Artificial Sequence: Synthetic oligonucleotide
  Target: ATXN1; (-) strand; PAM type: YTN; PAM sequence: TTC
attactattcccataacatt

SEQ ID NO: 165325 - DNA, 20 bp, Artificial Sequence
  Description of Artificial Sequence: Synthetic oligonucleotide
  Target: ATXN1; (-) strand; PAM type: YTN; PAM sequence: TTC
atggaaagcaaaaattcatt

SEQ ID NO: 165326 - DNA, 20 bp, Artificial Sequence
  Description of Artificial Sequence: Synthetic oligonucleotide
  Target: ATXN1; (-) strand; PAM type: YTN; PAM sequence: TTA
ttcatggaaagcaaaaattc

SEQ ID NO: 165327 - DNA, 20 bp, Artificial Sequence
  Description of Artificial Sequence: Synthetic oligonucleotide
  Target: ATXN1; (-) strand; PAM type: YTN; PAM sequence: TTT
attcatggaaagcaaaaatt

SEQ ID NO: 165328 - DNA, 20 bp, Artificial Sequence
  Description of Artificial Sequence: Synthetic oligonucleotide
  Target: ATXN1; (-) strand; PAM type: YTN; PAM sequence: CTG
aaaaatttattcatggaaag

SEQ ID NO: 165329 - DNA, 20 bp, Artificial Sequence
  Description of Artificial Sequence: Synthetic oligonucleotide
  Target: ATXN1; (-) strand; PAM type: YTN; PAM sequence: TTC
tgaaaaatttattcatggaa

SEQ ID NO: 165330 - DNA, 20 bp, Artificial Sequence
  Description of Artificial Sequence: Synthetic oligonucleotide
  Target: ATXN1; (-) strand; PAM type: YTN; PAM sequence: TTA
gattctgaaaaatttattca

SEQ ID NO: 165331 - DNA, 20 bp, Artificial Sequence
  Description of Artificial Sequence: Synthetic oligonucleotide
  Target: ATXN1; (-) strand; PAM type: YTN; PAM sequence: TTT
agattctgaaaaatttattc

SEQ ID NO: 165332 - DNA, 20 bp, Artificial Sequence
  Description of Artificial Sequence: Synthetic oligonucleotide
  Target: ATXN1; (-) strand; PAM type: YTN; PAM sequence: CTT
tagattctgaaaaatttatt

SEQ ID NO: 165333 - DNA, 20 bp, Artificial Sequence
  Description of Artificial Sequence: Synthetic oligonucleotide
  Target: ATXN1; (-) strand; PAM type: YTN; PAM sequence: CTC
aactttagattctgaaaaat

SEQ ID NO: 165334 - DNA, 20 bp, Artificial Sequence
  Description of Artificial Sequence: Synthetic oligonucleotide
  Target: ATXN1; (-) strand; PAM type: YTN; PAM sequence: TTA
tgtgagcctcaactttagat

SEQ ID NO: 165335 - DNA, 20 bp, Artificial Sequence
  Description of Artificial Sequence: Synthetic oligonucleotide
  Target: ATXN1; (-) strand; PAM type: YTN; PAM sequence: CTA
acaattatgtgagcctcaac

SEQ ID NO: 165336 - DNA, 20 bp, Artificial Sequence
  Description of Artificial Sequence: Synthetic oligonucleotide
  Target: ATXN1; (-) strand; PAM type: YTN; PAM sequence: CTG
tggggaaaatactaacaatt

SEQ ID NO: 165337 - DNA, 20 bp, Artificial Sequence
  Description of Artificial Sequence: Synthetic oligonucleotide
  Target: ATXN1; (-) strand; PAM type: YTN; PAM sequence: TTG
aaaaacactgtggggaaaat

SEQ ID NO: 165338 - DNA, 20 bp, Artificial Sequence
  Description of Artificial Sequence: Synthetic oligonucleotide
  Target: ATXN1; (-) strand; PAM type: YTN; PAM sequence: TTC
caaggaaaattgaaaaacac

SEQ ID NO: 165339 - DNA, 20 bp, Artificial Sequence
  Description of Artificial Sequence: Synthetic oligonucleotide
  Target: ATXN1; (-) strand; PAM type: YTN; PAM sequence: CTT
ccaaggaaaattgaaaaaca

SEQ ID NO: 165340 - DNA, 20 bp, Artificial Sequence
  Description of Artificial Sequence: Synthetic oligonucleotide
  Target: ATXN1; (-) strand; PAM type: YTN; PAM sequence: TTC
ccttccaaggaaaattgaaa

SEQ ID NO: 165341 - DNA, 20 bp, Artificial Sequence
  Description of Artificial Sequence: Synthetic oligonucleotide
  Target: ATXN1; (-) strand; PAM type: YTN; PAM sequence: CTT
cccttccaaggaaaattgaa

SEQ ID NO: 165342 - DNA, 20 bp, Artificial Sequence
  Description of Artificial Sequence: Synthetic oligonucleotide
  Target: ATXN1; (-) strand; PAM type: YTN; PAM sequence: CTA
cttcccttccaaggaaaatt

SEQ ID NO: 165343 - DNA, 20 bp, Artificial Sequence
  Description of Artificial Sequence: Synthetic oligonucleotide
  Target: ATXN1; (-) strand; PAM type: YTN; PAM sequence: TTC
agtctacttcccttccaagg

SEQ ID NO: 165344 - DNA, 20 bp, Artificial Sequence
  Description of Artificial Sequence: Synthetic oligonucleotide
  Target: ATXN1; (-) strand; PAM type: YTN; PAM sequence: TTG
taattcagtctacttccctt

SEQ ID NO: 165345 - DNA, 20 bp, Artificial Sequence
  Description of Artificial Sequence: Synthetic oligonucleotide
  Target: ATXN1; (-) strand; PAM type: YTN; PAM sequence: CTG
aggtattgtaattcagtcta

SEQ ID NO: 165346 - DNA, 20 bp, Artificial Sequence
  Description of Artificial Sequence: Synthetic oligonucleotide
  Target: ATXN1; (-) strand; PAM type: YTN; PAM sequence: TTA
caaaatgagaaactgaggta

SEQ ID NO: 165347 - DNA, 20 bp, Artificial Sequence
  Description of Artificial Sequence: Synthetic oligonucleotide
  Target: ATXN1; (-) strand; PAM type: YTN; PAM sequence: CTT
acaaaatgagaaactgaggt

SEQ ID NO: 165348 - DNA, 20 bp, Artificial Sequence
  Description of Artificial Sequence: Synthetic oligonucleotide
  Target: ATXN1; (-) strand; PAM type: YTN; PAM sequence: TTG
gcagcttacaaaatgagaaa

SEQ ID NO: 165349 - DNA, 20 bp, Artificial Sequence
  Description of Artificial Sequence: Synthetic oligonucleotide
  Target: ATXN1; (-) strand; PAM type: YTN; PAM sequence: CTT
ggcagcttacaaaatgagaa

SEQ ID NO: 165350 - DNA, 20 bp, Artificial Sequence
  Description of Artificial Sequence: Synthetic oligonucleotide
  Target: ATXN1; (-) strand; PAM type: YTN; PAM sequence: TTC
ttggcagcttacaaaatgag

SEQ ID NO: 165351 - DNA, 20 bp, Artificial Sequence
  Description of Artificial Sequence: Synthetic oligonucleotide
  Target: ATXN1; (-) strand; PAM type: YTN; PAM sequence: CTG
ttcttggcagcttacaaaat

SEQ ID NO: 165352 - DNA, 20 bp, Artificial Sequence
  Description of Artificial Sequence: Synthetic oligonucleotide
  Target: ATXN1; (-) strand; PAM type: YTN; PAM sequence: TTC
atactgttcttggcagctta

SEQ ID NO: 165353 - DNA, 20 bp, Artificial Sequence
  Description of Artificial Sequence: Synthetic oligonucleotide
  Target: ATXN1; (-) strand; PAM type: YTN; PAM sequence: TTC
caggacagttcatactgttc

SEQ ID NO: 165354 - DNA, 20 bp, Artificial Sequence
  Description of Artificial Sequence: Synthetic oligonucleotide
  Target: ATXN1; (-) strand; PAM type: YTN; PAM sequence: TTA
gttccaggacagttcatact

SEQ ID NO: 165355 - DNA, 20 bp, Artificial Sequence
  Description of Artificial Sequence: Synthetic oligonucleotide
  Target: ATXN1; (-) strand; PAM type: YTN; PAM sequence: TTT
agttccaggacagttcatac

SEQ ID NO: 165356 - DNA, 20 bp, Artificial Sequence
  Description of Artificial Sequence: Synthetic oligonucleotide
  Target: ATXN1; (-) strand; PAM type: YTN; PAM sequence: CTT
tagttccaggacagttcata

SEQ ID NO: 165357 - DNA, 20 bp, Artificial Sequence
  Description of Artificial Sequence: Synthetic oligonucleotide
  Target: ATXN1; (-) strand; PAM type: YTN; PAM sequence: TTC
tttagttccaggacagttca

SEQ ID NO: 165358 - DNA, 20 bp, Artificial Sequence
  Description of Artificial Sequence: Synthetic oligonucleotide
  Target: ATXN1; (-) strand; PAM type: YTN; PAM sequence: TTT
ctttagttccaggacagttc

SEQ ID NO: 165359 - DNA, 20 bp, Artificial Sequence
  Description of Artificial Sequence: Synthetic oligonucleotide
  Target: ATXN1; (-) strand; PAM type: YTN; PAM sequence: TTA
tgtttctttagttccaggac

SEQ ID NO: 165360 - DNA, 20 bp, Artificial Sequence
  Description of Artificial Sequence: Synthetic oligonucleotide
  Target: ATXN1; (-) strand; PAM type: YTN; PAM sequence: CTT
atgtttctttagttccagga

SEQ ID NO: 165361 - DNA, 20 bp, Artificial Sequence
  Description of Artificial Sequence: Synthetic oligonucleotide
  Target: ATXN1; (-) strand; PAM type: YTN; PAM sequence: TTG
tccttatgtttctttagttc

SEQ ID NO: 165362 - DNA, 20 bp, Artificial Sequence
  Description of Artificial Sequence: Synthetic oligonucleotide
  Target: ATXN1; (-) strand; PAM type: YTN; PAM sequence: TTT
gtccttatgtttctttagtt

SEQ ID NO: 165363 - DNA, 20 bp, Artificial Sequence
  Description of Artificial Sequence: Synthetic oligonucleotide
  Target: ATXN1; (-) strand; PAM type: YTN; PAM sequence: CTG
gtatcatttgtccttatgtt

SEQ ID NO: 165364 - DNA, 20 bp, Artificial Sequence
  Description of Artificial Sequence: Synthetic oligonucleotide
  Target: ATXN1; (-) strand; PAM type: YTN; PAM sequence: TTC
ctggtatcatttgtccttat

SEQ ID NO: 165365 - DNA, 20 bp, Artificial Sequence
  Description of Artificial Sequence: Synthetic oligonucleotide
  Target: ATXN1; (-) strand; PAM type: YTN; PAM sequence: TTT
cctggtatcatttgtcctta

SEQ ID NO: 165366 - DNA, 20 bp, Artificial Sequence
  Description of Artificial Sequence: Synthetic oligonucleotide
  Target: ATXN1; (-) strand; PAM type: YTN; PAM sequence: CTT
tcctggtatcatttgtcctt

SEQ ID NO: 165367 - DNA, 20 bp, Artificial Sequence
  Description of Artificial Sequence: Synthetic oligonucleotide
  Target: ATXN1; (-) strand; PAM type: YTN; PAM sequence: TTC
aaacggctttcctggtatca

SEQ ID NO: 165368 - DNA, 20 bp, Artificial Sequence
  Description of Artificial Sequence: Synthetic oligonucleotide
  Target: ATXN1; (-) strand; PAM type: YTN; PAM sequence: TTT
caaacggctttcctggtatc

SEQ ID NO: 165369 - DNA, 20 bp, Artificial Sequence
  Description of Artificial Sequence: Synthetic oligonucleotide
  Target: ATXN1; (-) strand; PAM type: YTN; PAM sequence: TTC
ccccaaagaatttcaaacgg

SEQ ID NO: 165370 - DNA, 20 bp, Artificial Sequence
  Description of Artificial Sequence: Synthetic oligonucleotide
  Target: ATXN1; (-) strand; PAM type: YTN; PAM sequence: TTT
cccccaaagaatttcaaacg

SEQ ID NO: 165371 - DNA, 20 bp, Artificial Sequence
  Description of Artificial Sequence: Synthetic oligonucleotide
  Target: ATXN1; (-) strand; PAM type: YTN; PAM sequence: TTT
tcccccaaagaatttcaaac

SEQ ID NO: 165372 - DNA, 20 bp, Artificial Sequence
  Description of Artificial Sequence: Synthetic oligonucleotide
  Target: ATXN1; (-) strand; PAM type: YTN; PAM sequence: CTT
ttcccccaaagaatttcaaa

SEQ ID NO: 165373 - DNA, 20 bp, Artificial Sequence
  Description of Artificial Sequence: Synthetic oligonucleotide
  Target: ATXN1; (-) strand; PAM type: YTN; PAM sequence: TTA
tatgcttttcccccaaagaa

SEQ ID NO: 165374 - DNA, 20 bp, Artificial Sequence
  Description of Artificial Sequence: Synthetic oligonucleotide
  Target: ATXN1; (-) strand; PAM type: YTN; PAM sequence: CTG
cataagttatatgcttttcc

SEQ ID NO: 165375 - DNA, 20 bp, Artificial Sequence
  Description of Artificial Sequence: Synthetic oligonucleotide
  Target: ATXN1; (-) strand; PAM type: YTN; PAM sequence: CTG
gataacccagggtggtctgc

SEQ ID NO: 165376 - DNA, 20 bp, Artificial Sequence
  Description of Artificial Sequence: Synthetic oligonucleotide
  Target: ATXN1; (-) strand; PAM type: YTN; PAM sequence: TTA
aaaactggataacccagggt

SEQ ID NO: 165377 - DNA, 20 bp, Artificial Sequence
  Description of Artificial Sequence: Synthetic oligonucleotide
  Target: ATXN1; (-) strand; PAM type: YTN; PAM sequence: TTT
aaaaactggataacccaggg

SEQ ID NO: 165378 - DNA, 20 bp, Artificial Sequence
  Description of Artificial Sequence: Synthetic oligonucleotide
  Target: ATXN1; (-) strand; PAM type: YTN; PAM sequence: TTT
taaaaactggataacccagg

SEQ ID NO: 165379 - DNA, 20 bp, Artificial Sequence
  Description of Artificial Sequence: Synthetic oligonucleotide
  Target: ATXN1; (-) strand; PAM type: YTN; PAM sequence: TTT
ttaaaaactggataacccag

SEQ ID NO: 165380 - DNA, 20 bp, Artificial Sequence
  Description of Artificial Sequence: Synthetic oligonucleotide
  Target: ATXN1; (-) strand; PAM type: YTN; PAM sequence: CTA
gtatgcagggatttttaaaa

SEQ ID NO: 165381 - DNA, 20 bp, Artificial Sequence
  Description of Artificial Sequence: Synthetic oligonucleotide
  Target: ATXN1; (-) strand; PAM type: YTN; PAM sequence: TTG
tctagtatgcagggattttt

SEQ ID NO: 165382 - DNA, 20 bp, Artificial Sequence
  Description of Artificial Sequence: Synthetic oligonucleotide
  Target: ATXN1; (-) strand; PAM type: YTN; PAM sequence: TTT
gtctagtatgcagggatttt

SEQ ID NO: 165383 - DNA, 20 bp, Artificial Sequence
  Description of Artificial Sequence: Synthetic oligonucleotide
  Target: ATXN1; (-) strand; PAM type: YTN; PAM sequence: TTA
ggaaagaaacgtggtccaaa

SEQ ID NO: 165384 - DNA, 20 bp, Artificial Sequence
  Description of Artificial Sequence: Synthetic oligonucleotide
  Target: ATXN1; (-) strand; PAM type: YTN; PAM sequence: CTT
aggaaagaaacgtggtccaa

SEQ ID NO: 165385 - DNA, 20 bp, Artificial Sequence
  Description of Artificial Sequence: Synthetic oligonucleotide
  Target: ATXN1; (-) strand; PAM type: YTN; PAM sequence: CTC
ttaggaaagaaacgtggtcc

SEQ ID NO: 165386 - DNA, 20 bp, Artificial Sequence
  Description of Artificial Sequence: Synthetic oligonucleotide
  Target: ATXN1; (-) strand; PAM type: YTN; PAM sequence: TTC
tcttaggaaagaaacgtggt

SEQ ID NO: 165387 - DNA, 20 bp, Artificial Sequence
  Description of Artificial Sequence: Synthetic oligonucleotide
  Target: ATXN1; (-) strand; PAM type: YTN; PAM sequence: CTT
ctcttaggaaagaaacgtgg

SEQ ID NO: 165388 - DNA, 20 bp, Artificial Sequence
  Description of Artificial Sequence: Synthetic oligonucleotide
  Target: ATXN1; (-) strand; PAM type: YTN; PAM sequence: TTC
aagcttctcttaggaaagaa

SEQ ID NO: 165389 - DNA, 20 bp, Artificial Sequence
  Description of Artificial Sequence: Synthetic oligonucleotide
  Target: ATXN1; (-) strand; PAM type: YTN; PAM sequence: CTT
caagcttctcttaggaaaga

SEQ ID NO: 165390 - DNA, 20 bp, Artificial Sequence
  Description of Artificial Sequence: Synthetic oligonucleotide
  Target: ATXN1; (-) strand; PAM type: YTN; PAM sequence: CTG
tcttcaagcttctcttagga

SEQ ID NO: 165391 - DNA, 20 bp, Artificial Sequence
  Description of Artificial Sequence: Synthetic oligonucleotide
  Target: ATXN1; (-) strand; PAM type: YTN; PAM sequence: TTG
ctgtcttcaagcttctctta

SEQ ID NO: 165392 - DNA, 20 bp, Artificial Sequence
  Description of Artificial Sequence: Synthetic oligonucleotide
  Target: ATXN1; (-) strand; PAM type: YTN; PAM sequence: TTT
gctgtcttcaagcttctctt

SEQ ID NO: 165393 - DNA, 20 bp, Artificial Sequence
  Description of Artificial Sequence: Synthetic oligonucleotide
  Target: ATXN1; (-) strand; PAM type: YTN; PAM sequence: TTA
gtttgctgtcttcaagcttc

SEQ ID NO: 165394 - DNA, 20 bp, Artificial Sequence
  Description of Artificial Sequence: Synthetic oligonucleotide
  Target: ATXN1; (-) strand; PAM type: YTN; PAM sequence: TTG
aaaattagtttgctgtcttc

SEQ ID NO: 165395 - DNA, 20 bp, Artificial Sequence
  Description of Artificial Sequence: Synthetic oligonucleotide
  Target: ATXN1; (-) strand; PAM type: YTN; PAM sequence: TTT
gaaaattagtttgctgtctt

SEQ ID NO: 165396 - DNA, 20 bp, Artificial Sequence
  Description of Artificial Sequence: Synthetic oligonucleotide
  Target: ATXN1; (-) strand; PAM type: YTN; PAM sequence: CTA
atttgaaaattagtttgctg

SEQ ID NO: 165397 - DNA, 20 bp, Artificial Sequence
  Description of Artificial Sequence: Synthetic oligonucleotide
  Target: ATXN1; (-) strand; PAM type: YTN; PAM sequence: TTG
acaaatgcctaatttgaaaa

SEQ ID NO: 165398 - DNA, 20 bp, Artificial Sequence
  Description of Artificial Sequence: Synthetic oligonucleotide
  Target: ATXN1; (-) strand; PAM type: YTN; PAM sequence: TTT
gacaaatgcctaatttgaaa

SEQ ID NO: 165399 - DNA, 20 bp, Artificial Sequence
  Description of Artificial Sequence: Synthetic oligonucleotide
  Target: ATXN1; (-) strand; PAM type: YTN; PAM sequence: CTA
aaaatgtttgacaaatgcct

SEQ ID NO: 165400 - DNA, 20 bp, Artificial Sequence
  Description of Artificial Sequence: Synthetic oligonucleotide
  Target: ATXN1; (-) strand; PAM type: YTN; PAM sequence: TTC
ctaaaaatgtttgacaaatg

SEQ ID NO: 165401 - DNA, 20 bp, Artificial Sequence
  Description of Artificial Sequence: Synthetic oligonucleotide
  Target: ATXN1; (-) strand; PAM type: YTN; PAM sequence: CTT
cctaaaaatgtttgacaaat

SEQ ID NO: 165402 - DNA, 20 bp, Artificial Sequence
  Description of Artificial Sequence: Synthetic oligonucleotide
  Target: ATXN1; (-) strand; PAM type: YTN; PAM sequence: TTC
atcttcctaaaaatgtttga

SEQ ID NO: 165403 - DNA, 20 bp, Artificial Sequence
  Description of Artificial Sequence: Synthetic oligonucleotide
  Target: ATXN1; (-) strand; PAM type: YTN; PAM sequence: CTC
aagattcatcttcctaaaaa

SEQ ID NO: 165404 - DNA, 20 bp, Artificial Sequence
  Description of Artificial Sequence: Synthetic oligonucleotide
  Target: ATXN1; (-) strand; PAM type: YTN; PAM sequence: TTG
ctcaagattcatcttcctaa

SEQ ID NO: 165405 - DNA, 20 bp, Artificial Sequence
  Description of Artificial Sequence: Synthetic oligonucleotide
  Target: ATXN1; (-) strand; PAM type: YTN; PAM sequence: TTT
gctcaagattcatcttccta

SEQ ID NO: 165406 - DNA, 20 bp, Artificial Sequence
  Description of Artificial Sequence: Synthetic oligonucleotide
  Target: ATXN1; (-) strand; PAM type: YTN; PAM sequence: TTT
tgctcaagattcatcttcct

SEQ ID NO: 165407 - DNA, 20 bp, Artificial Sequence
  Description of Artificial Sequence: Synthetic oligonucleotide
  Target: ATXN1; (-) strand; PAM type: YTN; PAM sequence: TTG
ttttgctcaagattcatctt

SEQ ID NO: 165408 - DNA, 20 bp, Artificial Sequence
  Description of Artificial Sequence: Synthetic oligonucleotide
  Target: ATXN1; (-) strand; PAM type: YTN; PAM sequence: TTT
gttttgctcaagattcatct

SEQ ID NO: 165409 - DNA, 20 bp, Artificial Sequence
  Description of Artificial Sequence: Synthetic oligonucleotide
  Target: ATXN1; (-) strand; PAM type: YTN; PAM sequence: TTG
aatataatcaaaagtttgtt

SEQ ID NO: 165410 - DNA, 20 bp, Artificial Sequence
  Description of Artificial Sequence: Synthetic oligonucleotide
  Target: ATXN1; (-) strand; PAM type: YTN; PAM sequence: TTT
gaatataatcaaaagtttgt

SEQ ID NO: 165411 - DNA, 20 bp, Artificial Sequence
  Description of Artificial Sequence: Synthetic oligonucleotide
  Target: ATXN1; (-) strand; PAM type: YTN; PAM sequence: TTT
tgaatataatcaaaagtttg

SEQ ID NO: 165412 - DNA, 20 bp, Artificial Sequence
  Description of Artificial Sequence: Synthetic oligonucleotide
  Target: ATXN1; (-) strand; PAM type: YTN; PAM sequence: TTT
ttgaatataatcaaaagttt

SEQ ID NO: 165413 - DNA, 20 bp, Artificial Sequence
  Description of Artificial Sequence: Synthetic oligonucleotide
  Target: ATXN1; (-) strand; PAM type: YTN; PAM sequence: TTT
tttgaatataatcaaaagtt

SEQ ID NO: 165414 - DNA, 20 bp, Artificial Sequence
  Description of Artificial Sequence: Synthetic oligonucleotide
  Target: ATXN1; (-) strand; PAM type: YTN; PAM sequence: TTG
gtgttttttgaatataatca

SEQ ID NO: 165415 - DNA, 20 bp, Artificial Sequence
  Description of Artificial Sequence: Synthetic oligonucleotide
  Target: ATXN1; (-) strand; PAM type: YTN; PAM sequence: TTT
ggtgttttttgaatataatc

SEQ ID NO: 165416 - DNA, 20 bp, Artificial Sequence
  Description of Artificial Sequence: Synthetic oligonucleotide
  Target: ATXN1; (-) strand; PAM type: YTN; PAM sequence: TTT
tggtgttttttgaatataat

SEQ ID NO: 165417 - DNA, 20 bp, Artificial Sequence
  Description of Artificial Sequence: Synthetic oligonucleotide
  Target: ATXN1; (-) strand; PAM type: YTN; PAM sequence: TTT
ttggtgttttttgaatataa

SEQ ID NO: 165418 - DNA, 20 bp, Artificial Sequence
  Description of Artificial Sequence: Synthetic oligonucleotide
  Target: ATXN1; (-) strand; PAM type: YTN; PAM sequence: TTT
tttggtgttttttgaatata

SEQ ID NO: 165419 - DNA, 20 bp, Artificial Sequence
  Description of Artificial Sequence: Synthetic oligonucleotide
  Target: ATXN1; (-) strand; PAM type: YTN; PAM sequence: TTT
ttttggtgttttttgaatat

SEQ ID NO: 165420 - DNA, 20 bp, Artificial Sequence
  Description of Artificial Sequence: Synthetic oligonucleotide
  Target: ATXN1; (-) strand; PAM type: YTN; PAM sequence: CTC
cagaatttttttggtgtttt

SEQ ID NO: 165421 - DNA, 20 bp, Artificial Sequence
  Description of Artificial Sequence: Synthetic oligonucleotide
  Target: ATXN1; (-) strand; PAM type: YTN; PAM sequence: CTA
gatctccagaatttttttgg

SEQ ID NO: 165422 - DNA, 20 bp, Artificial Sequence
  Description of Artificial Sequence: Synthetic oligonucleotide
  Target: ATXN1; (-) strand; PAM type: YTN; PAM sequence: TTC
ccaatctagatctccagaat

SEQ ID NO: 165423 - DNA, 20 bp, Artificial Sequence
  Description of Artificial Sequence: Synthetic oligonucleotide
  Target: ATXN1; (-) strand; PAM type: YTN; PAM sequence: TTT
cccaatctagatctccagaa

SEQ ID NO: 165424 - DNA, 20 bp, Artificial Sequence
  Description of Artificial Sequence: Synthetic oligonucleotide
  Target: ATXN1; (-) strand; PAM type: YTN; PAM sequence: CTT
tcccaatctagatctccaga

SEQ ID NO: 165425 - DNA, 20 bp, Artificial Sequence
  Description of Artificial Sequence: Synthetic oligonucleotide
  Target: ATXN1; (-) strand; PAM type: YTN; PAM sequence: CTG
ctttcccaatctagatctcc

SEQ ID NO: 165426 - DNA, 20 bp, Artificial Sequence
  Description of Artificial Sequence: Synthetic oligonucleotide
  Target: ATXN1; (-) strand; PAM type: YTN; PAM sequence: TTA
tatgacccctgctttcccaa

SEQ ID NO: 165427 - DNA, 20 bp, Artificial Sequence
  Description of Artificial Sequence: Synthetic oligonucleotide
  Target: ATXN1; (-) strand; PAM type: YTN; PAM sequence: TTT
atatgacccctgctttccca

SEQ ID NO: 165428 - DNA, 20 bp, Artificial Sequence
  Description of Artificial Sequence: Synthetic oligonucleotide
  Target: ATXN1; (-) strand; PAM type: YTN; PAM sequence: TTT
tatatgacccctgctttccc

SEQ ID NO: 165429 - DNA, 20 bp, Artificial Sequence
  Description of Artificial Sequence: Synthetic oligonucleotide
  Target: ATXN1; (-) strand; PAM type: YTN; PAM sequence: TTT
ttatatgacccctgctttcc

SEQ ID NO: 165430 - DNA, 20 bp, Artificial Sequence
  Description of Artificial Sequence: Synthetic oligonucleotide
  Target: ATXN1; (-) strand; PAM type: YTN; PAM sequence: CTT
tttatatgacccctgctttc

SEQ ID NO: 165431 - DNA, 20 bp, Artificial Sequence
  Description of Artificial Sequence: Synthetic oligonucleotide
  Target: ATXN1; (-) strand; PAM type: YTN; PAM sequence: TTA
gctttttatatgacccctgc

SEQ ID NO: 165432 - DNA, 20 bp, Artificial Sequence
  Description of Artificial Sequence: Synthetic oligonucleotide
  Target: ATXN1; (-) strand; PAM type: YTN; PAM sequence: CTC
catattagctttttatatga

SEQ ID NO: 165433 - DNA, 20 bp, Artificial Sequence
  Description of Artificial Sequence: Synthetic oligonucleotide
  Target: ATXN1; (-) strand; PAM type: YTN; PAM sequence: TTG
tcaccacagtcctccatatt

SEQ ID NO: 165434 - DNA, 20 bp, Artificial Sequence
  Description of Artificial Sequence: Synthetic oligonucleotide
  Target: ATXN1; (-) strand; PAM type: YTN; PAM sequence: CTG
attgtcaccacagtcctcca

SEQ ID NO: 165435 - DNA, 20 bp, Artificial Sequence
  Description of Artificial Sequence: Synthetic oligonucleotide
  Target: ATXN1; (-) strand; PAM type: YTN; PAM sequence: TTA
tggtctgattgtcaccacag

SEQ ID NO: 165436 - DNA, 20 bp, Artificial Sequence
  Description of Artificial Sequence: Synthetic oligonucleotide
  Target: ATXN1; (-) strand; PAM type: YTN; PAM sequence: CTG
tccgtattatggtctgattg

SEQ ID NO: 165437 - DNA, 20 bp, Artificial Sequence
  Description of Artificial Sequence: Synthetic oligonucleotide
  Target: ATXN1; (-) strand; PAM type: YTN; PAM sequence: TTA
ctgtccgtattatggtctga

SEQ ID NO: 165438 - DNA, 20 bp, Artificial Sequence
  Description of Artificial Sequence: Synthetic oligonucleotide
  Target: ATXN1; (-) strand; PAM type: YTN; PAM sequence: TTG
gtgaaaagaatataaagagg

SEQ ID NO: 165439 - DNA, 20 bp, Artificial Sequence
  Description of Artificial Sequence: Synthetic oligonucleotide
  Target: ATXN1; (-) strand; PAM type: YTN; PAM sequence: CTG
ttggtgaaaagaatataaag

SEQ ID NO: 165440 - DNA, 20 bp, Artificial Sequence
  Description of Artificial Sequence: Synthetic oligonucleotide
  Target: ATXN1; (-) strand; PAM type: YTN; PAM sequence: TTG
agactgttggtgaaaagaat

SEQ ID NO: 165441 - DNA, 20 bp, Artificial Sequence
  Description of Artificial Sequence: Synthetic oligonucleotide
  Target: ATXN1; (-) strand; PAM type: YTN; PAM sequence: TTT
gagactgttggtgaaaagaa

SEQ ID NO: 165442 - DNA, 20 bp, Artificial Sequence
  Description of Artificial Sequence: Synthetic oligonucleotide
  Target: ATXN1; (-) strand; PAM type: YTN; PAM sequence: CTG
aaaccagcatttgagactgt

SEQ ID NO: 165443 - DNA, 20 bp, Artificial Sequence
  Description of Artificial Sequence: Synthetic oligonucleotide
  Target: ATXN1; (-) strand; PAM type: YTN; PAM sequence: TTA
tgctgaaaccagcatttgag

SEQ ID NO: 165444 - DNA, 20 bp, Artificial Sequence
  Description of Artificial Sequence: Synthetic oligonucleotide
  Target: ATXN1; (-) strand; PAM type: YTN; PAM sequence: CTT
atgctgaaaccagcatttga

SEQ ID NO: 165445 - DNA, 20 bp, Artificial Sequence
  Description of Artificial Sequence: Synthetic oligonucleotide
  Target: ATXN1; (-) strand; PAM type: YTN; PAM sequence: TTG
gccttatgctgaaaccagca

SEQ ID NO: 165446 - DNA, 20 bp, Artificial Sequence
  Description of Artificial Sequence: Synthetic oligonucleotide
  Target: ATXN1; (-) strand; PAM type: YTN; PAM sequence: CTT
ggccttatgctgaaaccagc

SEQ ID NO: 165447 - DNA, 20 bp, Artificial Sequence
  Description of Artificial Sequence: Synthetic oligonucleotide
  Target: ATXN1; (-) strand; PAM type: YTN; PAM sequence: TTC
ttggccttatgctgaaacca

SEQ ID NO: 165448 - DNA, 20 bp, Artificial Sequence
  Description of Artificial Sequence: Synthetic oligonucleotide
  Target: ATXN1; (-) strand; PAM type: YTN; PAM sequence: TTT
cttggccttatgctgaaacc

SEQ ID NO: 165449 - DNA, 20 bp, Artificial Sequence
  Description of Artificial Sequence: Synthetic oligonucleotide
  Target: ATXN1; (-) strand; PAM type: YTN; PAM sequence: TTG
ggtttcttggccttatgctg

SEQ ID NO: 165450 - DNA, 20 bp, Artificial Sequence
  Description of Artificial Sequence: Synthetic oligonucleotide
  Target: ATXN1; (-) strand; PAM type: YTN; PAM sequence: TTT
gggtttcttggccttatgct

SEQ ID NO: 165451 - DNA, 20 bp, Artificial Sequence
  Description of Artificial Sequence: Synthetic oligonucleotide
  Target: ATXN1; (-) strand; PAM type: YTN; PAM sequence: TTC
catatagatttgggtttctt

SEQ ID NO: 165452 - DNA, 20 bp, Artificial Sequence
  Description of Artificial Sequence: Synthetic oligonucleotide
  Target: ATXN1; (-) strand; PAM type: YTN; PAM sequence: TTG
cataaattccatatagattt

SEQ ID NO: 165453 - DNA, 20 bp, Artificial Sequence
  Description of Artificial Sequence: Synthetic oligonucleotide
  Target: ATXN1; (-) strand; PAM type: YTN; PAM sequence: TTT
gcataaattccatatagatt

SEQ ID NO: 165454 - DNA, 20 bp, Artificial Sequence
  Description of Artificial Sequence: Synthetic oligonucleotide
  Target: ATXN1; (-) strand; PAM type: YTN; PAM sequence: CTA
taaatgaatataaatcgatg

SEQ ID NO: 165455 - DNA, 20 bp, Artificial Sequence
  Description of Artificial Sequence: Synthetic oligonucleotide
  Target: ATXN1; (-) strand; PAM type: YTN; PAM sequence: TTA
taaatggaataactataaat

SEQ ID NO: 165456 - DNA, 20 bp, Artificial Sequence
  Description of Artificial Sequence: Synthetic oligonucleotide
  Target: ATXN1; (-) strand; PAM type: YTN; PAM sequence: TTT
ataaatggaataactataaa

SEQ ID NO: 165457 - DNA, 20 bp, Artificial Sequence
  Description of Artificial Sequence: Synthetic oligonucleotide
  Target: ATXN1; (-) strand; PAM type: YTN; PAM sequence: TTT
tataaatggaataactataa

SEQ ID NO: 165458 - DNA, 20 bp, Artificial Sequence
  Description of Artificial Sequence: Synthetic oligonucleotide
  Target: ATXN1; (-) strand; PAM type: YTN; PAM sequence: CTG
cattttataaatggaataac

SEQ ID NO: 165459 - DNA, 20 bp, Artificial Sequence
  Description of Artificial Sequence: Synthetic oligonucleotide
  Target: ATXN1; (-) strand; PAM type: YTN; PAM sequence: CTA
taaaataagctgcattttat

SEQ ID NO: 165460 - DNA, 20 bp, Artificial Sequence
  Description of Artificial Sequence: Synthetic oligonucleotide
  Target: ATXN1; (-) strand; PAM type: YTN; PAM sequence: TTC
gccacctataaaataagctg

SEQ ID NO: 165461 - DNA, 20 bp, Artificial Sequence
  Description of Artificial Sequence: Synthetic oligonucleotide
  Target: ATXN1; (-) strand; PAM type: YTN; PAM sequence: TTT
cgccacctataaaataagct

SEQ ID NO: 165462 - DNA, 20 bp, Artificial Sequence
  Description of Artificial Sequence: Synthetic oligonucleotide
  Target: ATXN1; (-) strand; PAM type: YTN; PAM sequence: CTG
tttcgccacctataaaataa

SEQ ID NO: 165463 - DNA, 20 bp, Artificial Sequence
  Description of Artificial Sequence: Synthetic oligonucleotide
  Target: ATXN1; (-) strand; PAM type: YTN; PAM sequence: CTA
ggcctgtttcgccacctata

SEQ ID NO: 165464 - DNA, 20 bp, Artificial Sequence
  Description of Artificial Sequence: Synthetic oligonucleotide
  Target: ATXN1; (-) strand; PAM type: YTN; PAM sequence: CTC
taggcctgtttcgccaccta

SEQ ID NO: 165465 - DNA, 20 bp, Artificial Sequence
  Description of Artificial Sequence: Synthetic oligonucleotide
  Target: ATXN1; (-) strand; PAM type: YTN; PAM sequence: TTG
tctctaggcctgtttcgcca

SEQ ID NO: 165466 - DNA, 20 bp, Artificial Sequence
  Description of Artificial Sequence: Synthetic oligonucleotide
  Target: ATXN1; (-) strand; PAM type: YTN; PAM sequence: TTT
gtctctaggcctgtttcgcc

SEQ ID NO: 165467 - DNA, 20 bp, Artificial Sequence
  Description of Artificial Sequence: Synthetic oligonucleotide
  Target: ATXN1; (-) strand; PAM type: YTN; PAM sequence: TTA
gtagtgcatatttgtctcta

SEQ ID NO: 165468 - DNA, 20 bp, Artificial Sequence
  Description of Artificial Sequence: Synthetic oligonucleotide
  Target: ATXN1; (-) strand; PAM type: YTN; PAM sequence: CTT
agtagtgcatatttgtctct

SEQ ID NO: 165469 - DNA, 20 bp, Artificial Sequence
  Description of Artificial Sequence: Synthetic oligonucleotide
  Target: ATXN1; (-) strand; PAM type: YTN; PAM sequence: CTC
aaacccataggaccttagta

SEQ ID NO: 165470 - DNA, 20 bp, Artificial Sequence
  Description of Artificial Sequence: Synthetic oligonucleotide
  Target: ATXN1; (-) strand; PAM type: YTN; PAM sequence: CTC
aaaaagcaaaaaaaaataaa

SEQ ID NO: 165471 - DNA, 20 bp, Artificial Sequence
  Description of Artificial Sequence: Synthetic oligonucleotide
  Target: ATXN1; (-) strand; PAM type: YTN; PAM sequence: CTG
cgtctcaaaaagcaaaaaaa

SEQ ID NO: 165472 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagtgagactgcg

SEQ ID NO: 165473 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgacagagtga

SEQ ID NO: 165474 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggtgacag

SEQ ID NO: 165475 - DNA, 20 bp, Artificial Sequence
  Description of Artificial Sequence: Synthetic oligonucleotide
  Target: ATXN1; (-) strand; PAM type: YTN; PAM sequence: TTG
cagtgagccggggtcacgcc

SEQ ID NO: 165476 - DNA, 20 bp, Artificial Sequence
  Description of Artificial Sequence: Synthetic oligonucleotide
  Target: ATXN1; (-) strand; PAM type: YTN; PAM sequence: TTG
aacccgggaggcagaggttg

SEQ ID NO: 165477 - DNA, 20 bp, Artificial Sequence
  Description of Artificial Sequence: Synthetic oligonucleotide
  Target: ATXN1; (-) strand; PAM type: YTN; PAM sequence: CTT
gaacccgggaggcagaggtt

SEQ ID NO: 165478 - DNA, 20 bp, Artificial Sequence
  Description of Artificial Sequence: Synthetic oligonucleotide
  Target: ATXN1; (-) strand; PAM type: YTN; PAM sequence: CTG
aggcagaagaaccgcttgaa

SEQ ID NO: 165479 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggcagaagaa

SEQ ID NO: 165480 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgaggcagaa

SEQ ID NO: 165481 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctactcaggag

SEQ ID NO: 165482 - DNA, 20 bp, Artificial Sequence
  Description of Artificial Sequence: Synthetic oligonucleotide
  Target: ATXN1; (-) strand; PAM type: YTN; PAM sequence: TTA
gccgggcatggtggcgggca

SEQ ID NO: 165483 - DNA, 20 bp, Artificial Sequence
  Description of Artificial Sequence: Synthetic oligonucleotide
  Target: ATXN1; (-) strand; PAM type: YTN; PAM sequence: CTA
ccaaaaatacaaaaattagc

SEQ ID NO: 165484 - DNA, 20 bp, Artificial Sequence
  Description of Artificial Sequence: Synthetic oligonucleotide
  Target: ATXN1; (-) strand; PAM type: YTN; PAM sequence: CTC
taccaaaaatacaaaaatta

SEQ ID NO: 165485 - DNA, 20 bp, Artificial Sequence
  Description of Artificial Sequence: Synthetic oligonucleotide
  Target: ATXN1; (-) strand; PAM type: YTN; PAM sequence: CTC
gcctctaccaaaaatacaaa

SEQ ID NO: 165486 - DNA, 20 bp, Artificial Sequence
  Description of Artificial Sequence: Synthetic oligonucleotide
  Target: ATXN1; (-) strand; PAM type: YTN; PAM sequence: CTG
accaacatggtgaaatctcg

SEQ ID NO: 165487 - DNA, 20 bp, Artificial Sequence
  Description of Artificial Sequence: Synthetic oligonucleotide
  Target: ATXN1; (-) strand; PAM type: YTN; PAM sequence: TTG
agaccagcctgaccaacatg

SEQ ID NO: 165488 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctgaccaacat

SEQ ID NO: 165489 - DNA, 20 bp, Artificial Sequence
  Description of Artificial Sequence: Synthetic oligonucleotide
  Target: ATXN1; (-) strand; PAM type: YTN; PAM sequence: TTG
aggtcaggagtttgagacca

SEQ ID NO: 165490 - DNA, 20 bp, Artificial Sequence
  Description of Artificial Sequence: Synthetic oligonucleotide
  Target: ATXN1; (-) strand; PAM type: YTN; PAM sequence: TTT
gaggtcaggagtttgagacc

SEQ ID NO: 165491 - DNA, 20 bp, Artificial Sequence
  Description of Artificial Sequence: Synthetic oligonucleotide
  Target: ATXN1; (-) strand; PAM type: YTN; PAM sequence: TTG
ggaggccgatgtgggtggat

SEQ ID NO: 165492 - DNA, 20 bp, Artificial Sequence
  Description of Artificial Sequence: Synthetic oligonucleotide
  Target: ATXN1; (-) strand; PAM type: YTN; PAM sequence: TTT
gggaggccgatgtgggtgga

SEQ ID NO: 165493 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgatgtgggtgg

SEQ ID NO: 165494 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 165495 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatcccagcact

SEQ ID NO: 165496 - DNA, 20 bp, Artificial Sequence
  Description of Artificial Sequence: Synthetic oligonucleotide
  Target: ATXN1; (-) strand; PAM type: YTN; PAM sequence: TTG
gccaggcatggtggctcaca

SEQ ID NO: 165497 - DNA, 20 bp, Artificial Sequence
  Description of Artificial Sequence: Synthetic oligonucleotide
  Target: ATXN1; (-) strand; PAM type: YTN; PAM sequence: CTT
ggccaggcatggtggctcac

SEQ ID NO: 165498 - DNA, 20 bp, Artificial Sequence
  Description of Artificial Sequence: Synthetic oligonucleotide
  Target: ATXN1; (-) strand; PAM type: YTN; PAM sequence: TTA
aaatgtcttggccaggcatg

SEQ ID NO: 165499 - DNA, 20 bp, Artificial Sequence
  Description of Artificial Sequence: Synthetic oligonucleotide
  Target: ATXN1; (-) strand; PAM type: YTN; PAM sequence: TTA
attaaaatgtcttggccagg

SEQ ID NO: 165500 - DNA, 20 bp, Artificial Sequence
  Description of Artificial Sequence: Synthetic oligonucleotide
  Target: ATXN1; (-) strand; PAM type: YTN; PAM sequence: TTT
aattaaaatgtcttggccag

SEQ ID NO: 165501 - DNA, 20 bp, Artificial Sequence
  Description of Artificial Sequence: Synthetic oligonucleotide
  Target: ATXN1; (-) strand; PAM type: YTN; PAM sequence: TTA
agcatttaattaaaatgtct

SEQ ID NO: 165502 - DNA, 20 bp, Artificial Sequence
  Description of Artificial Sequence: Synthetic oligonucleotide
  Target: ATXN1; (-) strand; PAM type: YTN; PAM sequence: CTC
ggttaagcatttaattaaaa

SEQ ID NO: 165503 - DNA, 20 bp, Artificial Sequence
  Description of Artificial Sequence: Synthetic oligonucleotide
  Target: ATXN1; (-) strand; PAM type: YTN; PAM sequence: CTG
gactcggttaagcatttaat

SEQ ID NO: 165504 - DNA, 20 bp, Artificial Sequence
  Description of Artificial Sequence: Synthetic oligonucleotide
  Target: ATXN1; (-) strand; PAM type: YTN; PAM sequence: TTC
tggactcggttaagcattta

SEQ ID NO: 165505 - DNA, 20 bp, Artificial Sequence
  Description of Artificial Sequence: Synthetic oligonucleotide
  Target: ATXN1; (-) strand; PAM type: YTN; PAM sequence: TTA
gaaagatcaaattctggact

SEQ ID NO: 165506 - DNA, 20 bp, Artificial Sequence
  Description of Artificial Sequence: Synthetic oligonucleotide
  Target: ATXN1; (-) strand; PAM type: YTN; PAM sequence: CTG
cacggggagccatggtgtag

SEQ ID NO: 165507 - DNA, 20 bp, Artificial Sequence
  Description of Artificial Sequence: Synthetic oligonucleotide
  Target: ATXN1; (-) strand; PAM type: YTN; PAM sequence: TTC
tgcacggggagccatggtgt

SEQ ID NO: 165508 - DNA, 20 bp, Artificial Sequence
  Description of Artificial Sequence: Synthetic oligonucleotide
  Target: ATXN1; (-) strand; PAM type: YTN; PAM sequence: CTT
ctgcacggggagccatggtg

SEQ ID NO: 165509 - DNA, 20 bp, Artificial Sequence
  Description of Artificial Sequence: Synthetic oligonucleotide
  Target: ATXN1; (-) strand; PAM type: YTN; PAM sequence: TTG
cagtcttctgcacggggagc

SEQ ID NO: 165510 - DNA, 20 bp, Artificial Sequence
  Description of Artificial Sequence: Synthetic oligonucleotide
  Target: ATXN1; (-) strand; PAM type: YTN; PAM sequence: TTG
gattgcagtcttctgcacgg

SEQ ID NO: 165511 - DNA, 20 bp, Artificial Sequence
  Description of Artificial Sequence: Synthetic oligonucleotide
  Target: ATXN1; (-) strand; PAM type: YTN; PAM sequence: CTG
attggattgcagtcttctgc

SEQ ID NO: 165512 - DNA, 20 bp, Artificial Sequence
  Description of Artificial Sequence: Synthetic oligonucleotide
  Target: ATXN1; (-) strand; PAM type: YTN; PAM sequence: CTG
agctgattggattgcagtct

SEQ ID NO: 165513 - DNA, 20 bp, Artificial Sequence
  Description of Artificial Sequence: Synthetic oligonucleotide
  Target: ATXN1; (-) strand; PAM type: YTN; PAM sequence: CTG
ggaactgagctgattggatt

SEQ ID NO: 165514 - DNA, 20 bp, Artificial Sequence
  Description of Artificial Sequence: Synthetic oligonucleotide
  Target: ATXN1; (-) strand; PAM type: YTN; PAM sequence: CTC
tgggaactgagctgattgga

SEQ ID NO: 165515 - DNA, 20 bp, Artificial Sequence
  Description of Artificial Sequence: Synthetic oligonucleotide
  Target: ATXN1; (-) strand; PAM type: YTN; PAM sequence: CTA
gaccctctgggaactgagct

SEQ ID NO: 165516 - DNA, 20 bp, Artificial Sequence
  Description of Artificial Sequence: Synthetic oligonucleotide
  Target: ATXN1; (-) strand; PAM type: YTN; PAM sequence: CTG
agtctagaccctctgggaac

SEQ ID NO: 165517 - DNA, 20 bp, Artificial Sequence
  Description of Artificial Sequence: Synthetic oligonucleotide
  Target: ATXN1; (-) strand; PAM type: YTN; PAM sequence: CTA
cctgagtctagaccctctgg

SEQ ID NO: 165518 - DNA, 20 bp, Artificial Sequence
  Description of Artificial Sequence: Synthetic oligonucleotide
  Target: ATXN1; (-) strand; PAM type: YTN; PAM sequence: TTG
tcgctacctgagtctagacc

SEQ ID NO: 165519 - DNA, 20 bp, Artificial Sequence
  Description of Artificial Sequence: Synthetic oligonucleotide
  Target: ATXN1; (-) strand; PAM type: YTN; PAM sequence: TTA
ttgtcgctacctgagtctag

SEQ ID NO: 165520 - DNA, 20 bp, Artificial Sequence
  Description of Artificial Sequence: Synthetic oligonucleotide
  Target: ATXN1; (-) strand; PAM type: YTN; PAM sequence: TTT
attgtcgctacctgagtcta

SEQ ID NO: 165521 - DNA, 20 bp, Artificial Sequence
  Description of Artificial Sequence: Synthetic oligonucleotide
  Target: ATXN1; (-) strand; PAM type: YTN; PAM sequence: TTC
catgtttattgtcgctacct

SEQ ID NO: 165522 - DNA, 20 bp, Artificial Sequence
  Description of Artificial Sequence: Synthetic oligonucleotide
  Target: ATXN1; (-) strand; PAM type: YTN; PAM sequence: CTT
ccatgtttattgtcgctacc

SEQ ID NO: 165523 - DNA, 20 bp, Artificial Sequence
  Description of Artificial Sequence: Synthetic oligonucleotide
  Target: ATXN1; (-) strand; PAM type: YTN; PAM sequence: CTC
ttccatgtttattgtcgcta

SEQ ID NO: 165524 - DNA, 20 bp, Artificial Sequence
  Description of Artificial Sequence: Synthetic oligonucleotide
  Target: ATXN1; (-) strand; PAM type: YTN; PAM sequence: CTC
tcttccatgtttattgtcgc

SEQ ID NO: 165525 - DNA, 20 bp, Artificial Sequence
  Description of Artificial Sequence: Synthetic oligonucleotide
  Target: ATXN1; (-) strand; PAM type: YTN; PAM sequence: TTG
tctctcttccatgtttattg

SEQ ID NO: 165526 - DNA, 20 bp, Artificial Sequence
  Description of Artificial Sequence: Synthetic oligonucleotide
  Target: ATXN1; (-) strand; PAM type: YTN; PAM sequence: TTT
gtctctcttccatgtttatt

SEQ ID NO: 165527 - DNA, 20 bp, Artificial Sequence
  Description of Artificial Sequence: Synthetic oligonucleotide
  Target: ATXN1; (-) strand; PAM type: YTN; PAM sequence: TTT
tgtctctcttccatgtttat

SEQ ID NO: 165528 - DNA, 20 bp, Artificial Sequence
  Description of Artificial Sequence: Synthetic oligonucleotide
  Target: ATXN1; (-) strand; PAM type: YTN; PAM sequence: TTT
ttgtctctcttccatgttta

SEQ ID NO: 165529 - DNA, 20 bp, Artificial Sequence
  Description of Artificial Sequence: Synthetic oligonucleotide
  Target: ATXN1; (-) strand; PAM type: YTN; PAM sequence: TTT
tttgtctctcttccatgttt

SEQ ID NO: 165530 - DNA, 20 bp, Artificial Sequence
  Description of Artificial Sequence: Synthetic oligonucleotide
  Target: ATXN1; (-) strand; PAM type: YTN; PAM sequence: TTG
ccaattttttgtctctcttc

SEQ ID NO: 165531 - DNA, 20 bp, Artificial Sequence
  Description of Artificial Sequence: Synthetic oligonucleotide
  Target: ATXN1; (-) strand; PAM type: YTN; PAM sequence: CTT
gccaattttttgtctctctt

SEQ ID NO: 165532 - DNA, 20 bp, Artificial Sequence
  Description of Artificial Sequence: Synthetic oligonucleotide
  Target: ATXN1; (-) strand; PAM type: YTN; PAM sequence: CTC
gagccttgccaattttttgt

SEQ ID NO: 165533 - DNA, 20 bp, Artificial Sequence
  Description of Artificial Sequence: Synthetic oligonucleotide
  Target: ATXN1; (-) strand; PAM type: YTN; PAM sequence: TTC
ctcgagccttgccaattttt

SEQ ID NO: 165534 - DNA, 20 bp, Artificial Sequence
  Description of Artificial Sequence: Synthetic oligonucleotide
  Target: ATXN1; (-) strand; PAM type: YTN; PAM sequence: TTC
catcaatcattcctcgagcc

SEQ ID NO: 165535 - DNA, 20 bp, Artificial Sequence
  Description of Artificial Sequence: Synthetic oligonucleotide
  Target: ATXN1; (-) strand; PAM type: YTN; PAM sequence: CTT
ccatcaatcattcctcgagc

SEQ ID NO: 165536 - DNA, 20 bp, Artificial Sequence
  Description of Artificial Sequence: Synthetic oligonucleotide
  Target: ATXN1; (-) strand; PAM type: YTN; PAM sequence: TTC
aacccagcttccatcaatca

SEQ ID NO: 165537 - DNA, 20 bp, Artificial Sequence
  Description of Artificial Sequence: Synthetic oligonucleotide
  Target: ATXN1; (-) strand; PAM type: YTN; PAM sequence: TTG
gttcaacccagcttccatca

SEQ ID NO: 165538 - DNA, 20 bp, Artificial Sequence
  Description of Artificial Sequence: Synthetic oligonucleotide
  Target: ATXN1; (-) strand; PAM type: YTN; PAM sequence: TTT
ggttcaacccagcttccatc

SEQ ID NO: 165539 - DNA, 20 bp, Artificial Sequence
  Description of Artificial Sequence: Synthetic oligonucleotide
  Target: ATXN1; (-) strand; PAM type: YTN; PAM sequence: CTT
tggttcaacccagcttccat

SEQ ID NO: 165540 - DNA, 20 bp, Artificial Sequence
  Description of Artificial Sequence: Synthetic oligonucleotide
  Target: ATXN1; (-) strand; PAM type: YTN; PAM sequence: CTC
ctttggttcaacccagcttc

SEQ ID NO: 165541 - DNA, 20 bp, Artificial Sequence
  Description of Artificial Sequence: Synthetic oligonucleotide
  Target: ATXN1; (-) strand; PAM type: YTN; PAM sequence: CTC
ccactcctttggttcaaccc

SEQ ID NO: 165542 - DNA, 20 bp, Artificial Sequence
  Description of Artificial Sequence: Synthetic oligonucleotide
  Target: ATXN1; (-) strand; PAM type: YTN; PAM sequence: CTG
agagctcccactcctttggt

SEQ ID NO: 165543 - DNA, 20 bp, Artificial Sequence
  Description of Artificial Sequence: Synthetic oligonucleotide
  Target: ATXN1; (-) strand; PAM type: YTN; PAM sequence: TTC
ccacctgagagctcccactc

SEQ ID NO: 165544 - DNA, 20 bp, Artificial Sequence
  Description of Artificial Sequence: Synthetic oligonucleotide
  Target: ATXN1; (-) strand; PAM type: YTN; PAM sequence: CTA
ttcccacctgagagctccca

SEQ ID NO: 165545 - DNA, 20 bp, Artificial Sequence
  Description of Artificial Sequence: Synthetic oligonucleotide
  Target: ATXN1; (-) strand; PAM type: YTN; PAM sequence: TTC
ctattcccacctgagagctc

SEQ ID NO: 165546 - DNA, 20 bp, Artificial Sequence
  Description of Artificial Sequence: Synthetic oligonucleotide
  Target: ATXN1; (-) strand; PAM type: YTN; PAM sequence: TTT
cctattcccacctgagagct

SEQ ID NO: 165547 - DNA, 20 bp, Artificial Sequence
  Description of Artificial Sequence: Synthetic oligonucleotide
  Target: ATXN1; (-) strand; PAM type: YTN; PAM sequence: CTT
tcctattcccacctgagagc

SEQ ID NO: 165548 - DNA, 20 bp, Artificial Sequence
  Description of Artificial Sequence: Synthetic oligonucleotide
  Target: ATXN1; (-) strand; PAM type: YTN; PAM sequence: TTG
tacctttcctattcccacct

SEQ ID NO: 165549 - DNA, 20 bp, Artificial Sequence
  Description of Artificial Sequence: Synthetic oligonucleotide
  Target: ATXN1; (-) strand; PAM type: YTN; PAM sequence: TTG
cagttgtacctttcctattc

SEQ ID NO: 165550 - DNA, 20 bp, Artificial Sequence
  Description of Artificial Sequence: Synthetic oligonucleotide
  Target: ATXN1; (-) strand; PAM type: YTN; PAM sequence: TTA
ttgcagttgtacctttccta

SEQ ID NO: 165551 - DNA, 20 bp, Artificial Sequence
  Description of Artificial Sequence: Synthetic oligonucleotide
  Target: ATXN1; (-) strand; PAM type: YTN; PAM sequence: CTT
attgcagttgtacctttcct

SEQ ID NO: 165552 - DNA, 20 bp, Artificial Sequence
  Description of Artificial Sequence: Synthetic oligonucleotide
  Target: ATXN1; (-) strand; PAM type: YTN; PAM sequence: CTG
tgtatcttattgcagttgta

SEQ ID NO: 165553 - DNA, 20 bp, Artificial Sequence
  Description of Artificial Sequence: Synthetic oligonucleotide
  Target: ATXN1; (-) strand; PAM type: YTN; PAM sequence: TTC
tgtgtatcttattgcagttg

SEQ ID NO: 165554 - DNA, 20 bp, Artificial Sequence
  Description of Artificial Sequence: Synthetic oligonucleotide
  Target: ATXN1; (-) strand; PAM type: YTN; PAM sequence: CTG
tccattctgtgtatcttatt

SEQ ID NO: 165555 - DNA, 20 bp, Artificial Sequence
  Description of Artificial Sequence: Synthetic oligonucleotide
  Target: ATXN1; (-) strand; PAM type: YTN; PAM sequence: CTC
tgtccattctgtgtatctta

SEQ ID NO: 165556 - DNA, 20 bp, Artificial Sequence
  Description of Artificial Sequence: Synthetic oligonucleotide
  Target: ATXN1; (-) strand; PAM type: YTN; PAM sequence: TTA
gcactctgtccattctgtgt

SEQ ID NO: 165557 - DNA, 20 bp, Artificial Sequence
  Description of Artificial Sequence: Synthetic oligonucleotide
  Target: ATXN1; (-) strand; PAM type: YTN; PAM sequence: CTT
agcactctgtccattctgtg

SEQ ID NO: 165558 - DNA, 20 bp, Artificial Sequence
  Description of Artificial Sequence: Synthetic oligonucleotide
  Target: ATXN1; (-) strand; PAM type: YTN; PAM sequence: CTA
gcttagcactctgtccattc

SEQ ID NO: 165559 - DNA, 20 bp, Artificial Sequence
  Description of Artificial Sequence: Synthetic oligonucleotide
  Target: ATXN1; (-) strand; PAM type: YTN; PAM sequence: CTC
tagcttagcactctgtccat

SEQ ID NO: 165560 - DNA, 20 bp, Artificial Sequence
  Description of Artificial Sequence: Synthetic oligonucleotide
  Target: ATXN1; (-) strand; PAM type: YTN; PAM sequence: CTC
ctctagcttagcactctgtc

SEQ ID NO: 165561 - DNA, 20 bp, Artificial Sequence
  Description of Artificial Sequence: Synthetic oligonucleotide
  Target: ATXN1; (-) strand; PAM type: YTN; PAM sequence: CTG
cccctcctctagcttagcac

SEQ ID NO: 165562 - DNA, 20 bp, Artificial Sequence
  Description of Artificial Sequence: Synthetic oligonucleotide
  Target: ATXN1; (-) strand; PAM type: YTN; PAM sequence: TTA
tctgcccctcctctagctta

SEQ ID NO: 165563 - DNA, 20 bp, Artificial Sequence
  Description of Artificial Sequence: Synthetic oligonucleotide
  Target: ATXN1; (-) strand; PAM type: YTN; PAM sequence: TTA
ttatctgcccctcctctagc

SEQ ID NO: 165564 - DNA, 20 bp, Artificial Sequence
  Description of Artificial Sequence: Synthetic oligonucleotide
  Target: ATXN1; (-) strand; PAM type: YTN; PAM sequence: TTT
attatctgcccctcctctag

SEQ ID NO: 165565 - DNA, 20 bp, Artificial Sequence
  Description of Artificial Sequence: Synthetic oligonucleotide
  Target: ATXN1; (-) strand; PAM type: YTN; PAM sequence: CTT
tattatctgcccctcctcta

SEQ ID NO: 165566 - DNA, 20 bp, Artificial Sequence
  Description of Artificial Sequence: Synthetic oligonucleotide
  Target: ATXN1; (-) strand; PAM type: YTN; PAM sequence: TTA
acgagctttattatctgccc

SEQ ID NO: 165567 - DNA, 20 bp, Artificial Sequence
  Description of Artificial Sequence: Synthetic oligonucleotide
  Target: ATXN1; (-) strand; PAM type: YTN; PAM sequence: TTA
ttaacgagctttattatctg

SEQ ID NO: 165568 - DNA, 20 bp, Artificial Sequence
  Description of Artificial Sequence: Synthetic oligonucleotide
  Target: ATXN1; (-) strand; PAM type: YTN; PAM sequence: TTT
attaacgagctttattatct

SEQ ID NO: 165569 - DNA, 20 bp, Artificial Sequence
  Description of Artificial Sequence: Synthetic oligonucleotide
  Target: ATXN1; (-) strand; PAM type: YTN; PAM sequence: CTT
tattaacgagctttattatc

SEQ ID NO: 165570 - DNA, 20 bp, Artificial Sequence
  Description of Artificial Sequence: Synthetic oligonucleotide
  Target: ATXN1; (-) strand; PAM type: YTN; PAM sequence: CTA
tctttattaacgagctttat

SEQ ID NO: 165571 - DNA, 20 bp, Artificial Sequence
  Description of Artificial Sequence: Synthetic oligonucleotide
  Target: ATXN1; (-) strand; PAM type: YTN; PAM sequence: TTA
ctatctttattaacgagctt

SEQ ID NO: 165572 - DNA, 20 bp, Artificial Sequence
  Description of Artificial Sequence: Synthetic oligonucleotide
  Target: ATXN1; (-) strand; PAM type: YTN; PAM sequence: CTT
actatctttattaacgagct

SEQ ID NO: 165573 - DNA, 20 bp, Artificial Sequence
  Description of Artificial Sequence: Synthetic oligonucleotide
  Target: ATXN1; (-) strand; PAM type: YTN; PAM sequence: CTA
aatgggtcttactatcttta

SEQ ID NO: 165574 - DNA, 20 bp, Artificial Sequence
  Description of Artificial Sequence: Synthetic oligonucleotide
  Target: ATXN1; (-) strand; PAM type: YTN; PAM sequence: TTA
gagccacgtaaagctaaatg

SEQ ID NO: 165575 - DNA, 20 bp, Artificial Sequence
  Description of Artificial Sequence: Synthetic oligonucleotide
  Target: ATXN1; (-) strand; PAM type: YTN; PAM sequence: CTT
agagccacgtaaagctaaat

SEQ ID NO: 165576 - DNA, 20 bp, Artificial Sequence
  Description of Artificial Sequence: Synthetic oligonucleotide
  Target: ATXN1; (-) strand; PAM type: YTN; PAM sequence: TTA
tcttagagccacgtaaagct

SEQ ID NO: 165577 - DNA, 20 bp, Artificial Sequence
  Description of Artificial Sequence: Synthetic oligonucleotide
  Target: ATXN1; (-) strand; PAM type: YTN; PAM sequence: TTT
atcttagagccacgtaaagc

SEQ ID NO: 165578 - DNA, 20 bp, Artificial Sequence
  Description of Artificial Sequence: Synthetic oligonucleotide
  Target: ATXN1; (-) strand; PAM type: YTN; PAM sequence: CTG
tatgtttatcttagagccac

SEQ ID NO: 165579 - DNA, 20 bp, Artificial Sequence
  Description of Artificial Sequence: Synthetic oligonucleotide
  Target: ATXN1; (-) strand; PAM type: YTN; PAM sequence: TTC
ctgtatgtttatcttagagc

SEQ ID NO: 165580 - DNA, 20 bp, Artificial Sequence
  Description of Artificial Sequence: Synthetic oligonucleotide
  Target: ATXN1; (-) strand; PAM type: YTN; PAM sequence: TTC
aggagagttcctgtatgttt

SEQ ID NO: 165581 - DNA, 20 bp, Artificial Sequence
  Description of Artificial Sequence: Synthetic oligonucleotide
  Target: ATXN1; (-) strand; PAM type: YTN; PAM sequence: TTT
caggagagttcctgtatgtt

SEQ ID NO: 165582 - DNA, 20 bp, Artificial Sequence
  Description of Artificial Sequence: Synthetic oligonucleotide
  Target: ATXN1; (-) strand; PAM type: YTN; PAM sequence: CTT
tcaggagagttcctgtatgt

SEQ ID NO: 165583 - DNA, 20 bp, Artificial Sequence
  Description of Artificial Sequence: Synthetic oligonucleotide
  Target: ATXN1; (-) strand; PAM type: YTN; PAM sequence: TTG
gtcctttcaggagagttcct

SEQ ID NO: 165584 - DNA, 20 bp, Artificial Sequence
  Description of Artificial Sequence: Synthetic oligonucleotide
  Target: ATXN1; (-) strand; PAM type: YTN; PAM sequence: CTT
ggtcctttcaggagagttcc

SEQ ID NO: 165585 - DNA, 20 bp, Artificial Sequence
  Description of Artificial Sequence: Synthetic oligonucleotide
  Target: ATXN1; (-) strand; PAM type: YTN; PAM sequence: CTC
ttggtcctttcaggagagtt

SEQ ID NO: 165586 - DNA, 20 bp, Artificial Sequence
  Description of Artificial Sequence: Synthetic oligonucleotide
  Target: ATXN1; (-) strand; PAM type: YTN; PAM sequence: CTA
ctcttggtcctttcaggaga

SEQ ID NO: 165587 - DNA, 20 bp, Artificial Sequence
  Description of Artificial Sequence: Synthetic oligonucleotide
  Target: ATXN1; (-) strand; PAM type: YTN; PAM sequence: TTA
cctactcttggtcctttcag

SEQ ID NO: 165588 - DNA, 20 bp, Artificial Sequence
  Description of Artificial Sequence: Synthetic oligonucleotide
  Target: ATXN1; (-) strand; PAM type: YTN; PAM sequence: CTT
acctactcttggtcctttca

SEQ ID NO: 165589 - DNA, 20 bp, Artificial Sequence
  Description of Artificial Sequence: Synthetic oligonucleotide
  Target: ATXN1; (-) strand; PAM type: YTN; PAM sequence: TTC
ccttacctactcttggtcct

SEQ ID NO: 165590 - DNA, 20 bp, Artificial Sequence
  Description of Artificial Sequence: Synthetic oligonucleotide
  Target: ATXN1; (-) strand; PAM type: YTN; PAM sequence: CTG
tcaccccgttcccttaccta

SEQ ID NO: 165591 - DNA, 20 bp, Artificial Sequence
  Description of Artificial Sequence: Synthetic oligonucleotide
  Target: ATXN1; (-) strand; PAM type: YTN; PAM sequence: TTC
tgtcaccccgttcccttacc

SEQ ID NO: 165592 - DNA, 20 bp, Artificial Sequence
  Description of Artificial Sequence: Synthetic oligonucleotide
  Target: ATXN1; (-) strand; PAM type: YTN; PAM sequence: CTT
ctgtcaccccgttcccttac

SEQ ID NO: 165593 - DNA, 20 bp, Artificial Sequence
  Description of Artificial Sequence: Synthetic oligonucleotide
  Target: ATXN1; (-) strand; PAM type: YTN; PAM sequence: CTG
cttctgtcaccccgttccct

SEQ ID NO: 165594 - DNA, 20 bp, Artificial Sequence
  Description of Artificial Sequence: Synthetic oligonucleotide
  Target: ATXN1; (-) strand; PAM type: YTN; PAM sequence: CTG
gtgctgcttctgtcaccccg

SEQ ID NO: 165595 - DNA, 20 bp, Artificial Sequence
  Description of Artificial Sequence: Synthetic oligonucleotide
  Target: ATXN1; (-) strand; PAM type: YTN; PAM sequence: CTC
ccgggtactggtgctgcttc

SEQ ID NO: 165596 - DNA, 20 bp, Artificial Sequence
  Description of Artificial Sequence: Synthetic oligonucleotide
  Target: ATXN1; (-) strand; PAM type: YTN; PAM sequence: TTC
cctcccgggtactggtgctg

SEQ ID NO: 165597 - DNA, 20 bp, Artificial Sequence
  Description of Artificial Sequence: Synthetic oligonucleotide
  Target: ATXN1; (-) strand; PAM type: YTN; PAM sequence: CTT
ccctcccgggtactggtgct

SEQ ID NO: 165598 - DNA, 20 bp, Artificial Sequence
  Description of Artificial Sequence: Synthetic oligonucleotide
  Target: ATXN1; (-) strand; PAM type: YTN; PAM sequence: CTC
ccagtgtcagcttccctccc

SEQ ID NO: 165599 - DNA, 20 bp, Artificial Sequence
  Description of Artificial Sequence: Synthetic oligonucleotide
  Target: ATXN1; (-) strand; PAM type: YTN; PAM sequence: TTC
tcccagtgtcagcttccctc

SEQ ID NO: 165600 - DNA, 20 bp, Artificial Sequence
  Description of Artificial Sequence: Synthetic oligonucleotide
  Target: ATXN1; (-) strand; PAM type: YTN; PAM sequence: TTT
ctcccagtgtcagcttccct

SEQ ID NO: 165601 - DNA, 20 bp, Artificial Sequence
  Description of Artificial Sequence: Synthetic oligonucleotide
  Target: ATXN1; (-) strand; PAM type: YTN; PAM sequence: TTG
gatatttctcccagtgtcag

SEQ ID NO: 165602 - DNA, 20 bp, Artificial Sequence
  Description of Artificial Sequence: Synthetic oligonucleotide
  Target: ATXN1; (-) strand; PAM type: YTN; PAM sequence: CTT
ggatatttctcccagtgtca

SEQ ID NO: 165603 - DNA, 20 bp, Artificial Sequence
  Description of Artificial Sequence: Synthetic oligonucleotide
  Target: ATXN1; (-) strand; PAM type: YTN; PAM sequence: TTC
ttggatatttctcccagtgt

SEQ ID NO: 165604 - DNA, 20 bp, Artificial Sequence
  Description of Artificial Sequence: Synthetic oligonucleotide
  Target: ATXN1; (-) strand; PAM type: YTN; PAM sequence: TTT
cttggatatttctcccagtg

SEQ ID NO: 165605 - DNA, 20 bp, Artificial Sequence
  Description of Artificial Sequence: Synthetic oligonucleotide
  Target: ATXN1; (-) strand; PAM type: YTN; PAM sequence: CTT
tcttggatatttctcccagt

SEQ ID NO: 165606 - DNA, 20 bp, Artificial Sequence
  Description of Artificial Sequence: Synthetic oligonucleotide
  Target: ATXN1; (-) strand; PAM type: YTN; PAM sequence: TTG
cctttcttggatatttctcc

SEQ ID NO: 165607 - DNA, 20 bp, Artificial Sequence
  Description of Artificial Sequence: Synthetic oligonucleotide
  Target: ATXN1; (-) strand; PAM type: YTN; PAM sequence: TTG
attgcctttcttggatattt

SEQ ID NO: 165608 - DNA, 20 bp, Artificial Sequence
  Description of Artificial Sequence: Synthetic oligonucleotide
  Target: ATXN1; (-) strand; PAM type: YTN; PAM sequence: TTT
gattgcctttcttggatatt

SEQ ID NO: 165609 - DNA, 20 bp, Artificial Sequence
  Description of Artificial Sequence: Synthetic oligonucleotide
  Target: ATXN1; (-) strand; PAM type: YTN; PAM sequence: TTT
tgattgcctttcttggatat

SEQ ID NO: 165610 - DNA, 20 bp, Artificial Sequence
  Description of Artificial Sequence: Synthetic oligonucleotide
  Target: ATXN1; (-) strand; PAM type: YTN; PAM sequence: CTT
ttgattgcctttcttggata

SEQ ID NO: 165611 - DNA, 20 bp, Artificial Sequence
  Description of Artificial Sequence: Synthetic oligonucleotide
  Target: ATXN1; (-) strand; PAM type: YTN; PAM sequence: TTG
ccttttgattgcctttcttg

SEQ ID NO: 165612 - DNA, 20 bp, Artificial Sequence
  Description of Artificial Sequence: Synthetic oligonucleotide
  Target: ATXN1; (-) strand; PAM type: YTN; PAM sequence: CTT
gccttttgattgcctttctt

SEQ ID NO: 165613 - DNA, 20 bp, Artificial Sequence
  Description of Artificial Sequence: Synthetic oligonucleotide
  Target: ATXN1; (-) strand; PAM type: YTN; PAM sequence: TTC
ttgccttttgattgcctttc

SEQ ID NO: 165614 - DNA, 20 bp, Artificial Sequence
  Description of Artificial Sequence: Synthetic oligonucleotide
  Target: ATXN1; (-) strand; PAM type: YTN; PAM sequence: CTT
cttgccttttgattgccttt

SEQ ID NO: 165615 - DNA, 20 bp, Artificial Sequence
  Description of Artificial Sequence: Synthetic oligonucleotide
  Target: ATXN1; (-) strand; PAM type: YTN; PAM sequence: CTC
ttcttgccttttgattgcct

SEQ ID NO: 165616 - DNA, 20 bp, Artificial Sequence
  Description of Artificial Sequence: Synthetic oligonucleotide
  Target: ATXN1; (-) strand; PAM type: YTN; PAM sequence: TTG
ctcttcttgccttttgattg

SEQ ID NO: 165617 - DNA, 20 bp, Artificial Sequence
  Description of Artificial Sequence: Synthetic oligonucleotide
  Target: ATXN1; (-) strand; PAM type: YTN; PAM sequence: TTT
gctcttcttgccttttgatt

SEQ ID NO: 165618 - DNA, 20 bp, Artificial Sequence
  Description of Artificial Sequence: Synthetic oligonucleotide
  Target: ATXN1; (-) strand; PAM type: YTN; PAM sequence: TTA
tggtaggtgtttgctcttct

SEQ ID NO: 165619 - DNA, 20 bp, Artificial Sequence
  Description of Artificial Sequence: Synthetic oligonucleotide
  Target: ATXN1; (-) strand; PAM type: YTN; PAM sequence: CTA
accaaaattatggtaggtgt

SEQ ID NO: 165620 - DNA, 20 bp, Artificial Sequence
  Description of Artificial Sequence: Synthetic oligonucleotide
  Target: ATXN1; (-) strand; PAM type: YTN; PAM sequence: CTC
taaccaaaattatggtaggt

SEQ ID NO: 165621 - DNA, 20 bp, Artificial Sequence
  Description of Artificial Sequence: Synthetic oligonucleotide
  Target: ATXN1; (-) strand; PAM type: YTN; PAM sequence: CTC
tctaaccaaaattatggtag

SEQ ID NO: 165622 - DNA, 20 bp, Artificial Sequence
  Description of Artificial Sequence: Synthetic oligonucleotide
  Target: ATXN1; (-) strand; PAM type: YTN; PAM sequence: CTC
tctctaaccaaaattatggt

SEQ ID NO: 165623 - DNA, 20 bp, Artificial Sequence
  Description of Artificial Sequence: Synthetic oligonucleotide
  Target: ATXN1; (-) strand; PAM type: YTN; PAM sequence: TTC
ctctctctaaccaaaattat

SEQ ID NO: 165624 - DNA, 20 bp, Artificial Sequence
  Description of Artificial Sequence: Synthetic oligonucleotide
  Target: ATXN1; (-) strand; PAM type: YTN; PAM sequence: TTT
cctctctctaaccaaaatta

SEQ ID NO: 165625 - DNA, 20 bp, Artificial Sequence
  Description of Artificial Sequence: Synthetic oligonucleotide
  Target: ATXN1; (-) strand; PAM type: YTN; PAM sequence: TTT
tcctctctctaaccaaaatt

SEQ ID NO: 165626 - DNA, 20 bp, Artificial Sequence
  Description of Artificial Sequence: Synthetic oligonucleotide
  Target: ATXN1; (-) strand; PAM type: YTN; PAM sequence: CTT
ttcctctctctaaccaaaat

SEQ ID NO: 165627 - DNA, 20 bp, Artificial Sequence
  Description of Artificial Sequence: Synthetic oligonucleotide
  Target: ATXN1; (-) strand; PAM type: YTN; PAM sequence: CTA
cttttcctctctctaaccaa

SEQ ID NO: 165628 - DNA, 20 bp, Artificial Sequence
  Description of Artificial Sequence: Synthetic oligonucleotide
  Target: ATXN1; (-) strand; PAM type: YTN; PAM sequence: TTG
actacttttcctctctctaa

SEQ ID NO: 165629 - DNA, 20 bp, Artificial Sequence
  Description of Artificial Sequence: Synthetic oligonucleotide
  Target: ATXN1; (-) strand; PAM type: YTN; PAM sequence: CTT
gactacttttcctctctcta

SEQ ID NO: 165630 - DNA, 20 bp, Artificial Sequence
  Description of Artificial Sequence: Synthetic oligonucleotide
  Target: ATXN1; (-) strand; PAM type: YTN; PAM sequence: TTC
ttgactacttttcctctctc

SEQ ID NO: 165631 - DNA, 20 bp, Artificial Sequence
  Description of Artificial Sequence: Synthetic oligonucleotide
  Target: ATXN1; (-) strand; PAM type: YTN; PAM sequence: CTT
cttgactacttttcctctct

SEQ ID NO: 165632 - DNA, 20 bp, Artificial Sequence
  Description of Artificial Sequence: Synthetic oligonucleotide
  Target: ATXN1; (-) strand; PAM type: YTN; PAM sequence: TTC
gcccttcttgactacttttc

SEQ ID NO: 165633 - DNA, 20 bp, Artificial Sequence
  Description of Artificial Sequence: Synthetic oligonucleotide
  Target: ATXN1; (-) strand; PAM type: YTN; PAM sequence: CTT
cgcccttcttgactactttt

SEQ ID NO: 165634 - DNA, 20 bp, Artificial Sequence
  Description of Artificial Sequence: Synthetic oligonucleotide
  Target: ATXN1; (-) strand; PAM type: YTN; PAM sequence: TTG
catcttcgcccttcttgact

SEQ ID NO: 165635 - DNA, 20 bp, Artificial Sequence
  Description of Artificial Sequence: Synthetic oligonucleotide
  Target: ATXN1; (-) strand; PAM type: YTN; PAM sequence: TTT
gcatcttcgcccttcttgac

SEQ ID NO: 165636 - DNA, 20 bp, Artificial Sequence
  Description of Artificial Sequence: Synthetic oligonucleotide
  Target: ATXN1; (-) strand; PAM type: YTN; PAM sequence: TTT
tgcatcttcgcccttcttga

SEQ ID NO: 165637 - DNA, 20 bp, Artificial Sequence
  Description of Artificial Sequence: Synthetic oligonucleotide
  Target: ATXN1; (-) strand; PAM type: YTN; PAM sequence: TTT
ttgcatcttcgcccttcttg

SEQ ID NO: 165638 - DNA, 20 bp, Artificial Sequence
  Description of Artificial Sequence: Synthetic oligonucleotide
  Target: ATXN1; (-) strand; PAM type: YTN; PAM sequence: TTA
tggccatttttgcatcttcg

SEQ ID NO: 165639 - DNA, 20 bp, Artificial Sequence
  Description of Artificial Sequence: Synthetic oligonucleotide
  Target: ATXN1; (-) strand; PAM type: YTN; PAM sequence: TTA
ttatggccatttttgcatct

SEQ ID NO: 165640 - DNA, 20 bp, Artificial Sequence
  Description of Artificial Sequence: Synthetic oligonucleotide
  Target: ATXN1; (-) strand; PAM type: YTN; PAM sequence: TTT
attatggccatttttgcatc

SEQ ID NO: 165641 - DNA, 20 bp, Artificial Sequence
  Description of Artificial Sequence: Synthetic oligonucleotide
  Target: ATXN1; (-) strand; PAM type: YTN; PAM sequence: TTT
tattatggccatttttgcat

SEQ ID NO: 165642 - DNA, 20 bp, Artificial Sequence
  Description of Artificial Sequence: Synthetic oligonucleotide
  Target: ATXN1; (-) strand; PAM type: YTN; PAM sequence: TTT
ttattatggccatttttgca

SEQ ID NO: 165643 - DNA, 20 bp, Artificial Sequence
  Description of Artificial Sequence: Synthetic oligonucleotide
  Target: ATXN1; (-) strand; PAM type: YTN; PAM sequence: TTT
tttattatggccatttttgc

SEQ ID NO: 165644 - DNA, 20 bp, Artificial Sequence
  Description of Artificial Sequence: Synthetic oligonucleotide
  Target: ATXN1; (-) strand; PAM type: YTN; PAM sequence: TTT
ttttattatggccatttttg

SEQ ID NO: 165645 - DNA, 20 bp, Artificial Sequence
  Description of Artificial Sequence: Synthetic oligonucleotide
  Target: ATXN1; (-) strand; PAM type: YTN; PAM sequence: TTT
tttttattatggccattttt

SEQ ID NO: 165646 - DNA, 20 bp, Artificial Sequence
  Description of Artificial Sequence: Synthetic oligonucleotide
  Target: ATXN1; (-) strand; PAM type: YTN; PAM sequence: CTA
tcattttttttattatggcc

SEQ ID NO: 165647 - DNA, 20 bp, Artificial Sequence
  Description of Artificial Sequence: Synthetic oligonucleotide
  Target: ATXN1; (-) strand; PAM type: YTN; PAM sequence: TTC
accacatccccatcaatatc

SEQ ID NO: 165648 - DNA, 20 bp, Artificial Sequence
  Description of Artificial Sequence: Synthetic oligonucleotide
  Target: ATXN1; (-) strand; PAM type: YTN; PAM sequence: TTT
caccacatccccatcaatat

SEQ ID NO: 165649 - DNA, 20 bp, Artificial Sequence
  Description of Artificial Sequence: Synthetic oligonucleotide
  Target: ATXN1; (-) strand; PAM type: YTN; PAM sequence: TTC
ccgtttcaccacatccccat

SEQ ID NO: 165650 - DNA, 20 bp, Artificial Sequence
  Description of Artificial Sequence: Synthetic oligonucleotide
  Target: ATXN1; (-) strand; PAM type: YTN; PAM sequence: TTC
ccaccagcaatgtaaaagtg

SEQ ID NO: 165651 - DNA, 20 bp, Artificial Sequence
  Description of Artificial Sequence: Synthetic oligonucleotide
  Target: ATXN1; (-) strand; PAM type: YTN; PAM sequence: CTA
cattcccaccagcaatgtaa

SEQ ID NO: 165652 - DNA, 20 bp, Artificial Sequence
  Description of Artificial Sequence: Synthetic oligonucleotide
  Target: ATXN1; (-) strand; PAM type: YTN; PAM sequence: TTA
gtctacattcccaccagcaa

SEQ ID NO: 165653 - DNA, 20 bp, Artificial Sequence
  Description of Artificial Sequence: Synthetic oligonucleotide
  Target: ATXN1; (-) strand; PAM type: YTN; PAM sequence: TTG
tattagtctacattcccacc

SEQ ID NO: 165654 - DNA, 20 bp, Artificial Sequence
  Description of Artificial Sequence: Synthetic oligonucleotide
  Target: ATXN1; (-) strand; PAM type: YTN; PAM sequence: TTC
catagtggttgtattagtct

SEQ ID NO: 165655 - DNA, 20 bp, Artificial Sequence
  Description of Artificial Sequence: Synthetic oligonucleotide
  Target: ATXN1; (-) strand; PAM type: YTN; PAM sequence: TTT
ccatagtggttgtattagtc

SEQ ID NO: 165656 - DNA, 20 bp, Artificial Sequence
  Description of Artificial Sequence: Synthetic oligonucleotide
  Target: ATXN1; (-) strand; PAM type: YTN; PAM sequence: TTT
tccatagtggttgtattagt

SEQ ID NO: 165657 - DNA, 20 bp, Artificial Sequence
  Description of Artificial Sequence: Synthetic oligonucleotide
  Target: ATXN1; (-) strand; PAM type: YTN; PAM sequence: CTG
ttttccatagtggttgtatt

SEQ ID NO: 165658 - DNA, 20 bp, Artificial Sequence
  Description of Artificial Sequence: Synthetic oligonucleotide
  Target: ATXN1; (-) strand; PAM type: YTN; PAM sequence: CTC
cacactgttttccatagtgg

SEQ ID NO: 165659 - DNA, 20 bp, Artificial Sequence
  Description of Artificial Sequence: Synthetic oligonucleotide
  Target: ATXN1; (-) strand; PAM type: YTN; PAM sequence: TTA
aggaatctccacactgtttt

SEQ ID NO: 165660 - DNA, 20 bp, Artificial Sequence
  Description of Artificial Sequence: Synthetic oligonucleotide
  Target: ATXN1; (-) strand; PAM type: YTN; PAM sequence: TTT
aaggaatctccacactgttt

SEQ ID NO: 165661 - DNA, 20 bp, Artificial Sequence
  Description of Artificial Sequence: Synthetic oligonucleotide
  Target: ATXN1; (-) strand; PAM type: YTN; PAM sequence: CTT
taaggaatctccacactgtt

SEQ ID NO: 165662 - DNA, 20 bp, Artificial Sequence
  Description of Artificial Sequence: Synthetic oligonucleotide
  Target: ATXN1; (-) strand; PAM type: YTN; PAM sequence: TTC
tttaaggaatctccacactg

SEQ ID NO: 165663 - DNA, 20 bp, Artificial Sequence
  Description of Artificial Sequence: Synthetic oligonucleotide
  Target: ATXN1; (-) strand; PAM type: YTN; PAM sequence: TTA
agttctttaaggaatctcca

SEQ ID NO: 165664 - DNA, 20 bp, Artificial Sequence
  Description of Artificial Sequence: Synthetic oligonucleotide
  Target: ATXN1; (-) strand; PAM type: YTN; PAM sequence: TTT
aagttctttaaggaatctcc

SEQ ID NO: 165665 - DNA, 20 bp, Artificial Sequence
  Description of Artificial Sequence: Synthetic oligonucleotide
  Target: ATXN1; (-) strand; PAM type: YTN; PAM sequence: CTT
taagttctttaaggaatctc

SEQ ID NO: 165666 - DNA, 20 bp, Artificial Sequence
  Description of Artificial Sequence: Synthetic oligonucleotide
  Target: ATXN1; (-) strand; PAM type: YTN; PAM sequence: CTA
ctttaagttctttaaggaat

SEQ ID NO: 165667 - DNA, 20 bp, Artificial Sequence
  Description of Artificial Sequence: Synthetic oligonucleotide
  Target: ATXN1; (-) strand; PAM type: YTN; PAM sequence: TTC
tactttaagttctttaagga

SEQ ID NO: 165668 - DNA, 20 bp, Artificial Sequence
  Description of Artificial Sequence: Synthetic oligonucleotide
  Target: ATXN1; (-) strand; PAM type: YTN; PAM sequence: TTG
gatcaaatggtagttctact

SEQ ID NO: 165669 - DNA, 20 bp, Artificial Sequence
  Description of Artificial Sequence: Synthetic oligonucleotide
  Target: ATXN1; (-) strand; PAM type: YTN; PAM sequence: TTG
ttggatcaaatggtagttct

SEQ ID NO: 165670 - DNA, 20 bp, Artificial Sequence
  Description of Artificial Sequence: Synthetic oligonucleotide
  Target: ATXN1; (-) strand; PAM type: YTN; PAM sequence: CTG
ggtagatacccagtagtggg

SEQ ID NO: 165671 - DNA, 20 bp, Artificial Sequence
  Description of Artificial Sequence: Synthetic oligonucleotide
  Target: ATXN1; (-) strand; PAM type: YTN; PAM sequence: CTC
tgggtagatacccagtagtg

SEQ ID NO: 165672 - DNA, 20 bp, Artificial Sequence
  Description of Artificial Sequence: Synthetic oligonucleotide
  Target: ATXN1; (-) strand; PAM type: YTN; PAM sequence: CTC
ctctgggtagatacccagta

SEQ ID NO: 165673 - DNA, 20 bp, Artificial Sequence
  Description of Artificial Sequence: Synthetic oligonucleotide
  Target: ATXN1; (-) strand; PAM type: YTN; PAM sequence: TTC
ataagacgtctcctctgggt

SEQ ID NO: 165674 - DNA, 20 bp, Artificial Sequence
  Description of Artificial Sequence: Synthetic oligonucleotide
  Target: ATXN1; (-) strand; PAM type: YTN; PAM sequence: TTT
cataagacgtctcctctggg

SEQ ID NO: 165675 - DNA, 20 bp, Artificial Sequence
  Description of Artificial Sequence: Synthetic oligonucleotide
  Target: ATXN1; (-) strand; PAM type: YTN; PAM sequence: TTT
tcataagacgtctcctctgg

SEQ ID NO: 165676 - DNA, 20 bp, Artificial Sequence
  Description of Artificial Sequence: Synthetic oligonucleotide
  Target: ATXN1; (-) strand; PAM type: YTN; PAM sequence: TTT
ttcataagacgtctcctctg

SEQ ID NO: 165677 - DNA, 20 bp, Artificial Sequence
  Description of Artificial Sequence: Synthetic oligonucleotide
  Target: ATXN1; (-) strand; PAM type: YTN; PAM sequence: CTT
tttcataagacgtctcctct

SEQ ID NO: 165678 - DNA, 20 bp, Artificial Sequence
  Description of Artificial Sequence: Synthetic oligonucleotide
  Target: ATXN1; (-) strand; PAM type: YTN; PAM sequence: CTG
taaacatgcatgtgcaagta

SEQ ID NO: 165679 - DNA, 20 bp, Artificial Sequence
  Description of Artificial Sequence: Synthetic oligonucleotide
  Target: ATXN1; (-) strand; PAM type: YTN; PAM sequence: CTG
ctgtaaacatgcatgtgcaa

SEQ ID NO: 165680 - DNA, 20 bp, Artificial Sequence
  Description of Artificial Sequence: Synthetic oligonucleotide
  Target: ATXN1; (-) strand; PAM type: YTN; PAM sequence: TTG
tgctgctgtaaacatgcatg

SEQ ID NO: 165681 - DNA, 20 bp, Artificial Sequence
  Description of Artificial Sequence: Synthetic oligonucleotide
  Target: ATXN1; (-) strand; PAM type: YTN; PAM sequence: TTG
cgaattgtgctgctgtaaac

SEQ ID NO: 165682 - DNA, 20 bp, Artificial Sequence
  Description of Artificial Sequence: Synthetic oligonucleotide
  Target: ATXN1; (-) strand; PAM type: YTN; PAM sequence: CTG
caattgcgaattgtgctgct

SEQ ID NO: 165683 - DNA, 20 bp, Artificial Sequence
  Description of Artificial Sequence: Synthetic oligonucleotide
  Target: ATXN1; (-) strand; PAM type: YTN; PAM sequence: TTC
tgcaattgcgaattgtgctg

SEQ ID NO: 165684 - DNA, 20 bp, Artificial Sequence
  Description of Artificial Sequence: Synthetic oligonucleotide
  Target: ATXN1; (-) strand; PAM type: YTN; PAM sequence: TTT
ctgcaattgcgaattgtgct

SEQ ID NO: 165685 - DNA, 20 bp, Artificial Sequence
  Description of Artificial Sequence: Synthetic oligonucleotide
  Target: ATXN1; (-) strand; PAM type: YTN; PAM sequence: TTC
catatttctgcaattgcgaa

SEQ ID NO: 165686 - DNA, 20 bp, Artificial Sequence
  Description of Artificial Sequence: Synthetic oligonucleotide
  Target: ATXN1; (-) strand; PAM type: YTN; PAM sequence: CTG
gttccatatttctgcaattg

SEQ ID NO: 165687 - DNA, 20 bp, Artificial Sequence
  Description of Artificial Sequence: Synthetic oligonucleotide
  Target: ATXN1; (-) strand; PAM type: YTN; PAM sequence: TTG
ggctggttccatatttctgc

SEQ ID NO: 165688 - DNA, 20 bp, Artificial Sequence
  Description of Artificial Sequence: Synthetic oligonucleotide
  Target: ATXN1; (-) strand; PAM type: YTN; PAM sequence: TTT
gggctggttccatatttctg

SEQ ID NO: 165689 - DNA, 20 bp, Artificial Sequence
  Description of Artificial Sequence: Synthetic oligonucleotide
  Target: ATXN1; (-) strand; PAM type: YTN; PAM sequence: TTG
atgggcatttgggctggttc

SEQ ID NO: 165690 - DNA, 20 bp, Artificial Sequence
  Description of Artificial Sequence: Synthetic oligonucleotide
  Target: ATXN1; (-) strand; PAM type: YTN; PAM sequence: TTG
attgatgggcatttgggctg

SEQ ID NO: 165691 - DNA, 20 bp, Artificial Sequence
  Description of Artificial Sequence: Synthetic oligonucleotide
  Target: ATXN1; (-) strand; PAM type: YTN; PAM sequence: CTC
attgattgatgggcatttgg

SEQ ID NO: 165692 - DNA, 20 bp, Artificial Sequence
  Description of Artificial Sequence: Synthetic oligonucleotide
  Target: ATXN1; (-) strand; PAM type: YTN; PAM sequence: TTA
tccactcattgattgatggg

SEQ ID NO: 165693 - DNA, 20 bp, Artificial Sequence
  Description of Artificial Sequence: Synthetic oligonucleotide
  Target: ATXN1; (-) strand; PAM type: YTN; PAM sequence: TTT
atccactcattgattgatgg

SEQ ID NO: 165694 - DNA, 20 bp, Artificial Sequence
  Description of Artificial Sequence: Synthetic oligonucleotide
  Target: ATXN1; (-) strand; PAM type: YTN; PAM sequence: CTG
tgatatatacatacaataat

SEQ ID NO: 165695 - DNA, 20 bp, Artificial Sequence
  Description of Artificial Sequence: Synthetic oligonucleotide
  Target: ATXN1; (-) strand; PAM type: YTN; PAM sequence: TTC
tgtgatatatacatacaata

SEQ ID NO: 165696 - DNA, 20 bp, Artificial Sequence
  Description of Artificial Sequence: Synthetic oligonucleotide
  Target: ATXN1; (-) strand; PAM type: YTN; PAM sequence: CTG
agtagtattctgtgatatat

SEQ ID NO: 165697 - DNA, 20 bp, Artificial Sequence
  Description of Artificial Sequence: Synthetic oligonucleotide
  Target: ATXN1; (-) strand; PAM type: YTN; PAM sequence: TTA
tggctgagtagtattctgtg

SEQ ID NO: 165698 - DNA, 20 bp, Artificial Sequence
  Description of Artificial Sequence: Synthetic oligonucleotide
  Target: ATXN1; (-) strand; PAM type: YTN; PAM sequence: TTT
atggctgagtagtattctgt

SEQ ID NO: 165699 - DNA, 20 bp, Artificial Sequence
  Description of Artificial Sequence: Synthetic oligonucleotide
  Target: ATXN1; (-) strand; PAM type: YTN; PAM sequence: TTT
tatggctgagtagtattctg

SEQ ID NO: 165700 - DNA, 20 bp, Artificial Sequence
  Description of Artificial Sequence: Synthetic oligonucleotide
  Target: ATXN1; (-) strand; PAM type: YTN; PAM sequence: TTT
ttatggctgagtagtattct

SEQ ID NO: 165701 - DNA, 20 bp, Artificial Sequence
  Description of Artificial Sequence: Synthetic oligonucleotide
  Target: ATXN1; (-) strand; PAM type: YTN; PAM sequence: CTT
tttatggctgagtagtattc

SEQ ID NO: 165702 - DNA, 20 bp, Artificial Sequence
  Description of Artificial Sequence: Synthetic oligonucleotide
  Target: ATXN1; (-) strand; PAM type: YTN; PAM sequence: TTC
ctttttatggctgagtagta

SEQ ID NO: 165703 - DNA, 20 bp, Artificial Sequence
  Description of Artificial Sequence: Synthetic oligonucleotide
  Target: ATXN1; (-) strand; PAM type: YTN; PAM sequence: TTG
ttcctttttatggctgagta

SEQ ID NO: 165704 - DNA, 20 bp, Artificial Sequence
  Description of Artificial Sequence: Synthetic oligonucleotide
  Target: ATXN1; (-) strand; PAM type: YTN; PAM sequence: TTT
gttcctttttatggctgagt

SEQ ID NO: 165705 - DNA, 20 bp, Artificial Sequence
  Description of Artificial Sequence: Synthetic oligonucleotide
  Target: ATXN1; (-) strand; PAM type: YTN; PAM sequence: TTT
tgttcctttttatggctgag

SEQ ID NO: 165706 - DNA, 20 bp, Artificial Sequence
  Description of Artificial Sequence: Synthetic oligonucleotide
  Target: ATXN1; (-) strand; PAM type: YTN; PAM sequence: TTA
ttttgttcctttttatggct

SEQ ID NO: 165707 - DNA, 20 bp, Artificial Sequence
  Description of Artificial Sequence: Synthetic oligonucleotide
  Target: ATXN1; (-) strand; PAM type: YTN; PAM sequence: CTA
ttattttgttcctttttatg

SEQ ID NO: 165708 - DNA, 20 bp, Artificial Sequence
  Description of Artificial Sequence: Synthetic oligonucleotide
  Target: ATXN1; (-) strand; PAM type: YTN; PAM sequence: CTG
tgaatgctattattttgttc

SEQ ID NO: 165709 - DNA, 20 bp, Artificial Sequence
  Description of Artificial Sequence: Synthetic oligonucleotide
  Target: ATXN1; (-) strand; PAM type: YTN; PAM sequence: TTG
ctgtgaatgctattattttg

SEQ ID NO: 165710 - DNA, 20 bp, Artificial Sequence
  Description of Artificial Sequence: Synthetic oligonucleotide
  Target: ATXN1; (-) strand; PAM type: YTN; PAM sequence: TTC
caaacaggttgctgtgaatg

SEQ ID NO: 165711 - DNA, 20 bp, Artificial Sequence
  Description of Artificial Sequence: Synthetic oligonucleotide
  Target: ATXN1; (-) strand; PAM type: YTN; PAM sequence: TTA
gaataatggtatccagttcc

SEQ ID NO: 165712 - DNA, 20 bp, Artificial Sequence
  Description of Artificial Sequence: Synthetic oligonucleotide
  Target: ATXN1; (-) strand; PAM type: YTN; PAM sequence: CTT
agaataatggtatccagttc

SEQ ID NO: 165713 - DNA, 20 bp, Artificial Sequence
  Description of Artificial Sequence: Synthetic oligonucleotide
  Target: ATXN1; (-) strand; PAM type: YTN; PAM sequence: TTC
acttagaataatggtatcca

SEQ ID NO: 165714 - DNA, 20 bp, Artificial Sequence
  Description of Artificial Sequence: Synthetic oligonucleotide
  Target: ATXN1; (-) strand; PAM type: YTN; PAM sequence: CTT
cacttagaataatggtatcc

SEQ ID NO: 165715 - DNA, 20 bp, Artificial Sequence
  Description of Artificial Sequence: Synthetic oligonucleotide
  Target: ATXN1; (-) strand; PAM type: YTN; PAM sequence: TTA
cttcacttagaataatggta

SEQ ID NO: 165716 - DNA, 20 bp, Artificial Sequence
  Description of Artificial Sequence: Synthetic oligonucleotide
  Target: ATXN1; (-) strand; PAM type: YTN; PAM sequence: CTG
agttacttcacttagaataa

SEQ ID NO: 165717 - DNA, 20 bp, Artificial Sequence
  Description of Artificial Sequence: Synthetic oligonucleotide
  Target: ATXN1; (-) strand; PAM type: YTN; PAM sequence: TTC
ctgagttacttcacttagaa

SEQ ID NO: 165718 - DNA, 20 bp, Artificial Sequence
  Description of Artificial Sequence: Synthetic oligonucleotide
  Target: ATXN1; (-) strand; PAM type: YTN; PAM sequence: TTC
cattcctgagttacttcact

SEQ ID NO: 165719 - DNA, 20 bp, Artificial Sequence
  Description of Artificial Sequence: Synthetic oligonucleotide
  Target: ATXN1; (-) strand; PAM type: YTN; PAM sequence: TTT
ccattcctgagttacttcac

SEQ ID NO: 165720 - DNA, 20 bp, Artificial Sequence
  Description of Artificial Sequence: Synthetic oligonucleotide
  Target: ATXN1; (-) strand; PAM type: YTN; PAM sequence: TTT
tccattcctgagttacttca

SEQ ID NO: 165721 - DNA, 20 bp, Artificial Sequence
  Description of Artificial Sequence: Synthetic oligonucleotide
  Target: ATXN1; (-) strand; PAM type: YTN; PAM sequence: TTC
agttttccattcctgagtta

SEQ ID NO: 165722 - DNA, 20 bp, Artificial Sequence
  Description of Artificial Sequence: Synthetic oligonucleotide
  Target: ATXN1; (-) strand; PAM type: YTN; PAM sequence: TTA
cggtgttcagttttccattc

SEQ ID NO: 165723 - DNA, 20 bp, Artificial Sequence
  Description of Artificial Sequence: Synthetic oligonucleotide
  Target: ATXN1; (-) strand; PAM type: YTN; PAM sequence: CTG
ccatcattacggtgttcagt

SEQ ID NO: 165724 - DNA, 20 bp, Artificial Sequence
  Description of Artificial Sequence: Synthetic oligonucleotide
  Target: ATXN1; (-) strand; PAM type: YTN; PAM sequence: TTG
atggcagcagccactgccat

SEQ ID NO: 165725 - DNA, 20 bp, Artificial Sequence
  Description of Artificial Sequence: Synthetic oligonucleotide
  Target: ATXN1; (-) strand; PAM type: YTN; PAM sequence: CTT
gatggcagcagccactgcca

SEQ ID NO: 165726 - DNA, 20 bp, Artificial Sequence
  Description of Artificial Sequence: Synthetic oligonucleotide
  Target: ATXN1; (-) strand; PAM type: YTN; PAM sequence: CTC
catggagtatgcagcaccag

SEQ ID NO: 165727 - DNA, 20 bp, Artificial Sequence
  Description of Artificial Sequence: Synthetic oligonucleotide
  Target: ATXN1; (-) strand; PAM type: YTN; PAM sequence: CTG
ccaccagctccatggagtat

SEQ ID NO: 165728 - DNA, 20 bp, Artificial Sequence
  Description of Artificial Sequence: Synthetic oligonucleotide
  Target: ATXN1; (-) strand; PAM type: YTN; PAM sequence: CTC
ggaatgaacagggctgccac

SEQ ID NO: 165729 - DNA, 20 bp, Artificial Sequence
  Description of Artificial Sequence: Synthetic oligonucleotide
  Target: ATXN1; (-) strand; PAM type: YTN; PAM sequence: CTC
ccatcccaactcggaatgaa

SEQ ID NO: 165730 - DNA, 20 bp, Artificial Sequence
  Description of Artificial Sequence: Synthetic oligonucleotide
  Target: ATXN1; (-) strand; PAM type: YTN; PAM sequence: CTG
cagtggcacgcggagctccc

SEQ ID NO: 165731 - DNA, 20 bp, Artificial Sequence
  Description of Artificial Sequence: Synthetic oligonucleotide
  Target: ATXN1; (-) strand; PAM type: YTN; PAM sequence: TTC
aggtggctgcagtggcacgc

SEQ ID NO: 165732 - DNA, 20 bp, Artificial Sequence
  Description of Artificial Sequence: Synthetic oligonucleotide
  Target: ATXN1; (-) strand; PAM type: YTN; PAM sequence: CTG
cagttcaggtggctgcagtg

SEQ ID NO: 165733 - DNA, 20 bp, Artificial Sequence
  Description of Artificial Sequence: Synthetic oligonucleotide
  Target: ATXN1; (-) strand; PAM type: YTN; PAM sequence: CTG
cagctgcagttcaggtggct

SEQ ID NO: 165734 - DNA, 20 bp, Artificial Sequence
  Description of Artificial Sequence: Synthetic oligonucleotide
  Target: ATXN1; (-) strand; PAM type: YTN; PAM sequence: CTG
ggtctgcagctgcagttcag

SEQ ID NO: 165735 - DNA, 20 bp, Artificial Sequence
  Description of Artificial Sequence: Synthetic oligonucleotide
  Target: ATXN1; (-) strand; PAM type: YTN; PAM sequence: CTG
tggagcaggaggcctgggtc

SEQ ID NO: 165736 - DNA, 20 bp, Artificial Sequence
  Description of Artificial Sequence: Synthetic oligonucleotide
  Target: ATXN1; (-) strand; PAM type: YTN; PAM sequence: CTC
tgtggagcaggaggcctggg

SEQ ID NO: 165737 - DNA, 20 bp, Artificial Sequence
  Description of Artificial Sequence: Synthetic oligonucleotide
  Target: ATXN1; (-) strand; PAM type: YTN; PAM sequence: TTG
ctctgtggagcaggaggcct

SEQ ID NO: 165738 - DNA, 20 bp, Artificial Sequence
  Description of Artificial Sequence: Synthetic oligonucleotide
  Target: ATXN1; (-) strand; PAM type: YTN; PAM sequence: CTT
gctctgtggagcaggaggcc

SEQ ID NO: 165739 - DNA, 20 bp, Artificial Sequence
  Description of Artificial Sequence: Synthetic oligonucleotide
  Target: ATXN1; (-) strand; PAM type: YTN; PAM sequence: CTG
cttgctctgtggagcaggag

SEQ ID NO: 165740 - DNA, 20 bp, Artificial Sequence
  Description of Artificial Sequence: Synthetic oligonucleotide
  Target: ATXN1; (-) strand; PAM type: YTN; PAM sequence: CTC
ctgcttgctctgtggagcag

SEQ ID NO: 165741 - DNA, 20 bp, Artificial Sequence
  Description of Artificial Sequence: Synthetic oligonucleotide
  Target: ATXN1; (-) strand; PAM type: YTN; PAM sequence: CTG
tggccccaagagggcggggc

SEQ ID NO: 165742 - DNA, 20 bp, Artificial Sequence
  Description of Artificial Sequence: Synthetic oligonucleotide
  Target: ATXN1; (-) strand; PAM type: YTN; PAM sequence: TTG
ggtggctgtggccccaagag

SEQ ID NO: 165743 - DNA, 20 bp, Artificial Sequence
  Description of Artificial Sequence: Synthetic oligonucleotide
  Target: ATXN1; (-) strand; PAM type: YTN; PAM sequence: TTT
gggtggctgtggccccaaga

SEQ ID NO: 165744 - DNA, 20 bp, Artificial Sequence
  Description of Artificial Sequence: Synthetic oligonucleotide
  Target: ATXN1; (-) strand; PAM type: YTN; PAM sequence: CTG
cagtttgggtggctgtggcc

SEQ ID NO: 165745 - DNA, 20 bp, Artificial Sequence
  Description of Artificial Sequence: Synthetic oligonucleotide
  Target: ATXN1; (-) strand; PAM type: YTN; PAM sequence: CTA
cagctgcagtttgggtggct

SEQ ID NO: 165746 - DNA, 20 bp, Artificial Sequence
  Description of Artificial Sequence: Synthetic oligonucleotide
  Target: ATXN1; (-) strand; PAM type: YTN; PAM sequence: CTC
ggatctacagctgcagtttg

SEQ ID NO: 165747 - DNA, 20 bp, Artificial Sequence
  Description of Artificial Sequence: Synthetic oligonucleotide
  Target: ATXN1; (-) strand; PAM type: YTN; PAM sequence: CTC
ccccaagagcacagggagac

SEQ ID NO: 165748 - DNA, 20 bp, Artificial Sequence
  Description of Artificial Sequence: Synthetic oligonucleotide
  Target: ATXN1; (-) strand; PAM type: YTN; PAM sequence: TTC
caggctcccccaagagcaca

SEQ ID NO: 165749 - DNA, 20 bp, Artificial Sequence
  Description of Artificial Sequence: Synthetic oligonucleotide
  Target: ATXN1; (-) strand; PAM type: YTN; PAM sequence: CTG
ttccaggctcccccaagagc

SEQ ID NO: 165750 - DNA, 20 bp, Artificial Sequence
  Description of Artificial Sequence: Synthetic oligonucleotide
  Target: ATXN1; (-) strand; PAM type: YTN; PAM sequence: CTG
cctgttccaggctcccccaa

SEQ ID NO: 165751 - DNA, 20 bp, Artificial Sequence
  Description of Artificial Sequence: Synthetic oligonucleotide
  Target: ATXN1; (-) strand; PAM type: YTN; PAM sequence: CTG
ggaaggcagatcctgcctgt

SEQ ID NO: 165752 - DNA, 20 bp, Artificial Sequence
  Description of Artificial Sequence: Synthetic oligonucleotide
  Target: ATXN1; (-) strand; PAM type: YTN; PAM sequence: CTG
cacctgggaaggcagatcct

SEQ ID NO: 165753 - DNA, 20 bp, Artificial Sequence
  Description of Artificial Sequence: Synthetic oligonucleotide
  Target: ATXN1; (-) strand; PAM type: YTN; PAM sequence: CTG
cagctgcacctgggaaggca

SEQ ID NO: 165754 - DNA, 20 bp, Artificial Sequence
  Description of Artificial Sequence: Synthetic oligonucleotide
  Target: ATXN1; (-) strand; PAM type: YTN; PAM sequence: CTG
cagccgtgggtgcggcagct

SEQ ID NO: 165755 - DNA, 20 bp, Artificial Sequence
  Description of Artificial Sequence: Synthetic oligonucleotide
  Target: ATXN1; (-) strand; PAM type: YTN; PAM sequence: CTG
gaatgggaggcccaggtctg

SEQ ID NO: 165756 - DNA, 20 bp, Artificial Sequence
  Description of Artificial Sequence: Synthetic oligonucleotide
  Target: ATXN1; (-) strand; PAM type: YTN; PAM sequence: TTC
ctggaatgggaggcccaggt

SEQ ID NO: 165757 - DNA, 20 bp, Artificial Sequence
  Description of Artificial Sequence: Synthetic oligonucleotide
  Target: ATXN1; (-) strand; PAM type: YTN; PAM sequence: CTT
cctggaatgggaggcccagg

SEQ ID NO: 165758 - DNA, 20 bp, Artificial Sequence
  Description of Artificial Sequence: Synthetic oligonucleotide
  Target: ATXN1; (-) strand; PAM type: YTN; PAM sequence: CTG
cttcctggaatgggaggccc

SEQ ID NO: 165759 - DNA, 20 bp, Artificial Sequence
  Description of Artificial Sequence: Synthetic oligonucleotide
  Target: ATXN1; (-) strand; PAM type: YTN; PAM sequence: CTG
cctgcttcctggaatgggag

SEQ ID NO: 165760 - DNA, 20 bp, Artificial Sequence
  Description of Artificial Sequence: Synthetic oligonucleotide
  Target: ATXN1; (-) strand; PAM type: YTN; PAM sequence: CTC
ctgcctgcttcctggaatgg

SEQ ID NO: 165761 - DNA, 20 bp, Artificial Sequence
  Description of Artificial Sequence: Synthetic oligonucleotide
  Target: ATXN1; (-) strand; PAM type: YTN; PAM sequence: CTG
gctcctgcctgcttcctgga

SEQ ID NO: 165762 - DNA, 20 bp, Artificial Sequence
  Description of Artificial Sequence: Synthetic oligonucleotide
  Target: ATXN1; (-) strand; PAM type: YTN; PAM sequence: TTC
ctggctcctgcctgcttcct

SEQ ID NO: 165763 - DNA, 20 bp, Artificial Sequence
  Description of Artificial Sequence: Synthetic oligonucleotide
  Target: ATXN1; (-) strand; PAM type: YTN; PAM sequence: TTG
ttcctggctcctgcctgctt

SEQ ID NO: 165764 - DNA, 20 bp, Artificial Sequence
  Description of Artificial Sequence: Synthetic oligonucleotide
  Target: ATXN1; (-) strand; PAM type: YTN; PAM sequence: CTT
gttcctggctcctgcctgct

SEQ ID NO: 165765 - DNA, 20 bp, Artificial Sequence
  Description of Artificial Sequence: Synthetic oligonucleotide
  Target: ATXN1; (-) strand; PAM type: YTN; PAM sequence: CTC
ccgcttgttcctggctcctg

SEQ ID NO: 165766 - DNA, 20 bp, Artificial Sequence
  Description of Artificial Sequence: Synthetic oligonucleotide
  Target: ATXN1; (-) strand; PAM type: YTN; PAM sequence: CTC
ggaaggggcagggctcccgc

SEQ ID NO: 165767 - DNA, 20 bp, Artificial Sequence
  Description of Artificial Sequence: Synthetic oligonucleotide
  Target: ATXN1; (-) strand; PAM type: YTN; PAM sequence: CTG
acaactcggaaggggcaggg

SEQ ID NO: 165768 - DNA, 20 bp, Artificial Sequence
  Description of Artificial Sequence: Synthetic oligonucleotide
  Target: ATXN1; (-) strand; PAM type: YTN; PAM sequence: CTC
ccgccctgacaactcggaag

SEQ ID NO: 165769 - DNA, 20 bp, Artificial Sequence
  Description of Artificial Sequence: Synthetic oligonucleotide
  Target: ATXN1; (-) strand; PAM type: YTN; PAM sequence: CTG
cacccgggagctcccgccct

SEQ ID NO: 165770 - DNA, 20 bp, Artificial Sequence
  Description of Artificial Sequence: Synthetic oligonucleotide
  Target: ATXN1; (-) strand; PAM type: YTN; PAM sequence: TTG
gccacagctgcacccgggag

SEQ ID NO: 165771 - DNA, 20 bp, Artificial Sequence
  Description of Artificial Sequence: Synthetic oligonucleotide
  Target: ATXN1; (-) strand; PAM type: YTN; PAM sequence: CTG
ggagggttggccacagctgc

SEQ ID NO: 165772 - DNA, 20 bp, Artificial Sequence
  Description of Artificial Sequence: Synthetic oligonucleotide
  Target: ATXN1; (-) strand; PAM type: YTN; PAM sequence: CTG
tgcctgggagggttggccac

SEQ ID NO: 165773 - DNA, 20 bp, Artificial Sequence
  Description of Artificial Sequence: Synthetic oligonucleotide
  Target: ATXN1; (-) strand; PAM type: YTN; PAM sequence: CTG
cagagacgcccaggtcctgt

SEQ ID NO: 165774 - DNA, 20 bp, Artificial Sequence
  Description of Artificial Sequence: Synthetic oligonucleotide
  Target: ATXN1; (-) strand; PAM type: YTN; PAM sequence: CTG
gggcgcccaagggtgcaggc

SEQ ID NO: 165775 - DNA, 20 bp, Artificial Sequence
  Description of Artificial Sequence: Synthetic oligonucleotide
  Target: ATXN1; (-) strand; PAM type: YTN; PAM sequence: TTC
ctggggcgcccaagggtgca

SEQ ID NO: 165776 - DNA, 20 bp, Artificial Sequence
  Description of Artificial Sequence: Synthetic oligonucleotide
  Target: ATXN1; (-) strand; PAM type: YTN; PAM sequence: CTT
cctggggcgcccaagggtgc

SEQ ID NO: 165777 - DNA, 20 bp, Artificial Sequence
  Description of Artificial Sequence: Synthetic oligonucleotide
  Target: ATXN1; (-) strand; PAM type: YTN; PAM sequence: CTG
agcatgcagagatggggagg

SEQ ID NO: 165778 - DNA, 20 bp, Artificial Sequence
  Description of Artificial Sequence: Synthetic oligonucleotide
  Target: ATXN1; (-) strand; PAM type: YTN; PAM sequence: CTG
gaacggagagaggccaggca

SEQ ID NO: 165779 - DNA, 20 bp, Artificial Sequence
  Description of Artificial Sequence: Synthetic oligonucleotide
  Target: ATXN1; (-) strand; PAM type: YTN; PAM sequence: CTG
agtgggtgcctggaacggag

SEQ ID NO: 165780 - DNA, 20 bp, Artificial Sequence
  Description of Artificial Sequence: Synthetic oligonucleotide
  Target: ATXN1; (-) strand; PAM type: YTN; PAM sequence: CTG
agatctgagtgggtgcctgg

SEQ ID NO: 165781 - DNA, 20 bp, Artificial Sequence
  Description of Artificial Sequence: Synthetic oligonucleotide
  Target: ATXN1; (-) strand; PAM type: YTN; PAM sequence: CTC
tgagatctgagtgggtgcct

SEQ ID NO: 165782 - DNA, 20 bp, Artificial Sequence
  Description of Artificial Sequence: Synthetic oligonucleotide
  Target: ATXN1; (-) strand; PAM type: YTN; PAM sequence: TTG
gccccaacccagctctgaga

SEQ ID NO: 165783 - DNA, 20 bp, Artificial Sequence
  Description of Artificial Sequence: Synthetic oligonucleotide
  Target: ATXN1; (-) strand; PAM type: YTN; PAM sequence: CTT
ggccccaacccagctctgag

SEQ ID NO: 165784 - DNA, 20 bp, Artificial Sequence
  Description of Artificial Sequence: Synthetic oligonucleotide
  Target: ATXN1; (-) strand; PAM type: YTN; PAM sequence: TTC
atggccccggggcttggccc

SEQ ID NO: 165785 - DNA, 20 bp, Artificial Sequence
  Description of Artificial Sequence: Synthetic oligonucleotide
  Target: ATXN1; (-) strand; PAM type: YTN; PAM sequence: CTG
ccattcatggccccggggct

SEQ ID NO: 165786 - DNA, 20 bp, Artificial Sequence
  Description of Artificial Sequence: Synthetic oligonucleotide
  Target: ATXN1; (-) strand; PAM type: YTN; PAM sequence: CTG
ctgccattcatggccccggg

SEQ ID NO: 165787 - DNA, 20 bp, Artificial Sequence
  Description of Artificial Sequence: Synthetic oligonucleotide
  Target: ATXN1; (-) strand; PAM type: YTN; PAM sequence: CTC
ctgctgccattcatggcccc

SEQ ID NO: 165788 - DNA, 20 bp, Artificial Sequence
  Description of Artificial Sequence: Synthetic oligonucleotide
  Target: ATXN1; (-) strand; PAM type: YTN; PAM sequence: TTC
ctcctgctgccattcatggc

SEQ ID NO: 165789 - DNA, 20 bp, Artificial Sequence
  Description of Artificial Sequence: Synthetic oligonucleotide
  Target: ATXN1; (-) strand; PAM type: YTN; PAM sequence: CTT
cctcctgctgccattcatgg

SEQ ID NO: 165790 - DNA, 20 bp, Artificial Sequence
  Description of Artificial Sequence: Synthetic oligonucleotide
  Target: ATXN1; (-) strand; PAM type: YTN; PAM sequence: CTG
tcttcctcctgctgccattc

SEQ ID NO: 165791 - DNA, 20 bp, Artificial Sequence
  Description of Artificial Sequence: Synthetic oligonucleotide
  Target: ATXN1; (-) strand; PAM type: YTN; PAM sequence: CTG
ccccggaccctgtcttcctc

SEQ ID NO: 165792 - DNA, 20 bp, Artificial Sequence
  Description of Artificial Sequence: Synthetic oligonucleotide
  Target: ATXN1; (-) strand; PAM type: YTN; PAM sequence: TTC
tgccccggaccctgtcttcc

SEQ ID NO: 165793 - DNA, 20 bp, Artificial Sequence
  Description of Artificial Sequence: Synthetic oligonucleotide
  Target: ATXN1; (-) strand; PAM type: YTN; PAM sequence: TTT
ctgccccggaccctgtcttc

SEQ ID NO: 165794 - DNA, 20 bp, Artificial Sequence
  Description of Artificial Sequence: Synthetic oligonucleotide
  Target: ATXN1; (-) strand; PAM type: YTN; PAM sequence: TTT
tctgccccggaccctgtctt

SEQ ID NO: 165795 - DNA, 20 bp, Artificial Sequence
  Description of Artificial Sequence: Synthetic oligonucleotide
  Target: ATXN1; (-) strand; PAM type: YTN; PAM sequence: CTT
ttctgccccggaccctgtct

SEQ ID NO: 165796 - DNA, 20 bp, Artificial Sequence
  Description of Artificial Sequence: Synthetic oligonucleotide
  Target: ATXN1; (-) strand; PAM type: YTN; PAM sequence: CTC
ttttctgccccggaccctgt

SEQ ID NO: 165797 - DNA, 20 bp, Artificial Sequence
  Description of Artificial Sequence: Synthetic oligonucleotide
  Target: ATXN1; (-) strand; PAM type: YTN; PAM sequence: CTC
ccctcttttctgccccggac

SEQ ID NO: 165798 - DNA, 20 bp, Artificial Sequence
  Description of Artificial Sequence: Synthetic oligonucleotide
  Target: ATXN1; (-) strand; PAM type: YTN; PAM sequence: TTG
gggactcccctcttttctgc

SEQ ID NO: 165799 - DNA, 20 bp, Artificial Sequence
  Description of Artificial Sequence: Synthetic oligonucleotide
  Target: ATXN1; (-) strand; PAM type: YTN; PAM sequence: CTA
attggggactcccctctttt

SEQ ID NO: 165800 - DNA, 20 bp, Artificial Sequence
  Description of Artificial Sequence: Synthetic oligonucleotide
  Target: ATXN1; (-) strand; PAM type: YTN; PAM sequence: CTG
aaggtggggcctaattgggg

SEQ ID NO: 165801 - DNA, 20 bp, Artificial Sequence
  Description of Artificial Sequence: Synthetic oligonucleotide
  Target: ATXN1; (-) strand; PAM type: YTN; PAM sequence: CTC
gcctgaaggtggggcctaat

SEQ ID NO: 165802 - DNA, 20 bp, Artificial Sequence
  Description of Artificial Sequence: Synthetic oligonucleotide
  Target: ATXN1; (-) strand; PAM type: YTN; PAM sequence: CTC
cctcgcctgaaggtggggcc

SEQ ID NO: 165803 - DNA, 20 bp, Artificial Sequence
  Description of Artificial Sequence: Synthetic oligonucleotide
  Target: ATXN1; (-) strand; PAM type: YTN; PAM sequence: TTC
aggccctccctcgcctgaag

SEQ ID NO: 165804 - DNA, 20 bp, Artificial Sequence
  Description of Artificial Sequence: Synthetic oligonucleotide
  Target: ATXN1; (-) strand; PAM type: YTN; PAM sequence: CTT
caggccctccctcgcctgaa

SEQ ID NO: 165805 - DNA, 20 bp, Artificial Sequence
  Description of Artificial Sequence: Synthetic oligonucleotide
  Target: ATXN1; (-) strand; PAM type: YTN; PAM sequence: CTG
gcagcccggcccccagcctt

SEQ ID NO: 165806 - DNA, 20 bp, Artificial Sequence
  Description of Artificial Sequence: Synthetic oligonucleotide
  Target: ATXN1; (-) strand; PAM type: YTN; PAM sequence: CTG
gtcggcaggactggcagccc

SEQ ID NO: 165807 - DNA, 20 bp, Artificial Sequence
  Description of Artificial Sequence: Synthetic oligonucleotide
  Target: ATXN1; (-) strand; PAM type: YTN; PAM sequence: CTC
tggtcggcaggactggcagc

SEQ ID NO: 165808 - DNA, 20 bp, Artificial Sequence
  Description of Artificial Sequence: Synthetic oligonucleotide
  Target: ATXN1; (-) strand; PAM type: YTN; PAM sequence: TTG
gtccatgggtggccatgggt

SEQ ID NO: 165809 - DNA, 20 bp, Artificial Sequence
  Description of Artificial Sequence: Synthetic oligonucleotide
  Target: ATXN1; (-) strand; PAM type: YTN; PAM sequence: CTC
agaggggaggaagtatgtgc

SEQ ID NO: 165810 - DNA, 20 bp, Artificial Sequence
  Description of Artificial Sequence: Synthetic oligonucleotide
  Target: ATXN1; (-) strand; PAM type: YTN; PAM sequence: TTA
tggacctcagaggggaggaa

SEQ ID NO: 165811 - DNA, 20 bp, Artificial Sequence
  Description of Artificial Sequence: Synthetic oligonucleotide
  Target: ATXN1; (-) strand; PAM type: YTN; PAM sequence: TTT
atggacctcagaggggagga

SEQ ID NO: 165812 - DNA, 20 bp, Artificial Sequence
  Description of Artificial Sequence: Synthetic oligonucleotide
  Target: ATXN1; (-) strand; PAM type: YTN; PAM sequence: TTT
tatggacctcagaggggagg

SEQ ID NO: 165813 - DNA, 20 bp, Artificial Sequence
  Description of Artificial Sequence: Synthetic oligonucleotide
  Target: ATXN1; (-) strand; PAM type: YTN; PAM sequence: CTT
ttatggacctcagaggggag

SEQ ID NO: 165814 - DNA, 20 bp, Artificial Sequence
  Description of Artificial Sequence: Synthetic oligonucleotide
  Target: ATXN1; (-) strand; PAM type: YTN; PAM sequence: CTA
agcccagggcttttatggac

SEQ ID NO: 165815 - DNA, 20 bp, Artificial Sequence
  Description of Artificial Sequence: Synthetic oligonucleotide
  Target: ATXN1; (-) strand; PAM type: YTN; PAM sequence: CTG
tggctaagcccagggctttt

SEQ ID NO: 165816 - DNA, 20 bp, Artificial Sequence
  Description of Artificial Sequence: Synthetic oligonucleotide
  Target: ATXN1; (-) strand; PAM type: YTN; PAM sequence: CTG
ctgtggctaagcccagggct

SEQ ID NO: 165817 - DNA, 20 bp, Artificial Sequence
  Description of Artificial Sequence: Synthetic oligonucleotide
  Target: ATXN1; (-) strand; PAM type: YTN; PAM sequence: CTG
cctgctgtggctaagcccag

SEQ ID NO: 165818 - DNA, 20 bp, Artificial Sequence
  Description of Artificial Sequence: Synthetic oligonucleotide
  Target: ATXN1; (-) strand; PAM type: YTN; PAM sequence: CTC
ctgcctgctgtggctaagcc

SEQ ID NO: 165819 - DNA, 20 bp, Artificial Sequence
  Description of Artificial Sequence: Synthetic oligonucleotide
  Target: ATXN1; (-) strand; PAM type: YTN; PAM sequence: CTG
gccatcctcctgcctgctgt

SEQ ID NO: 165820 - DNA, 20 bp, Artificial Sequence
  Description of Artificial Sequence: Synthetic oligonucleotide
  Target: ATXN1; (-) strand; PAM type: YTN; PAM sequence: TTG
tccctggccatcctcctgcc

SEQ ID NO: 165821 - DNA, 20 bp, Artificial Sequence
  Description of Artificial Sequence: Synthetic oligonucleotide
  Target: ATXN1; (-) strand; PAM type: YTN; PAM sequence: TTT
gtccctggccatcctcctgc

SEQ ID NO: 165822 - DNA, 20 bp, Artificial Sequence
  Description of Artificial Sequence: Synthetic oligonucleotide
  Target: ATXN1; (-) strand; PAM type: YTN; PAM sequence: CTT
tgtccctggccatcctcctg

SEQ ID NO: 165823 - DNA, 20 bp, Artificial Sequence
  Description of Artificial Sequence: Synthetic oligonucleotide
  Target: ATXN1; (-) strand; PAM type: YTN; PAM sequence: CTG
ccccctttgtccctggccat

SEQ ID NO: 165824 - DNA, 20 bp, Artificial Sequence
  Description of Artificial Sequence: Synthetic oligonucleotide
  Target: ATXN1; (-) strand; PAM type: YTN; PAM sequence: CTC
tgccccctttgtccctggcc

SEQ ID NO: 165825 - DNA, 20 bp, Artificial Sequence
  Description of Artificial Sequence: Synthetic oligonucleotide
  Target: ATXN1; (-) strand; PAM type: YTN; PAM sequence: CTC
tctgccccctttgtccctgg

SEQ ID NO: 165826 - DNA, 20 bp, Artificial Sequence
  Description of Artificial Sequence: Synthetic oligonucleotide
  Target: ATXN1; (-) strand; PAM type: YTN; PAM sequence: CTC
tctctgccccctttgtccct

SEQ ID NO: 165827 - DNA, 20 bp, Artificial Sequence
  Description of Artificial Sequence: Synthetic oligonucleotide
  Target: ATXN1; (-) strand; PAM type: YTN; PAM sequence: TTC
tctctctgccccctttgtcc

SEQ ID NO: 165828 - DNA, 20 bp, Artificial Sequence
  Description of Artificial Sequence: Synthetic oligonucleotide
  Target: ATXN1; (-) strand; PAM type: YTN; PAM sequence: CTG
gtcatccagtcccattctct

SEQ ID NO: 165829 - DNA, 20 bp, Artificial Sequence
  Description of Artificial Sequence: Synthetic oligonucleotide
  Target: ATXN1; (-) strand; PAM type: YTN; PAM sequence: CTG
caactggtcatccagtccca

SEQ ID NO: 165830 - DNA, 20 bp, Artificial Sequence
  Description of Artificial Sequence: Synthetic oligonucleotide
  Target: ATXN1; (-) strand; PAM type: YTN; PAM sequence: CTC
tgcaactggtcatccagtcc

SEQ ID NO: 165831 - DNA, 20 bp, Artificial Sequence
  Description of Artificial Sequence: Synthetic oligonucleotide
  Target: ATXN1; (-) strand; PAM type: YTN; PAM sequence: CTC
tctgcaactggtcatccagt

SEQ ID NO: 165832 - DNA, 20 bp, Artificial Sequence
  Description of Artificial Sequence: Synthetic oligonucleotide
  Target: ATXN1; (-) strand; PAM type: YTN; PAM sequence: CTC
ctctctgcaactggtcatcc

SEQ ID NO: 165833 - DNA, 20 bp, Artificial Sequence
  Description of Artificial Sequence: Synthetic oligonucleotide
  Target: ATXN1; (-) strand; PAM type: YTN; PAM sequence: CTA
tcagcagagagggtactcct

SEQ ID NO: 165834 - DNA, 20 bp, Artificial Sequence
  Description of Artificial Sequence: Synthetic oligonucleotide
  Target: ATXN1; (-) strand; PAM type: YTN; PAM sequence: CTC
cagctatcagcagagagggt

SEQ ID NO: 165835 - DNA, 20 bp, Artificial Sequence
  Description of Artificial Sequence: Synthetic oligonucleotide
  Target: ATXN1; (-) strand; PAM type: YTN; PAM sequence: TTG
tcccatcgtctccagctatc

SEQ ID NO: 165836 - DNA, 20 bp, Artificial Sequence
  Description of Artificial Sequence: Synthetic oligonucleotide
  Target: ATXN1; (-) strand; PAM type: YTN; PAM sequence: CTG
gttgtcccatcgtctccagc

SEQ ID NO: 165837 - DNA, 20 bp, Artificial Sequence
  Description of Artificial Sequence: Synthetic oligonucleotide
  Target: ATXN1; (-) strand; PAM type: YTN; PAM sequence: CTG
cagctggttgtcccatcgtc

SEQ ID NO: 165838 - DNA, 20 bp, Artificial Sequence
  Description of Artificial Sequence: Synthetic oligonucleotide
  Target: ATXN1; (-) strand; PAM type: YTN; PAM sequence: CTC
tgcagctggttgtcccatcg

SEQ ID NO: 165839 - DNA, 20 bp, Artificial Sequence
  Description of Artificial Sequence: Synthetic oligonucleotide
  Target: ATXN1; (-) strand; PAM type: YTN; PAM sequence: CTG
ccagcaggtcatctctgcag

SEQ ID NO: 165840 - DNA, 20 bp, Artificial Sequence
  Description of Artificial Sequence: Synthetic oligonucleotide
  Target: ATXN1; (-) strand; PAM type: YTN; PAM sequence: CTC
tgccagcaggtcatctctgc

SEQ ID NO: 165841 - DNA, 20 bp, Artificial Sequence
  Description of Artificial Sequence: Synthetic oligonucleotide
  Target: ATXN1; (-) strand; PAM type: YTN; PAM sequence: CTC
tctgccagcaggtcatctct

SEQ ID NO: 165842 - DNA, 20 bp, Artificial Sequence
  Description of Artificial Sequence: Synthetic oligonucleotide
  Target: ATXN1; (-) strand; PAM type: YTN; PAM sequence: CTC
ctctctgccagcaggtcatc

SEQ ID NO: 165843 - DNA, 20 bp, Artificial Sequence
  Description of Artificial Sequence: Synthetic oligonucleotide
  Target: ATXN1; (-) strand; PAM type: YTN; PAM sequence: TTA
gcagagagggtagctcctct

SEQ ID NO: 165844 - DNA, 20 bp, Artificial Sequence
  Description of Artificial Sequence: Synthetic oligonucleotide
  Target: ATXN1; (-) strand; PAM type: YTN; PAM sequence: CTT
agcagagagggtagctcctc

SEQ ID NO: 165845 - DNA, 20 bp, Artificial Sequence
  Description of Artificial Sequence: Synthetic oligonucleotide
  Target: ATXN1; (-) strand; PAM type: YTN; PAM sequence: CTC
ttagcagagagggtagctcc

SEQ ID NO: 165846 - DNA, 20 bp, Artificial Sequence
  Description of Artificial Sequence: Synthetic oligonucleotide
  Target: ATXN1; (-) strand; PAM type: YTN; PAM sequence: CTC
ctcttagcagagagggtagc

SEQ ID NO: 165847 - DNA, 20 bp, Artificial Sequence
  Description of Artificial Sequence: Synthetic oligonucleotide
  Target: ATXN1; (-) strand; PAM type: YTN; PAM sequence: CTG
aagcactcctcttagcagag

SEQ ID NO: 165848 - DNA, 20 bp, Artificial Sequence
  Description of Artificial Sequence: Synthetic oligonucleotide
  Target: ATXN1; (-) strand; PAM type: YTN; PAM sequence: CTC
tgaagcactcctcttagcag

SEQ ID NO: 165849 - DNA, 20 bp, Artificial Sequence
  Description of Artificial Sequence: Synthetic oligonucleotide
  Target: ATXN1; (-) strand; PAM type: YTN; PAM sequence: CTG
caggtctctgaagcactcct

SEQ ID NO: 165850 - DNA, 20 bp, Artificial Sequence
  Description of Artificial Sequence: Synthetic oligonucleotide
  Target: ATXN1; (-) strand; PAM type: YTN; PAM sequence: TTC
tgcaggtctctgaagcactc

SEQ ID NO: 165851 - DNA, 20 bp, Artificial Sequence
  Description of Artificial Sequence: Synthetic oligonucleotide
  Target: ATXN1; (-) strand; PAM type: YTN; PAM sequence: CTG
caggcaagtcattctgcagg

SEQ ID NO: 165852 - DNA, 20 bp, Artificial Sequence
  Description of Artificial Sequence: Synthetic oligonucleotide
  Target: ATXN1; (-) strand; PAM type: YTN; PAM sequence: CTC
tgcaggcaagtcattctgca

SEQ ID NO: 165853 - DNA, 20 bp, Artificial Sequence
  Description of Artificial Sequence: Synthetic oligonucleotide
  Target: ATXN1; (-) strand; PAM type: YTN; PAM sequence: CTC
tctgcaggcaagtcattctg

SEQ ID NO: 165854 - DNA, 20 bp, Artificial Sequence
  Description of Artificial Sequence: Synthetic oligonucleotide
  Target: ATXN1; (-) strand; PAM type: YTN; PAM sequence: CTC
ctctctgcaggcaagtcatt

SEQ ID NO: 165855 - DNA, 20 bp, Artificial Sequence
  Description of Artificial Sequence: Synthetic oligonucleotide
  Target: ATXN1; (-) strand; PAM type: YTN; PAM sequence: CTG
gaaagggtggctcctctctg

SEQ ID NO: 165856 - DNA, 20 bp, Artificial Sequence
  Description of Artificial Sequence: Synthetic oligonucleotide
  Target: ATXN1; (-) strand; PAM type: YTN; PAM sequence: CTC
agcagagaggaggccctgga

SEQ ID NO: 165857 - DNA, 20 bp, Artificial Sequence
  Description of Artificial Sequence: Synthetic oligonucleotide
  Target: ATXN1; (-) strand; PAM type: YTN; PAM sequence: CTC
tcagcagagaggaggccctg

SEQ ID NO: 165858 - DNA, 20 bp, Artificial Sequence
  Description of Artificial Sequence: Synthetic oligonucleotide
  Target: ATXN1; (-) strand; PAM type: YTN; PAM sequence: TTC
agctctcagcagagaggagg

SEQ ID NO: 165859 - DNA, 20 bp, Artificial Sequence
  Description of Artificial Sequence: Synthetic oligonucleotide
  Target: ATXN1; (-) strand; PAM type: YTN; PAM sequence: TTG
agtgttcagctctcagcaga

SEQ ID NO: 165860 - DNA, 20 bp, Artificial Sequence
  Description of Artificial Sequence: Synthetic oligonucleotide
  Target: ATXN1; (-) strand; PAM type: YTN; PAM sequence: CTA
taagcagatcgtcccattga

SEQ ID NO: 165861 - DNA, 20 bp, Artificial Sequence
  Description of Artificial Sequence: Synthetic oligonucleotide
  Target: ATXN1; (-) strand; PAM type: YTN; PAM sequence: CTC
tataagcagatcgtcccatt

SEQ ID NO: 165862 - DNA, 20 bp, Artificial Sequence
  Description of Artificial Sequence: Synthetic oligonucleotide
  Target: ATXN1; (-) strand; PAM type: YTN; PAM sequence: CTC
tctataagcagatcgtccca

SEQ ID NO: 165863 - DNA, 20 bp, Artificial Sequence
  Description of Artificial Sequence: Synthetic oligonucleotide
  Target: ATXN1; (-) strand; PAM type: YTN; PAM sequence: CTC
ctctctataagcagatcgtc

SEQ ID NO: 165864 - DNA, 20 bp, Artificial Sequence
  Description of Artificial Sequence: Synthetic oligonucleotide
  Target: ATXN1; (-) strand; PAM type: YTN; PAM sequence: CTC
ggaggagtggggagctcctc

SEQ ID NO: 165865 - DNA, 20 bp, Artificial Sequence
  Description of Artificial Sequence: Synthetic oligonucleotide
  Target: ATXN1; (-) strand; PAM type: YTN; PAM sequence: TTA
gaacaactcggaggagtggg

SEQ ID NO: 165866 - DNA, 20 bp, Artificial Sequence
  Description of Artificial Sequence: Synthetic oligonucleotide
  Target: ATXN1; (-) strand; PAM type: YTN; PAM sequence: TTA
gtgttagaacaactcggagg

SEQ ID NO: 165867 - DNA, 20 bp, Artificial Sequence
  Description of Artificial Sequence: Synthetic oligonucleotide
  Target: ATXN1; (-) strand; PAM type: YTN; PAM sequence: TTT
agtgttagaacaactcggag

SEQ ID NO: 165868 - DNA, 20 bp, Artificial Sequence
  Description of Artificial Sequence: Synthetic oligonucleotide
  Target: ATXN1; (-) strand; PAM type: YTN; PAM sequence: TTA
tttagtgttagaacaactcg

SEQ ID NO: 165869 - DNA, 20 bp, Artificial Sequence
  Description of Artificial Sequence: Synthetic oligonucleotide
  Target: ATXN1; (-) strand; PAM type: YTN; PAM sequence: TTT
atttagtgttagaacaactc

SEQ ID NO: 165870 - DNA, 20 bp, Artificial Sequence
  Description of Artificial Sequence: Synthetic oligonucleotide
  Target: ATXN1; (-) strand; PAM type: YTN; PAM sequence: TTT
tatttagtgttagaacaact

SEQ ID NO: 165871 - DNA, 20 bp, Artificial Sequence
  Description of Artificial Sequence: Synthetic oligonucleotide
  Target: ATXN1; (-) strand; PAM type: YTN; PAM sequence: CTG
cgtccagaaagaatgaggta

SEQ ID NO: 165872 - DNA, 20 bp, Artificial Sequence
  Description of Artificial Sequence: Synthetic oligonucleotide
  Target: ATXN1; (-) strand; PAM type: YTN; PAM sequence: TTG
tcctgcgtccagaaagaatg

SEQ ID NO: 165873 - DNA, 20 bp, Artificial Sequence
  Description of Artificial Sequence: Synthetic oligonucleotide
  Target: ATXN1; (-) strand; PAM type: YTN; PAM sequence: TTT
gtcctgcgtccagaaagaat

SEQ ID NO: 165874 - DNA, 20 bp, Artificial Sequence
  Description of Artificial Sequence: Synthetic oligonucleotide
  Target: ATXN1; (-) strand; PAM type: YTN; PAM sequence: TTT
tgtcctgcgtccagaaagaa

SEQ ID NO: 165875 - DNA, 20 bp, Artificial Sequence
  Description of Artificial Sequence: Synthetic oligonucleotide
  Target: ATXN1; (-) strand; PAM type: YTN; PAM sequence: TTT
ttgtcctgcgtccagaaaga

SEQ ID NO: 165876 - DNA, 20 bp, Artificial Sequence
  Description of Artificial Sequence: Synthetic oligonucleotide
  Target: ATXN1; (-) strand; PAM type: YTN; PAM sequence: TTA
agcccaagtttttgtcctgc

SEQ ID NO: 165877 - DNA, 20 bp, Artificial Sequence
  Description of Artificial Sequence: Synthetic oligonucleotide
  Target: ATXN1; (-) strand; PAM type: YTN; PAM sequence: TTT
aagcccaagtttttgtcctg

SEQ ID NO: 165878 - DNA, 20 bp, Artificial Sequence
  Description of Artificial Sequence: Synthetic oligonucleotide
  Target: ATXN1; (-) strand; PAM type: YTN; PAM sequence: TTT
taagcccaagtttttgtcct

SEQ ID NO: 165879 - DNA, 20 bp, Artificial Sequence
  Description of Artificial Sequence: Synthetic oligonucleotide
  Target: ATXN1; (-) strand; PAM type: YTN; PAM sequence: CTT
ttaagcccaagtttttgtcc

SEQ ID NO: 165880 - DNA, 20 bp, Artificial Sequence
  Description of Artificial Sequence: Synthetic oligonucleotide
  Target: ATXN1; (-) strand; PAM type: YTN; PAM sequence: CTG
tggccgcaacgccttttaag

SEQ ID NO: 165881 - DNA, 20 bp, Artificial Sequence
  Description of Artificial Sequence: Synthetic oligonucleotide
  Target: ATXN1; (-) strand; PAM type: YTN; PAM sequence: TTC
tgtggccgcaacgcctttta

SEQ ID NO: 165882 - DNA, 20 bp, Artificial Sequence
  Description of Artificial Sequence: Synthetic oligonucleotide
  Target: ATXN1; (-) strand; PAM type: YTN; PAM sequence: CTT
ctgtggccgcaacgcctttt

SEQ ID NO: 165883 - DNA, 20 bp, Artificial Sequence
  Description of Artificial Sequence: Synthetic oligonucleotide
  Target: ATXN1; (-) strand; PAM type: YTN; PAM sequence: CTG
atgggaaacttctgtggccg

SEQ ID NO: 165884 - DNA, 20 bp, Artificial Sequence
  Description of Artificial Sequence: Synthetic oligonucleotide
  Target: ATXN1; (-) strand; PAM type: YTN; PAM sequence: TTC
tgatgggaaacttctgtggc

SEQ ID NO: 165885 - DNA, 20 bp, Artificial Sequence
  Description of Artificial Sequence: Synthetic oligonucleotide
  Target: ATXN1; (-) strand; PAM type: YTN; PAM sequence: TTT
ctgatgggaaacttctgtgg

SEQ ID NO: 165886 - DNA, 20 bp, Artificial Sequence
  Description of Artificial Sequence: Synthetic oligonucleotide
  Target: ATXN1; (-) strand; PAM type: YTN; PAM sequence: TTT
tctgatgggaaacttctgtg

SEQ ID NO: 165887 - DNA, 20 bp, Artificial Sequence
  Description of Artificial Sequence: Synthetic oligonucleotide
  Target: ATXN1; (-) strand; PAM type: YTN; PAM sequence: TTT
ttctgatgggaaacttctgt

SEQ ID NO: 165888 - DNA, 20 bp, Artificial Sequence
  Description of Artificial Sequence: Synthetic oligonucleotide
  Target: ATXN1; (-) strand; PAM type: YTN; PAM sequence: CTG
gggtgtcaatttttctgatg

SEQ ID NO: 165889 - DNA, 20 bp, Artificial Sequence
  Description of Artificial Sequence: Synthetic oligonucleotide
  Target: ATXN1; (-) strand; PAM type: YTN; PAM sequence: CTC
tggggtgtcaatttttctga

SEQ ID NO: 165890 - DNA, 20 bp, Artificial Sequence
  Description of Artificial Sequence: Synthetic oligonucleotide
  Target: ATXN1; (-) strand; PAM type: YTN; PAM sequence: TTA
taggatctctggggtgtcaa

SEQ ID NO: 165891 - DNA, 20 bp, Artificial Sequence
  Description of Artificial Sequence: Synthetic oligonucleotide
  Target: ATXN1; (-) strand; PAM type: YTN; PAM sequence: CTG
ttataggatctctggggtgt

SEQ ID NO: 165892 - DNA, 20 bp, Artificial Sequence
  Description of Artificial Sequence: Synthetic oligonucleotide
  Target: ATXN1; (-) strand; PAM type: YTN; PAM sequence: TTA
tgcgtgagaacatactgtta

SEQ ID NO: 165893 - DNA, 20 bp, Artificial Sequence
  Description of Artificial Sequence: Synthetic oligonucleotide
  Target: ATXN1; (-) strand; PAM type: YTN; PAM sequence: CTT
atgcgtgagaacatactgtt

SEQ ID NO: 165894 - DNA, 20 bp, Artificial Sequence
  Description of Artificial Sequence: Synthetic oligonucleotide
  Target: ATXN1; (-) strand; PAM type: YTN; PAM sequence: CTC
ccacttatgcgtgagaacat

SEQ ID NO: 165895 - DNA, 20 bp, Artificial Sequence
  Description of Artificial Sequence: Synthetic oligonucleotide
  Target: ATXN1; (-) strand; PAM type: YTN; PAM sequence: TTG
gctcccacttatgcgtgaga

SEQ ID NO: 165896 - DNA, 20 bp, Artificial Sequence
  Description of Artificial Sequence: Synthetic oligonucleotide
  Target: ATXN1; (-) strand; PAM type: YTN; PAM sequence: CTT
ggctcccacttatgcgtgag

SEQ ID NO: 165897 - DNA, 20 bp, Artificial Sequence
  Description of Artificial Sequence: Synthetic oligonucleotide
  Target: ATXN1; (-) strand; PAM type: YTN; PAM sequence: CTC
atggcttggctcccacttat

SEQ ID NO: 165898 - DNA, 20 bp, Artificial Sequence
  Description of Artificial Sequence: Synthetic oligonucleotide
  Target: ATXN1; (-) strand; PAM type: YTN; PAM sequence: TTG
catcctcatggcttggctcc

SEQ ID NO: 165899 - DNA, 20 bp, Artificial Sequence
  Description of Artificial Sequence: Synthetic oligonucleotide
  Target: ATXN1; (-) strand; PAM type: YTN; PAM sequence: TTT
gcatcctcatggcttggctc

SEQ ID NO: 165900 - DNA, 20 bp, Artificial Sequence
  Description of Artificial Sequence: Synthetic oligonucleotide
  Target: ATXN1; (-) strand; PAM type: YTN; PAM sequence: CTT
tgcatcctcatggcttggct

SEQ ID NO: 165901 - DNA, 20 bp, Artificial Sequence
  Description of Artificial Sequence: Synthetic oligonucleotide
  Target: ATXN1; (-) strand; PAM type: YTN; PAM sequence: TTG
tgaggcctttgcatcctcat

SEQ ID NO: 165902 - DNA, 20 bp, Artificial Sequence
  Description of Artificial Sequence: Synthetic oligonucleotide
  Target: ATXN1; (-) strand; PAM type: YTN; PAM sequence: CTG
tatcattgtgaggcctttgc

SEQ ID NO: 165903 - DNA, 20 bp, Artificial Sequence
  Description of Artificial Sequence: Synthetic oligonucleotide
  Target: ATXN1; (-) strand; PAM type: YTN; PAM sequence: CTC
ccaagtccccaaagtccact

SEQ ID NO: 165904 - DNA, 20 bp, Artificial Sequence
  Description of Artificial Sequence: Synthetic oligonucleotide
  Target: ATXN1; (-) strand; PAM type: YTN; PAM sequence: TTC
tcccaagtccccaaagtcca

SEQ ID NO: 165905 - DNA, 20 bp, Artificial Sequence
  Description of Artificial Sequence: Synthetic oligonucleotide
  Target: ATXN1; (-) strand; PAM type: YTN; PAM sequence: TTT
ctcccaagtccccaaagtcc

SEQ ID NO: 165906 - DNA, 20 bp, Artificial Sequence
  Description of Artificial Sequence: Synthetic oligonucleotide
  Target: ATXN1; (-) strand; PAM type: YTN; PAM sequence: CTT
tctcccaagtccccaaagtc

SEQ ID NO: 165907 - DNA, 20 bp, Artificial Sequence
  Description of Artificial Sequence: Synthetic oligonucleotide
  Target: ATXN1; (-) strand; PAM type: YTN; PAM sequence: CTC
ccaccctttctcccaagtcc

SEQ ID NO: 165908 - DNA, 20 bp, Artificial Sequence
  Description of Artificial Sequence: Synthetic oligonucleotide
  Target: ATXN1; (-) strand; PAM type: YTN; PAM sequence: CTC
acccccctcccaccctttct

SEQ ID NO: 165909 - DNA, 20 bp, Artificial Sequence
  Description of Artificial Sequence: Synthetic oligonucleotide
  Target: ATXN1; (-) strand; PAM type: YTN; PAM sequence: TTA
tccctcacccccctcccacc

SEQ ID NO: 165910 - DNA, 20 bp, Artificial Sequence
  Description of Artificial Sequence: Synthetic oligonucleotide
  Target: ATXN1; (-) strand; PAM type: YTN; PAM sequence: TTT
atccctcacccccctcccac

SEQ ID NO: 165911 - DNA, 20 bp, Artificial Sequence
  Description of Artificial Sequence: Synthetic oligonucleotide
  Target: ATXN1; (-) strand; PAM type: YTN; PAM sequence: TTG
tagtcatttatccctcaccc

SEQ ID NO: 165912 - DNA, 20 bp, Artificial Sequence
  Description of Artificial Sequence: Synthetic oligonucleotide
  Target: ATXN1; (-) strand; PAM type: YTN; PAM sequence: TTT
gtagtcatttatccctcacc

SEQ ID NO: 165913 - DNA, 20 bp, Artificial Sequence
  Description of Artificial Sequence: Synthetic oligonucleotide
  Target: ATXN1; (-) strand; PAM type: YTN; PAM sequence: TTT
tgtagtcatttatccctcac

SEQ ID NO: 165914 - DNA, 20 bp, Artificial Sequence
  Description of Artificial Sequence: Synthetic oligonucleotide
  Target: ATXN1; (-) strand; PAM type: YTN; PAM sequence: CTG
tacccattttgtagtcattt

SEQ ID NO: 165915 - DNA, 20 bp, Artificial Sequence
  Description of Artificial Sequence: Synthetic oligonucleotide
  Target: ATXN1; (-) strand; PAM type: YTN; PAM sequence: CTA
tacactgtacccattttgta

SEQ ID NO: 165916 - DNA, 20 bp, Artificial Sequence
  Description of Artificial Sequence: Synthetic oligonucleotide
  Target: ATXN1; (-) strand; PAM type: YTN; PAM sequence: TTC
ggtgcagccatcacccgagc

SEQ ID NO: 165917 - DNA, 20 bp, Artificial Sequence
  Description of Artificial Sequence: Synthetic oligonucleotide
  Target: ATXN1; (-) strand; PAM type: YTN; PAM sequence: TTT
cggtgcagccatcacccgag

SEQ ID NO: 165918 - DNA, 20 bp, Artificial Sequence
  Description of Artificial Sequence: Synthetic oligonucleotide
  Target: ATXN1; (-) strand; PAM type: YTN; PAM sequence: TTT
tcggtgcagccatcacccga

SEQ ID NO: 165919 - DNA, 20 bp, Artificial Sequence
  Description of Artificial Sequence: Synthetic oligonucleotide
  Target: ATXN1; (-) strand; PAM type: YTN; PAM sequence: CTG
agattttcggtgcagccatc

SEQ ID NO: 165920 - DNA, 20 bp, Artificial Sequence
  Description of Artificial Sequence: Synthetic oligonucleotide
  Target: ATXN1; (-) strand; PAM type: YTN; PAM sequence: TTC
tgagattttcggtgcagcca

SEQ ID NO: 165921 - DNA, 20 bp, Artificial Sequence
  Description of Artificial Sequence: Synthetic oligonucleotide
  Target: ATXN1; (-) strand; PAM type: YTN; PAM sequence: TTT
ctgagattttcggtgcagcc

SEQ ID NO: 165922 - DNA, 20 bp, Artificial Sequence
  Description of Artificial Sequence: Synthetic oligonucleotide
  Target: ATXN1; (-) strand; PAM type: YTN; PAM sequence: TTC
ggtggtgatttctgagattt

SEQ ID NO: 165923 - DNA, 20 bp, Artificial Sequence
  Description of Artificial Sequence: Synthetic oligonucleotide
  Target: ATXN1; (-) strand; PAM type: YTN; PAM sequence: CTT
cggtggtgatttctgagatt

SEQ ID NO: 165924 - DNA, 20 bp, Artificial Sequence
  Description of Artificial Sequence: Synthetic oligonucleotide
  Target: ATXN1; (-) strand; PAM type: YTN; PAM sequence: TTC
ttcggtggtgatttctgaga

SEQ ID NO: 165925 - DNA, 20 bp, Artificial Sequence
  Description of Artificial Sequence: Synthetic oligonucleotide
  Target: ATXN1; (-) strand; PAM type: YTN; PAM sequence: TTA
catgaataagttcttcggtg

SEQ ID NO: 165926 - DNA, 20 bp, Artificial Sequence
  Description of Artificial Sequence: Synthetic oligonucleotide
  Target: ATXN1; (-) strand; PAM type: YTN; PAM sequence: TTG
gttacatgaataagttcttc

SEQ ID NO: 165927 - DNA, 20 bp, Artificial Sequence
  Description of Artificial Sequence: Synthetic oligonucleotide
  Target: ATXN1; (-) strand; PAM type: YTN; PAM sequence: TTT
ggttacatgaataagttctt

SEQ ID NO: 165928 - DNA, 20 bp, Artificial Sequence
  Description of Artificial Sequence: Synthetic oligonucleotide
  Target: ATXN1; (-) strand; PAM type: YTN; PAM sequence: TTG
ggggaacaggtggtgtttgg

SEQ ID NO: 165929 - DNA, 20 bp, Artificial Sequence
  Description of Artificial Sequence: Synthetic oligonucleotide
  Target: ATXN1; (-) strand; PAM type: YTN; PAM sequence: TTT
gggggaacaggtggtgtttg

SEQ ID NO: 165930 - DNA, 20 bp, Artificial Sequence
  Description of Artificial Sequence: Synthetic oligonucleotide
  Target: ATXN1; (-) strand; PAM type: YTN; PAM sequence: TTT
tgggggaacaggtggtgttt

SEQ ID NO: 165931 - DNA, 20 bp, Artificial Sequence
  Description of Artificial Sequence: Synthetic oligonucleotide
  Target: ATXN1; (-) strand; PAM type: YTN; PAM sequence: TTA
cgtccataggttttggggga

SEQ ID NO: 165932 - DNA, 20 bp, Artificial Sequence
  Description of Artificial Sequence: Synthetic oligonucleotide
  Target: ATXN1; (-) strand; PAM type: YTN; PAM sequence: TTT
acgtccataggttttggggg

SEQ ID NO: 165933 - DNA, 20 bp, Artificial Sequence
  Description of Artificial Sequence: Synthetic oligonucleotide
  Target: ATXN1; (-) strand; PAM type: YTN; PAM sequence: TTT
tacgtccataggttttgggg

SEQ ID NO: 165934 - DNA, 20 bp, Artificial Sequence
  Description of Artificial Sequence: Synthetic oligonucleotide
  Target: ATXN1; (-) strand; PAM type: YTN; PAM sequence: TTT
ttacgtccataggttttggg

SEQ ID NO: 165935 - DNA, 20 bp, Artificial Sequence
  Description of Artificial Sequence: Synthetic oligonucleotide
  Target: ATXN1; (-) strand; PAM type: YTN; PAM sequence: TTT
tttacgtccataggttttgg

SEQ ID NO: 165936 - DNA, 20 bp, Artificial Sequence
  Description of Artificial Sequence: Synthetic oligonucleotide
  Target: ATXN1; (-) strand; PAM type: YTN; PAM sequence: TTA
ttttttacgtccataggttt

SEQ ID NO: 165937 - DNA, 20 bp, Artificial Sequence
  Description of Artificial Sequence: Synthetic oligonucleotide
  Target: ATXN1; (-) strand; PAM type: YTN; PAM sequence: TTT
attttttacgtccataggtt

SEQ ID NO: 165938 - DNA, 20 bp, Artificial Sequence
  Description of Artificial Sequence: Synthetic oligonucleotide
  Target: ATXN1; (-) strand; PAM type: YTN; PAM sequence: TTT
tattttttacgtccataggt

SEQ ID NO: 165939 - DNA, 20 bp, Artificial Sequence
  Description of Artificial Sequence: Synthetic oligonucleotide
  Target: ATXN1; (-) strand; PAM type: YTN; PAM sequence: TTT
ttattttttacgtccatagg

SEQ ID NO: 165940 - DNA, 20 bp, Artificial Sequence
  Description of Artificial Sequence: Synthetic oligonucleotide
  Target: ATXN1; (-) strand; PAM type: YTN; PAM sequence: TTA
tttttattttttacgtccat

SEQ ID NO: 165941 - DNA, 20 bp, Artificial Sequence
  Description of Artificial Sequence: Synthetic oligonucleotide
  Target: ATXN1; (-) strand; PAM type: YTN; PAM sequence: TTT
atttttattttttacgtcca

SEQ ID NO: 165942 - DNA, 20 bp, Artificial Sequence
  Description of Artificial Sequence: Synthetic oligonucleotide
  Target: ATXN1; (-) strand; PAM type: YTN; PAM sequence: TTT
tatttttattttttacgtcc

SEQ ID NO: 165943 - DNA, 20 bp, Artificial Sequence
  Description of Artificial Sequence: Synthetic oligonucleotide
  Target: ATXN1; (-) strand; PAM type: YTN; PAM sequence: TTT
ttatttttattttttacgtc

SEQ ID NO: 165944 - DNA, 20 bp, Artificial Sequence
  Description of Artificial Sequence: Synthetic oligonucleotide
  Target: ATXN1; (-) strand; PAM type: YTN; PAM sequence: TTT
tttatttttattttttacgt

SEQ ID NO: 165945 - DNA, 20 bp, Artificial Sequence
  Description of Artificial Sequence: Synthetic oligonucleotide
  Target: ATXN1; (-) strand; PAM type: YTN; PAM sequence: CTT
ttttatttttattttttacg

SEQ ID NO: 165946 - DNA, 20 bp, Artificial Sequence
  Description of Artificial Sequence: Synthetic oligonucleotide
  Target: ATXN1; (-) strand; PAM type: YTN; PAM sequence: CTG
tcttttttatttttattttt

SEQ ID NO: 165947 - DNA, 20 bp, Artificial Sequence
  Description of Artificial Sequence: Synthetic oligonucleotide
  Target: ATXN1; (-) strand; PAM type: YTN; PAM sequence: TTC
tgtcttttttatttttattt

SEQ ID NO: 165948 - DNA, 20 bp, Artificial Sequence
  Description of Artificial Sequence: Synthetic oligonucleotide
  Target: ATXN1; (-) strand; PAM type: YTN; PAM sequence: CTT
ctgtcttttttatttttatt

SEQ ID NO: 165949 - DNA, 20 bp, Artificial Sequence
  Description of Artificial Sequence: Synthetic oligonucleotide
  Target: ATXN1; (-) strand; PAM type: YTN; PAM sequence: TTC
ttctgtcttttttattttta

SEQ ID NO: 165950 - DNA, 20 bp, Artificial Sequence
  Description of Artificial Sequence: Synthetic oligonucleotide
  Target: ATXN1; (-) strand; PAM type: YTN; PAM sequence: TTT
cttctgtcttttttattttt

SEQ ID NO: 165951 - DNA, 20 bp, Artificial Sequence
  Description of Artificial Sequence: Synthetic oligonucleotide
  Target: ATXN1; (-) strand; PAM type: YTN; PAM sequence: TTT
tcttctgtcttttttatttt

SEQ ID NO: 165952 - DNA, 20 bp, Artificial Sequence
  Description of Artificial Sequence: Synthetic oligonucleotide
  Target: ATXN1; (-) strand; PAM type: YTN; PAM sequence: TTA
attttcttctgtctttttta

SEQ ID NO: 165953 - DNA, 20 bp, Artificial Sequence
  Description of Artificial Sequence: Synthetic oligonucleotide
  Target: ATXN1; (-) strand; PAM type: YTN; PAM sequence: CTT
aattttcttctgtctttttt

SEQ ID NO: 165954 - DNA, 20 bp, Artificial Sequence
  Description of Artificial Sequence: Synthetic oligonucleotide
  Target: ATXN1; (-) strand; PAM type: YTN; PAM sequence: TTG
atgtcttaattttcttctgt

SEQ ID NO: 165955 - DNA, 20 bp, Artificial Sequence
  Description of Artificial Sequence: Synthetic oligonucleotide
  Target: ATXN1; (-) strand; PAM type: YTN; PAM sequence: TTA
atataattgatgtcttaatt

SEQ ID NO: 165956 - DNA, 20 bp, Artificial Sequence
  Description of Artificial Sequence: Synthetic oligonucleotide
  Target: ATXN1; (-) strand; PAM type: YTN; PAM sequence: TTT
aatataattgatgtcttaat

SEQ ID NO: 165957 - DNA, 20 bp, Artificial Sequence
  Description of Artificial Sequence: Synthetic oligonucleotide
  Target: ATXN1; (-) strand; PAM type: YTN; PAM sequence: CTG
catttaatataattgatgtc

SEQ ID NO: 165958 - DNA, 20 bp, Artificial Sequence
  Description of Artificial Sequence: Synthetic oligonucleotide
  Target: ATXN1; (-) strand; PAM type: YTN; PAM sequence: CTG
ctgcatttaatataattgat

SEQ ID NO: 165959 - DNA, 20 bp, Artificial Sequence
  Description of Artificial Sequence: Synthetic oligonucleotide
  Target: ATXN1; (-) strand; PAM type: YTN; PAM sequence: CTC
tgctgcatttaatataattg

SEQ ID NO: 165960 - DNA, 20 bp, Artificial Sequence
  Description of Artificial Sequence: Synthetic oligonucleotide
  Target: ATXN1; (-) strand; PAM type: YTN; PAM sequence: TTC
tctgctgcatttaatataat

SEQ ID NO: 165961 - DNA, 20 bp, Artificial Sequence
  Description of Artificial Sequence: Synthetic oligonucleotide
  Target: ATXN1; (-) strand; PAM type: YTN; PAM sequence: TTT
ctctgctgcatttaatataa

SEQ ID NO: 165962 - DNA, 20 bp, Artificial Sequence
  Description of Artificial Sequence: Synthetic oligonucleotide
  Target: ATXN1; (-) strand; PAM type: YTN; PAM sequence: CTG
tttctctgctgcatttaata

SEQ ID NO: 165963 - DNA, 20 bp, Artificial Sequence
  Description of Artificial Sequence: Synthetic oligonucleotide
  Target: ATXN1; (-) strand; PAM type: YTN; PAM sequence: TTC
tgtttctctgctgcatttaa

SEQ ID NO: 165964 - DNA, 20 bp, Artificial Sequence
  Description of Artificial Sequence: Synthetic oligonucleotide
  Target: ATXN1; (-) strand; PAM type: YTN; PAM sequence: TTT
ctgtttctctgctgcattta

SEQ ID NO: 165965 - DNA, 20 bp, Artificial Sequence
  Description of Artificial Sequence: Synthetic oligonucleotide
  Target: ATXN1; (-) strand; PAM type: YTN; PAM sequence: CTT
tctgtttctctgctgcattt

SEQ ID NO: 165966 - DNA, 20 bp, Artificial Sequence
  Description of Artificial Sequence: Synthetic oligonucleotide
  Target: ATXN1; (-) strand; PAM type: YTN; PAM sequence: TTA
gtctttctgtttctctgctg

SEQ ID NO: 165967 - DNA, 20 bp, Artificial Sequence
  Description of Artificial Sequence: Synthetic oligonucleotide
  Target: ATXN1; (-) strand; PAM type: YTN; PAM sequence: CTT
agtctttctgtttctctgct

SEQ ID NO: 165968 - DNA, 20 bp, Artificial Sequence
  Description of Artificial Sequence: Synthetic oligonucleotide
  Target: ATXN1; (-) strand; PAM type: YTN; PAM sequence: TTC
ttagtctttctgtttctctg

SEQ ID NO: 165969 - DNA, 20 bp, Artificial Sequence
  Description of Artificial Sequence: Synthetic oligonucleotide
  Target: ATXN1; (-) strand; PAM type: YTN; PAM sequence: CTA
atccaatggccattcttagt

SEQ ID NO: 165970 - DNA, 20 bp, Artificial Sequence
  Description of Artificial Sequence: Synthetic oligonucleotide
  Target: ATXN1; (-) strand; PAM type: YTN; PAM sequence: TTG
agaacccatggtctaatcca

SEQ ID NO: 165971 - DNA, 20 bp, Artificial Sequence
  Description of Artificial Sequence: Synthetic oligonucleotide
  Target: ATXN1; (-) strand; PAM type: YTN; PAM sequence: TTC
agcagatattgagaacccat

SEQ ID NO: 165972 - DNA, 20 bp, Artificial Sequence
  Description of Artificial Sequence: Synthetic oligonucleotide
  Target: ATXN1; (-) strand; PAM type: YTN; PAM sequence: CTA
atattcagcagatattgaga

SEQ ID NO: 165973 - DNA, 20 bp, Artificial Sequence
  Description of Artificial Sequence: Synthetic oligonucleotide
  Target: ATXN1; (-) strand; PAM type: YTN; PAM sequence: TTC
taatattcagcagatattga

SEQ ID NO: 165974 - DNA, 20 bp, Artificial Sequence
  Description of Artificial Sequence: Synthetic oligonucleotide
  Target: ATXN1; (-) strand; PAM type: YTN; PAM sequence: CTT
ctaatattcagcagatattg

SEQ ID NO: 165975 - DNA, 20 bp, Artificial Sequence
  Description of Artificial Sequence: Synthetic oligonucleotide
  Target: ATXN1; (-) strand; PAM type: YTN; PAM sequence: CTC
cggtgcttctaatattcagc

SEQ ID NO: 165976 - DNA, 20 bp, Artificial Sequence
  Description of Artificial Sequence: Synthetic oligonucleotide
  Target: ATXN1; (-) strand; PAM type: YTN; PAM sequence: CTC
tccggtgcttctaatattca

SEQ ID NO: 165977 - DNA, 20 bp, Artificial Sequence
  Description of Artificial Sequence: Synthetic oligonucleotide
  Target: ATXN1; (-) strand; PAM type: YTN; PAM sequence: TTG
tagaagctctccggtgcttc

SEQ ID NO: 165978 - DNA, 20 bp, Artificial Sequence
  Description of Artificial Sequence: Synthetic oligonucleotide
  Target: ATXN1; (-) strand; PAM type: YTN; PAM sequence: CTT
gtagaagctctccggtgctt

SEQ ID NO: 165979 - DNA, 20 bp, Artificial Sequence
  Description of Artificial Sequence: Synthetic oligonucleotide
  Target: ATXN1; (-) strand; PAM type: YTN; PAM sequence: TTA
gtgtcttgtagaagctctcc

SEQ ID NO: 165980 - DNA, 20 bp, Artificial Sequence
  Description of Artificial Sequence: Synthetic oligonucleotide
  Target: ATXN1; (-) strand; PAM type: YTN; PAM sequence: CTG
ggttagtgtcttgtagaagc

SEQ ID NO: 165981 - DNA, 20 bp, Artificial Sequence
  Description of Artificial Sequence: Synthetic oligonucleotide
  Target: ATXN1; (-) strand; PAM type: YTN; PAM sequence: TTC
tgggttagtgtcttgtagaa

SEQ ID NO: 165982 - DNA, 20 bp, Artificial Sequence
  Description of Artificial Sequence: Synthetic oligonucleotide
  Target: ATXN1; (-) strand; PAM type: YTN; PAM sequence: TTC
agattctgggttagtgtctt

SEQ ID NO: 165983 - DNA, 20 bp, Artificial Sequence
  Description of Artificial Sequence: Synthetic oligonucleotide
  Target: ATXN1; (-) strand; PAM type: YTN; PAM sequence: TTA
attcagattctgggttagtg

SEQ ID NO: 165984 - DNA, 20 bp, Artificial Sequence
  Description of Artificial Sequence: Synthetic oligonucleotide
  Target: ATXN1; (-) strand; PAM type: YTN; PAM sequence: TTA
atccagtgggcattaattca

SEQ ID NO: 165985 - DNA, 20 bp, Artificial Sequence
  Description of Artificial Sequence: Synthetic oligonucleotide
  Target: ATXN1; (-) strand; PAM type: YTN; PAM sequence: TTT
aatccagtgggcattaattc

SEQ ID NO: 165986 - DNA, 20 bp, Artificial Sequence
  Description of Artificial Sequence: Synthetic oligonucleotide
  Target: ATXN1; (-) strand; PAM type: YTN; PAM sequence: CTG
accatacagtttaatccagt

SEQ ID NO: 165987 - DNA, 20 bp, Artificial Sequence
  Description of Artificial Sequence: Synthetic oligonucleotide
  Target: ATXN1; (-) strand; PAM type: YTN; PAM sequence: CTC
tgaccatacagtttaatcca

SEQ ID NO: 165988 - DNA, 20 bp, Artificial Sequence
  Description of Artificial Sequence: Synthetic oligonucleotide
  Target: ATXN1; (-) strand; PAM type: YTN; PAM sequence: TTG
aagtcatctctgaccataca

SEQ ID NO: 165989 - DNA, 20 bp, Artificial Sequence
  Description of Artificial Sequence: Synthetic oligonucleotide
  Target: ATXN1; (-) strand; PAM type: YTN; PAM sequence: TTT
gaagtcatctctgaccatac

SEQ ID NO: 165990 - DNA, 20 bp, Artificial Sequence
  Description of Artificial Sequence: Synthetic oligonucleotide
  Target: ATXN1; (-) strand; PAM type: YTN; PAM sequence: CTT
tgaagtcatctctgaccata

SEQ ID NO: 165991 - DNA, 20 bp, Artificial Sequence
  Description of Artificial Sequence: Synthetic oligonucleotide
  Target: ATXN1; (-) strand; PAM type: YTN; PAM sequence: CTC
tttgaagtcatctctgacca

SEQ ID NO: 165992 - DNA, 20 bp, Artificial Sequence
  Description of Artificial Sequence: Synthetic oligonucleotide
  Target: ATXN1; (-) strand; PAM type: YTN; PAM sequence: TTC
tctttgaagtcatctctgac

SEQ ID NO: 165993 - DNA, 20 bp, Artificial Sequence
  Description of Artificial Sequence: Synthetic oligonucleotide
  Target: ATXN1; (-) strand; PAM type: YTN; PAM sequence: CTG
ttctctttgaagtcatctct

SEQ ID NO: 165994 - DNA, 20 bp, Artificial Sequence
  Description of Artificial Sequence: Synthetic oligonucleotide
  Target: ATXN1; (-) strand; PAM type: YTN; PAM sequence: CTA
tagagctgttctctttgaag

SEQ ID NO: 165995 - DNA, 20 bp, Artificial Sequence
  Description of Artificial Sequence: Synthetic oligonucleotide
  Target: ATXN1; (-) strand; PAM type: YTN; PAM sequence: TTA
aaataggactatagagctgt

SEQ ID NO: 165996 - DNA, 20 bp, Artificial Sequence
  Description of Artificial Sequence: Synthetic oligonucleotide
  Target: ATXN1; (-) strand; PAM type: YTN; PAM sequence: TTT
aaaataggactatagagctg

SEQ ID NO: 165997 - DNA, 20 bp, Artificial Sequence
  Description of Artificial Sequence: Synthetic oligonucleotide
  Target: ATXN1; (-) strand; PAM type: YTN; PAM sequence: CTT
taaaataggactatagagct

SEQ ID NO: 165998 - DNA, 20 bp, Artificial Sequence
  Description of Artificial Sequence: Synthetic oligonucleotide
  Target: ATXN1; (-) strand; PAM type: YTN; PAM sequence: CTA
ctttaaaataggactataga

SEQ ID NO: 165999 - DNA, 20 bp, Artificial Sequence
  Description of Artificial Sequence: Synthetic oligonucleotide
  Target: ATXN1; (-) strand; PAM type: YTN; PAM sequence: TTC
ccctactttaaaataggact

SEQ ID NO: 166000 - DNA, 20 bp, Artificial Sequence
  Description of Artificial Sequence: Synthetic oligonucleotide
  Target: ATXN1; (-) strand; PAM type: YTN; PAM sequence: CTG
ttcccctactttaaaatagg

SEQ ID NO: 166001 - DNA, 20 bp, Artificial Sequence
  Description of Artificial Sequence: Synthetic oligonucleotide
  Target: ATXN1; (-) strand; PAM type: YTN; PAM sequence: CTG
ggtatatctgttcccctact

SEQ ID NO: 166002 - DNA, 20 bp, Artificial Sequence
  Description of Artificial Sequence: Synthetic oligonucleotide
  Target: ATXN1; (-) strand; PAM type: YTN; PAM sequence: TTC
cgatgtcactgggtatatct

SEQ ID NO: 166003 - DNA, 20 bp, Artificial Sequence
  Description of Artificial Sequence: Synthetic oligonucleotide
  Target: ATXN1; (-) strand; PAM type: YTN; PAM sequence: TTT
ccgatgtcactgggtatatc

SEQ ID NO: 166004 - DNA, 20 bp, Artificial Sequence
  Description of Artificial Sequence: Synthetic oligonucleotide
  Target: ATXN1; (-) strand; PAM type: YTN; PAM sequence: TTG
ggaatggaaaacacatttcc

SEQ ID NO: 166005 - DNA, 20 bp, Artificial Sequence
  Description of Artificial Sequence: Synthetic oligonucleotide
  Target: ATXN1; (-) strand; PAM type: YTN; PAM sequence: CTT
gggaatggaaaacacatttc

SEQ ID NO: 166006 - DNA, 20 bp, Artificial Sequence
  Description of Artificial Sequence: Synthetic oligonucleotide
  Target: ATXN1; (-) strand; PAM type: YTN; PAM sequence: TTG
aatcttgggaatggaaaaca

SEQ ID NO: 166007 - DNA, 20 bp, Artificial Sequence
  Description of Artificial Sequence: Synthetic oligonucleotide
  Target: ATXN1; (-) strand; PAM type: YTN; PAM sequence: TTA
catattgaatcttgggaatg

SEQ ID NO: 166008 - DNA, 20 bp, Artificial Sequence
  Description of Artificial Sequence: Synthetic oligonucleotide
  Target: ATXN1; (-) strand; PAM type: YTN; PAM sequence: TTT
acatattgaatcttgggaat

SEQ ID NO: 166009 - DNA, 20 bp, Artificial Sequence
  Description of Artificial Sequence: Synthetic oligonucleotide
  Target: ATXN1; (-) strand; PAM type: YTN; PAM sequence: TTA
aaaataaaataataatgcaa

SEQ ID NO: 166010 - DNA, 20 bp, Artificial Sequence
  Description of Artificial Sequence: Synthetic oligonucleotide
  Target: ATXN1; (-) strand; PAM type: YTN; PAM sequence: TTT
aaaaataaaataataatgca

SEQ ID NO: 166011 - DNA, 20 bp, Artificial Sequence
  Description of Artificial Sequence: Synthetic oligonucleotide
  Target: ATXN1; (-) strand; PAM type: YTN; PAM sequence: TTG
acatatgtaaatttaaaaat

SEQ ID NO: 166012 - DNA, 20 bp, Artificial Sequence
  Description of Artificial Sequence: Synthetic oligonucleotide
  Target: ATXN1; (-) strand; PAM type: YTN; PAM sequence: TTC
ccattgacatatgtaaattt

SEQ ID NO: 166013 - DNA, 20 bp, Artificial Sequence
  Description of Artificial Sequence: Synthetic oligonucleotide
  Target: ATXN1; (-) strand; PAM type: YTN; PAM sequence: TTT
cccattgacatatgtaaatt

SEQ ID NO: 166014 - DNA, 20 bp, Artificial Sequence
  Description of Artificial Sequence: Synthetic oligonucleotide
  Target: ATXN1; (-) strand; PAM type: YTN; PAM sequence: TTA
tttcccattgacatatgtaa

SEQ ID NO: 166015 - DNA, 20 bp, Artificial Sequence
  Description of Artificial Sequence: Synthetic oligonucleotide
  Target: ATXN1; (-) strand; PAM type: YTN; PAM sequence: TTC
aagcacattatttcccattg

SEQ ID NO: 166016 - DNA, 20 bp, Artificial Sequence
  Description of Artificial Sequence: Synthetic oligonucleotide
  Target: ATXN1; (-) strand; PAM type: YTN; PAM sequence: TTA
ttcaagcacattatttccca

SEQ ID NO: 166017 - DNA, 20 bp, Artificial Sequence
  Description of Artificial Sequence: Synthetic oligonucleotide
  Target: ATXN1; (-) strand; PAM type: YTN; PAM sequence: CTG
aatatgttattcaagcacat

SEQ ID NO: 166018 - DNA, 20 bp, Artificial Sequence
  Description of Artificial Sequence: Synthetic oligonucleotide
  Target: ATXN1; (-) strand; PAM type: YTN; PAM sequence: TTC
aaatgctgaatatgttattc

SEQ ID NO: 166019 - DNA, 20 bp, Artificial Sequence
  Description of Artificial Sequence: Synthetic oligonucleotide
  Target: ATXN1; (-) strand; PAM type: YTN; PAM sequence: CTC
agccagtgtaatcccaggca

SEQ ID NO: 166020 - DNA, 20 bp, Artificial Sequence
  Description of Artificial Sequence: Synthetic oligonucleotide
  Target: ATXN1; (-) strand; PAM type: YTN; PAM sequence: TTC
gtgatgtgggaggctcagcc

SEQ ID NO: 166021 - DNA, 20 bp, Artificial Sequence
  Description of Artificial Sequence: Synthetic oligonucleotide
  Target: ATXN1; (-) strand; PAM type: YTN; PAM sequence: CTT
cgtgatgtgggaggctcagc

SEQ ID NO: 166022 - DNA, 20 bp, Artificial Sequence
  Description of Artificial Sequence: Synthetic oligonucleotide
  Target: ATXN1; (-) strand; PAM type: YTN; PAM sequence: TTG
cttcgtgatgtgggaggctc

SEQ ID NO: 166023 - DNA, 20 bp, Artificial Sequence
  Description of Artificial Sequence: Synthetic oligonucleotide
  Target: ATXN1; (-) strand; PAM type: YTN; PAM sequence: TTT
gcttcgtgatgtgggaggct

SEQ ID NO: 166024 - DNA, 20 bp, Artificial Sequence
  Description of Artificial Sequence: Synthetic oligonucleotide
  Target: ATXN1; (-) strand; PAM type: YTN; PAM sequence: TTC
aagcatttgcttcgtgatgt

SEQ ID NO: 166025 - DNA, 20 bp, Artificial Sequence
  Description of Artificial Sequence: Synthetic oligonucleotide
  Target: ATXN1; (-) strand; PAM type: YTN; PAM sequence: TTA
ttcaagcatttgcttcgtga

SEQ ID NO: 166026 - DNA, 20 bp, Artificial Sequence
  Description of Artificial Sequence: Synthetic oligonucleotide
  Target: ATXN1; (-) strand; PAM type: YTN; PAM sequence: TTT
attcaagcatttgcttcgtg

SEQ ID NO: 166027 - DNA, 20 bp, Artificial Sequence
  Description of Artificial Sequence: Synthetic oligonucleotide
  Target: ATXN1; (-) strand; PAM type: YTN; PAM sequence: CTC
agagcccatatgtttattca

SEQ ID NO: 166028 - DNA, 20 bp, Artificial Sequence
  Description of Artificial Sequence: Synthetic oligonucleotide
  Target: ATXN1; (-) strand; PAM type: YTN; PAM sequence: TTC
tcagagcccatatgtttatt

SEQ ID NO: 166029 - DNA, 20 bp, Artificial Sequence
  Description of Artificial Sequence: Synthetic oligonucleotide
  Target: ATXN1; (-) strand; PAM type: YTN; PAM sequence: TTT
ctcagagcccatatgtttat

SEQ ID NO: 166030 - DNA, 20 bp, Artificial Sequence
  Description of Artificial Sequence: Synthetic oligonucleotide
  Target: ATXN1; (-) strand; PAM type: YTN; PAM sequence: CTT
tctcagagcccatatgttta

SEQ ID NO: 166031 - DNA, 20 bp, Artificial Sequence
  Description of Artificial Sequence: Synthetic oligonucleotide
  Target: ATXN1; (-) strand; PAM type: YTN; PAM sequence: CTG
agggcactttctcagagccc

SEQ ID NO: 166032 - DNA, 20 bp, Artificial Sequence
  Description of Artificial Sequence: Synthetic oligonucleotide
  Target: ATXN1; (-) strand; PAM type: YTN; PAM sequence: CTC
tgagggcactttctcagagc

SEQ ID NO: 166033 - DNA, 20 bp, Artificial Sequence
  Description of Artificial Sequence: Synthetic oligonucleotide
  Target: ATXN1; (-) strand; PAM type: YTN; PAM sequence: CTG
gctctgagggcactttctca

SEQ ID NO: 166034 - DNA, 20 bp, Artificial Sequence
  Description of Artificial Sequence: Synthetic oligonucleotide
  Target: ATXN1; (-) strand; PAM type: YTN; PAM sequence: TTC
cctggctctgagggcacttt

SEQ ID NO: 166035 - DNA, 20 bp, Artificial Sequence
  Description of Artificial Sequence: Synthetic oligonucleotide
  Target: ATXN1; (-) strand; PAM type: YTN; PAM sequence: TTG
aaatatagtcatgttccctg

SEQ ID NO: 166036 - DNA, 20 bp, Artificial Sequence
  Description of Artificial Sequence: Synthetic oligonucleotide
  Target: ATXN1; (-) strand; PAM type: YTN; PAM sequence: TTA
aattgaaatatagtcatgtt

SEQ ID NO: 166037 - DNA, 20 bp, Artificial Sequence
  Description of Artificial Sequence: Synthetic oligonucleotide
  Target: ATXN1; (-) strand; PAM type: YTN; PAM sequence: CTT
aaattgaaatatagtcatgt

SEQ ID NO: 166038 - DNA, 20 bp, Artificial Sequence
  Description of Artificial Sequence: Synthetic oligonucleotide
  Target: ATXN1; (-) strand; PAM type: YTN; PAM sequence: CTC
ttaaattgaaatatagtcat

SEQ ID NO: 166039 - DNA, 20 bp, Artificial Sequence
  Description of Artificial Sequence: Synthetic oligonucleotide
  Target: ATXN1; (-) strand; PAM type: YTN; PAM sequence: TTC
tcttaaattgaaatatagtc

SEQ ID NO: 166040 - DNA, 20 bp, Artificial Sequence
  Description of Artificial Sequence: Synthetic oligonucleotide
  Target: ATXN1; (-) strand; PAM type: YTN; PAM sequence: CTT
ctcttaaattgaaatatagt

SEQ ID NO: 166041 - DNA, 20 bp, Artificial Sequence
  Description of Artificial Sequence: Synthetic oligonucleotide
  Target: ATXN1; (-) strand; PAM type: YTN; PAM sequence: TTA
cttctcttaaattgaaatat

SEQ ID NO: 166042 - DNA, 20 bp, Artificial Sequence
  Description of Artificial Sequence: Synthetic oligonucleotide
  Target: ATXN1; (-) strand; PAM type: YTN; PAM sequence: CTT
acttctcttaaattgaaata

SEQ ID NO: 166043 - DNA, 20 bp, Artificial Sequence
  Description of Artificial Sequence: Synthetic oligonucleotide
  Target: ATXN1; (-) strand; PAM type: YTN; PAM sequence: TTC
caagaggcttacttctctta

SEQ ID NO: 166044 - DNA, 20 bp, Artificial Sequence
  Description of Artificial Sequence: Synthetic oligonucleotide
  Target: ATXN1; (-) strand; PAM type: YTN; PAM sequence: TTT
ccaagaggcttacttctctt

SEQ ID NO: 166045 - DNA, 20 bp, Artificial Sequence
  Description of Artificial Sequence: Synthetic oligonucleotide
  Target: ATXN1; (-) strand; PAM type: YTN; PAM sequence: TTT
tccaagaggcttacttctct

SEQ ID NO: 166046 - DNA, 20 bp, Artificial Sequence
  Description of Artificial Sequence: Synthetic oligonucleotide
  Target: ATXN1; (-) strand; PAM type: YTN; PAM sequence: TTG
aagagggagcaaacaagagg

SEQ ID NO: 166047 - DNA, 20 bp, Artificial Sequence
  Description of Artificial Sequence: Synthetic oligonucleotide
  Target: ATXN1; (-) strand; PAM type: YTN; PAM sequence: TTA
aaaacccgttgaagagggag

SEQ ID NO: 166048 - DNA, 20 bp, Artificial Sequence
  Description of Artificial Sequence: Synthetic oligonucleotide
  Target: ATXN1; (-) strand; PAM type: YTN; PAM sequence: CTT
aaaaacccgttgaagaggga

SEQ ID NO: 166049 - DNA, 20 bp, Artificial Sequence
  Description of Artificial Sequence: Synthetic oligonucleotide
  Target: ATXN1; (-) strand; PAM type: YTN; PAM sequence: CTG
gacttaaaaacccgttgaag

SEQ ID NO: 166050 - DNA, 20 bp, Artificial Sequence
  Description of Artificial Sequence: Synthetic oligonucleotide
  Target: ATXN1; (-) strand; PAM type: YTN; PAM sequence: TTG
gaatgagccctggacttaaa

SEQ ID NO: 166051 - DNA, 20 bp, Artificial Sequence
  Description of Artificial Sequence: Synthetic oligonucleotide
  Target: ATXN1; (-) strand; PAM type: YTN; PAM sequence: TTT
ggaatgagccctggacttaa

SEQ ID NO: 166052 - DNA, 20 bp, Artificial Sequence
  Description of Artificial Sequence: Synthetic oligonucleotide
  Target: ATXN1; (-) strand; PAM type: YTN; PAM sequence: TTT
tggaatgagccctggactta

SEQ ID NO: 166053 - DNA, 20 bp, Artificial Sequence
  Description of Artificial Sequence: Synthetic oligonucleotide
  Target: ATXN1; (-) strand; PAM type: YTN; PAM sequence: CTT
ttggaatgagccctggactt

SEQ ID NO: 166054 - DNA, 20 bp, Artificial Sequence
  Description of Artificial Sequence: Synthetic oligonucleotide
  Target: ATXN1; (-) strand; PAM type: YTN; PAM sequence: CTA
aaggacttttggaatgagcc

SEQ ID NO: 166055 - DNA, 20 bp, Artificial Sequence
  Description of Artificial Sequence: Synthetic oligonucleotide
  Target: ATXN1; (-) strand; PAM type: YTN; PAM sequence: TTG
gctaaaggacttttggaatg

SEQ ID NO: 166056 - DNA, 20 bp, Artificial Sequence
  Description of Artificial Sequence: Synthetic oligonucleotide
  Target: ATXN1; (-) strand; PAM type: YTN; PAM sequence: CTA
agattggctaaaggactttt

SEQ ID NO: 166057 - DNA, 20 bp, Artificial Sequence
  Description of Artificial Sequence: Synthetic oligonucleotide
  Target: ATXN1; (-) strand; PAM type: YTN; PAM sequence: TTA
gaggaactaagattggctaa

SEQ ID NO: 166058 - DNA, 20 bp, Artificial Sequence
  Description of Artificial Sequence: Synthetic oligonucleotide
  Target: ATXN1; (-) strand; PAM type: YTN; PAM sequence: TTA
cgattagaggaactaagatt

SEQ ID NO: 166059 - DNA, 20 bp, Artificial Sequence
  Description of Artificial Sequence: Synthetic oligonucleotide
  Target: ATXN1; (-) strand; PAM type: YTN; PAM sequence: CTG
aatatgttacgattagagga

SEQ ID NO: 166060 - DNA, 20 bp, Artificial Sequence
  Description of Artificial Sequence: Synthetic oligonucleotide
  Target: ATXN1; (-) strand; PAM type: YTN; PAM sequence: CTC
actgaatatgttacgattag

SEQ ID NO: 166061 - DNA, 20 bp, Artificial Sequence
  Description of Artificial Sequence: Synthetic oligonucleotide
  Target: ATXN1; (-) strand; PAM type: YTN; PAM sequence: TTC
tcactgaatatgttacgatt

SEQ ID NO: 166062 - DNA, 20 bp, Artificial Sequence
  Description of Artificial Sequence: Synthetic oligonucleotide
  Target: ATXN1; (-) strand; PAM type: YTN; PAM sequence: TTT
ctcactgaatatgttacgat

SEQ ID NO: 166063 - DNA, 20 bp, Artificial Sequence
  Description of Artificial Sequence: Synthetic oligonucleotide
  Target: ATXN1; (-) strand; PAM type: YTN; PAM sequence: CTT
tctcactgaatatgttacga

SEQ ID NO: 166064 - DNA, 20 bp, Artificial Sequence
  Description of Artificial Sequence: Synthetic oligonucleotide
  Target: ATXN1; (-) strand; PAM type: YTN; PAM sequence: CTC
ctttctcactgaatatgtta

SEQ ID NO: 166065 - DNA, 20 bp, Artificial Sequence
  Description of Artificial Sequence: Synthetic oligonucleotide
  Target: ATXN1; (-) strand; PAM type: YTN; PAM sequence: TTA
taggatctcctttctcactg

SEQ ID NO: 166066 - DNA, 20 bp, Artificial Sequence
  Description of Artificial Sequence: Synthetic oligonucleotide
  Target: ATXN1; (-) strand; PAM type: YTN; PAM sequence: CTT
ataggatctcctttctcact

SEQ ID NO: 166067 - DNA, 20 bp, Artificial Sequence
  Description of Artificial Sequence: Synthetic oligonucleotide
  Target: ATXN1; (-) strand; PAM type: YTN; PAM sequence: CTG
accttataggatctcctttc

SEQ ID NO: 166068 - DNA, 20 bp, Artificial Sequence
  Description of Artificial Sequence: Synthetic oligonucleotide
  Target: ATXN1; (-) strand; PAM type: YTN; PAM sequence: TTG
cctgaccttataggatctcc

SEQ ID NO: 166069 - DNA, 20 bp, Artificial Sequence
  Description of Artificial Sequence: Synthetic oligonucleotide
  Target: ATXN1; (-) strand; PAM type: YTN; PAM sequence: TTT
gcctgaccttataggatctc

SEQ ID NO: 166070 - DNA, 20 bp, Artificial Sequence
  Description of Artificial Sequence: Synthetic oligonucleotide
  Target: ATXN1; (-) strand; PAM type: YTN; PAM sequence: CTA
acaacaatttgcctgacctt

SEQ ID NO: 166071 - DNA, 20 bp, Artificial Sequence
  Description of Artificial Sequence: Synthetic oligonucleotide
  Target: ATXN1; (-) strand; PAM type: YTN; PAM sequence: TTC
taacaacaatttgcctgacc

SEQ ID NO: 166072 - DNA, 20 bp, Artificial Sequence
  Description of Artificial Sequence: Synthetic oligonucleotide
  Target: ATXN1; (-) strand; PAM type: YTN; PAM sequence: TTT
ctaacaacaatttgcctgac

SEQ ID NO: 166073 - DNA, 20 bp, Artificial Sequence
  Description of Artificial Sequence: Synthetic oligonucleotide
  Target: ATXN1; (-) strand; PAM type: YTN; PAM sequence: CTG
gatcacatttctaacaacaa

SEQ ID NO: 166074 - DNA, 20 bp, Artificial Sequence
  Description of Artificial Sequence: Synthetic oligonucleotide
  Target: ATXN1; (-) strand; PAM type: YTN; PAM sequence: TTG
ctggatcacatttctaacaa

SEQ ID NO: 166075 - DNA, 20 bp, Artificial Sequence
  Description of Artificial Sequence: Synthetic oligonucleotide
  Target: ATXN1; (-) strand; PAM type: YTN; PAM sequence: CTA
aagttgctggatcacatttc

SEQ ID NO: 166076 - DNA, 20 bp, Artificial Sequence
  Description of Artificial Sequence: Synthetic oligonucleotide
  Target: ATXN1; (-) strand; PAM type: YTN; PAM sequence: TTC
aaacctaaagttgctggatc

SEQ ID NO: 166077 - DNA, 20 bp, Artificial Sequence
  Description of Artificial Sequence: Synthetic oligonucleotide
  Target: ATXN1; (-) strand; PAM type: YTN; PAM sequence: CTT
caaacctaaagttgctggat

SEQ ID NO: 166078 - DNA, 20 bp, Artificial Sequence
  Description of Artificial Sequence: Synthetic oligonucleotide
  Target: ATXN1; (-) strand; PAM type: YTN; PAM sequence: TTC
ttcaaacctaaagttgctgg

SEQ ID NO: 166079 - DNA, 20 bp, Artificial Sequence
  Description of Artificial Sequence: Synthetic oligonucleotide
  Target: ATXN1; (-) strand; PAM type: YTN; PAM sequence: TTT
cttcaaacctaaagttgctg

SEQ ID NO: 166080 - DNA, 20 bp, Artificial Sequence
  Description of Artificial Sequence: Synthetic oligonucleotide
  Target: ATXN1; (-) strand; PAM type: YTN; PAM sequence: CTG
gatttcttcaaacctaaagt

SEQ ID NO: 166081 - DNA, 20 bp, Artificial Sequence
  Description of Artificial Sequence: Synthetic oligonucleotide
  Target: ATXN1; (-) strand; PAM type: YTN; PAM sequence: CTC
cactggatttcttcaaacct

SEQ ID NO: 166082 - DNA, 20 bp, Artificial Sequence
  Description of Artificial Sequence: Synthetic oligonucleotide
  Target: ATXN1; (-) strand; PAM type: YTN; PAM sequence: TTC
tccactggatttcttcaaac

SEQ ID NO: 166083 - DNA, 20 bp, Artificial Sequence
  Description of Artificial Sequence: Synthetic oligonucleotide
  Target: ATXN1; (-) strand; PAM type: YTN; PAM sequence: TTT
ctccactggatttcttcaaa

SEQ ID NO: 166084 - DNA, 20 bp, Artificial Sequence
  Description of Artificial Sequence: Synthetic oligonucleotide
  Target: ATXN1; (-) strand; PAM type: YTN; PAM sequence: TTT
tctccactggatttcttcaa

SEQ ID NO: 166085 - DNA, 20 bp, Artificial Sequence
  Description of Artificial Sequence: Synthetic oligonucleotide
  Target: ATXN1; (-) strand; PAM type: YTN; PAM sequence: TTG
tgtgtgtgttttctccactg

SEQ ID NO: 166086 - DNA, 20 bp, Artificial Sequence
  Description of Artificial Sequence: Synthetic oligonucleotide
  Target: ATXN1; (-) strand; PAM type: YTN; PAM sequence: CTT
gtgtgtgtgttttctccact

SEQ ID NO: 166087 - DNA, 20 bp, Artificial Sequence
  Description of Artificial Sequence: Synthetic oligonucleotide
  Target: ATXN1; (-) strand; PAM type: YTN; PAM sequence: CTG
aatgtgaggtgtggacgtgg

SEQ ID NO: 166088 - DNA, 20 bp, Artificial Sequence
  Description of Artificial Sequence: Synthetic oligonucleotide
  Target: ATXN1; (-) strand; PAM type: YTN; PAM sequence: TTG
ggataatggagacagacagg

SEQ ID NO: 166089 - DNA, 20 bp, Artificial Sequence
  Description of Artificial Sequence: Synthetic oligonucleotide
  Target: ATXN1; (-) strand; PAM type: YTN; PAM sequence: CTG
aatacagggaaagaccccag

SEQ ID NO: 166090 - DNA, 20 bp, Artificial Sequence
  Description of Artificial Sequence: Synthetic oligonucleotide
  Target: ATXN1; (-) strand; PAM type: YTN; PAM sequence: TTC
ctgaatacagggaaagaccc

SEQ ID NO: 166091 - DNA, 20 bp, Artificial Sequence
  Description of Artificial Sequence: Synthetic oligonucleotide
  Target: ATXN1; (-) strand; PAM type: YTN; PAM sequence: CTT
cctgaatacagggaaagacc

SEQ ID NO: 166092 - DNA, 20 bp, Artificial Sequence
  Description of Artificial Sequence: Synthetic oligonucleotide
  Target: ATXN1; (-) strand; PAM type: YTN; PAM sequence: CTA
gaacccacttcctgaataca

SEQ ID NO: 166093 - DNA, 20 bp, Artificial Sequence
  Description of Artificial Sequence: Synthetic oligonucleotide
  Target: ATXN1; (-) strand; PAM type: YTN; PAM sequence: TTC
tagaacccacttcctgaata

SEQ ID NO: 166094 - DNA, 20 bp, Artificial Sequence
  Description of Artificial Sequence: Synthetic oligonucleotide
  Target: ATXN1; (-) strand; PAM type: YTN; PAM sequence: CTG
ttctagaacccacttcctga

SEQ ID NO: 166095 - DNA, 20 bp, Artificial Sequence
  Description of Artificial Sequence: Synthetic oligonucleotide
  Target: ATXN1; (-) strand; PAM type: YTN; PAM sequence: TTA
caaatggacagggctgttct

SEQ ID NO: 166096 - DNA, 20 bp, Artificial Sequence
  Description of Artificial Sequence: Synthetic oligonucleotide
  Target: ATXN1; (-) strand; PAM type: YTN; PAM sequence: CTT
acaaatggacagggctgttc

SEQ ID NO: 166097 - DNA, 20 bp, Artificial Sequence
  Description of Artificial Sequence: Synthetic oligonucleotide
  Target: ATXN1; (-) strand; PAM type: YTN; PAM sequence: TTC
cttacaaatggacagggctg

SEQ ID NO: 166098 - DNA, 20 bp, Artificial Sequence
  Description of Artificial Sequence: Synthetic oligonucleotide
  Target: ATXN1; (-) strand; PAM type: YTN; PAM sequence: TTA
ttccttacaaatggacaggg

SEQ ID NO: 166099 - DNA, 20 bp, Artificial Sequence
  Description of Artificial Sequence: Synthetic oligonucleotide
  Target: ATXN1; (-) strand; PAM type: YTN; PAM sequence: TTG
tgttattccttacaaatgga

SEQ ID NO: 166100 - DNA, 20 bp, Artificial Sequence
  Description of Artificial Sequence: Synthetic oligonucleotide
  Target: ATXN1; (-) strand; PAM type: YTN; PAM sequence: CTT
gtgttattccttacaaatgg

SEQ ID NO: 166101 - DNA, 20 bp, Artificial Sequence
  Description of Artificial Sequence: Synthetic oligonucleotide
  Target: ATXN1; (-) strand; PAM type: YTN; PAM sequence: TTA
ccttgtgttattccttacaa

SEQ ID NO: 166102 - DNA, 20 bp, Artificial Sequence
  Description of Artificial Sequence: Synthetic oligonucleotide
  Target: ATXN1; (-) strand; PAM type: YTN; PAM sequence: CTT
accttgtgttattccttaca

SEQ ID NO: 166103 - DNA, 20 bp, Artificial Sequence
  Description of Artificial Sequence: Synthetic oligonucleotide
  Target: ATXN1; (-) strand; PAM type: YTN; PAM sequence: TTC
aggcgtcttaccttgtgtta

SEQ ID NO: 166104 - DNA, 20 bp, Artificial Sequence
  Description of Artificial Sequence: Synthetic oligonucleotide
  Target: ATXN1; (-) strand; PAM type: YTN; PAM sequence: TTT
caggcgtcttaccttgtgtt

SEQ ID NO: 166105 - DNA, 20 bp, Artificial Sequence
  Description of Artificial Sequence: Synthetic oligonucleotide
  Target: ATXN1; (-) strand; PAM type: YTN; PAM sequence: CTA
gtttcaggcgtcttaccttg

SEQ ID NO: 166106 - DNA, 20 bp, Artificial Sequence
  Description of Artificial Sequence: Synthetic oligonucleotide
  Target: ATXN1; (-) strand; PAM type: YTN; PAM sequence: TTG
ctagtttcaggcgtcttacc

SEQ ID NO: 166107 - DNA, 20 bp, Artificial Sequence
  Description of Artificial Sequence: Synthetic oligonucleotide
  Target: ATXN1; (-) strand; PAM type: YTN; PAM sequence: CTT
gctagtttcaggcgtcttac

SEQ ID NO: 166108 - DNA, 20 bp, Artificial Sequence
  Description of Artificial Sequence: Synthetic oligonucleotide
  Target: ATXN1; (-) strand; PAM type: YTN; PAM sequence: CTC
acttgctagtttcaggcgtc

SEQ ID NO: 166109 - DNA, 20 bp, Artificial Sequence
  Description of Artificial Sequence: Synthetic oligonucleotide
  Target: ATXN1; (-) strand; PAM type: YTN; PAM sequence: TTC
tcacttgctagtttcaggcg

SEQ ID NO: 166110 - DNA, 20 bp, Artificial Sequence
  Description of Artificial Sequence: Synthetic oligonucleotide
  Target: ATXN1; (-) strand; PAM type: YTN; PAM sequence: TTT
ctcacttgctagtttcaggc

SEQ ID NO: 166111 - DNA, 20 bp, Artificial Sequence
  Description of Artificial Sequence: Synthetic oligonucleotide
  Target: ATXN1; (-) strand; PAM type: YTN; PAM sequence: CTT
tctcacttgctagtttcagg

SEQ ID NO: 166112 - DNA, 20 bp, Artificial Sequence
  Description of Artificial Sequence: Synthetic oligonucleotide
  Target: ATXN1; (-) strand; PAM type: YTN; PAM sequence: TTA
gaataagtaaagactttctc

SEQ ID NO: 166113 - DNA, 20 bp, Artificial Sequence
  Description of Artificial Sequence: Synthetic oligonucleotide
  Target: ATXN1; (-) strand; PAM type: YTN; PAM sequence: CTT
agaataagtaaagactttct

SEQ ID NO: 166114 - DNA, 20 bp, Artificial Sequence
  Description of Artificial Sequence: Synthetic oligonucleotide
  Target: ATXN1; (-) strand; PAM type: YTN; PAM sequence: TTA
cttagaataagtaaagactt

SEQ ID NO: 166115 - DNA, 20 bp, Artificial Sequence
  Description of Artificial Sequence: Synthetic oligonucleotide
  Target: ATXN1; (-) strand; PAM type: YTN; PAM sequence: TTT
acttagaataagtaaagact

SEQ ID NO: 166116 - DNA, 20 bp, Artificial Sequence
  Description of Artificial Sequence: Synthetic oligonucleotide
  Target: ATXN1; (-) strand; PAM type: YTN; PAM sequence: TTG
ggagtcatttacttagaata

SEQ ID NO: 166117 - DNA, 20 bp, Artificial Sequence
  Description of Artificial Sequence: Synthetic oligonucleotide
  Target: ATXN1; (-) strand; PAM type: YTN; PAM sequence: CTT
gggagtcatttacttagaat

SEQ ID NO: 166118 - DNA, 20 bp, Artificial Sequence
  Description of Artificial Sequence: Synthetic oligonucleotide
  Target: ATXN1; (-) strand; PAM type: YTN; PAM sequence: TTG
tccttgggagtcatttactt

SEQ ID NO: 166119 - DNA, 20 bp, Artificial Sequence
  Description of Artificial Sequence: Synthetic oligonucleotide
  Target: ATXN1; (-) strand; PAM type: YTN; PAM sequence: CTT
gtccttgggagtcatttact

SEQ ID NO: 166120 - DNA, 20 bp, Artificial Sequence
  Description of Artificial Sequence: Synthetic oligonucleotide
  Target: ATXN1; (-) strand; PAM type: YTN; PAM sequence: CTA
catcttgtccttgggagtca

SEQ ID NO: 166121 - DNA, 20 bp, Artificial Sequence
  Description of Artificial Sequence: Synthetic oligonucleotide
  Target: ATXN1; (-) strand; PAM type: YTN; PAM sequence: CTG
cgagctacatcttgtccttg

SEQ ID NO: 166122 - DNA, 20 bp, Artificial Sequence
  Description of Artificial Sequence: Synthetic oligonucleotide
  Target: ATXN1; (-) strand; PAM type: YTN; PAM sequence: CTG
aagaagctgcgagctacatc

SEQ ID NO: 166123 - DNA, 20 bp, Artificial Sequence
  Description of Artificial Sequence: Synthetic oligonucleotide
  Target: ATXN1; (-) strand; PAM type: YTN; PAM sequence: TTA
aatgtatgtcgtaaatgtgc

SEQ ID NO: 166124 - DNA, 20 bp, Artificial Sequence
  Description of Artificial Sequence: Synthetic oligonucleotide
  Target: ATXN1; (-) strand; PAM type: YTN; PAM sequence: CTA
aaataaattaaatgtatgtc

SEQ ID NO: 166125 - DNA, 20 bp, Artificial Sequence
  Description of Artificial Sequence: Synthetic oligonucleotide
  Target: ATXN1; (-) strand; PAM type: YTN; PAM sequence: TTA
gctaaaataaattaaatgta

SEQ ID NO: 166126 - DNA, 20 bp, Artificial Sequence
  Description of Artificial Sequence: Synthetic oligonucleotide
  Target: ATXN1; (-) strand; PAM type: YTN; PAM sequence: TTC
attagctaaaataaattaaa

SEQ ID NO: 166127 - DNA, 20 bp, Artificial Sequence
  Description of Artificial Sequence: Synthetic oligonucleotide
  Target: ATXN1; (-) strand; PAM type: YTN; PAM sequence: TTT
cattagctaaaataaattaa

SEQ ID NO: 166128 - DNA, 20 bp, Artificial Sequence
  Description of Artificial Sequence: Synthetic oligonucleotide
  Target: ATXN1; (-) strand; PAM type: YTN; PAM sequence: TTT
tcattagctaaaataaatta

SEQ ID NO: 166129 - DNA, 20 bp, Artificial Sequence
  Description of Artificial Sequence: Synthetic oligonucleotide
  Target: ATXN1; (-) strand; PAM type: YTN; PAM sequence: TTG
agcattttcattagctaaaa

SEQ ID NO: 166130 - DNA, 20 bp, Artificial Sequence
  Description of Artificial Sequence: Synthetic oligonucleotide
  Target: ATXN1; (-) strand; PAM type: YTN; PAM sequence: CTA
ttgagcattttcattagcta

SEQ ID NO: 166131 - DNA, 20 bp, Artificial Sequence
  Description of Artificial Sequence: Synthetic oligonucleotide
  Target: ATXN1; (-) strand; PAM type: YTN; PAM sequence: TTC
actattgagcattttcatta

SEQ ID NO: 166132 - DNA, 20 bp, Artificial Sequence
  Description of Artificial Sequence: Synthetic oligonucleotide
  Target: ATXN1; (-) strand; PAM type: YTN; PAM sequence: CTC
agacatattcactattgagc

SEQ ID NO: 166133 - DNA, 20 bp, Artificial Sequence
  Description of Artificial Sequence: Synthetic oligonucleotide
  Target: ATXN1; (-) strand; PAM type: YTN; PAM sequence: CTC
cataggggctcagacatatt

SEQ ID NO: 166134 - DNA, 20 bp, Artificial Sequence
  Description of Artificial Sequence: Synthetic oligonucleotide
  Target: ATXN1; (-) strand; PAM type: YTN; PAM sequence: TTC
tccataggggctcagacata

SEQ ID NO: 166135 - DNA, 20 bp, Artificial Sequence
  Description of Artificial Sequence: Synthetic oligonucleotide
  Target: ATXN1; (-) strand; PAM type: YTN; PAM sequence: TTA
ttctccataggggctcagac

SEQ ID NO: 166136 - DNA, 20 bp, Artificial Sequence
  Description of Artificial Sequence: Synthetic oligonucleotide
  Target: ATXN1; (-) strand; PAM type: YTN; PAM sequence: CTT
attctccataggggctcaga

SEQ ID NO: 166137 - DNA, 20 bp, Artificial Sequence
  Description of Artificial Sequence: Synthetic oligonucleotide
  Target: ATXN1; (-) strand; PAM type: YTN; PAM sequence: CTA
cttattctccataggggctc

SEQ ID NO: 166138 - DNA, 20 bp, Artificial Sequence
  Description of Artificial Sequence: Synthetic oligonucleotide
  Target: ATXN1; (-) strand; PAM type: YTN; PAM sequence: TTG
cactacttattctccatagg

SEQ ID NO: 166139 - DNA, 20 bp, Artificial Sequence
  Description of Artificial Sequence: Synthetic oligonucleotide
  Target: ATXN1; (-) strand; PAM type: YTN; PAM sequence: TTG
ggtattgcactacttattct

SEQ ID NO: 166140 - DNA, 20 bp, Artificial Sequence
  Description of Artificial Sequence: Synthetic oligonucleotide
  Target: ATXN1; (-) strand; PAM type: YTN; PAM sequence: TTT
gggtattgcactacttattc

SEQ ID NO: 166141 - DNA, 20 bp, Artificial Sequence
  Description of Artificial Sequence: Synthetic oligonucleotide
  Target: ATXN1; (-) strand; PAM type: YTN; PAM sequence: CTT
tgggtattgcactacttatt

SEQ ID NO: 166142 - DNA, 20 bp, Artificial Sequence
  Description of Artificial Sequence: Synthetic oligonucleotide
  Target: ATXN1; (-) strand; PAM type: YTN; PAM sequence: TTA
aatgtctttgggtattgcac

SEQ ID NO: 166143 - DNA, 20 bp, Artificial Sequence
  Description of Artificial Sequence: Synthetic oligonucleotide
  Target: ATXN1; (-) strand; PAM type: YTN; PAM sequence: CTC
agagacagttaaatgtcttt

SEQ ID NO: 166144 - DNA, 20 bp, Artificial Sequence
  Description of Artificial Sequence: Synthetic oligonucleotide
  Target: ATXN1; (-) strand; PAM type: YTN; PAM sequence: CTC
tcagagacagttaaatgtct

SEQ ID NO: 166145 - DNA, 20 bp, Artificial Sequence
  Description of Artificial Sequence: Synthetic oligonucleotide
  Target: ATXN1; (-) strand; PAM type: YTN; PAM sequence: TTG
cctctcagagacagttaaat

SEQ ID NO: 166146 - DNA, 20 bp, Artificial Sequence
  Description of Artificial Sequence: Synthetic oligonucleotide
  Target: ATXN1; (-) strand; PAM type: YTN; PAM sequence: CTT
gcctctcagagacagttaaa

SEQ ID NO: 166147 - DNA, 20 bp, Artificial Sequence
  Description of Artificial Sequence: Synthetic oligonucleotide
  Target: ATXN1; (-) strand; PAM type: YTN; PAM sequence: TTC
ttgcctctcagagacagtta

SEQ ID NO: 166148 - DNA, 20 bp, Artificial Sequence
  Description of Artificial Sequence: Synthetic oligonucleotide
  Target: ATXN1; (-) strand; PAM type: YTN; PAM sequence: CTT
cttgcctctcagagacagtt

SEQ ID NO: 166149 - DNA, 20 bp, Artificial Sequence
  Description of Artificial Sequence: Synthetic oligonucleotide
  Target: ATXN1; (-) strand; PAM type: YTN; PAM sequence: TTC
ttcttgcctctcagagacag

SEQ ID NO: 166150 - DNA, 20 bp, Artificial Sequence
  Description of Artificial Sequence: Synthetic oligonucleotide
  Target: ATXN1; (-) strand; PAM type: YTN; PAM sequence: CTA
acacagattcttcttgcctc

SEQ ID NO: 166151 - DNA, 20 bp, Artificial Sequence
  Description of Artificial Sequence: Synthetic oligonucleotide
  Target: ATXN1; (-) strand; PAM type: YTN; PAM sequence: CTA
tatatagagccacaccccta

SEQ ID NO: 166152 - DNA, 20 bp, Artificial Sequence
  Description of Artificial Sequence: Synthetic oligonucleotide
  Target: ATXN1; (-) strand; PAM type: YTN; PAM sequence: CTC
tatatatagagccacacccc

SEQ ID NO: 166153 - DNA, 20 bp, Artificial Sequence
  Description of Artificial Sequence: Synthetic oligonucleotide
  Target: ATXN1; (-) strand; PAM type: YTN; PAM sequence: TTA
atgtctctatatatagagcc

SEQ ID NO: 166154 - DNA, 20 bp, Artificial Sequence
  Description of Artificial Sequence: Synthetic oligonucleotide
  Target: ATXN1; (-) strand; PAM type: YTN; PAM sequence: TTT
aatgtctctatatatagagc

SEQ ID NO: 166155 - DNA, 20 bp, Artificial Sequence
  Description of Artificial Sequence: Synthetic oligonucleotide
  Target: ATXN1; (-) strand; PAM type: YTN; PAM sequence: CTA
tgaatttaatgtctctatat

SEQ ID NO: 166156 - DNA, 20 bp, Artificial Sequence
  Description of Artificial Sequence: Synthetic oligonucleotide
  Target: ATXN1; (-) strand; PAM type: YTN; PAM sequence: TTG
gctatgaatttaatgtctct

SEQ ID NO: 166157 - DNA, 20 bp, Artificial Sequence
  Description of Artificial Sequence: Synthetic oligonucleotide
  Target: ATXN1; (-) strand; PAM type: YTN; PAM sequence: TTT
ggctatgaatttaatgtctc

SEQ ID NO: 166158 - DNA, 20 bp, Artificial Sequence
  Description of Artificial Sequence: Synthetic oligonucleotide
  Target: ATXN1; (-) strand; PAM type: YTN; PAM sequence: TTT
tggctatgaatttaatgtct

SEQ ID NO: 166159 - DNA, 20 bp, Artificial Sequence
  Description of Artificial Sequence: Synthetic oligonucleotide
  Target: ATXN1; (-) strand; PAM type: YTN; PAM sequence: CTT
ttggctatgaatttaatgtc

SEQ ID NO: 166160 - DNA, 20 bp, Artificial Sequence
  Description of Artificial Sequence: Synthetic oligonucleotide
  Target: ATXN1; (-) strand; PAM type: YTN; PAM sequence: TTA
cccttttggctatgaattta

SEQ ID NO: 166161 - DNA, 20 bp, Artificial Sequence
  Description of Artificial Sequence: Synthetic oligonucleotide
  Target: ATXN1; (-) strand; PAM type: YTN; PAM sequence: CTA
ttacccttttggctatgaat

SEQ ID NO: 166162 - DNA, 20 bp, Artificial Sequence
  Description of Artificial Sequence: Synthetic oligonucleotide
  Target: ATXN1; (-) strand; PAM type: YTN; PAM sequence: TTG
taataatcactattaccctt

SEQ ID NO: 166163 - DNA, 20 bp, Artificial Sequence
  Description of Artificial Sequence: Synthetic oligonucleotide
  Target: ATXN1; (-) strand; PAM type: YTN; PAM sequence: TTT
gtaataatcactattaccct

SEQ ID NO: 166164 - DNA, 20 bp, Artificial Sequence
  Description of Artificial Sequence: Synthetic oligonucleotide
  Target: ATXN1; (-) strand; PAM type: YTN; PAM sequence: TTT
tgtaataatcactattaccc

SEQ ID NO: 166165 - DNA, 20 bp, Artificial Sequence
  Description of Artificial Sequence: Synthetic oligonucleotide
  Target: ATXN1; (-) strand; PAM type: YTN; PAM sequence: CTG
aattttgtaataatcactat

SEQ ID NO: 166166 - DNA, 20 bp, Artificial Sequence
  Description of Artificial Sequence: Synthetic oligonucleotide
  Target: ATXN1; (-) strand; PAM type: YTN; PAM sequence: TTA
cccctgaattttgtaataat

SEQ ID NO: 166167 - DNA, 20 bp, Artificial Sequence
  Description of Artificial Sequence: Synthetic oligonucleotide
  Target: ATXN1; (-) strand; PAM type: YTN; PAM sequence: TTG
ttacccctgaattttgtaat

SEQ ID NO: 166168 - DNA, 20 bp, Artificial Sequence
  Description of Artificial Sequence: Synthetic oligonucleotide
  Target: ATXN1; (-) strand; PAM type: YTN; PAM sequence: CTT
gttacccctgaattttgtaa

SEQ ID NO: 166169 - DNA, 20 bp, Artificial Sequence
  Description of Artificial Sequence: Synthetic oligonucleotide
  Target: ATXN1; (-) strand; PAM type: YTN; PAM sequence: TTC
acccttgttacccctgaatt

SEQ ID NO: 166170 - DNA, 20 bp, Artificial Sequence
  Description of Artificial Sequence: Synthetic oligonucleotide
  Target: ATXN1; (-) strand; PAM type: YTN; PAM sequence: TTT
cacccttgttacccctgaat

SEQ ID NO: 166171 - DNA, 20 bp, Artificial Sequence
  Description of Artificial Sequence: Synthetic oligonucleotide
  Target: ATXN1; (-) strand; PAM type: YTN; PAM sequence: CTT
tcacccttgttacccctgaa

SEQ ID NO: 166172 - DNA, 20 bp, Artificial Sequence
  Description of Artificial Sequence: Synthetic oligonucleotide
  Target: ATXN1; (-) strand; PAM type: YTN; PAM sequence: CTC
tttcacccttgttacccctg

SEQ ID NO: 166173 - DNA, 20 bp, Artificial Sequence
  Description of Artificial Sequence: Synthetic oligonucleotide
  Target: ATXN1; (-) strand; PAM type: YTN; PAM sequence: TTC
tctttcacccttgttacccc

SEQ ID NO: 166174 - DNA, 20 bp, Artificial Sequence
  Description of Artificial Sequence: Synthetic oligonucleotide
  Target: ATXN1; (-) strand; PAM type: YTN; PAM sequence: TTT
ctctttcacccttgttaccc

SEQ ID NO: 166175 - DNA, 20 bp, Artificial Sequence
  Description of Artificial Sequence: Synthetic oligonucleotide
  Target: ATXN1; (-) strand; PAM type: YTN; PAM sequence: TTT
tctctttcacccttgttacc

SEQ ID NO: 166176 - DNA, 20 bp, Artificial Sequence
  Description of Artificial Sequence: Synthetic oligonucleotide
  Target: ATXN1; (-) strand; PAM type: YTN; PAM sequence: CTT
ttctctttcacccttgttac

SEQ ID NO: 166177 - DNA, 20 bp, Artificial Sequence
  Description of Artificial Sequence: Synthetic oligonucleotide
  Target: ATXN1; (-) strand; PAM type: YTN; PAM sequence: CTC
ttttctctttcacccttgtt

SEQ ID NO: 166178 - DNA, 20 bp, Artificial Sequence
  Description of Artificial Sequence: Synthetic oligonucleotide
  Target: ATXN1; (-) strand; PAM type: YTN; PAM sequence: CTC
tcttttctctttcacccttg

SEQ ID NO: 166179 - DNA, 20 bp, Artificial Sequence
  Description of Artificial Sequence: Synthetic oligonucleotide
  Target: ATXN1; (-) strand; PAM type: YTN; PAM sequence: CTC
atccctctcttttctctttc

SEQ ID NO: 166180 - DNA, 20 bp, Artificial Sequence
  Description of Artificial Sequence: Synthetic oligonucleotide
  Target: ATXN1; (-) strand; PAM type: YTN; PAM sequence: CTC
tcatccctctcttttctctt

SEQ ID NO: 166181 - DNA, 20 bp, Artificial Sequence
  Description of Artificial Sequence: Synthetic oligonucleotide
  Target: ATXN1; (-) strand; PAM type: YTN; PAM sequence: TTC
tctcatccctctcttttctc

SEQ ID NO: 166182 - DNA, 20 bp, Artificial Sequence
  Description of Artificial Sequence: Synthetic oligonucleotide
  Target: ATXN1; (-) strand; PAM type: YTN; PAM sequence: TTA
cgttctctcatccctctctt

SEQ ID NO: 166183 - DNA, 20 bp, Artificial Sequence
  Description of Artificial Sequence: Synthetic oligonucleotide
  Target: ATXN1; (-) strand; PAM type: YTN; PAM sequence: TTC
agaaacagaatgtgaaggaa

SEQ ID NO: 166184 - DNA, 20 bp, Artificial Sequence
  Description of Artificial Sequence: Synthetic oligonucleotide
  Target: ATXN1; (-) strand; PAM type: YTN; PAM sequence: TTT
cagaaacagaatgtgaagga

SEQ ID NO: 166185 - DNA, 20 bp, Artificial Sequence
  Description of Artificial Sequence: Synthetic oligonucleotide
  Target: ATXN1; (-) strand; PAM type: YTN; PAM sequence: CTG
tttcagaaacagaatgtgaa

SEQ ID NO: 166186 - DNA, 20 bp, Artificial Sequence
  Description of Artificial Sequence: Synthetic oligonucleotide
  Target: ATXN1; (-) strand; PAM type: YTN; PAM sequence: TTG
aatcctgtttcagaaacaga

SEQ ID NO: 166187 - DNA, 20 bp, Artificial Sequence
  Description of Artificial Sequence: Synthetic oligonucleotide
  Target: ATXN1; (-) strand; PAM type: YTN; PAM sequence: CTT
gaatcctgtttcagaaacag

SEQ ID NO: 166188 - DNA, 20 bp, Artificial Sequence
  Description of Artificial Sequence: Synthetic oligonucleotide
  Target: ATXN1; (-) strand; PAM type: YTN; PAM sequence: CTG
cttgaatcctgtttcagaaa

SEQ ID NO: 166189 - DNA, 20 bp, Artificial Sequence
  Description of Artificial Sequence: Synthetic oligonucleotide
  Target: ATXN1; (-) strand; PAM type: YTN; PAM sequence: TTA
gccatgtgcgtgaacgaaaa

SEQ ID NO: 166190 - DNA, 20 bp, Artificial Sequence
  Description of Artificial Sequence: Synthetic oligonucleotide
  Target: ATXN1; (-) strand; PAM type: YTN; PAM sequence: CTG
tagaaataattagccatgtg

SEQ ID NO: 166191 - DNA, 20 bp, Artificial Sequence
  Description of Artificial Sequence: Synthetic oligonucleotide
  Target: ATXN1; (-) strand; PAM type: YTN; PAM sequence: CTG
aatgctgtagaaataattag

SEQ ID NO: 166192 - DNA, 20 bp, Artificial Sequence
  Description of Artificial Sequence: Synthetic oligonucleotide
  Target: ATXN1; (-) strand; PAM type: YTN; PAM sequence: TTA
aagagatctgaatgctgtag

SEQ ID NO: 166193 - DNA, 20 bp, Artificial Sequence
  Description of Artificial Sequence: Synthetic oligonucleotide
  Target: ATXN1; (-) strand; PAM type: YTN; PAM sequence: TTT
aaagagatctgaatgctgta

SEQ ID NO: 166194 - DNA, 20 bp, Artificial Sequence
  Description of Artificial Sequence: Synthetic oligonucleotide
  Target: ATXN1; (-) strand; PAM type: YTN; PAM sequence: TTT
taaagagatctgaatgctgt

SEQ ID NO: 166195 - DNA, 20 bp, Artificial Sequence
  Description of Artificial Sequence: Synthetic oligonucleotide
  Target: ATXN1; (-) strand; PAM type: YTN; PAM sequence: TTG
ttttaaagagatctgaatgc

SEQ ID NO: 166196 - DNA, 20 bp, Artificial Sequence
  Description of Artificial Sequence: Synthetic oligonucleotide
  Target: ATXN1; (-) strand; PAM type: YTN; PAM sequence: TTT
gttttaaagagatctgaatg

SEQ ID NO: 166197 - DNA, 20 bp, Artificial Sequence
  Description of Artificial Sequence: Synthetic oligonucleotide
  Target: ATXN1; (-) strand; PAM type: YTN; PAM sequence: TTA
aaggtgggcgtgtatgtgca

SEQ ID NO: 166198 - DNA, 20 bp, Artificial Sequence
  Description of Artificial Sequence: Synthetic oligonucleotide
  Target: ATXN1; (-) strand; PAM type: YTN; PAM sequence: TTT
aaaggtgggcgtgtatgtgc

SEQ ID NO: 166199 - DNA, 20 bp, Artificial Sequence
  Description of Artificial Sequence: Synthetic oligonucleotide
  Target: ATXN1; (-) strand; PAM type: YTN; PAM sequence: TTT
taaaggtgggcgtgtatgtg

SEQ ID NO: 166200 - DNA, 20 bp, Artificial Sequence
  Description of Artificial Sequence: Synthetic oligonucleotide
  Target: ATXN1; (-) strand; PAM type: YTN; PAM sequence: TTT
ttaaaggtgggcgtgtatgt

SEQ ID NO: 166201 - DNA, 20 bp, Artificial Sequence
  Description of Artificial Sequence: Synthetic oligonucleotide
  Target: ATXN1; (-) strand; PAM type: YTN; PAM sequence: CTG
tggaaaaggggataaaaggc

SEQ ID NO: 166202 - DNA, 20 bp, Artificial Sequence
  Description of Artificial Sequence: Synthetic oligonucleotide
  Target: ATXN1; (-) strand; PAM type: YTN; PAM sequence: CTC
aaggctgtggaaaaggggat

SEQ ID NO: 166203 - DNA, 20 bp, Artificial Sequence
  Description of Artificial Sequence: Synthetic oligonucleotide
  Target: ATXN1; (-) strand; PAM type: YTN; PAM sequence: TTC
ctcaaggctgtggaaaaggg

SEQ ID NO: 166204 - DNA, 20 bp, Artificial Sequence
  Description of Artificial Sequence: Synthetic oligonucleotide
  Target: ATXN1; (-) strand; PAM type: YTN; PAM sequence: TTT
cctcaaggctgtggaaaagg

SEQ ID NO: 166205 - DNA, 20 bp, Artificial Sequence
  Description of Artificial Sequence: Synthetic oligonucleotide
  Target: ATXN1; (-) strand; PAM type: YTN; PAM sequence: CTG
agacaatccatcagatattt

SEQ ID NO: 166206 - DNA, 20 bp, Artificial Sequence
  Description of Artificial Sequence: Synthetic oligonucleotide
  Target: ATXN1; (-) strand; PAM type: YTN; PAM sequence: CTC
ctgagacaatccatcagata

SEQ ID NO: 166207 - DNA, 20 bp, Artificial Sequence
  Description of Artificial Sequence: Synthetic oligonucleotide
  Target: ATXN1; (-) strand; PAM type: YTN; PAM sequence: CTG
ctcctgagacaatccatcag

SEQ ID NO: 166208 - DNA, 20 bp, Artificial Sequence
  Description of Artificial Sequence: Synthetic oligonucleotide
  Target: ATXN1; (-) strand; PAM type: YTN; PAM sequence: TTC
ccaaaacactgctcctgaga

SEQ ID NO: 166209 - DNA, 20 bp, Artificial Sequence
  Description of Artificial Sequence: Synthetic oligonucleotide
  Target: ATXN1; (-) strand; PAM type: YTN; PAM sequence: TTA
ttcccaaaacactgctcctg

SEQ ID NO: 166210 - DNA, 20 bp, Artificial Sequence
  Description of Artificial Sequence: Synthetic oligonucleotide
  Target: ATXN1; (-) strand; PAM type: YTN; PAM sequence: TTT
attcccaaaacactgctcct

SEQ ID NO: 166211 - DNA, 20 bp, Artificial Sequence
  Description of Artificial Sequence: Synthetic oligonucleotide
  Target: ATXN1; (-) strand; PAM type: YTN; PAM sequence: CTA
catttattcccaaaacactg

SEQ ID NO: 166212 - DNA, 20 bp, Artificial Sequence
  Description of Artificial Sequence: Synthetic oligonucleotide
  Target: ATXN1; (-) strand; PAM type: YTN; PAM sequence: TTA
gcatataatctacatttatt

SEQ ID NO: 166213 - DNA, 20 bp, Artificial Sequence
  Description of Artificial Sequence: Synthetic oligonucleotide
  Target: ATXN1; (-) strand; PAM type: YTN; PAM sequence: TTT
agcatataatctacatttat

SEQ ID NO: 166214 - DNA, 20 bp, Artificial Sequence
  Description of Artificial Sequence: Synthetic oligonucleotide
  Target: ATXN1; (-) strand; PAM type: YTN; PAM sequence: TTT
tagcatataatctacattta

SEQ ID NO: 166215 - DNA, 20 bp, Artificial Sequence
  Description of Artificial Sequence: Synthetic oligonucleotide
  Target: ATXN1; (-) strand; PAM type: YTN; PAM sequence: TTT
ttagcatataatctacattt

SEQ ID NO: 166216 - DNA, 20 bp, Artificial Sequence
  Description of Artificial Sequence: Synthetic oligonucleotide
  Target: ATXN1; (-) strand; PAM type: YTN; PAM sequence: TTT
tttagcatataatctacatt

SEQ ID NO: 166217 - DNA, 20 bp, Artificial Sequence
  Description of Artificial Sequence: Synthetic oligonucleotide
  Target: ATXN1; (-) strand; PAM type: YTN; PAM sequence: TTT
ttttagcatataatctacat

SEQ ID NO: 166218 - DNA, 20 bp, Artificial Sequence
  Description of Artificial Sequence: Synthetic oligonucleotide
  Target: ATXN1; (-) strand; PAM type: YTN; PAM sequence: TTA
cgtttttttagcatataatc

SEQ ID NO: 166219 - DNA, 20 bp, Artificial Sequence
  Description of Artificial Sequence: Synthetic oligonucleotide
  Target: ATXN1; (-) strand; PAM type: YTN; PAM sequence: TTA
ggggacaagttacgtttttt

SEQ ID NO: 166220 - DNA, 20 bp, Artificial Sequence
  Description of Artificial Sequence: Synthetic oligonucleotide
  Target: ATXN1; (-) strand; PAM type: YTN; PAM sequence: TTT
aggggacaagttacgttttt

SEQ ID NO: 166221 - DNA, 20 bp, Artificial Sequence
  Description of Artificial Sequence: Synthetic oligonucleotide
  Target: ATXN1; (-) strand; PAM type: YTN; PAM sequence: TTT
taggggacaagttacgtttt

SEQ ID NO: 166222 - DNA, 20 bp, Artificial Sequence
  Description of Artificial Sequence: Synthetic oligonucleotide
  Target: ATXN1; (-) strand; PAM type: YTN; PAM sequence: TTA
tgcaagttttaggggacaag

SEQ ID NO: 166223 - DNA, 20 bp, Artificial Sequence
  Description of Artificial Sequence: Synthetic oligonucleotide
  Target: ATXN1; (-) strand; PAM type: YTN; PAM sequence: TTT
atgcaagttttaggggacaa

SEQ ID NO: 166224 - DNA, 20 bp, Artificial Sequence
  Description of Artificial Sequence: Synthetic oligonucleotide
  Target: ATXN1; (-) strand; PAM type: YTN; PAM sequence: TTG
tttatgcaagttttagggga

SEQ ID NO: 166225 - DNA, 20 bp, Artificial Sequence
  Description of Artificial Sequence: Synthetic oligonucleotide
  Target: ATXN1; (-) strand; PAM type: YTN; PAM sequence: TTT
gtttatgcaagttttagggg

SEQ ID NO: 166226 - DNA, 20 bp, Artificial Sequence
  Description of Artificial Sequence: Synthetic oligonucleotide
  Target: ATXN1; (-) strand; PAM type: YTN; PAM sequence: TTG
atttgtttatgcaagtttta

SEQ ID NO: 166227 - DNA, 20 bp, Artificial Sequence
  Description of Artificial Sequence: Synthetic oligonucleotide
  Target: ATXN1; (-) strand; PAM type: YTN; PAM sequence: TTT
gatttgtttatgcaagtttt

SEQ ID NO: 166228 - DNA, 20 bp, Artificial Sequence
  Description of Artificial Sequence: Synthetic oligonucleotide
  Target: ATXN1; (-) strand; PAM type: YTN; PAM sequence: CTT
tgatttgtttatgcaagttt

SEQ ID NO: 166229 - DNA, 20 bp, Artificial Sequence
  Description of Artificial Sequence: Synthetic oligonucleotide
  Target: ATXN1; (-) strand; PAM type: YTN; PAM sequence: CTA
caatgtcctttgatttgttt

SEQ ID NO: 166230 - DNA, 20 bp, Artificial Sequence
  Description of Artificial Sequence: Synthetic oligonucleotide
  Target: ATXN1; (-) strand; PAM type: YTN; PAM sequence: CTC
gaaatgctacaatgtccttt

SEQ ID NO: 166231 - DNA, 20 bp, Artificial Sequence
  Description of Artificial Sequence: Synthetic oligonucleotide
  Target: ATXN1; (-) strand; PAM type: YTN; PAM sequence: TTA
tactcgaaatgctacaatgt

SEQ ID NO: 166232 - DNA, 20 bp, Artificial Sequence
  Description of Artificial Sequence: Synthetic oligonucleotide
  Target: ATXN1; (-) strand; PAM type: YTN; PAM sequence: TTT
atactcgaaatgctacaatg

SEQ ID NO: 166233 - DNA, 20 bp, Artificial Sequence
  Description of Artificial Sequence: Synthetic oligonucleotide
  Target: ATXN1; (-) strand; PAM type: YTN; PAM sequence: TTG
tttatactcgaaatgctaca

SEQ ID NO: 166234 - DNA, 20 bp, Artificial Sequence
  Description of Artificial Sequence: Synthetic oligonucleotide
  Target: ATXN1; (-) strand; PAM type: YTN; PAM sequence: TTT
gtttatactcgaaatgctac

SEQ ID NO: 166235 - DNA, 20 bp, Artificial Sequence
  Description of Artificial Sequence: Synthetic oligonucleotide
  Target: ATXN1; (-) strand; PAM type: YTN; PAM sequence: TTT
tgtttatactcgaaatgcta

SEQ ID NO: 166236 - DNA, 20 bp, Artificial Sequence
  Description of Artificial Sequence: Synthetic oligonucleotide
  Target: ATXN1; (-) strand; PAM type: YTN; PAM sequence: TTG
agagtcattttgtttatact

SEQ ID NO: 166237 - DNA, 20 bp, Artificial Sequence
  Description of Artificial Sequence: Synthetic oligonucleotide
  Target: ATXN1; (-) strand; PAM type: YTN; PAM sequence: TTA
agttgagagtcattttgttt

SEQ ID NO: 166238 - DNA, 20 bp, Artificial Sequence
  Description of Artificial Sequence: Synthetic oligonucleotide
  Target: ATXN1; (-) strand; PAM type: YTN; PAM sequence: CTG
caagttaagttgagagtcat

SEQ ID NO: 166239 - DNA, 20 bp, Artificial Sequence
  Description of Artificial Sequence: Synthetic oligonucleotide
  Target: ATXN1; (-) strand; PAM type: YTN; PAM sequence: TTA
aaaaaagatctgcaagttaa

SEQ ID NO: 166240 - DNA, 20 bp, Artificial Sequence
  Description of Artificial Sequence: Synthetic oligonucleotide
  Target: ATXN1; (-) strand; PAM type: YTN; PAM sequence: CTG
aacattaaaaaaagatctgc

SEQ ID NO: 166241 - DNA, 20 bp, Artificial Sequence
  Description of Artificial Sequence: Synthetic oligonucleotide
  Target: ATXN1; (-) strand; PAM type: YTN; PAM sequence: TTA
ctgaacattaaaaaaagatc

SEQ ID NO: 166242 - DNA, 20 bp, Artificial Sequence
  Description of Artificial Sequence: Synthetic oligonucleotide
  Target: ATXN1; (-) strand; PAM type: YTN; PAM sequence: TTA
ttactgaacattaaaaaaag

SEQ ID NO: 166243 - DNA, 20 bp, Artificial Sequence
  Description of Artificial Sequence: Synthetic oligonucleotide
  Target: ATXN1; (-) strand; PAM type: YTN; PAM sequence: TTT
attactgaacattaaaaaaa

SEQ ID NO: 166244 - DNA, 20 bp, Artificial Sequence
  Description of Artificial Sequence: Synthetic oligonucleotide
  Target: ATXN1; (-) strand; PAM type: YTN; PAM sequence: CTG
ggagtaaaatttattactga

SEQ ID NO: 166245 - DNA, 20 bp, Artificial Sequence
  Description of Artificial Sequence: Synthetic oligonucleotide
  Target: ATXN1; (-) strand; PAM type: YTN; PAM sequence: TTC
tgggagtaaaatttattact

SEQ ID NO: 166246 - DNA, 20 bp, Artificial Sequence
  Description of Artificial Sequence: Synthetic oligonucleotide
  Target: ATXN1; (-) strand; PAM type: YTN; PAM sequence: CTT
ctgggagtaaaatttattac

SEQ ID NO: 166247 - DNA, 20 bp, Artificial Sequence
  Description of Artificial Sequence: Synthetic oligonucleotide
  Target: ATXN1; (-) strand; PAM type: YTN; PAM sequence: TTG
ggaagagagaggacagtgta

SEQ ID NO: 166248 - DNA, 20 bp, Artificial Sequence
  Description of Artificial Sequence: Synthetic oligonucleotide
  Target: ATXN1; (-) strand; PAM type: YTN; PAM sequence: TTT
gggaagagagaggacagtgt

SEQ ID NO: 166249 - DNA, 20 bp, Artificial Sequence
  Description of Artificial Sequence: Synthetic oligonucleotide
  Target: ATXN1; (-) strand; PAM type: YTN; PAM sequence: TTG
taggaggaggagaagtttgg

SEQ ID NO: 166250 - DNA, 20 bp, Artificial Sequence
  Description of Artificial Sequence: Synthetic oligonucleotide
  Target: ATXN1; (-) strand; PAM type: YTN; PAM sequence: CTG
ggggattgtaggaggaggag

SEQ ID NO: 166251 - DNA, 20 bp, Artificial Sequence
  Description of Artificial Sequence: Synthetic oligonucleotide
  Target: ATXN1; (-) strand; PAM type: YTN; PAM sequence: TTA
aaacaactgggggattgtag

SEQ ID NO: 166252 - DNA, 20 bp, Artificial Sequence
  Description of Artificial Sequence: Synthetic oligonucleotide
  Target: ATXN1; (-) strand; PAM type: YTN; PAM sequence: CTG
acattaaaacaactggggga

SEQ ID NO: 166253 - DNA, 20 bp, Artificial Sequence
  Description of Artificial Sequence: Synthetic oligonucleotide
  Target: ATXN1; (-) strand; PAM type: YTN; PAM sequence: TTA
tgcatctgacattaaaacaa

SEQ ID NO: 166254 - DNA, 20 bp, Artificial Sequence
  Description of Artificial Sequence: Synthetic oligonucleotide
  Target: ATXN1; (-) strand; PAM type: YTN; PAM sequence: CTG
aattatgcatctgacattaa

SEQ ID NO: 166255 - DNA, 20 bp, Artificial Sequence
  Description of Artificial Sequence: Synthetic oligonucleotide
  Target: ATXN1; (-) strand; PAM type: YTN; PAM sequence: TTC
aagccagacaactgaattat

SEQ ID NO: 166256 - DNA, 20 bp, Artificial Sequence
  Description of Artificial Sequence: Synthetic oligonucleotide
  Target: ATXN1; (-) strand; PAM type: YTN; PAM sequence: TTC
ccataatgagttcaagccag

SEQ ID NO: 166257 - DNA, 20 bp, Artificial Sequence
  Description of Artificial Sequence: Synthetic oligonucleotide
  Target: ATXN1; (-) strand; PAM type: YTN; PAM sequence: CTC
acaggaaaatcaaatgtaat

SEQ ID NO: 166258 - DNA, 20 bp, Artificial Sequence
  Description of Artificial Sequence: Synthetic oligonucleotide
  Target: ATXN1; (-) strand; PAM type: YTN; PAM sequence: CTG
gcctcacaggaaaatcaaat

SEQ ID NO: 166259 - DNA, 20 bp, Artificial Sequence
  Description of Artificial Sequence: Synthetic oligonucleotide
  Target: ATXN1; (-) strand; PAM type: YTN; PAM sequence: CTC
agtcaaggctggcctcacag

SEQ ID NO: 166260 - DNA, 20 bp, Artificial Sequence
  Description of Artificial Sequence: Synthetic oligonucleotide
  Target: ATXN1; (-) strand; PAM type: YTN; PAM sequence: TTA
gaatcagaagaccctcagtc

SEQ ID NO: 166261 - DNA, 20 bp, Artificial Sequence
  Description of Artificial Sequence: Synthetic oligonucleotide
  Target: ATXN1; (-) strand; PAM type: YTN; PAM sequence: TTT
agaatcagaagaccctcagt

SEQ ID NO: 166262 - DNA, 20 bp, Artificial Sequence
  Description of Artificial Sequence: Synthetic oligonucleotide
  Target: ATXN1; (-) strand; PAM type: YTN; PAM sequence: TTG
accatttagaatcagaagac

SEQ ID NO: 166263 - DNA, 20 bp, Artificial Sequence
  Description of Artificial Sequence: Synthetic oligonucleotide
  Target: ATXN1; (-) strand; PAM type: YTN; PAM sequence: CTA
cagaaacattgaccatttag

SEQ ID NO: 166264 - DNA, 20 bp, Artificial Sequence
  Description of Artificial Sequence: Synthetic oligonucleotide
  Target: ATXN1; (-) strand; PAM type: YTN; PAM sequence: CTG
acactacagaaacattgacc

SEQ ID NO: 166265 - DNA, 20 bp, Artificial Sequence
  Description of Artificial Sequence: Synthetic oligonucleotide
  Target: ATXN1; (-) strand; PAM type: YTN; PAM sequence: TTC
ctgacactacagaaacattg

SEQ ID NO: 166266 - DNA, 20 bp, Artificial Sequence
  Description of Artificial Sequence: Synthetic oligonucleotide
  Target: ATXN1; (-) strand; PAM type: YTN; PAM sequence: TTC
agagaatgattcctgacact

SEQ ID NO: 166267 - DNA, 20 bp, Artificial Sequence
  Description of Artificial Sequence: Synthetic oligonucleotide
  Target: ATXN1; (-) strand; PAM type: YTN; PAM sequence: TTT
cagagaatgattcctgacac

SEQ ID NO: 166268 - DNA, 20 bp, Artificial Sequence
  Description of Artificial Sequence: Synthetic oligonucleotide
  Target: ATXN1; (-) strand; PAM type: YTN; PAM sequence: TTT
tcagagaatgattcctgaca

SEQ ID NO: 166269 - DNA, 20 bp, Artificial Sequence
  Description of Artificial Sequence: Synthetic oligonucleotide
  Target: ATXN1; (-) strand; PAM type: YTN; PAM sequence: CTC
aagaaggtgaagcattttca

SEQ ID NO: 166270 - DNA, 20 bp, Artificial Sequence
  Description of Artificial Sequence: Synthetic oligonucleotide
  Target: ATXN1; (-) strand; PAM type: YTN; PAM sequence: TTC
atatggccacatgcccacag

SEQ ID NO: 166271 - DNA, 20 bp, Artificial Sequence
  Description of Artificial Sequence: Synthetic oligonucleotide
  Target: ATXN1; (-) strand; PAM type: YTN; PAM sequence: TTT
catatggccacatgcccaca

SEQ ID NO: 166272 - DNA, 20 bp, Artificial Sequence
  Description of Artificial Sequence: Synthetic oligonucleotide
  Target: ATXN1; (-) strand; PAM type: YTN; PAM sequence: TTT
tcatatggccacatgcccac

SEQ ID NO: 166273 - DNA, 20 bp, Artificial Sequence
  Description of Artificial Sequence: Synthetic oligonucleotide
  Target: ATXN1; (-) strand; PAM type: YTN; PAM sequence: TTC
accagataatcacacaacat

SEQ ID NO: 166274 - DNA, 20 bp, Artificial Sequence
  Description of Artificial Sequence: Synthetic oligonucleotide
  Target: ATXN1; (-) strand; PAM type: YTN; PAM sequence: TTT
caccagataatcacacaaca

SEQ ID NO: 166275 - DNA, 20 bp, Artificial Sequence
  Description of Artificial Sequence: Synthetic oligonucleotide
  Target: ATXN1; (-) strand; PAM type: YTN; PAM sequence: CTG
gatgaggagtcccccaattt

SEQ ID NO: 166276 - DNA, 20 bp, Artificial Sequence
  Description of Artificial Sequence: Synthetic oligonucleotide
  Target: ATXN1; (-) strand; PAM type: YTN; PAM sequence: TTC
gctggatgaggagtccccca

SEQ ID NO: 166277 - DNA, 20 bp, Artificial Sequence
  Description of Artificial Sequence: Synthetic oligonucleotide
  Target: ATXN1; (-) strand; PAM type: YTN; PAM sequence: CTA
gttcgctggatgaggagtcc

SEQ ID NO: 166278 - DNA, 20 bp, Artificial Sequence
  Description of Artificial Sequence: Synthetic oligonucleotide
  Target: ATXN1; (-) strand; PAM type: YTN; PAM sequence: CTC
ctagttcgctggatgaggag

SEQ ID NO: 166279 - DNA, 20 bp, Artificial Sequence
  Description of Artificial Sequence: Synthetic oligonucleotide
  Target: ATXN1; (-) strand; PAM type: YTN; PAM sequence: TTC
aggtgaaggaacacacagaa

SEQ ID NO: 166280 - DNA, 20 bp, Artificial Sequence
  Description of Artificial Sequence: Synthetic oligonucleotide
  Target: ATXN1; (-) strand; PAM type: YTN; PAM sequence: CTC
acccagcaagggaacaaagg

SEQ ID NO: 166281 - DNA, 20 bp, Artificial Sequence
  Description of Artificial Sequence: Synthetic oligonucleotide
  Target: ATXN1; (-) strand; PAM type: YTN; PAM sequence: CTG
acccggctcacccagcaagg

SEQ ID NO: 166282 - DNA, 20 bp, Artificial Sequence
  Description of Artificial Sequence: Synthetic oligonucleotide
  Target: ATXN1; (-) strand; PAM type: YTN; PAM sequence: TTA
tgacaagacacagcagggct

SEQ ID NO: 166283 - DNA, 20 bp, Artificial Sequence
  Description of Artificial Sequence: Synthetic oligonucleotide
  Target: ATXN1; (-) strand; PAM type: YTN; PAM sequence: CTA
cagttatgacaagacacagc

SEQ ID NO: 166284 - DNA, 20 bp, Artificial Sequence
  Description of Artificial Sequence: Synthetic oligonucleotide
  Target: ATXN1; (-) strand; PAM type: YTN; PAM sequence: TTA
cggaatgtctacagttatga

SEQ ID NO: 166285 - DNA, 20 bp, Artificial Sequence
  Description of Artificial Sequence: Synthetic oligonucleotide
  Target: ATXN1; (-) strand; PAM type: YTN; PAM sequence: TTA
catgaacaccagttacggaa

SEQ ID NO: 166286 - DNA, 20 bp, Artificial Sequence
  Description of Artificial Sequence: Synthetic oligonucleotide
  Target: ATXN1; (-) strand; PAM type: YTN; PAM sequence: CTC
cagcagttacatgaacacca

SEQ ID NO: 166287 - DNA, 20 bp, Artificial Sequence
  Description of Artificial Sequence: Synthetic oligonucleotide
  Target: ATXN1; (-) strand; PAM type: YTN; PAM sequence: TTG
aagcaagctccagcagttac

SEQ ID NO: 166288 - DNA, 20 bp, Artificial Sequence
  Description of Artificial Sequence: Synthetic oligonucleotide
  Target: ATXN1; (-) strand; PAM type: YTN; PAM sequence: TTT
gaagcaagctccagcagtta

SEQ ID NO: 166289 - DNA, 20 bp, Artificial Sequence
  Description of Artificial Sequence: Synthetic oligonucleotide
  Target: ATXN1; (-) strand; PAM type: YTN; PAM sequence: TTG
gtttgaagcaagctccagca

SEQ ID NO: 166290 - DNA, 20 bp, Artificial Sequence
  Description of Artificial Sequence: Synthetic oligonucleotide
  Target: ATXN1; (-) strand; PAM type: YTN; PAM sequence: CTT
ggtttgaagcaagctccagc

SEQ ID NO: 166291 - DNA, 20 bp, Artificial Sequence
  Description of Artificial Sequence: Synthetic oligonucleotide
  Target: ATXN1; (-) strand; PAM type: YTN; PAM sequence: CTG
ccttggtttgaagcaagctc

SEQ ID NO: 166292 - DNA, 20 bp, Artificial Sequence
  Description of Artificial Sequence: Synthetic oligonucleotide
  Target: ATXN1; (-) strand; PAM type: YTN; PAM sequence: TTC
tgccttggtttgaagcaagc

SEQ ID NO: 166293 - DNA, 20 bp, Artificial Sequence
  Description of Artificial Sequence: Synthetic oligonucleotide
  Target: ATXN1; (-) strand; PAM type: YTN; PAM sequence: TTT
ctgccttggtttgaagcaag

SEQ ID NO: 166294 - DNA, 20 bp, Artificial Sequence
  Description of Artificial Sequence: Synthetic oligonucleotide
  Target: ATXN1; (-) strand; PAM type: YTN; PAM sequence: CTC
catcgtcacgggtttctgcc

SEQ ID NO: 166295 - DNA, 20 bp, Artificial Sequence
  Description of Artificial Sequence: Synthetic oligonucleotide
  Target: ATXN1; (-) strand; PAM type: YTN; PAM sequence: TTA
atgtgaggggaaggcaagaa

SEQ ID NO: 166296 - DNA, 20 bp, Artificial Sequence
  Description of Artificial Sequence: Synthetic oligonucleotide
  Target: ATXN1; (-) strand; PAM type: YTN; PAM sequence: CTG
gttaatgtgaggggaaggca

SEQ ID NO: 166297 - DNA, 20 bp, Artificial Sequence
  Description of Artificial Sequence: Synthetic oligonucleotide
  Target: ATXN1; (-) strand; PAM type: YTN; PAM sequence: CTC
catagtcacgaactggttaa

SEQ ID NO: 166298 - DNA, 20 bp, Artificial Sequence
  Description of Artificial Sequence: Synthetic oligonucleotide
  Target: ATXN1; (-) strand; PAM type: YTN; PAM sequence: TTC
tccatagtcacgaactggtt

SEQ ID NO: 166299 - DNA, 20 bp, Artificial Sequence
  Description of Artificial Sequence: Synthetic oligonucleotide
  Target: ATXN1; (-) strand; PAM type: YTN; PAM sequence: TTT
ctccatagtcacgaactggt

SEQ ID NO: 166300 - DNA, 20 bp, Artificial Sequence
  Description of Artificial Sequence: Synthetic oligonucleotide
  Target: ATXN1; (-) strand; PAM type: YTN; PAM sequence: CTG
tttctccatagtcacgaact

SEQ ID NO: 166301 - DNA, 20 bp, Artificial Sequence
  Description of Artificial Sequence: Synthetic oligonucleotide
  Target: ATXN1; (-) strand; PAM type: YTN; PAM sequence: TTG
ccctgtttctccatagtcac

SEQ ID NO: 166302 - DNA, 20 bp, Artificial Sequence
  Description of Artificial Sequence: Synthetic oligonucleotide
  Target: ATXN1; (-) strand; PAM type: YTN; PAM sequence: CTT
gccctgtttctccatagtca

SEQ ID NO: 166303 - DNA, 20 bp, Artificial Sequence
  Description of Artificial Sequence: Synthetic oligonucleotide
  Target: ATXN1; (-) strand; PAM type: YTN; PAM sequence: CTA
cttgccctgtttctccatag

SEQ ID NO: 166304 - DNA, 20 bp, Artificial Sequence
  Description of Artificial Sequence: Synthetic oligonucleotide
  Target: ATXN1; (-) strand; PAM type: YTN; PAM sequence: CTC
caaagccatccgtccagtca

SEQ ID NO: 166305 - DNA, 20 bp, Artificial Sequence
  Description of Artificial Sequence: Synthetic oligonucleotide
  Target: ATXN1; (-) strand; PAM type: YTN; PAM sequence: CTG
gtctccaaagccatccgtcc

SEQ ID NO: 166306 - DNA, 20 bp, Artificial Sequence
  Description of Artificial Sequence: Synthetic oligonucleotide
  Target: ATXN1; (-) strand; PAM type: YTN; PAM sequence: TTC
agagcctggtctccaaagcc

SEQ ID NO: 166307 - DNA, 20 bp, Artificial Sequence
  Description of Artificial Sequence: Synthetic oligonucleotide
  Target: ATXN1; (-) strand; PAM type: YTN; PAM sequence: CTT
cagagcctggtctccaaagc

SEQ ID NO: 166308 - DNA, 20 bp, Artificial Sequence
  Description of Artificial Sequence: Synthetic oligonucleotide
  Target: ATXN1; (-) strand; PAM type: YTN; PAM sequence: CTC
ttcagagcctggtctccaaa

SEQ ID NO: 166309 - DNA, 20 bp, Artificial Sequence
  Description of Artificial Sequence: Synthetic oligonucleotide
  Target: ATXN1; (-) strand; PAM type: YTN; PAM sequence: TTA
caagcatctcttcagagcct

SEQ ID NO: 166310 - DNA, 20 bp, Artificial Sequence
  Description of Artificial Sequence: Synthetic oligonucleotide
  Target: ATXN1; (-) strand; PAM type: YTN; PAM sequence: TTT
acaagcatctcttcagagcc

SEQ ID NO: 166311 - DNA, 20 bp, Artificial Sequence
  Description of Artificial Sequence: Synthetic oligonucleotide
  Target: ATXN1; (-) strand; PAM type: YTN; PAM sequence: TTT
tacaagcatctcttcagagc

SEQ ID NO: 166312 - DNA, 20 bp, Artificial Sequence
  Description of Artificial Sequence: Synthetic oligonucleotide
  Target: ATXN1; (-) strand; PAM type: YTN; PAM sequence: TTT
ttacaagcatctcttcagag

SEQ ID NO: 166313 - DNA, 20 bp, Artificial Sequence
  Description of Artificial Sequence: Synthetic oligonucleotide
  Target: ATXN1; (-) strand; PAM type: YTN; PAM sequence: CTC
cagatttttacaagcatctc

SEQ ID NO: 166314 - DNA, 20 bp, Artificial Sequence
  Description of Artificial Sequence: Synthetic oligonucleotide
  Target: ATXN1; (-) strand; PAM type: YTN; PAM sequence: TTA
agctccagatttttacaagc

SEQ ID NO: 166315 - DNA, 20 bp, Artificial Sequence
  Description of Artificial Sequence: Synthetic oligonucleotide
  Target: ATXN1; (-) strand; PAM type: YTN; PAM sequence: TTG
tgttaagctccagattttta

SEQ ID NO: 166316 - DNA, 20 bp, Artificial Sequence
  Description of Artificial Sequence: Synthetic oligonucleotide
  Target: ATXN1; (-) strand; PAM type: YTN; PAM sequence: CTT
gtgttaagctccagattttt

SEQ ID NO: 166317 - DNA, 20 bp, Artificial Sequence
  Description of Artificial Sequence: Synthetic oligonucleotide
  Target: ATXN1; (-) strand; PAM type: YTN; PAM sequence: TTC
ttgtgttaagctccagattt

SEQ ID NO: 166318 - DNA, 20 bp, Artificial Sequence
  Description of Artificial Sequence: Synthetic oligonucleotide
  Target: ATXN1; (-) strand; PAM type: YTN; PAM sequence: CTT
cttgtgttaagctccagatt

SEQ ID NO: 166319 - DNA, 20 bp, Artificial Sequence
  Description of Artificial Sequence: Synthetic oligonucleotide
  Target: ATXN1; (-) strand; PAM type: YTN; PAM sequence: TTA
agcttcttgtgttaagctcc

SEQ ID NO: 166320 - DNA, 20 bp, Artificial Sequence
  Description of Artificial Sequence: Synthetic oligonucleotide
  Target: ATXN1; (-) strand; PAM type: YTN; PAM sequence: TTT
aagcttcttgtgttaagctc

SEQ ID NO: 166321 - DNA, 20 bp, Artificial Sequence
  Description of Artificial Sequence: Synthetic oligonucleotide
  Target: ATXN1; (-) strand; PAM type: YTN; PAM sequence: TTT
taagcttcttgtgttaagct

SEQ ID NO: 166322 - DNA, 20 bp, Artificial Sequence
  Description of Artificial Sequence: Synthetic oligonucleotide
  Target: ATXN1; (-) strand; PAM type: YTN; PAM sequence: TTG
ttttaagcttcttgtgttaa

SEQ ID NO: 166323 - DNA, 20 bp, Artificial Sequence
  Description of Artificial Sequence: Synthetic oligonucleotide
  Target: ATXN1; (-) strand; PAM type: YTN; PAM sequence: CTT
gttttaagcttcttgtgtta

SEQ ID NO: 166324 - DNA, 20 bp, Artificial Sequence
  Description of Artificial Sequence: Synthetic oligonucleotide
  Target: ATXN1; (-) strand; PAM type: YTN; PAM sequence: TTC
ttgttttaagcttcttgtgt

SEQ ID NO: 166325 - DNA, 20 bp, Artificial Sequence
  Description of Artificial Sequence: Synthetic oligonucleotide
  Target: ATXN1; (-) strand; PAM type: YTN; PAM sequence: CTT
cttgttttaagcttcttgtg

SEQ ID NO: 166326 - DNA, 20 bp, Artificial Sequence
  Description of Artificial Sequence: Synthetic oligonucleotide
  Target: ATXN1; (-) strand; PAM type: YTN; PAM sequence: TTA
aaggagcttcttgttttaag

SEQ ID NO: 166327 - DNA, 20 bp, Artificial Sequence
  Description of Artificial Sequence: Synthetic oligonucleotide
  Target: ATXN1; (-) strand; PAM type: YTN; PAM sequence: CTT
aaaggagcttcttgttttaa

SEQ ID NO: 166328 - DNA, 20 bp, Artificial Sequence
  Description of Artificial Sequence: Synthetic oligonucleotide
  Target: ATXN1; (-) strand; PAM type: YTN; PAM sequence: CTC
caacacttaaaggagcttct

SEQ ID NO: 166329 - DNA, 20 bp, Artificial Sequence
  Description of Artificial Sequence: Synthetic oligonucleotide
  Target: ATXN1; (-) strand; PAM type: YTN; PAM sequence: CTG
aagctccaacacttaaagga

SEQ ID NO: 166330 - DNA, 20 bp, Artificial Sequence
  Description of Artificial Sequence: Synthetic oligonucleotide
  Target: ATXN1; (-) strand; PAM type: YTN; PAM sequence: CTC
tgaagctccaacacttaaag

SEQ ID NO: 166331 - DNA, 20 bp, Artificial Sequence
  Description of Artificial Sequence: Synthetic oligonucleotide
  Target: ATXN1; (-) strand; PAM type: YTN; PAM sequence: TTC
tctgaagctccaacacttaa

SEQ ID NO: 166332 - DNA, 20 bp, Artificial Sequence
  Description of Artificial Sequence: Synthetic oligonucleotide
  Target: ATXN1; (-) strand; PAM type: YTN; PAM sequence: TTT
ctctgaagctccaacactta

SEQ ID NO: 166333 - DNA, 20 bp, Artificial Sequence
  Description of Artificial Sequence: Synthetic oligonucleotide
  Target: ATXN1; (-) strand; PAM type: YTN; PAM sequence: CTT
tctctgaagctccaacactt

SEQ ID NO: 166334 - DNA, 20 bp, Artificial Sequence
  Description of Artificial Sequence: Synthetic oligonucleotide
  Target: ATXN1; (-) strand; PAM type: YTN; PAM sequence: CTC
ctttctctgaagctccaaca

SEQ ID NO: 166335 - DNA, 20 bp, Artificial Sequence
  Description of Artificial Sequence: Synthetic oligonucleotide
  Target: ATXN1; (-) strand; PAM type: YTN; PAM sequence: CTG
aaatgggtaacgtggctcct

SEQ ID NO: 166336 - DNA, 20 bp, Artificial Sequence
  Description of Artificial Sequence: Synthetic oligonucleotide
  Target: ATXN1; (-) strand; PAM type: YTN; PAM sequence: CTC
tgaaatgggtaacgtggctc

SEQ ID NO: 166337 - DNA, 20 bp, Artificial Sequence
  Description of Artificial Sequence: Synthetic oligonucleotide
  Target: ATXN1; (-) strand; PAM type: YTN; PAM sequence: CTG
ctctgaaatgggtaacgtgg

SEQ ID NO: 166338 - DNA, 20 bp, Artificial Sequence
  Description of Artificial Sequence: Synthetic oligonucleotide
  Target: ATXN1; (-) strand; PAM type: YTN; PAM sequence: CTC
cctgctctgaaatgggtaac

SEQ ID NO: 166339 - DNA, 20 bp, Artificial Sequence
  Description of Artificial Sequence: Synthetic oligonucleotide
  Target: ATXN1; (-) strand; PAM type: YTN; PAM sequence: CTG
gaatctccctgctctgaaat

SEQ ID NO: 166340 - DNA, 20 bp, Artificial Sequence
  Description of Artificial Sequence: Synthetic oligonucleotide
  Target: ATXN1; (-) strand; PAM type: YTN; PAM sequence: CTC
tggaatctccctgctctgaa

SEQ ID NO: 166341 - DNA, 20 bp, Artificial Sequence
  Description of Artificial Sequence: Synthetic oligonucleotide
  Target: ATXN1; (-) strand; PAM type: YTN; PAM sequence: TTC
tctggaatctccctgctctg

SEQ ID NO: 166342 - DNA, 20 bp, Artificial Sequence
  Description of Artificial Sequence: Synthetic oligonucleotide
  Target: ATXN1; (-) strand; PAM type: YTN; PAM sequence: CTT
ctctggaatctccctgctct

SEQ ID NO: 166343 - DNA, 20 bp, Artificial Sequence
  Description of Artificial Sequence: Synthetic oligonucleotide
  Target: ATXN1; (-) strand; PAM type: YTN; PAM sequence: CTC
agaagccgacacccaggtga

SEQ ID NO: 166344 - DNA, 20 bp, Artificial Sequence
  Description of Artificial Sequence: Synthetic oligonucleotide
  Target: ATXN1; (-) strand; PAM type: YTN; PAM sequence: CTG
agagcgggagggtgggggcc

SEQ ID NO: 166345 - DNA, 20 bp, Artificial Sequence
  Description of Artificial Sequence: Synthetic oligonucleotide
  Target: ATXN1; (-) strand; PAM type: YTN; PAM sequence: CTG
ctgagagcgggagggtgggg

SEQ ID NO: 166346 - DNA, 20 bp, Artificial Sequence
  Description of Artificial Sequence: Synthetic oligonucleotide
  Target: ATXN1; (-) strand; PAM type: YTN; PAM sequence: CTC
cggagcgggggtgatgacag

SEQ ID NO: 166347 - DNA, 20 bp, Artificial Sequence
  Description of Artificial Sequence: Synthetic oligonucleotide
  Target: ATXN1; (-) strand; PAM type: YTN; PAM sequence: TTC
actccggagcgggggtgatg

SEQ ID NO: 166348 - DNA, 20 bp, Artificial Sequence
  Description of Artificial Sequence: Synthetic oligonucleotide
  Target: ATXN1; (-) strand; PAM type: YTN; PAM sequence: TTT
cactccggagcgggggtgat

SEQ ID NO: 166349 - DNA, 20 bp, Artificial Sequence
  Description of Artificial Sequence: Synthetic oligonucleotide
  Target: ATXN1; (-) strand; PAM type: YTN; PAM sequence: CTT
tcactccggagcgggggtga

SEQ ID NO: 166350 - DNA, 20 bp, Artificial Sequence
  Description of Artificial Sequence: Synthetic oligonucleotide
  Target: ATXN1; (-) strand; PAM type: YTN; PAM sequence: TTC
tttcactccggagcgggggt

SEQ ID NO: 166351 - DNA, 20 bp, Artificial Sequence
  Description of Artificial Sequence: Synthetic oligonucleotide
  Target: ATXN1; (-) strand; PAM type: YTN; PAM sequence: TTT
ctttcactccggagcggggg

SEQ ID NO: 166352 - DNA, 20 bp, Artificial Sequence
  Description of Artificial Sequence: Synthetic oligonucleotide
  Target: ATXN1; (-) strand; PAM type: YTN; PAM sequence: CTT
tctttcactccggagcgggg

SEQ ID NO: 166353 - DNA, 20 bp, Artificial Sequence
  Description of Artificial Sequence: Synthetic oligonucleotide
  Target: ATXN1; (-) strand; PAM type: YTN; PAM sequence: CTC
ctttctttcactccggagcg

SEQ ID NO: 166354 - DNA, 20 bp, Artificial Sequence
  Description of Artificial Sequence: Synthetic oligonucleotide
  Target: ATXN1; (-) strand; PAM type: YTN; PAM sequence: CTG
gtgggaagagccgtggtaag

SEQ ID NO: 166355 - DNA, 20 bp, Artificial Sequence
  Description of Artificial Sequence: Synthetic oligonucleotide
  Target: ATXN1; (-) strand; PAM type: YTN; PAM sequence: CTG
ctggtgggaagagccgtggt

SEQ ID NO: 166356 - DNA, 20 bp, Artificial Sequence
  Description of Artificial Sequence: Synthetic oligonucleotide
  Target: ATXN1; (-) strand; PAM type: YTN; PAM sequence: CTG
gtgctgctggtgggaagagc

SEQ ID NO: 166357 - DNA, 20 bp, Artificial Sequence
  Description of Artificial Sequence: Synthetic oligonucleotide
  Target: ATXN1; (-) strand; PAM type: YTN; PAM sequence: TTC
ctggtgctgctggtgggaag

SEQ ID NO: 166358 - DNA, 20 bp, Artificial Sequence
  Description of Artificial Sequence: Synthetic oligonucleotide
  Target: ATXN1; (-) strand; PAM type: YTN; PAM sequence: CTT
cctggtgctgctggtgggaa

SEQ ID NO: 166359 - DNA, 20 bp, Artificial Sequence
  Description of Artificial Sequence: Synthetic oligonucleotide
  Target: ATXN1; (-) strand; PAM type: YTN; PAM sequence: TTA
aatagaaatggcagtagcag

SEQ ID NO: 166360 - DNA, 20 bp, Artificial Sequence
  Description of Artificial Sequence: Synthetic oligonucleotide
  Target: ATXN1; (-) strand; PAM type: YTN; PAM sequence: TTT
aaatagaaatggcagtagca

SEQ ID NO: 166361 - DNA, 20 bp, Artificial Sequence
  Description of Artificial Sequence: Synthetic oligonucleotide
  Target: ATXN1; (-) strand; PAM type: YTN; PAM sequence: CTA
tccatttaaatagaaatggc

SEQ ID NO: 166362 - DNA, 20 bp, Artificial Sequence
  Description of Artificial Sequence: Synthetic oligonucleotide
  Target: ATXN1; (-) strand; PAM type: YTN; PAM sequence: CTG
cccaacatccctatccattt

SEQ ID NO: 166363 - DNA, 20 bp, Artificial Sequence
  Description of Artificial Sequence: Synthetic oligonucleotide
  Target: ATXN1; (-) strand; PAM type: YTN; PAM sequence: CTC
tgcccaacatccctatccat

SEQ ID NO: 166364 - DNA, 20 bp, Artificial Sequence
  Description of Artificial Sequence: Synthetic oligonucleotide
  Target: ATXN1; (-) strand; PAM type: YTN; PAM sequence: CTC
tctgcccaacatccctatcc

SEQ ID NO: 166365 - DNA, 20 bp, Artificial Sequence
  Description of Artificial Sequence: Synthetic oligonucleotide
  Target: ATXN1; (-) strand; PAM type: YTN; PAM sequence: CTC
cgaaagtgtctctctgccca

SEQ ID NO: 166366 - DNA, 20 bp, Artificial Sequence
  Description of Artificial Sequence: Synthetic oligonucleotide
  Target: ATXN1; (-) strand; PAM type: YTN; PAM sequence: TTA
caggctccgaaagtgtctct

SEQ ID NO: 166367 - DNA, 20 bp, Artificial Sequence
  Description of Artificial Sequence: Synthetic oligonucleotide
  Target: ATXN1; (-) strand; PAM type: YTN; PAM sequence: CTT
acaggctccgaaagtgtctc

SEQ ID NO: 166368 - DNA, 20 bp, Artificial Sequence
  Description of Artificial Sequence: Synthetic oligonucleotide
  Target: ATXN1; (-) strand; PAM type: YTN; PAM sequence: TTA
aacttacaggctccgaaagt

SEQ ID NO: 166369 - DNA, 20 bp, Artificial Sequence
  Description of Artificial Sequence: Synthetic oligonucleotide
  Target: ATXN1; (-) strand; PAM type: YTN; PAM sequence: CTT
aaacttacaggctccgaaag

SEQ ID NO: 166370 - DNA, 20 bp, Artificial Sequence
  Description of Artificial Sequence: Synthetic oligonucleotide
  Target: ATXN1; (-) strand; PAM type: YTN; PAM sequence: CTG
aacacttaaacttacaggct

SEQ ID NO: 166371 - DNA, 20 bp, Artificial Sequence
  Description of Artificial Sequence: Synthetic oligonucleotide
  Target: ATXN1; (-) strand; PAM type: YTN; PAM sequence: CTG
caaagaatgatctgaacact

SEQ ID NO: 166372 - DNA, 20 bp, Artificial Sequence
  Description of Artificial Sequence: Synthetic oligonucleotide
  Target: ATXN1; (-) strand; PAM type: YTN; PAM sequence: TTC
tgcaaagaatgatctgaaca

SEQ ID NO: 166373 - DNA, 20 bp, Artificial Sequence
  Description of Artificial Sequence: Synthetic oligonucleotide
  Target: ATXN1; (-) strand; PAM type: YTN; PAM sequence: TTA
tattctgcaaagaatgatct

SEQ ID NO: 166374 - DNA, 20 bp, Artificial Sequence
  Description of Artificial Sequence: Synthetic oligonucleotide
  Target: ATXN1; (-) strand; PAM type: YTN; PAM sequence: TTC
acattatattctgcaaagaa

SEQ ID NO: 166375 - DNA, 20 bp, Artificial Sequence
  Description of Artificial Sequence: Synthetic oligonucleotide
  Target: ATXN1; (-) strand; PAM type: YTN; PAM sequence: TTA
cagtacaagcaagagcaaga

SEQ ID NO: 166376 - DNA, 20 bp, Artificial Sequence
  Description of Artificial Sequence: Synthetic oligonucleotide
  Target: ATXN1; (-) strand; PAM type: YTN; PAM sequence: TTT
acagtacaagcaagagcaag

SEQ ID NO: 166377 - DNA, 20 bp, Artificial Sequence
  Description of Artificial Sequence: Synthetic oligonucleotide
  Target: ATXN1; (-) strand; PAM type: YTN; PAM sequence: TTT
tacagtacaagcaagagcaa

SEQ ID NO: 166378 - DNA, 20 bp, Artificial Sequence
  Description of Artificial Sequence: Synthetic oligonucleotide
  Target: ATXN1; (-) strand; PAM type: YTN; PAM sequence: CTT
ttacagtacaagcaagagca

SEQ ID NO: 166379 - DNA, 20 bp, Artificial Sequence
  Description of Artificial Sequence: Synthetic oligonucleotide
  Target: ATXN1; (-) strand; PAM type: YTN; PAM sequence: CTA
tatgaatagagaacctttta

SEQ ID NO: 166380 - DNA, 20 bp, Artificial Sequence
  Description of Artificial Sequence: Synthetic oligonucleotide
  Target: ATXN1; (-) strand; PAM type: YTN; PAM sequence: CTG
aatatcacatctatatgaat

SEQ ID NO: 166381 - DNA, 20 bp, Artificial Sequence
  Description of Artificial Sequence: Synthetic oligonucleotide
  Target: ATXN1; (-) strand; PAM type: YTN; PAM sequence: CTA
tacataaactgaatatcaca

SEQ ID NO: 166382 - DNA, 20 bp, Artificial Sequence
  Description of Artificial Sequence: Synthetic oligonucleotide
  Target: ATXN1; (-) strand; PAM type: YTN; PAM sequence: CTG
aaatgtaaacctatacataa

SEQ ID NO: 166383 - DNA, 20 bp, Artificial Sequence
  Description of Artificial Sequence: Synthetic oligonucleotide
  Target: ATXN1; (-) strand; PAM type: YTN; PAM sequence: TTA
gtgctgaaatgtaaacctat

SEQ ID NO: 166384 - DNA, 20 bp, Artificial Sequence
  Description of Artificial Sequence: Synthetic oligonucleotide
  Target: ATXN1; (-) strand; PAM type: YTN; PAM sequence: TTT
agtgctgaaatgtaaaccta

SEQ ID NO: 166385 - DNA, 20 bp, Artificial Sequence
  Description of Artificial Sequence: Synthetic oligonucleotide
  Target: ATXN1; (-) strand; PAM type: YTN; PAM sequence: TTG
cgacatgagtgggtgggaga

SEQ ID NO: 166386 - DNA, 20 bp, Artificial Sequence
  Description of Artificial Sequence: Synthetic oligonucleotide
  Target: ATXN1; (-) strand; PAM type: YTN; PAM sequence: TTT
gcgacatgagtgggtgggag

SEQ ID NO: 166387 - DNA, 20 bp, Artificial Sequence
  Description of Artificial Sequence: Synthetic oligonucleotide
  Target: ATXN1; (-) strand; PAM type: YTN; PAM sequence: CTC
cataaaggtttgcgacatga

SEQ ID NO: 166388 - DNA, 20 bp, Artificial Sequence
  Description of Artificial Sequence: Synthetic oligonucleotide
  Target: ATXN1; (-) strand; PAM type: YTN; PAM sequence: CTA
atatgtagtaggcactccat

SEQ ID NO: 166389 - DNA, 20 bp, Artificial Sequence
  Description of Artificial Sequence: Synthetic oligonucleotide
  Target: ATXN1; (-) strand; PAM type: YTN; PAM sequence: CTC
atcactaatatgtagtaggc

SEQ ID NO: 166390 - DNA, 20 bp, Artificial Sequence
  Description of Artificial Sequence: Synthetic oligonucleotide
  Target: ATXN1; (-) strand; PAM type: YTN; PAM sequence: CTG
ctcatcactaatatgtagta

SEQ ID NO: 166391 - DNA, 20 bp, Artificial Sequence
  Description of Artificial Sequence: Synthetic oligonucleotide
  Target: ATXN1; (-) strand; PAM type: YTN; PAM sequence: CTA
ctgctcatcactaatatgta

SEQ ID NO: 166392 - DNA, 20 bp, Artificial Sequence
  Description of Artificial Sequence: Synthetic oligonucleotide
  Target: ATXN1; (-) strand; PAM type: YTN; PAM sequence: TTC
ctactgctcatcactaatat

SEQ ID NO: 166393 - DNA, 20 bp, Artificial Sequence
  Description of Artificial Sequence: Synthetic oligonucleotide
  Target: ATXN1; (-) strand; PAM type: YTN; PAM sequence: TTA
ttcctactgctcatcactaa

SEQ ID NO: 166394 - DNA, 20 bp, Artificial Sequence
  Description of Artificial Sequence: Synthetic oligonucleotide
  Target: ATXN1; (-) strand; PAM type: YTN; PAM sequence: TTA
ttattcctactgctcatcac

SEQ ID NO: 166395 - DNA, 20 bp, Artificial Sequence
  Description of Artificial Sequence: Synthetic oligonucleotide
  Target: ATXN1; (-) strand; PAM type: YTN; PAM sequence: CTG
ttattattcctactgctcat

SEQ ID NO: 166396 - DNA, 20 bp, Artificial Sequence
  Description of Artificial Sequence: Synthetic oligonucleotide
  Target: ATXN1; (-) strand; PAM type: YTN; PAM sequence: TTA
gctgttattattcctactgc

SEQ ID NO: 166397 - DNA, 20 bp, Artificial Sequence
  Description of Artificial Sequence: Synthetic oligonucleotide
  Target: ATXN1; (-) strand; PAM type: YTN; PAM sequence: TTG
taggtattagctgttattat

SEQ ID NO: 166398 - DNA, 20 bp, Artificial Sequence
  Description of Artificial Sequence: Synthetic oligonucleotide
  Target: ATXN1; (-) strand; PAM type: YTN; PAM sequence: TTT
gtaggtattagctgttatta

SEQ ID NO: 166399 - DNA, 20 bp, Artificial Sequence
  Description of Artificial Sequence: Synthetic oligonucleotide
  Target: ATXN1; (-) strand; PAM type: YTN; PAM sequence: CTT
tgtaggtattagctgttatt

SEQ ID NO: 166400 - DNA, 20 bp, Artificial Sequence
  Description of Artificial Sequence: Synthetic oligonucleotide
  Target: ATXN1; (-) strand; PAM type: YTN; PAM sequence: CTG
aaagtgctttgtaggtatta

SEQ ID NO: 166401 - DNA, 20 bp, Artificial Sequence
  Description of Artificial Sequence: Synthetic oligonucleotide
  Target: ATXN1; (-) strand; PAM type: YTN; PAM sequence: CTA
gcagactgaaagtgctttgt

SEQ ID NO: 166402 - DNA, 20 bp, Artificial Sequence
  Description of Artificial Sequence: Synthetic oligonucleotide
  Target: ATXN1; (-) strand; PAM type: YTN; PAM sequence: CTC
catgcaaagccctagcagac

SEQ ID NO: 166403 - DNA, 20 bp, Artificial Sequence
  Description of Artificial Sequence: Synthetic oligonucleotide
  Target: ATXN1; (-) strand; PAM type: YTN; PAM sequence: TTA
aatgagcggctccatgcaaa

SEQ ID NO: 166404 - DNA, 20 bp, Artificial Sequence
  Description of Artificial Sequence: Synthetic oligonucleotide
  Target: ATXN1; (-) strand; PAM type: YTN; PAM sequence: CTT
aaatgagcggctccatgcaa

SEQ ID NO: 166405 - DNA, 20 bp, Artificial Sequence
  Description of Artificial Sequence: Synthetic oligonucleotide
  Target: ATXN1; (-) strand; PAM type: YTN; PAM sequence: TTA
cttaaatgagcggctccatg

SEQ ID NO: 166406 - DNA, 20 bp, Artificial Sequence
  Description of Artificial Sequence: Synthetic oligonucleotide
  Target: ATXN1; (-) strand; PAM type: YTN; PAM sequence: CTT
acttaaatgagcggctccat

SEQ ID NO: 166407 - DNA, 20 bp, Artificial Sequence
  Description of Artificial Sequence: Synthetic oligonucleotide
  Target: ATXN1; (-) strand; PAM type: YTN; PAM sequence: CTA
gaagagtgcttacttaaatg

SEQ ID NO: 166408 - DNA, 20 bp, Artificial Sequence
  Description of Artificial Sequence: Synthetic oligonucleotide
  Target: ATXN1; (-) strand; PAM type: YTN; PAM sequence: TTA
gatggtatcatggcaactag

SEQ ID NO: 166409 - DNA, 20 bp, Artificial Sequence
  Description of Artificial Sequence: Synthetic oligonucleotide
  Target: ATXN1; (-) strand; PAM type: YTN; PAM sequence: TTA
attagatggtatcatggcaa

SEQ ID NO: 166410 - DNA, 20 bp, Artificial Sequence
  Description of Artificial Sequence: Synthetic oligonucleotide
  Target: ATXN1; (-) strand; PAM type: YTN; PAM sequence: TTT
aattagatggtatcatggca

SEQ ID NO: 166411 - DNA, 20 bp, Artificial Sequence
  Description of Artificial Sequence: Synthetic oligonucleotide
  Target: ATXN1; (-) strand; PAM type: YTN; PAM sequence: CTC
atttaattagatggtatcat

SEQ ID NO: 166412 - DNA, 20 bp, Artificial Sequence
  Description of Artificial Sequence: Synthetic oligonucleotide
  Target: ATXN1; (-) strand; PAM type: YTN; PAM sequence: CTG
tgaagcacctcatttaatta

SEQ ID NO: 166413 - DNA, 20 bp, Artificial Sequence
  Description of Artificial Sequence: Synthetic oligonucleotide
  Target: ATXN1; (-) strand; PAM type: YTN; PAM sequence: TTG
tgtctgtgaagcacctcatt

SEQ ID NO: 166414 - DNA, 20 bp, Artificial Sequence
  Description of Artificial Sequence: Synthetic oligonucleotide
  Target: ATXN1; (-) strand; PAM type: YTN; PAM sequence: TTT
gtgtctgtgaagcacctcat

SEQ ID NO: 166415 - DNA, 20 bp, Artificial Sequence
  Description of Artificial Sequence: Synthetic oligonucleotide
  Target: ATXN1; (-) strand; PAM type: YTN; PAM sequence: CTG
tatatttgtgtctgtgaagc

SEQ ID NO: 166416 - DNA, 20 bp, Artificial Sequence
  Description of Artificial Sequence: Synthetic oligonucleotide
  Target: ATXN1; (-) strand; PAM type: YTN; PAM sequence: TTA
tatcgctgtatatttgtgtc

SEQ ID NO: 166417 - DNA, 20 bp, Artificial Sequence
  Description of Artificial Sequence: Synthetic oligonucleotide
  Target: ATXN1; (-) strand; PAM type: YTN; PAM sequence: TTA
taaaggaacagcatacatat

SEQ ID NO: 166418 - DNA, 20 bp, Artificial Sequence
  Description of Artificial Sequence: Synthetic oligonucleotide
  Target: ATXN1; (-) strand; PAM type: YTN; PAM sequence: TTC
cgttataaaggaacagcata

SEQ ID NO: 166419 - DNA, 20 bp, Artificial Sequence
  Description of Artificial Sequence: Synthetic oligonucleotide
  Target: ATXN1; (-) strand; PAM type: YTN; PAM sequence: CTG
agaaaagtaggcagggtagg

SEQ ID NO: 166420 - DNA, 20 bp, Artificial Sequence
  Description of Artificial Sequence: Synthetic oligonucleotide
  Target: ATXN1; (-) strand; PAM type: YTN; PAM sequence: TTG
gggtgaaataacatgataag

SEQ ID NO: 166421 - DNA, 20 bp, Artificial Sequence
  Description of Artificial Sequence: Synthetic oligonucleotide
  Target: ATXN1; (-) strand; PAM type: YTN; PAM sequence: CTG
ttggggtgaaataacatgat

SEQ ID NO: 166422 - DNA, 20 bp, Artificial Sequence
  Description of Artificial Sequence: Synthetic oligonucleotide
  Target: ATXN1; (-) strand; PAM type: YTN; PAM sequence: TTC
cagaaaaagtctgttggggt

SEQ ID NO: 166423 - DNA, 20 bp, Artificial Sequence
  Description of Artificial Sequence: Synthetic oligonucleotide
  Target: ATXN1; (-) strand; PAM type: YTN; PAM sequence: TTT
ccagaaaaagtctgttgggg

SEQ ID NO: 166424 - DNA, 20 bp, Artificial Sequence
  Description of Artificial Sequence: Synthetic oligonucleotide
  Target: ATXN1; (-) strand; PAM type: YTN; PAM sequence: TTT
tccagaaaaagtctgttggg

SEQ ID NO: 166425 - DNA, 20 bp, Artificial Sequence
  Description of Artificial Sequence: Synthetic oligonucleotide
  Target: ATXN1; (-) strand; PAM type: YTN; PAM sequence: TTT
ttccagaaaaagtctgttgg

SEQ ID NO: 166426 - DNA, 20 bp, Artificial Sequence
  Description of Artificial Sequence: Synthetic oligonucleotide
  Target: ATXN1; (-) strand; PAM type: YTN; PAM sequence: CTG
acatgtagtaagcaatcatt

SEQ ID NO: 166427 - DNA, 20 bp, Artificial Sequence
  Description of Artificial Sequence: Synthetic oligonucleotide
  Target: ATXN1; (-) strand; PAM type: YTN; PAM sequence: CTG
tgaacagccaactgacatgt

SEQ ID NO: 166428 - DNA, 20 bp, Artificial Sequence
  Description of Artificial Sequence: Synthetic oligonucleotide
  Target: ATXN1; (-) strand; PAM type: YTN; PAM sequence: CTG
aaactgtgaacagccaactg

SEQ ID NO: 166429 - DNA, 20 bp, Artificial Sequence
  Description of Artificial Sequence: Synthetic oligonucleotide
  Target: ATXN1; (-) strand; PAM type: YTN; PAM sequence: TTC
tgaaactgtgaacagccaac

SEQ ID NO: 166430 - DNA, 20 bp, Artificial Sequence
  Description of Artificial Sequence: Synthetic oligonucleotide
  Target: ATXN1; (-) strand; PAM type: YTN; PAM sequence: TTT
ctgaaactgtgaacagccaa

SEQ ID NO: 166431 - DNA, 20 bp, Artificial Sequence
  Description of Artificial Sequence: Synthetic oligonucleotide
  Target: ATXN1; (-) strand; PAM type: YTN; PAM sequence: TTG
tatttctgaaactgtgaaca

SEQ ID NO: 166432 - DNA, 20 bp, Artificial Sequence
  Description of Artificial Sequence: Synthetic oligonucleotide
  Target: ATXN1; (-) strand; PAM type: YTN; PAM sequence: CTT
gtatttctgaaactgtgaac

SEQ ID NO: 166433 - DNA, 20 bp, Artificial Sequence
  Description of Artificial Sequence: Synthetic oligonucleotide
  Target: ATXN1; (-) strand; PAM type: YTN; PAM sequence: CTC
cacttgtatttctgaaactg

SEQ ID NO: 166434 - DNA, 20 bp, Artificial Sequence
  Description of Artificial Sequence: Synthetic oligonucleotide
  Target: ATXN1; (-) strand; PAM type: YTN; PAM sequence: TTC
tccacttgtatttctgaaac

SEQ ID NO: 166435 - DNA, 20 bp, Artificial Sequence
  Description of Artificial Sequence: Synthetic oligonucleotide
  Target: ATXN1; (-) strand; PAM type: YTN; PAM sequence: TTT
ctccacttgtatttctgaaa

SEQ ID NO: 166436 - DNA, 20 bp, Artificial Sequence
  Description of Artificial Sequence: Synthetic oligonucleotide
  Target: ATXN1; (-) strand; PAM type: YTN; PAM sequence: TTC
caagtttctccacttgtatt

SEQ ID NO: 166437 - DNA, 20 bp, Artificial Sequence
  Description of Artificial Sequence: Synthetic oligonucleotide
  Target: ATXN1; (-) strand; PAM type: YTN; PAM sequence: TTT
ccaagtttctccacttgtat

SEQ ID NO: 166438 - DNA, 20 bp, Artificial Sequence
  Description of Artificial Sequence: Synthetic oligonucleotide
  Target: ATXN1; (-) strand; PAM type: YTN; PAM sequence: TTT
tccaagtttctccacttgta

SEQ ID NO: 166439 - DNA, 20 bp, Artificial Sequence
  Description of Artificial Sequence: Synthetic oligonucleotide
  Target: ATXN1; (-) strand; PAM type: YTN; PAM sequence: CTG
ttttccaagtttctccactt

SEQ ID NO: 166440 - DNA, 20 bp, Artificial Sequence
  Description of Artificial Sequence: Synthetic oligonucleotide
  Target: ATXN1; (-) strand; PAM type: YTN; PAM sequence: TTG
atagatgctgttttccaagt

SEQ ID NO: 166441 - DNA, 20 bp, Artificial Sequence
  Description of Artificial Sequence: Synthetic oligonucleotide
  Target: ATXN1; (-) strand; PAM type: YTN; PAM sequence: CTA
gaagttgatagatgctgttt

SEQ ID NO: 166442 - DNA, 20 bp, Artificial Sequence
  Description of Artificial Sequence: Synthetic oligonucleotide
  Target: ATXN1; (-) strand; PAM type: YTN; PAM sequence: TTA
gatctagaagttgatagatg

SEQ ID NO: 166443 - DNA, 20 bp, Artificial Sequence
  Description of Artificial Sequence: Synthetic oligonucleotide
  Target: ATXN1; (-) strand; PAM type: YTN; PAM sequence: CTT
agatctagaagttgatagat

SEQ ID NO: 166444 - DNA, 20 bp, Artificial Sequence
  Description of Artificial Sequence: Synthetic oligonucleotide
  Target: ATXN1; (-) strand; PAM type: YTN; PAM sequence: CTC
agagagcttagatctagaag

SEQ ID NO: 166445 - DNA, 20 bp, Artificial Sequence
  Description of Artificial Sequence: Synthetic oligonucleotide
  Target: ATXN1; (-) strand; PAM type: YTN; PAM sequence: CTC
tcagagagcttagatctaga

SEQ ID NO: 166446 - DNA, 20 bp, Artificial Sequence
  Description of Artificial Sequence: Synthetic oligonucleotide
  Target: ATXN1; (-) strand; PAM type: YTN; PAM sequence: TTG
ctctcagagagcttagatct

SEQ ID NO: 166447 - DNA, 20 bp, Artificial Sequence
  Description of Artificial Sequence: Synthetic oligonucleotide
  Target: ATXN1; (-) strand; PAM type: YTN; PAM sequence: CTT
gctctcagagagcttagatc

SEQ ID NO: 166448 - DNA, 20 bp, Artificial Sequence
  Description of Artificial Sequence: Synthetic oligonucleotide
  Target: ATXN1; (-) strand; PAM type: YTN; PAM sequence: TTC
ttgctctcagagagcttaga

SEQ ID NO: 166449 - DNA, 20 bp, Artificial Sequence
  Description of Artificial Sequence: Synthetic oligonucleotide
  Target: ATXN1; (-) strand; PAM type: YTN; PAM sequence: TTA
ggatggagaagaaaaaacat

SEQ ID NO: 166450 - DNA, 20 bp, Artificial Sequence
  Description of Artificial Sequence: Synthetic oligonucleotide
  Target: ATXN1; (-) strand; PAM type: YTN; PAM sequence: CTT
aggatggagaagaaaaaaca

SEQ ID NO: 166451 - DNA, 20 bp, Artificial Sequence
  Description of Artificial Sequence: Synthetic oligonucleotide
  Target: ATXN1; (-) strand; PAM type: YTN; PAM sequence: CTA
tcaaatatgtatcaggcaca

SEQ ID NO: 166452 - DNA, 20 bp, Artificial Sequence
  Description of Artificial Sequence: Synthetic oligonucleotide
  Target: ATXN1; (-) strand; PAM type: YTN; PAM sequence: TTA
gcatgcacctatcaaatatg

SEQ ID NO: 166453 - DNA, 20 bp, Artificial Sequence
  Description of Artificial Sequence: Synthetic oligonucleotide
  Target: ATXN1; (-) strand; PAM type: YTN; PAM sequence: CTT
agcatgcacctatcaaatat

SEQ ID NO: 166454 - DNA, 20 bp, Artificial Sequence
  Description of Artificial Sequence: Synthetic oligonucleotide
  Target: ATXN1; (-) strand; PAM type: YTN; PAM sequence: TTA
tgtaacacatacttagcatg

SEQ ID NO: 166455 - DNA, 20 bp, Artificial Sequence
  Description of Artificial Sequence: Synthetic oligonucleotide
  Target: ATXN1; (-) strand; PAM type: YTN; PAM sequence: TTT
atgtaacacatacttagcat

SEQ ID NO: 166456 - DNA, 20 bp, Artificial Sequence
  Description of Artificial Sequence: Synthetic oligonucleotide
  Target: ATXN1; (-) strand; PAM type: YTN; PAM sequence: TTA
atttatgtaacacatactta

SEQ ID NO: 166457 - DNA, 20 bp, Artificial Sequence
  Description of Artificial Sequence: Synthetic oligonucleotide
  Target: ATXN1; (-) strand; PAM type: YTN; PAM sequence: TTA
gcatatggcacatcatggaa

SEQ ID NO: 166458 - DNA, 20 bp, Artificial Sequence
  Description of Artificial Sequence: Synthetic oligonucleotide
  Target: ATXN1; (-) strand; PAM type: YTN; PAM sequence: CTA
gacaggatattagcatatgg

SEQ ID NO: 166459 - DNA, 20 bp, Artificial Sequence
  Description of Artificial Sequence: Synthetic oligonucleotide
  Target: ATXN1; (-) strand; PAM type: YTN; PAM sequence: TTA
ctagacaggatattagcata

SEQ ID NO: 166460 - DNA, 20 bp, Artificial Sequence
  Description of Artificial Sequence: Synthetic oligonucleotide
  Target: ATXN1; (-) strand; PAM type: YTN; PAM sequence: TTA
ttactagacaggatattagc

SEQ ID NO: 166461 - DNA, 20 bp, Artificial Sequence
  Description of Artificial Sequence: Synthetic oligonucleotide
  Target: ATXN1; (-) strand; PAM type: YTN; PAM sequence: CTC
agcagttattactagacagg

SEQ ID NO: 166462 - DNA, 20 bp, Artificial Sequence
  Description of Artificial Sequence: Synthetic oligonucleotide
  Target: ATXN1; (-) strand; PAM type: YTN; PAM sequence: CTG
aagtcctcagcagttattac

SEQ ID NO: 166463 - DNA, 20 bp, Artificial Sequence
  Description of Artificial Sequence: Synthetic oligonucleotide
  Target: ATXN1; (-) strand; PAM type: YTN; PAM sequence: TTC
tgaagtcctcagcagttatt

SEQ ID NO: 166464 - DNA, 20 bp, Artificial Sequence
  Description of Artificial Sequence: Synthetic oligonucleotide
  Target: ATXN1; (-) strand; PAM type: YTN; PAM sequence: CTG
gtcagcaaatattctgaagt

SEQ ID NO: 166465 - DNA, 20 bp, Artificial Sequence
  Description of Artificial Sequence: Synthetic oligonucleotide
  Target: ATXN1; (-) strand; PAM type: YTN; PAM sequence: TTC
agtggagtatcagacaccag

SEQ ID NO: 166466 - DNA, 20 bp, Artificial Sequence
  Description of Artificial Sequence: Synthetic oligonucleotide
  Target: ATXN1; (-) strand; PAM type: YTN; PAM sequence: CTT
cagtggagtatcagacacca

SEQ ID NO: 166467 - DNA, 20 bp, Artificial Sequence
  Description of Artificial Sequence: Synthetic oligonucleotide
  Target: ATXN1; (-) strand; PAM type: YTN; PAM sequence: TTG
tccttcagtggagtatcaga

SEQ ID NO: 166468 - DNA, 20 bp, Artificial Sequence
  Description of Artificial Sequence: Synthetic oligonucleotide
  Target: ATXN1; (-) strand; PAM type: YTN; PAM sequence: TTT
gtccttcagtggagtatcag

SEQ ID NO: 166469 - DNA, 20 bp, Artificial Sequence
  Description of Artificial Sequence: Synthetic oligonucleotide
  Target: ATXN1; (-) strand; PAM type: YTN; PAM sequence: TTT
tgtccttcagtggagtatca

SEQ ID NO: 166470 - DNA, 20 bp, Artificial Sequence
  Description of Artificial Sequence: Synthetic oligonucleotide
  Target: ATXN1; (-) strand; PAM type: YTN; PAM sequence: TTG
ttttgtccttcagtggagta

SEQ ID NO: 166471 - DNA, 20 bp, Artificial Sequence
  Description of Artificial Sequence: Synthetic oligonucleotide
  Target: ATXN1; (-) strand; PAM type: YTN; PAM sequence: TTT
gttttgtccttcagtggagt

SEQ ID NO: 166472 - DNA, 20 bp, Artificial Sequence
  Description of Artificial Sequence: Synthetic oligonucleotide
  Target: ATXN1; (-) strand; PAM type: YTN; PAM sequence: TTT
tgttttgtccttcagtggag

SEQ ID NO: 166473 - DNA, 20 bp, Artificial Sequence
  Description of Artificial Sequence: Synthetic oligonucleotide
  Target: ATXN1; (-) strand; PAM type: YTN; PAM sequence: TTG
aatcaatgatcaattttgtt

SEQ ID NO: 166474 - DNA, 20 bp, Artificial Sequence
  Description of Artificial Sequence: Synthetic oligonucleotide
  Target: ATXN1; (-) strand; PAM type: YTN; PAM sequence: CTT
gaatcaatgatcaattttgt

SEQ ID NO: 166475 - DNA, 20 bp, Artificial Sequence
  Description of Artificial Sequence: Synthetic oligonucleotide
  Target: ATXN1; (-) strand; PAM type: YTN; PAM sequence: TTA
gtggaaccttgaatcaatga

SEQ ID NO: 166476 - DNA, 20 bp, Artificial Sequence
  Description of Artificial Sequence: Synthetic oligonucleotide
  Target: ATXN1; (-) strand; PAM type: YTN; PAM sequence: CTT
agtggaaccttgaatcaatg

SEQ ID NO: 166477 - DNA, 20 bp, Artificial Sequence
  Description of Artificial Sequence: Synthetic oligonucleotide
  Target: ATXN1; (-) strand; PAM type: YTN; PAM sequence: CTC
ttagtggaaccttgaatcaa

SEQ ID NO: 166478 - DNA, 20 bp, Artificial Sequence
  Description of Artificial Sequence: Synthetic oligonucleotide
  Target: ATXN1; (-) strand; PAM type: YTN; PAM sequence: TTA
ctcttagtggaaccttgaat

SEQ ID NO: 166479 - DNA, 20 bp, Artificial Sequence
  Description of Artificial Sequence: Synthetic oligonucleotide
  Target: ATXN1; (-) strand; PAM type: YTN; PAM sequence: TTT
actcttagtggaaccttgaa

SEQ ID NO: 166480 - DNA, 20 bp, Artificial Sequence
  Description of Artificial Sequence: Synthetic oligonucleotide
  Target: ATXN1; (-) strand; PAM type: YTN; PAM sequence: TTA
tttactcttagtggaacctt

SEQ ID NO: 166481 - DNA, 20 bp, Artificial Sequence
  Description of Artificial Sequence: Synthetic oligonucleotide
  Target: ATXN1; (-) strand; PAM type: YTN; PAM sequence: TTT
atttactcttagtggaacct

SEQ ID NO: 166482 - DNA, 20 bp, Artificial Sequence
  Description of Artificial Sequence: Synthetic oligonucleotide
  Target: ATXN1; (-) strand; PAM type: YTN; PAM sequence: CTT
tatttactcttagtggaacc

SEQ ID NO: 166483 - DNA, 20 bp, Artificial Sequence
  Description of Artificial Sequence: Synthetic oligonucleotide
  Target: ATXN1; (-) strand; PAM type: YTN; PAM sequence: TTC
cataccacatcacactttat

SEQ ID NO: 166484 - DNA, 20 bp, Artificial Sequence
  Description of Artificial Sequence: Synthetic oligonucleotide
  Target: ATXN1; (-) strand; PAM type: YTN; PAM sequence: CTT
ccataccacatcacacttta

SEQ ID NO: 166485 - DNA, 20 bp, Artificial Sequence
  Description of Artificial Sequence: Synthetic oligonucleotide
  Target: ATXN1; (-) strand; PAM type: YTN; PAM sequence: TTA
tgccatggcttccataccac

SEQ ID NO: 166486 - DNA, 20 bp, Artificial Sequence
  Description of Artificial Sequence: Synthetic oligonucleotide
  Target: ATXN1; (-) strand; PAM type: YTN; PAM sequence: TTT
atgccatggcttccatacca

SEQ ID NO: 166487 - DNA, 20 bp, Artificial Sequence
  Description of Artificial Sequence: Synthetic oligonucleotide
  Target: ATXN1; (-) strand; PAM type: YTN; PAM sequence: TTA
tttatgccatggcttccata

SEQ ID NO: 166488 - DNA, 20 bp, Artificial Sequence
  Description of Artificial Sequence: Synthetic oligonucleotide
  Target: ATXN1; (-) strand; PAM type: YTN; PAM sequence: CTT
atttatgccatggcttccat

SEQ ID NO: 166489 - DNA, 20 bp, Artificial Sequence
  Description of Artificial Sequence: Synthetic oligonucleotide
  Target: ATXN1; (-) strand; PAM type: YTN; PAM sequence: TTC
ttatttatgccatggcttcc

SEQ ID NO: 166490 - DNA, 20 bp, Artificial Sequence
  Description of Artificial Sequence: Synthetic oligonucleotide
  Target: ATXN1; (-) strand; PAM type: YTN; PAM sequence: TTT
cttatttatgccatggcttc

SEQ ID NO: 166491 - DNA, 20 bp, Artificial Sequence
  Description of Artificial Sequence: Synthetic oligonucleotide
  Target: ATXN1; (-) strand; PAM type: YTN; PAM sequence: TTT
tcttatttatgccatggctt

SEQ ID NO: 166492 - DNA, 20 bp, Artificial Sequence
  Description of Artificial Sequence: Synthetic oligonucleotide
  Target: ATXN1; (-) strand; PAM type: YTN; PAM sequence: CTT
ttcttatttatgccatggct

SEQ ID NO: 166493 - DNA, 20 bp, Artificial Sequence
  Description of Artificial Sequence: Synthetic oligonucleotide
  Target: ATXN1; (-) strand; PAM type: YTN; PAM sequence: TTC
atgtcaaagagcatcaactt

SEQ ID NO: 166494 - DNA, 20 bp, Artificial Sequence
  Description of Artificial Sequence: Synthetic oligonucleotide
  Target: ATXN1; (-) strand; PAM type: YTN; PAM sequence: CTG
aacagatcaattcatgtcaa

SEQ ID NO: 166495 - DNA, 20 bp, Artificial Sequence
  Description of Artificial Sequence: Synthetic oligonucleotide
  Target: ATXN1; (-) strand; PAM type: YTN; PAM sequence: TTG
tgctgaacagatcaattcat

SEQ ID NO: 166496 - DNA, 20 bp, Artificial Sequence
  Description of Artificial Sequence: Synthetic oligonucleotide
  Target: ATXN1; (-) strand; PAM type: YTN; PAM sequence: TTA
gattgtgctgaacagatcaa

SEQ ID NO: 166497 - DNA, 20 bp, Artificial Sequence
  Description of Artificial Sequence: Synthetic oligonucleotide
  Target: ATXN1; (-) strand; PAM type: YTN; PAM sequence: TTG
gttagattgtgctgaacaga

SEQ ID NO: 166498 - DNA, 20 bp, Artificial Sequence
  Description of Artificial Sequence: Synthetic oligonucleotide
  Target: ATXN1; (-) strand; PAM type: YTN; PAM sequence: TTT
ggttagattgtgctgaacag

SEQ ID NO: 166499 - DNA, 20 bp, Artificial Sequence
  Description of Artificial Sequence: Synthetic oligonucleotide
  Target: ATXN1; (-) strand; PAM type: YTN; PAM sequence: CTT
tggttagattgtgctgaaca

SEQ ID NO: 166500 - DNA, 20 bp, Artificial Sequence
  Description of Artificial Sequence: Synthetic oligonucleotide
  Target: ATXN1; (-) strand; PAM type: YTN; PAM sequence: TTC
tttggttagattgtgctgaa

SEQ ID NO: 166501 - DNA, 20 bp, Artificial Sequence
  Description of Artificial Sequence: Synthetic oligonucleotide
  Target: ATXN1; (-) strand; PAM type: YTN; PAM sequence: TTG
ttctttggttagattgtgct

SEQ ID NO: 166502 - DNA, 20 bp, Artificial Sequence
  Description of Artificial Sequence: Synthetic oligonucleotide
  Target: ATXN1; (-) strand; PAM type: YTN; PAM sequence: CTT
gttctttggttagattgtgc

SEQ ID NO: 166503 - DNA, 20 bp, Artificial Sequence
  Description of Artificial Sequence: Synthetic oligonucleotide
  Target: ATXN1; (-) strand; PAM type: YTN; PAM sequence: TTG
ccttgttctttggttagatt

SEQ ID NO: 166504 - DNA, 20 bp, Artificial Sequence
  Description of Artificial Sequence: Synthetic oligonucleotide
  Target: ATXN1; (-) strand; PAM type: YTN; PAM sequence: TTT
gccttgttctttggttagat

SEQ ID NO: 166505 - DNA, 20 bp, Artificial Sequence
  Description of Artificial Sequence: Synthetic oligonucleotide
  Target: ATXN1; (-) strand; PAM type: YTN; PAM sequence: CTT
tgccttgttctttggttaga

SEQ ID NO: 166506 - DNA, 20 bp, Artificial Sequence
  Description of Artificial Sequence: Synthetic oligonucleotide
  Target: ATXN1; (-) strand; PAM type: YTN; PAM sequence: TTG
aaggaaaactttgccttgtt

SEQ ID NO: 166507 - DNA, 20 bp, Artificial Sequence
  Description of Artificial Sequence: Synthetic oligonucleotide
  Target: ATXN1; (-) strand; PAM type: YTN; PAM sequence: CTT
gaaggaaaactttgccttgt

SEQ ID NO: 166508 - DNA, 20 bp, Artificial Sequence
  Description of Artificial Sequence: Synthetic oligonucleotide
  Target: ATXN1; (-) strand; PAM type: YTN; PAM sequence: CTA
tgcttgaaggaaaactttgc

SEQ ID NO: 166509 - DNA, 20 bp, Artificial Sequence
  Description of Artificial Sequence: Synthetic oligonucleotide
  Target: ATXN1; (-) strand; PAM type: YTN; PAM sequence: TTC
tatgcttgaaggaaaacttt

SEQ ID NO: 166510 - DNA, 20 bp, Artificial Sequence
  Description of Artificial Sequence: Synthetic oligonucleotide
  Target: ATXN1; (-) strand; PAM type: YTN; PAM sequence: CTC
attctatgcttgaaggaaaa

SEQ ID NO: 166511 - DNA, 20 bp, Artificial Sequence
  Description of Artificial Sequence: Synthetic oligonucleotide
  Target: ATXN1; (-) strand; PAM type: YTN; PAM sequence: TTA
taaatcccagagggaactca

SEQ ID NO: 166512 - DNA, 20 bp, Artificial Sequence
  Description of Artificial Sequence: Synthetic oligonucleotide
  Target: ATXN1; (-) strand; PAM type: YTN; PAM sequence: TTT
ataaatcccagagggaactc

SEQ ID NO: 166513 - DNA, 20 bp, Artificial Sequence
  Description of Artificial Sequence: Synthetic oligonucleotide
  Target: ATXN1; (-) strand; PAM type: YTN; PAM sequence: CTT
tataaatcccagagggaact

SEQ ID NO: 166514 - DNA, 20 bp, Artificial Sequence
  Description of Artificial Sequence: Synthetic oligonucleotide
  Target: ATXN1; (-) strand; PAM type: YTN; PAM sequence: CTG
gtccactttataaatcccag

SEQ ID NO: 166515 - DNA, 20 bp, Artificial Sequence
  Description of Artificial Sequence: Synthetic oligonucleotide
  Target: ATXN1; (-) strand; PAM type: YTN; PAM sequence: CTG
tactggtccactttataaat

SEQ ID NO: 166516 - DNA, 20 bp, Artificial Sequence
  Description of Artificial Sequence: Synthetic oligonucleotide
  Target: ATXN1; (-) strand; PAM type: YTN; PAM sequence: CTC
tgtactggtccactttataa

SEQ ID NO: 166517 - DNA, 20 bp, Artificial Sequence
  Description of Artificial Sequence: Synthetic oligonucleotide
  Target: ATXN1; (-) strand; PAM type: YTN; PAM sequence: TTA
aacggtacgggtgggagcca

SEQ ID NO: 166518 - DNA, 20 bp, Artificial Sequence
  Description of Artificial Sequence: Synthetic oligonucleotide
  Target: ATXN1; (-) strand; PAM type: YTN; PAM sequence: TTT
aaacggtacgggtgggagcc

SEQ ID NO: 166519 - DNA, 20 bp, Artificial Sequence
  Description of Artificial Sequence: Synthetic oligonucleotide
  Target: ATXN1; (-) strand; PAM type: YTN; PAM sequence: TTT
taaacggtacgggtgggagc

SEQ ID NO: 166520 - DNA, 20 bp, Artificial Sequence
  Description of Artificial Sequence: Synthetic oligonucleotide
  Target: ATXN1; (-) strand; PAM type: YTN; PAM sequence: CTA
gttttaaacggtacgggtgg

SEQ ID NO: 166521 - DNA, 20 bp, Artificial Sequence
  Description of Artificial Sequence: Synthetic oligonucleotide
  Target: ATXN1; (-) strand; PAM type: YTN; PAM sequence: CTA
aaaatcaactagttttaaac

SEQ ID NO: 166522 - DNA, 20 bp, Artificial Sequence
  Description of Artificial Sequence: Synthetic oligonucleotide
  Target: ATXN1; (-) strand; PAM type: YTN; PAM sequence: TTG
gagaatacactaaaaatcaa

SEQ ID NO: 166523 - DNA, 20 bp, Artificial Sequence
  Description of Artificial Sequence: Synthetic oligonucleotide
  Target: ATXN1; (-) strand; PAM type: YTN; PAM sequence: CTG
agagggggaagataggtgaa

SEQ ID NO: 166524 - DNA, 20 bp, Artificial Sequence
  Description of Artificial Sequence: Synthetic oligonucleotide
  Target: ATXN1; (-) strand; PAM type: YTN; PAM sequence: TTG
ctgagagggggaagataggt

SEQ ID NO: 166525 - DNA, 20 bp, Artificial Sequence
  Description of Artificial Sequence: Synthetic oligonucleotide
  Target: ATXN1; (-) strand; PAM type: YTN; PAM sequence: TTC
cagcaaacaaatccgtaata

SEQ ID NO: 166526 - DNA, 20 bp, Artificial Sequence
  Description of Artificial Sequence: Synthetic oligonucleotide
  Target: ATXN1; (-) strand; PAM type: YTN; PAM sequence: CTC
caagtcattccagcaaacaa

SEQ ID NO: 166527 - DNA, 20 bp, Artificial Sequence
  Description of Artificial Sequence: Synthetic oligonucleotide
  Target: ATXN1; (-) strand; PAM type: YTN; PAM sequence: CTG
ccactccaagtcattccagc

SEQ ID NO: 166528 - DNA, 20 bp, Artificial Sequence
  Description of Artificial Sequence: Synthetic oligonucleotide
  Target: ATXN1; (-) strand; PAM type: YTN; PAM sequence: CTG
accccacctgccactccaag

SEQ ID NO: 166529 - DNA, 20 bp, Artificial Sequence
  Description of Artificial Sequence: Synthetic oligonucleotide
  Target: ATXN1; (-) strand; PAM type: YTN; PAM sequence: CTC
ctgaccccacctgccactcc

SEQ ID NO: 166530 - DNA, 20 bp, Artificial Sequence
  Description of Artificial Sequence: Synthetic oligonucleotide
  Target: ATXN1; (-) strand; PAM type: YTN; PAM sequence: CTC
actcctgaccccacctgcca

SEQ ID NO: 166531 - DNA, 20 bp, Artificial Sequence
  Description of Artificial Sequence: Synthetic oligonucleotide
  Target: ATXN1; (-) strand; PAM type: YTN; PAM sequence: CTA
actcactcctgaccccacct

SEQ ID NO: 166532 - DNA, 20 bp, Artificial Sequence
  Description of Artificial Sequence: Synthetic oligonucleotide
  Target: ATXN1; (-) strand; PAM type: YTN; PAM sequence: TTA
ctaactcactcctgacccca

SEQ ID NO: 166533 - DNA, 20 bp, Artificial Sequence
  Description of Artificial Sequence: Synthetic oligonucleotide
  Target: ATXN1; (-) strand; PAM type: YTN; PAM sequence: CTT
actaactcactcctgacccc

SEQ ID NO: 166534 - DNA, 20 bp, Artificial Sequence
  Description of Artificial Sequence: Synthetic oligonucleotide
  Target: ATXN1; (-) strand; PAM type: YTN; PAM sequence: CTG
gggatgaaacgaaatgctta

SEQ ID NO: 166535 - DNA, 20 bp, Artificial Sequence
  Description of Artificial Sequence: Synthetic oligonucleotide
  Target: ATXN1; (-) strand; PAM type: YTN; PAM sequence: TTA
ctggggatgaaacgaaatgc

SEQ ID NO: 166536 - DNA, 20 bp, Artificial Sequence
  Description of Artificial Sequence: Synthetic oligonucleotide
  Target: ATXN1; (-) strand; PAM type: YTN; PAM sequence: TTT
actggggatgaaacgaaatg

SEQ ID NO: 166537 - DNA, 20 bp, Artificial Sequence
  Description of Artificial Sequence: Synthetic oligonucleotide
  Target: ATXN1; (-) strand; PAM type: YTN; PAM sequence: CTT
tactggggatgaaacgaaat

SEQ ID NO: 166538 - DNA, 20 bp, Artificial Sequence
  Description of Artificial Sequence: Synthetic oligonucleotide
  Target: ATXN1; (-) strand; PAM type: YTN; PAM sequence: TTA
ccctttactggggatgaaac

SEQ ID NO: 166539 - DNA, 20 bp, Artificial Sequence
  Description of Artificial Sequence: Synthetic oligonucleotide
  Target: ATXN1; (-) strand; PAM type: YTN; PAM sequence: CTT
accctttactggggatgaaa

SEQ ID NO: 166540 - DNA, 20 bp, Artificial Sequence
  Description of Artificial Sequence: Synthetic oligonucleotide
  Target: ATXN1; (-) strand; PAM type: YTN; PAM sequence: TTC
aatcatcttaccctttactg

SEQ ID NO: 166541 - DNA, 20 bp, Artificial Sequence
  Description of Artificial Sequence: Synthetic oligonucleotide
  Target: ATXN1; (-) strand; PAM type: YTN; PAM sequence: CTG
attcaatcatcttacccttt

SEQ ID NO: 166542 - DNA, 20 bp, Artificial Sequence
  Description of Artificial Sequence: Synthetic oligonucleotide
  Target: ATXN1; (-) strand; PAM type: YTN; PAM sequence: CTG
actgattcaatcatcttacc

SEQ ID NO: 166543 - DNA, 20 bp, Artificial Sequence
  Description of Artificial Sequence: Synthetic oligonucleotide
  Target: ATXN1; (-) strand; PAM type: YTN; PAM sequence: CTC
agcagactgactgattcaat

SEQ ID NO: 166544 - DNA, 20 bp, Artificial Sequence
  Description of Artificial Sequence: Synthetic oligonucleotide
  Target: ATXN1; (-) strand; PAM type: YTN; PAM sequence: CTG
gccccatctcagcagactga

SEQ ID NO: 166545 - DNA, 20 bp, Artificial Sequence
  Description of Artificial Sequence: Synthetic oligonucleotide
  Target: ATXN1; (-) strand; PAM type: YTN; PAM sequence: CTC
tggccccatctcagcagact

SEQ ID NO: 166546 - DNA, 20 bp, Artificial Sequence
  Description of Artificial Sequence: Synthetic oligonucleotide
  Target: ATXN1; (-) strand; PAM type: YTN; PAM sequence: TTA
tcaggtaactctggccccat

SEQ ID NO: 166547 - DNA, 20 bp, Artificial Sequence
  Description of Artificial Sequence: Synthetic oligonucleotide
  Target: ATXN1; (-) strand; PAM type: YTN; PAM sequence: TTT
atcaggtaactctggcccca

SEQ ID NO: 166548 - DNA, 20 bp, Artificial Sequence
  Description of Artificial Sequence: Synthetic oligonucleotide
  Target: ATXN1; (-) strand; PAM type: YTN; PAM sequence: CTA
gtggcatggccccaatattt

SEQ ID NO: 166549 - DNA, 20 bp, Artificial Sequence
  Description of Artificial Sequence: Synthetic oligonucleotide
  Target: ATXN1; (-) strand; PAM type: YTN; PAM sequence: TTC
acctagtggcatggccccaa

SEQ ID NO: 166550 - DNA, 20 bp, Artificial Sequence
  Description of Artificial Sequence: Synthetic oligonucleotide
  Target: ATXN1; (-) strand; PAM type: YTN; PAM sequence: TTT
cacctagtggcatggcccca

SEQ ID NO: 166551 - DNA, 20 bp, Artificial Sequence
  Description of Artificial Sequence: Synthetic oligonucleotide
  Target: ATXN1; (-) strand; PAM type: YTN; PAM sequence: TTA
acgaaaagatttcacctagt

SEQ ID NO: 166552 - DNA, 20 bp, Artificial Sequence
  Description of Artificial Sequence: Synthetic oligonucleotide
  Target: ATXN1; (-) strand; PAM type: YTN; PAM sequence: CTT
aacgaaaagatttcacctag

SEQ ID NO: 166553 - DNA, 20 bp, Artificial Sequence
  Description of Artificial Sequence: Synthetic oligonucleotide
  Target: ATXN1; (-) strand; PAM type: YTN; PAM sequence: TTA
gagtcacttaacgaaaagat

SEQ ID NO: 166554 - DNA, 20 bp, Artificial Sequence
  Description of Artificial Sequence: Synthetic oligonucleotide
  Target: ATXN1; (-) strand; PAM type: YTN; PAM sequence: TTT
agagtcacttaacgaaaaga

SEQ ID NO: 166555 - DNA, 20 bp, Artificial Sequence
  Description of Artificial Sequence: Synthetic oligonucleotide
  Target: ATXN1; (-) strand; PAM type: YTN; PAM sequence: TTT
tagagtcacttaacgaaaag

SEQ ID NO: 166556 - DNA, 20 bp, Artificial Sequence
  Description of Artificial Sequence: Synthetic oligonucleotide
  Target: ATXN1; (-) strand; PAM type: YTN; PAM sequence: TTA
ttttagagtcacttaacgaa

SEQ ID NO: 166557 - DNA, 20 bp, Artificial Sequence
  Description of Artificial Sequence: Synthetic oligonucleotide
  Target: ATXN1; (-) strand; PAM type: YTN; PAM sequence: TTT
attttagagtcacttaacga

SEQ ID NO: 166558 - DNA, 20 bp, Artificial Sequence
  Description of Artificial Sequence: Synthetic oligonucleotide
  Target: ATXN1; (-) strand; PAM type: YTN; PAM sequence: TTT
tattttagagtcacttaacg

SEQ ID NO: 166559 - DNA, 20 bp, Artificial Sequence
  Description of Artificial Sequence: Synthetic oligonucleotide
  Target: ATXN1; (-) strand; PAM type: YTN; PAM sequence: TTG
ggattttattttagagtcac

SEQ ID NO: 166560 - DNA, 20 bp, Artificial Sequence
  Description of Artificial Sequence: Synthetic oligonucleotide
  Target: ATXN1; (-) strand; PAM type: YTN; PAM sequence: TTA
ggttgggattttattttaga

SEQ ID NO: 166561 - DNA, 20 bp, Artificial Sequence
  Description of Artificial Sequence: Synthetic oligonucleotide
  Target: ATXN1; (-) strand; PAM type: YTN; PAM sequence: TTT
aggttgggattttattttag

SEQ ID NO: 166562 - DNA, 20 bp, Artificial Sequence
  Description of Artificial Sequence: Synthetic oligonucleotide
  Target: ATXN1; (-) strand; PAM type: YTN; PAM sequence: TTT
taggttgggattttatttta

SEQ ID NO: 166563 - DNA, 20 bp, Artificial Sequence
  Description of Artificial Sequence: Synthetic oligonucleotide
  Target: ATXN1; (-) strand; PAM type: YTN; PAM sequence: CTC
agcaattttaggttgggatt

SEQ ID NO: 166564 - DNA, 20 bp, Artificial Sequence
  Description of Artificial Sequence: Synthetic oligonucleotide
  Target: ATXN1; (-) strand; PAM type: YTN; PAM sequence: CTG
actcagcaattttaggttgg

SEQ ID NO: 166565 - DNA, 20 bp, Artificial Sequence
  Description of Artificial Sequence: Synthetic oligonucleotide
  Target: ATXN1; (-) strand; PAM type: YTN; PAM sequence: TTC
ccactgactcagcaatttta

SEQ ID NO: 166566 - DNA, 20 bp, Artificial Sequence
  Description of Artificial Sequence: Synthetic oligonucleotide
  Target: ATXN1; (-) strand; PAM type: YTN; PAM sequence: CTG
agaaattcccactgactcag

SEQ ID NO: 166567 - DNA, 20 bp, Artificial Sequence
  Description of Artificial Sequence: Synthetic oligonucleotide
  Target: ATXN1; (-) strand; PAM type: YTN; PAM sequence: TTC
cctgagaaattcccactgac

SEQ ID NO: 166568 - DNA, 20 bp, Artificial Sequence
  Description of Artificial Sequence: Synthetic oligonucleotide
  Target: ATXN1; (-) strand; PAM type: YTN; PAM sequence: CTA
gagccagcggaacatggatt

SEQ ID NO: 166569 - DNA, 20 bp, Artificial Sequence
  Description of Artificial Sequence: Synthetic oligonucleotide
  Target: ATXN1; (-) strand; PAM type: YTN; PAM sequence: TTC
tagagccagcggaacatgga

SEQ ID NO: 166570 - DNA, 20 bp, Artificial Sequence
  Description of Artificial Sequence: Synthetic oligonucleotide
  Target: ATXN1; (-) strand; PAM type: YTN; PAM sequence: TTT
ctagagccagcggaacatgg

SEQ ID NO: 166571 - DNA, 20 bp, Artificial Sequence
  Description of Artificial Sequence: Synthetic oligonucleotide
  Target: ATXN1; (-) strand; PAM type: YTN; PAM sequence: CTC
ataatcaaaatcatttctag

SEQ ID NO: 166572 - DNA, 20 bp, Artificial Sequence
  Description of Artificial Sequence: Synthetic oligonucleotide
  Target: ATXN1; (-) strand; PAM type: YTN; PAM sequence: TTG
tctcataatcaaaatcattt

SEQ ID NO: 166573 - DNA, 20 bp, Artificial Sequence
  Description of Artificial Sequence: Synthetic oligonucleotide
  Target: ATXN1; (-) strand; PAM type: YTN; PAM sequence: CTT
gtctcataatcaaaatcatt

SEQ ID NO: 166574 - DNA, 20 bp, Artificial Sequence
  Description of Artificial Sequence: Synthetic oligonucleotide
  Target: ATXN1; (-) strand; PAM type: YTN; PAM sequence: CTG
ccaaaataccttgtctcata

SEQ ID NO: 166575 - DNA, 20 bp, Artificial Sequence
  Description of Artificial Sequence: Synthetic oligonucleotide
  Target: ATXN1; (-) strand; PAM type: YTN; PAM sequence: CTG
ctgccaaaataccttgtctc

SEQ ID NO: 166576 - DNA, 20 bp, Artificial Sequence
  Description of Artificial Sequence: Synthetic oligonucleotide
  Target: ATXN1; (-) strand; PAM type: YTN; PAM sequence: CTG
aacatggtaaataaaagcca

SEQ ID NO: 166577 - DNA, 20 bp, Artificial Sequence
  Description of Artificial Sequence: Synthetic oligonucleotide
  Target: ATXN1; (-) strand; PAM type: YTN; PAM sequence: TTC
tgaacatggtaaataaaagc

SEQ ID NO: 166578 - DNA, 20 bp, Artificial Sequence
  Description of Artificial Sequence: Synthetic oligonucleotide
  Target: ATXN1; (-) strand; PAM type: YTN; PAM sequence: TTC
aagttctgaacatggtaaat

SEQ ID NO: 166579 - DNA, 20 bp, Artificial Sequence
  Description of Artificial Sequence: Synthetic oligonucleotide
  Target: ATXN1; (-) strand; PAM type: YTN; PAM sequence: TTT
caagttctgaacatggtaaa

SEQ ID NO: 166580 - DNA, 20 bp, Artificial Sequence
  Description of Artificial Sequence: Synthetic oligonucleotide
  Target: ATXN1; (-) strand; PAM type: YTN; PAM sequence: CTT
tcaagttctgaacatggtaa

SEQ ID NO: 166581 - DNA, 20 bp, Artificial Sequence
  Description of Artificial Sequence: Synthetic oligonucleotide
  Target: ATXN1; (-) strand; PAM type: YTN; PAM sequence: CTG
gacactttcaagttctgaac

SEQ ID NO: 166582 - DNA, 20 bp, Artificial Sequence
  Description of Artificial Sequence: Synthetic oligonucleotide
  Target: ATXN1; (-) strand; PAM type: YTN; PAM sequence: TTA
atgaactggacactttcaag

SEQ ID NO: 166583 - DNA, 20 bp, Artificial Sequence
  Description of Artificial Sequence: Synthetic oligonucleotide
  Target: ATXN1; (-) strand; PAM type: YTN; PAM sequence: CTT
aatgaactggacactttcaa

SEQ ID NO: 166584 - DNA, 20 bp, Artificial Sequence
  Description of Artificial Sequence: Synthetic oligonucleotide
  Target: ATXN1; (-) strand; PAM type: YTN; PAM sequence: TTG
aacttaatgaactggacact

SEQ ID NO: 166585 - DNA, 20 bp, Artificial Sequence
  Description of Artificial Sequence: Synthetic oligonucleotide
  Target: ATXN1; (-) strand; PAM type: YTN; PAM sequence: CTT
gaacttaatgaactggacac

SEQ ID NO: 166586 - DNA, 20 bp, Artificial Sequence
  Description of Artificial Sequence: Synthetic oligonucleotide
  Target: ATXN1; (-) strand; PAM type: YTN; PAM sequence: CTC
ttgaacttaatgaactggac

SEQ ID NO: 166587 - DNA, 20 bp, Artificial Sequence
  Description of Artificial Sequence: Synthetic oligonucleotide
  Target: ATXN1; (-) strand; PAM type: YTN; PAM sequence: CTC
cagctcttgaacttaatgaa

SEQ ID NO: 166588 - DNA, 20 bp, Artificial Sequence
  Description of Artificial Sequence: Synthetic oligonucleotide
  Target: ATXN1; (-) strand; PAM type: YTN; PAM sequence: TTA
agcgactccagctcttgaac

SEQ ID NO: 166589 - DNA, 20 bp, Artificial Sequence
  Description of Artificial Sequence: Synthetic oligonucleotide
  Target: ATXN1; (-) strand; PAM type: YTN; PAM sequence: TTT
aagcgactccagctcttgaa

SEQ ID NO: 166590 - DNA, 20 bp, Artificial Sequence
  Description of Artificial Sequence: Synthetic oligonucleotide
  Target: ATXN1; (-) strand; PAM type: YTN; PAM sequence: CTT
taagcgactccagctcttga

SEQ ID NO: 166591 - DNA, 20 bp, Artificial Sequence
  Description of Artificial Sequence: Synthetic oligonucleotide
  Target: ATXN1; (-) strand; PAM type: YTN; PAM sequence: CTA
cctttaagcgactccagctc

SEQ ID NO: 166592 - DNA, 20 bp, Artificial Sequence
  Description of Artificial Sequence: Synthetic oligonucleotide
  Target: ATXN1; (-) strand; PAM type: YTN; PAM sequence: TTC
agggtctacctttaagcgac

SEQ ID NO: 166593 - DNA, 20 bp, Artificial Sequence
  Description of Artificial Sequence: Synthetic oligonucleotide
  Target: ATXN1; (-) strand; PAM type: YTN; PAM sequence: TTA
aggcatcattcagggtctac

SEQ ID NO: 166594 - DNA, 20 bp, Artificial Sequence
  Description of Artificial Sequence: Synthetic oligonucleotide
  Target: ATXN1; (-) strand; PAM type: YTN; PAM sequence: CTT
aaggcatcattcagggtcta

SEQ ID NO: 166595 - DNA, 20 bp, Artificial Sequence
  Description of Artificial Sequence: Synthetic oligonucleotide
  Target: ATXN1; (-) strand; PAM type: YTN; PAM sequence: TTA
gtgtaatgaaaatacagtgg

SEQ ID NO: 166596 - DNA, 20 bp, Artificial Sequence
  Description of Artificial Sequence: Synthetic oligonucleotide
  Target: ATXN1; (-) strand; PAM type: YTN; PAM sequence: TTT
agtgtaatgaaaatacagtg

SEQ ID NO: 166597 - DNA, 20 bp, Artificial Sequence
  Description of Artificial Sequence: Synthetic oligonucleotide
  Target: ATXN1; (-) strand; PAM type: YTN; PAM sequence: CTA
agtgccatggtttagtgtaa

SEQ ID NO: 166598 - DNA, 20 bp, Artificial Sequence
  Description of Artificial Sequence: Synthetic oligonucleotide
  Target: ATXN1; (-) strand; PAM type: YTN; PAM sequence: CTG
cctaagtgccatggtttagt

SEQ ID NO: 166599 - DNA, 20 bp, Artificial Sequence
  Description of Artificial Sequence: Synthetic oligonucleotide
  Target: ATXN1; (-) strand; PAM type: YTN; PAM sequence: CTG
gctgcctaagtgccatggtt

SEQ ID NO: 166600 - DNA, 20 bp, Artificial Sequence
  Description of Artificial Sequence: Synthetic oligonucleotide
  Target: ATXN1; (-) strand; PAM type: YTN; PAM sequence: TTA
ctggctgcctaagtgccatg

SEQ ID NO: 166601 - DNA, 20 bp, Artificial Sequence
  Description of Artificial Sequence: Synthetic oligonucleotide
  Target: ATXN1; (-) strand; PAM type: YTN; PAM sequence: TTT
actggctgcctaagtgccat

SEQ ID NO: 166602 - DNA, 20 bp, Artificial Sequence
  Description of Artificial Sequence: Synthetic oligonucleotide
  Target: ATXN1; (-) strand; PAM type: YTN; PAM sequence: CTT
tactggctgcctaagtgcca

SEQ ID NO: 166603 - DNA, 20 bp, Artificial Sequence
  Description of Artificial Sequence: Synthetic oligonucleotide
  Target: ATXN1; (-) strand; PAM type: YTN; PAM sequence: CTC
cagctttactggctgcctaa

SEQ ID NO: 166604 - DNA, 20 bp, Artificial Sequence
  Description of Artificial Sequence: Synthetic oligonucleotide
  Target: ATXN1; (-) strand; PAM type: YTN; PAM sequence: CTG
actccagctttactggctgc

SEQ ID NO: 166605 - DNA, 20 bp, Artificial Sequence
  Description of Artificial Sequence: Synthetic oligonucleotide
  Target: ATXN1; (-) strand; PAM type: YTN; PAM sequence: TTC
tgactccagctttactggct

SEQ ID NO: 166606 - DNA, 20 bp, Artificial Sequence
  Description of Artificial Sequence: Synthetic oligonucleotide
  Target: ATXN1; (-) strand; PAM type: YTN; PAM sequence: CTG
aatcagagttctgactccag

SEQ ID NO: 166607 - DNA, 20 bp, Artificial Sequence
  Description of Artificial Sequence: Synthetic oligonucleotide
  Target: ATXN1; (-) strand; PAM type: YTN; PAM sequence: CTC
tgaatcagagttctgactcc

SEQ ID NO: 166608 - DNA, 20 bp, Artificial Sequence
  Description of Artificial Sequence: Synthetic oligonucleotide
  Target: ATXN1; (-) strand; PAM type: YTN; PAM sequence: CTG
taaatgaggtgctctgaatc

SEQ ID NO: 166609 - DNA, 20 bp, Artificial Sequence
  Description of Artificial Sequence: Synthetic oligonucleotide
  Target: ATXN1; (-) strand; PAM type: YTN; PAM sequence: TTC
tgtaaatgaggtgctctgaa

SEQ ID NO: 166610 - DNA, 20 bp, Artificial Sequence
  Description of Artificial Sequence: Synthetic oligonucleotide
  Target: ATXN1; (-) strand; PAM type: YTN; PAM sequence: TTT
ctgtaaatgaggtgctctga

SEQ ID NO: 166611 - DNA, 20 bp, Artificial Sequence
  Description of Artificial Sequence: Synthetic oligonucleotide
  Target: ATXN1; (-) strand; PAM type: YTN; PAM sequence: TTT
tctgtaaatgaggtgctctg

SEQ ID NO: 166612 - DNA, 20 bp, Artificial Sequence
  Description of Artificial Sequence: Synthetic oligonucleotide
  Target: ATXN1; (-) strand; PAM type: YTN; PAM sequence: TTA
ttttctgtaaatgaggtgct

SEQ ID NO: 166613 - DNA, 20 bp, Artificial Sequence
  Description of Artificial Sequence: Synthetic oligonucleotide
  Target: ATXN1; (-) strand; PAM type: YTN; PAM sequence: TTG
gggaattattttctgtaaat

SEQ ID NO: 166614 - DNA, 20 bp, Artificial Sequence
  Description of Artificial Sequence: Synthetic oligonucleotide
  Target: ATXN1; (-) strand; PAM type: YTN; PAM sequence: TTT
ggggaattattttctgtaaa

SEQ ID NO: 166615 - DNA, 20 bp, Artificial Sequence
  Description of Artificial Sequence: Synthetic oligonucleotide
  Target: ATXN1; (-) strand; PAM type: YTN; PAM sequence: TTC
agtttggggaattattttct

SEQ ID NO: 166616 - DNA, 20 bp, Artificial Sequence
  Description of Artificial Sequence: Synthetic oligonucleotide
  Target: ATXN1; (-) strand; PAM type: YTN; PAM sequence: TTC
aggcaattcagtttggggaa

SEQ ID NO: 166617 - DNA, 20 bp, Artificial Sequence
  Description of Artificial Sequence: Synthetic oligonucleotide
  Target: ATXN1; (-) strand; PAM type: YTN; PAM sequence: TTA
gtcaaattcaggcaattcag

SEQ ID NO: 166618 - DNA, 20 bp, Artificial Sequence
  Description of Artificial Sequence: Synthetic oligonucleotide
  Target: ATXN1; (-) strand; PAM type: YTN; PAM sequence: CTT
agtcaaattcaggcaattca

SEQ ID NO: 166619 - DNA, 20 bp, Artificial Sequence
  Description of Artificial Sequence: Synthetic oligonucleotide
  Target: ATXN1; (-) strand; PAM type: YTN; PAM sequence: CTA
tacttagtcaaattcaggca

SEQ ID NO: 166620 - DNA, 20 bp, Artificial Sequence
  Description of Artificial Sequence: Synthetic oligonucleotide
  Target: ATXN1; (-) strand; PAM type: YTN; PAM sequence: TTA
aaatggtgccctatacttag

SEQ ID NO: 166621 - DNA, 20 bp, Artificial Sequence
  Description of Artificial Sequence: Synthetic oligonucleotide
  Target: ATXN1; (-) strand; PAM type: YTN; PAM sequence: TTT
aaaatggtgccctatactta

SEQ ID NO: 166622 - DNA, 20 bp, Artificial Sequence
  Description of Artificial Sequence: Synthetic oligonucleotide
  Target: ATXN1; (-) strand; PAM type: YTN; PAM sequence: TTT
taaaatggtgccctatactt

SEQ ID NO: 166623 - DNA, 20 bp, Artificial Sequence
  Description of Artificial Sequence: Synthetic oligonucleotide
  Target: ATXN1; (-) strand; PAM type: YTN; PAM sequence: TTT
ttaaaatggtgccctatact

SEQ ID NO: 166624 - DNA, 20 bp, Artificial Sequence
  Description of Artificial Sequence: Synthetic oligonucleotide
  Target: ATXN1; (-) strand; PAM type: YTN; PAM sequence: CTC
agcatgaagccatttttaaa

SEQ ID NO: 166625 - DNA, 20 bp, Artificial Sequence
  Description of Artificial Sequence: Synthetic oligonucleotide
  Target: ATXN1; (-) strand; PAM type: YTN; PAM sequence: CTA
gaacctcagcatgaagccat

SEQ ID NO: 166626 - DNA, 20 bp, Artificial Sequence
  Description of Artificial Sequence: Synthetic oligonucleotide
  Target: ATXN1; (-) strand; PAM type: YTN; PAM sequence: CTC
caaaaaaaaaaaatctagaa

SEQ ID NO: 166627 - DNA, 20 bp, Artificial Sequence
  Description of Artificial Sequence: Synthetic oligonucleotide
  Target: ATXN1; (-) strand; PAM type: YTN; PAM sequence: CTC
catctccaaaaaaaaaaaat

SEQ ID NO: 166628 - DNA, 20 bp, Artificial Sequence
  Description of Artificial Sequence: Synthetic oligonucleotide
  Target: ATXN1; (-) strand; PAM type: YTN; PAM sequence: CTG
gcgacagaacgagcctccat

SEQ ID NO: 166629 - DNA, 20 bp, Artificial Sequence
  Description of Artificial Sequence: Synthetic oligonucleotide
  Target: ATXN1; (-) strand; PAM type: YTN; PAM sequence: CTC
cagcctggcgacagaacgag

SEQ ID NO: 166630 - DNA, 20 bp, Artificial Sequence
  Description of Artificial Sequence: Synthetic oligonucleotide
  Target: ATXN1; (-) strand; PAM type: YTN; PAM sequence: CTG
cactccagcctggcgacaga

SEQ ID NO: 166631 - DNA, 20 bp, Artificial Sequence
  Description of Artificial Sequence: Synthetic oligonucleotide
  Target: ATXN1; (-) strand; PAM type: YTN; PAM sequence: CTG
agatcgcgccactgcactcc

SEQ ID NO: 166632 - DNA, 20 bp, Artificial Sequence
  Description of Artificial Sequence: Synthetic oligonucleotide
  Target: ATXN1; (-) strand; PAM type: YTN; PAM sequence: TTG
cagtgagctgagatcgcgcc

SEQ ID NO: 166633 - DNA, 20 bp, Artificial Sequence
  Description of Artificial Sequence: Synthetic oligonucleotide
  Target: ATXN1; (-) strand; PAM type: YTN; PAM sequence: CTT
gcagtgagctgagatcgcgc

SEQ ID NO: 166634 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatggtgtgaa

SEQ ID NO: 166635 - DNA, 20 bp, Artificial Sequence
  Description of Artificial Sequence: Synthetic oligonucleotide
  Target: ATXN1; (-) strand; PAM type: YTN; PAM sequence: CTC
gggaggctgaggcaggagaa

SEQ ID NO: 166636 - DNA, 20 bp, Artificial Sequence
  Description of Artificial Sequence: Synthetic oligonucleotide
  Target: ATXN1; (-) strand; PAM type: YTN; PAM sequence: CTG
tagtcccagatactcgggag

SEQ ID NO: 166637 - DNA, 20 bp, Artificial Sequence
  Description of Artificial Sequence: Synthetic oligonucleotide
  Target: ATXN1; (-) strand; PAM type: YTN; PAM sequence: TTA
gccaggcgtggtggcgggtg

SEQ ID NO: 166638 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaaattagcca

SEQ ID NO: 166639 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaaattag

SEQ ID NO: 166640 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaaatt

SEQ ID NO: 166641 - DNA, 20 bp, Artificial Sequence
  Description of Artificial Sequence: Synthetic oligonucleotide
  Target: ATXN1; (-) strand; PAM type: YTN; PAM sequence: CTA
tctctactaaaaatacaaaa

SEQ ID NO: 166642 - DNA, 20 bp, Artificial Sequence
  Description of Artificial Sequence: Synthetic oligonucleotide
  Target: ATXN1; (-) strand; PAM type: YTN; PAM sequence: CTA
acacagtgaaaccctatctc

SEQ ID NO: 166643 - DNA, 20 bp, Artificial Sequence
  Description of Artificial Sequence: Synthetic oligonucleotide
  Target: ATXN1; (-) strand; PAM type: YTN; PAM sequence: CTG
gctaacacagtgaaacccta

SEQ ID NO: 166644 - DNA, 20 bp, Artificial Sequence
  Description of Artificial Sequence: Synthetic oligonucleotide
  Target: ATXN1; (-) strand; PAM type: YTN; PAM sequence: CTG
aggcgggcagatcacgaggt

SEQ ID NO: 166645 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcgggcagat

SEQ ID NO: 166646 - DNA, 20 bp, Artificial Sequence
  Description of Artificial Sequence: Synthetic oligonucleotide
  Target: ATXN1; (-) strand; PAM type: YTN; PAM sequence: CTG
taatcccagcacattgggag

SEQ ID NO: 166647 - DNA, 20 bp, Artificial Sequence
  Description of Artificial Sequence: Synthetic oligonucleotide
  Target: ATXN1; (-) strand; PAM type: YTN; PAM sequence: CTC
atgcctgtaatcccagcaca

SEQ ID NO: 166648 - DNA, 20 bp, Artificial Sequence
  Description of Artificial Sequence: Synthetic oligonucleotide
  Target: ATXN1; (-) strand; PAM type: YTN; PAM sequence: CTG
ggtgcggtggctcatgcctg

SEQ ID NO: 166649 - DNA, 20 bp, Artificial Sequence
  Description of Artificial Sequence: Synthetic oligonucleotide
  Target: ATXN1; (-) strand; PAM type: YTN; PAM sequence: CTG
gctgggtgcggtggctcatg

SEQ ID NO: 166650 - DNA, 20 bp, Artificial Sequence
  Description of Artificial Sequence: Synthetic oligonucleotide
  Target: ATXN1; (-) strand; PAM type: YTN; PAM sequence: CTA
gaactggctgggtgcggtgg

SEQ ID NO: 166651 - DNA, 20 bp, Artificial Sequence
  Description of Artificial Sequence: Synthetic oligonucleotide
  Target: ATXN1; (-) strand; PAM type: YTN; PAM sequence: CTC
aaaatatctagaactggctg

SEQ ID NO: 166652 - DNA, 20 bp, Artificial Sequence
  Description of Artificial Sequence: Synthetic oligonucleotide
  Target: ATXN1; (-) strand; PAM type: YTN; PAM sequence: TTA
ccacctcaaaatatctagaa

SEQ ID NO: 166653 - DNA, 20 bp, Artificial Sequence
  Description of Artificial Sequence: Synthetic oligonucleotide
  Target: ATXN1; (-) strand; PAM type: YTN; PAM sequence: CTT
accacctcaaaatatctaga

SEQ ID NO: 166654 - DNA, 20 bp, Artificial Sequence
  Description of Artificial Sequence: Synthetic oligonucleotide
  Target: ATXN1; (-) strand; PAM type: YTN; PAM sequence: TTC
ttaccacctcaaaatatcta

SEQ ID NO: 166655 - DNA, 20 bp, Artificial Sequence
  Description of Artificial Sequence: Synthetic oligonucleotide
  Target: ATXN1; (-) strand; PAM type: YTN; PAM sequence: TTA
ttcttaccacctcaaaatat

SEQ ID NO: 166656 - DNA, 20 bp, Artificial Sequence
  Description of Artificial Sequence: Synthetic oligonucleotide
  Target: ATXN1; (-) strand; PAM type: YTN; PAM sequence: CTT
attcttaccacctcaaaata

SEQ ID NO: 166657 - DNA, 20 bp, Artificial Sequence
  Description of Artificial Sequence: Synthetic oligonucleotide
  Target: ATXN1; (-) strand; PAM type: YTN; PAM sequence: TTG
agcagtaggggaaccatacc

SEQ ID NO: 166658 - DNA, 20 bp, Artificial Sequence
  Description of Artificial Sequence: Synthetic oligonucleotide
  Target: ATXN1; (-) strand; PAM type: YTN; PAM sequence: CTT
gagcagtaggggaaccatac

SEQ ID NO: 166659 - DNA, 20 bp, Artificial Sequence
  Description of Artificial Sequence: Synthetic oligonucleotide
  Target: ATXN1; (-) strand; PAM type: YTN; PAM sequence: CTG
gcacatgagaaacaagtatc

SEQ ID NO: 166660 - DNA, 20 bp, Artificial Sequence
  Description of Artificial Sequence: Synthetic oligonucleotide
  Target: ATXN1; (-) strand; PAM type: YTN; PAM sequence: CTG
ggtccctggcacatgagaaa

SEQ ID NO: 166661 - DNA, 20 bp, Artificial Sequence
  Description of Artificial Sequence: Synthetic oligonucleotide
  Target: ATXN1; (-) strand; PAM type: YTN; PAM sequence: CTC
aatgcctgggtccctggcac

SEQ ID NO: 166662 - DNA, 20 bp, Artificial Sequence
  Description of Artificial Sequence: Synthetic oligonucleotide
  Target: ATXN1; (-) strand; PAM type: YTN; PAM sequence: TTG
ggctcaatgcctgggtccct

SEQ ID NO: 166663 - DNA, 20 bp, Artificial Sequence
  Description of Artificial Sequence: Synthetic oligonucleotide
  Target: ATXN1; (-) strand; PAM type: YTN; PAM sequence: CTA
ttgggctcaatgcctgggtc

SEQ ID NO: 166664 - DNA, 20 bp, Artificial Sequence
  Description of Artificial Sequence: Synthetic oligonucleotide
  Target: ATXN1; (-) strand; PAM type: YTN; PAM sequence: TTC
tattgggctcaatgcctggg

SEQ ID NO: 166665 - DNA, 20 bp, Artificial Sequence
  Description of Artificial Sequence: Synthetic oligonucleotide
  Target: ATXN1; (-) strand; PAM type: YTN; PAM sequence: TTT
ctattgggctcaatgcctgg

SEQ ID NO: 166666 - DNA, 20 bp, Artificial Sequence
  Description of Artificial Sequence: Synthetic oligonucleotide
  Target: ATXN1; (-) strand; PAM type: YTN; PAM sequence: CTT
tctattgggctcaatgcctg

SEQ ID NO: 166667 - DNA, 20 bp, Artificial Sequence
  Description of Artificial Sequence: Synthetic oligonucleotide
  Target: ATXN1; (-) strand; PAM type: YTN; PAM sequence: CTA
tggctttctattgggctcaa

SEQ ID NO: 166668 - DNA, 20 bp, Artificial Sequence
  Description of Artificial Sequence: Synthetic oligonucleotide
  Target: ATXN1; (-) strand; PAM type: YTN; PAM sequence: TTC
tatggctttctattgggctc

SEQ ID NO: 166669 - DNA, 20 bp, Artificial Sequence
  Description of Artificial Sequence: Synthetic oligonucleotide
  Target: ATXN1; (-) strand; PAM type: YTN; PAM sequence: TTT
ctatggctttctattgggct

SEQ ID NO: 166670 - DNA, 20 bp, Artificial Sequence
  Description of Artificial Sequence: Synthetic oligonucleotide
  Target: ATXN1; (-) strand; PAM type: YTN; PAM sequence: TTA
tttctatggctttctattgg

SEQ ID NO: 166671 - DNA, 20 bp, Artificial Sequence
  Description of Artificial Sequence: Synthetic oligonucleotide
  Target: ATXN1; (-) strand; PAM type: YTN; PAM sequence: CTT
atttctatggctttctattg

SEQ ID NO: 166672 - DNA, 20 bp, Artificial Sequence
  Description of Artificial Sequence: Synthetic oligonucleotide
  Target: ATXN1; (-) strand; PAM type: YTN; PAM sequence: TTC
atgaatagcatcacatccag

SEQ ID NO: 166673 - DNA, 20 bp, Artificial Sequence
  Description of Artificial Sequence: Synthetic oligonucleotide
  Target: ATXN1; (-) strand; PAM type: YTN; PAM sequence: CTG
tgacattcatgaatagcatc

SEQ ID NO: 166674 - DNA, 20 bp, Artificial Sequence
  Description of Artificial Sequence: Synthetic oligonucleotide
  Target: ATXN1; (-) strand; PAM type: YTN; PAM sequence: TTA
aggagactgtgacattcatg

SEQ ID NO: 166675 - DNA, 20 bp, Artificial Sequence
  Description of Artificial Sequence: Synthetic oligonucleotide
  Target: ATXN1; (-) strand; PAM type: YTN; PAM sequence: TTT
aaggagactgtgacattcat

SEQ ID NO: 166676 - DNA, 20 bp, Artificial Sequence
  Description of Artificial Sequence: Synthetic oligonucleotide
  Target: ATXN1; (-) strand; PAM type: YTN; PAM sequence: TTA
ataaaatggggtttaaggag

SEQ ID NO: 166677 - DNA, 20 bp, Artificial Sequence
  Description of Artificial Sequence: Synthetic oligonucleotide
  Target: ATXN1; (-) strand; PAM type: YTN; PAM sequence: TTT
aataaaatggggtttaagga

SEQ ID NO: 166678 - DNA, 20 bp, Artificial Sequence
  Description of Artificial Sequence: Synthetic oligonucleotide
  Target: ATXN1; (-) strand; PAM type: YTN; PAM sequence: CTG
aacagtttaataaaatgggg

SEQ ID NO: 166679 - DNA, 20 bp, Artificial Sequence
  Description of Artificial Sequence: Synthetic oligonucleotide
  Target: ATXN1; (-) strand; PAM type: YTN; PAM sequence: CTG
aacgagtggatccctgaaca

SEQ ID NO: 166680 - DNA, 20 bp, Artificial Sequence
  Description of Artificial Sequence: Synthetic oligonucleotide
  Target: ATXN1; (-) strand; PAM type: YTN; PAM sequence: TTG
aataatctgaacgagtggat

SEQ ID NO: 166681 - DNA, 20 bp, Artificial Sequence
  Description of Artificial Sequence: Synthetic oligonucleotide
  Target: ATXN1; (-) strand; PAM type: YTN; PAM sequence: CTG
gcacgtaaatgttgaataat

SEQ ID NO: 166682 - DNA, 20 bp, Artificial Sequence
  Description of Artificial Sequence: Synthetic oligonucleotide
  Target: ATXN1; (-) strand; PAM type: YTN; PAM sequence: TTC
atatcccaccaccatgatgt

SEQ ID NO: 166683 - DNA, 20 bp, Artificial Sequence
  Description of Artificial Sequence: Synthetic oligonucleotide
  Target: ATXN1; (-) strand; PAM type: YTN; PAM sequence: CTT
catatcccaccaccatgatg

SEQ ID NO: 166684 - DNA, 20 bp, Artificial Sequence
  Description of Artificial Sequence: Synthetic oligonucleotide
  Target: ATXN1; (-) strand; PAM type: YTN; PAM sequence: TTA
cttcatatcccaccaccatg

SEQ ID NO: 166685 - DNA, 20 bp, Artificial Sequence
  Description of Artificial Sequence: Synthetic oligonucleotide
  Target: ATXN1; (-) strand; PAM type: YTN; PAM sequence: TTT
acttcatatcccaccaccat

SEQ ID NO: 166686 - DNA, 20 bp, Artificial Sequence
  Description of Artificial Sequence: Synthetic oligonucleotide
  Target: ATXN1; (-) strand; PAM type: YTN; PAM sequence: TTT
tacttcatatcccaccacca

SEQ ID NO: 166687 - DNA, 20 bp, Artificial Sequence
  Description of Artificial Sequence: Synthetic oligonucleotide
  Target: ATXN1; (-) strand; PAM type: YTN; PAM sequence: TTG
aaggagacaaggcaccaagt

SEQ ID NO: 166688 - DNA, 20 bp, Artificial Sequence
  Description of Artificial Sequence: Synthetic oligonucleotide
  Target: ATXN1; (-) strand; PAM type: YTN; PAM sequence: CTT
gaaggagacaaggcaccaag

SEQ ID NO: 166689 - DNA, 20 bp, Artificial Sequence
  Description of Artificial Sequence: Synthetic oligonucleotide
  Target: ATXN1; (-) strand; PAM type: YTN; PAM sequence: CTC
cttgaaggagacaaggcacc

SEQ ID NO: 166690 - DNA, 20 bp, Artificial Sequence
  Description of Artificial Sequence: Synthetic oligonucleotide
  Target: ATXN1; (-) strand; PAM type: YTN; PAM sequence: CTG
gaagctccttgaaggagaca

SEQ ID NO: 166691 - DNA, 20 bp, Artificial Sequence
  Description of Artificial Sequence: Synthetic oligonucleotide
  Target: ATXN1; (-) strand; PAM type: YTN; PAM sequence: TTG
tggactggaagctccttgaa

SEQ ID NO: 166692 - DNA, 20 bp, Artificial Sequence
  Description of Artificial Sequence: Synthetic oligonucleotide
  Target: ATXN1; (-) strand; PAM type: YTN; PAM sequence: CTT
gtggactggaagctccttga

SEQ ID NO: 166693 - DNA, 20 bp, Artificial Sequence
  Description of Artificial Sequence: Synthetic oligonucleotide
  Target: ATXN1; (-) strand; PAM type: YTN; PAM sequence: TTA
gccccttgtggactggaagc

SEQ ID NO: 166694 - DNA, 20 bp, Artificial Sequence
  Description of Artificial Sequence: Synthetic oligonucleotide
  Target: ATXN1; (-) strand; PAM type: YTN; PAM sequence: CTG
ttagccccttgtggactgga

SEQ ID NO: 166695 - DNA, 20 bp, Artificial Sequence
  Description of Artificial Sequence: Synthetic oligonucleotide
  Target: ATXN1; (-) strand; PAM type: YTN; PAM sequence: TTC
cctgttagccccttgtggac

SEQ ID NO: 166696 - DNA, 20 bp, Artificial Sequence
  Description of Artificial Sequence: Synthetic oligonucleotide
  Target: ATXN1; (-) strand; PAM type: YTN; PAM sequence: TTT
ccctgttagccccttgtgga

SEQ ID NO: 166697 - DNA, 20 bp, Artificial Sequence
  Description of Artificial Sequence: Synthetic oligonucleotide
  Target: ATXN1; (-) strand; PAM type: YTN; PAM sequence: CTC
atttccctgttagccccttg

SEQ ID NO: 166698 - DNA, 20 bp, Artificial Sequence
  Description of Artificial Sequence: Synthetic oligonucleotide
  Target: ATXN1; (-) strand; PAM type: YTN; PAM sequence: CTG
tagtcaccactcatttccct

SEQ ID NO: 166699 - DNA, 20 bp, Artificial Sequence
  Description of Artificial Sequence: Synthetic oligonucleotide
  Target: ATXN1; (-) strand; PAM type: YTN; PAM sequence: TTA
gctgtagtcaccactcattt

SEQ ID NO: 166700 - DNA, 20 bp, Artificial Sequence
  Description of Artificial Sequence: Synthetic oligonucleotide
  Target: ATXN1; (-) strand; PAM type: YTN; PAM sequence: TTT
agctgtagtcaccactcatt

SEQ ID NO: 166701 - DNA, 20 bp, Artificial Sequence
  Description of Artificial Sequence: Synthetic oligonucleotide
  Target: ATXN1; (-) strand; PAM type: YTN; PAM sequence: TTT
tagctgtagtcaccactcat

SEQ ID NO: 166702 - DNA, 20 bp, Artificial Sequence
  Description of Artificial Sequence: Synthetic oligonucleotide
  Target: ATXN1; (-) strand; PAM type: YTN; PAM sequence: CTT
ttagctgtagtcaccactca

SEQ ID NO: 166703 - DNA, 20 bp, Artificial Sequence
  Description of Artificial Sequence: Synthetic oligonucleotide
  Target: ATXN1; (-) strand; PAM type: YTN; PAM sequence: CTG
ccttttagctgtagtcacca

SEQ ID NO: 166704 - DNA, 20 bp, Artificial Sequence
  Description of Artificial Sequence: Synthetic oligonucleotide
  Target: ATXN1; (-) strand; PAM type: YTN; PAM sequence: CTG
ggaagacaggagcaactgcc

SEQ ID NO: 166705 - DNA, 20 bp, Artificial Sequence
  Description of Artificial Sequence: Synthetic oligonucleotide
  Target: ATXN1; (-) strand; PAM type: YTN; PAM sequence: TTC
tgggaagacaggagcaactg

SEQ ID NO: 166706 - DNA, 20 bp, Artificial Sequence
  Description of Artificial Sequence: Synthetic oligonucleotide
  Target: ATXN1; (-) strand; PAM type: YTN; PAM sequence: TTA
tcaccgccattctgggaaga

SEQ ID NO: 166707 - DNA, 20 bp, Artificial Sequence
  Description of Artificial Sequence: Synthetic oligonucleotide
  Target: ATXN1; (-) strand; PAM type: YTN; PAM sequence: CTT
atcaccgccattctgggaag

SEQ ID NO: 166708 - DNA, 20 bp, Artificial Sequence
  Description of Artificial Sequence: Synthetic oligonucleotide
  Target: ATXN1; (-) strand; PAM type: YTN; PAM sequence: CTA
gcttatcaccgccattctgg

SEQ ID NO: 166709 - DNA, 20 bp, Artificial Sequence
  Description of Artificial Sequence: Synthetic oligonucleotide
  Target: ATXN1; (-) strand; PAM type: YTN; PAM sequence: CTC
tagcttatcaccgccattct

SEQ ID NO: 166710 - DNA, 20 bp, Artificial Sequence
  Description of Artificial Sequence: Synthetic oligonucleotide
  Target: ATXN1; (-) strand; PAM type: YTN; PAM sequence: CTG
ggtatacctctagcttatca

SEQ ID NO: 166711 - DNA, 20 bp, Artificial Sequence
  Description of Artificial Sequence: Synthetic oligonucleotide
  Target: ATXN1; (-) strand; PAM type: YTN; PAM sequence: CTC
ctgggtatacctctagctta

SEQ ID NO: 166712 - DNA, 20 bp, Artificial Sequence
  Description of Artificial Sequence: Synthetic oligonucleotide
  Target: ATXN1; (-) strand; PAM type: YTN; PAM sequence: CTC
tcctgggtatacctctagct

SEQ ID NO: 166713 - DNA, 20 bp, Artificial Sequence
  Description of Artificial Sequence: Synthetic oligonucleotide
  Target: ATXN1; (-) strand; PAM type: YTN; PAM sequence: TTG
tctctcctgggtatacctct

SEQ ID NO: 166714 - DNA, 20 bp, Artificial Sequence
  Description of Artificial Sequence: Synthetic oligonucleotide
  Target: ATXN1; (-) strand; PAM type: YTN; PAM sequence: CTG
gttgtctctcctgggtatac

SEQ ID NO: 166715 - DNA, 20 bp, Artificial Sequence
  Description of Artificial Sequence: Synthetic oligonucleotide
  Target: ATXN1; (-) strand; PAM type: YTN; PAM sequence: TTG
ctggttgtctctcctgggta

SEQ ID NO: 166716 - DNA, 20 bp, Artificial Sequence
  Description of Artificial Sequence: Synthetic oligonucleotide
  Target: ATXN1; (-) strand; PAM type: YTN; PAM sequence: TTT
gctggttgtctctcctgggt

SEQ ID NO: 166717 - DNA, 20 bp, Artificial Sequence
  Description of Artificial Sequence: Synthetic oligonucleotide
  Target: ATXN1; (-) strand; PAM type: YTN; PAM sequence: TTT
tgctggttgtctctcctggg

SEQ ID NO: 166718 - DNA, 20 bp, Artificial Sequence
  Description of Artificial Sequence: Synthetic oligonucleotide
  Target: ATXN1; (-) strand; PAM type: YTN; PAM sequence: CTT
ttgctggttgtctctcctgg

SEQ ID NO: 166719 - DNA, 20 bp, Artificial Sequence
  Description of Artificial Sequence: Synthetic oligonucleotide
  Target: ATXN1; (-) strand; PAM type: YTN; PAM sequence: TTG
aggtgtcacacttttgctgg

SEQ ID NO: 166720 - DNA, 20 bp, Artificial Sequence
  Description of Artificial Sequence: Synthetic oligonucleotide
  Target: ATXN1; (-) strand; PAM type: YTN; PAM sequence: CTG
attgaggtgtcacacttttg

SEQ ID NO: 166721 - DNA, 20 bp, Artificial Sequence
  Description of Artificial Sequence: Synthetic oligonucleotide
  Target: ATXN1; (-) strand; PAM type: YTN; PAM sequence: TTA
aagtgtaataaaatatatat

SEQ ID NO: 166722 - DNA, 20 bp, Artificial Sequence
  Description of Artificial Sequence: Synthetic oligonucleotide
  Target: ATXN1; (-) strand; PAM type: YTN; PAM sequence: CTT
aaagtgtaataaaatatata

SEQ ID NO: 166723 - DNA, 20 bp, Artificial Sequence
  Description of Artificial Sequence: Synthetic oligonucleotide
  Target: ATXN1; (-) strand; PAM type: YTN; PAM sequence: CTA
gaacttaaagtgtaataaaa

SEQ ID NO: 166724 - DNA, 20 bp, Artificial Sequence
  Description of Artificial Sequence: Synthetic oligonucleotide
  Target: ATXN1; (-) strand; PAM type: YTN; PAM sequence: TTG
tgcatatgtaccctagaact

SEQ ID NO: 166725 - DNA, 20 bp, Artificial Sequence
  Description of Artificial Sequence: Synthetic oligonucleotide
  Target: ATXN1; (-) strand; PAM type: YTN; PAM sequence: CTA
tggcacatgtatacatatgt

SEQ ID NO: 166726 - DNA, 20 bp, Artificial Sequence
  Description of Artificial Sequence: Synthetic oligonucleotide
  Target: ATXN1; (-) strand; PAM type: YTN; PAM sequence: CTG
ctatggcacatgtatacata

SEQ ID NO: 166727 - DNA, 20 bp, Artificial Sequence
  Description of Artificial Sequence: Synthetic oligonucleotide
  Target: ATXN1; (-) strand; PAM type: YTN; PAM sequence: CTC
tgctatggcacatgtataca

SEQ ID NO: 166728 - DNA, 20 bp, Artificial Sequence
  Description of Artificial Sequence: Synthetic oligonucleotide
  Target: ATXN1; (-) strand; PAM type: YTN; PAM sequence: TTG
ctctgctatggcacatgtat

SEQ ID NO: 166729 - DNA, 20 bp, Artificial Sequence
  Description of Artificial Sequence: Synthetic oligonucleotide
  Target: ATXN1; (-) strand; PAM type: YTN; PAM sequence: CTT
gctctgctatggcacatgta

SEQ ID NO: 166730 - DNA, 20 bp, Artificial Sequence
  Description of Artificial Sequence: Synthetic oligonucleotide
  Target: ATXN1; (-) strand; PAM type: YTN; PAM sequence: CTC
cttgctctgctatggcacat

SEQ ID NO: 166731 - DNA, 20 bp, Artificial Sequence
  Description of Artificial Sequence: Synthetic oligonucleotide
  Target: ATXN1; (-) strand; PAM type: YTN; PAM sequence: TTG
gaactccttgctctgctatg

SEQ ID NO: 166732 - DNA, 20 bp, Artificial Sequence
  Description of Artificial Sequence: Synthetic oligonucleotide
  Target: ATXN1; (-) strand; PAM type: YTN; PAM sequence: TTT
ggaactccttgctctgctat

SEQ ID NO: 166733 - DNA, 20 bp, Artificial Sequence
  Description of Artificial Sequence: Synthetic oligonucleotide
  Target: ATXN1; (-) strand; PAM type: YTN; PAM sequence: TTT
tggaactccttgctctgcta

SEQ ID NO: 166734 - DNA, 20 bp, Artificial Sequence
  Description of Artificial Sequence: Synthetic oligonucleotide
  Target: ATXN1; (-) strand; PAM type: YTN; PAM sequence: CTG
ttttggaactccttgctctg

SEQ ID NO: 166735 - DNA, 20 bp, Artificial Sequence
  Description of Artificial Sequence: Synthetic oligonucleotide
  Target: ATXN1; (-) strand; PAM type: YTN; PAM sequence: TTC
tgttttggaactccttgctc

SEQ ID NO: 166736 - DNA, 20 bp, Artificial Sequence
  Description of Artificial Sequence: Synthetic oligonucleotide
  Target: ATXN1; (-) strand; PAM type: YTN; PAM sequence: CTC
aataagaaaaaaaagaaaac

SEQ ID NO: 166737 - DNA, 20 bp, Artificial Sequence
  Description of Artificial Sequence: Synthetic oligonucleotide
  Target: ATXN1; (-) strand; PAM type: YTN; PAM sequence: TTG
tctcaataagaaaaaaaaga

SEQ ID NO: 166738 - DNA, 20 bp, Artificial Sequence
  Description of Artificial Sequence: Synthetic oligonucleotide
  Target: ATXN1; (-) strand; PAM type: YTN; PAM sequence: TTT
gtctcaataagaaaaaaaag

SEQ ID NO: 166739 - DNA, 20 bp, Artificial Sequence
  Description of Artificial Sequence: Synthetic oligonucleotide
  Target: ATXN1; (-) strand; PAM type: YTN; PAM sequence: CTT
tgtctcaataagaaaaaaaa

SEQ ID NO: 166740 - DNA, 20 bp, Artificial Sequence
  Description of Artificial Sequence: Synthetic oligonucleotide
  Target: ATXN1; (-) strand; PAM type: YTN; PAM sequence: CTG
ggcaacagagtgagactttg

SEQ ID NO: 166741 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcaacagagtga

SEQ ID NO: 166742 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggcaacag

SEQ ID NO: 166743 - DNA, 20 bp, Artificial Sequence
  Description of Artificial Sequence: Synthetic oligonucleotide
  Target: ATXN1; (-) strand; PAM type: YTN; PAM sequence: TTG
caccactgcactccagcctg

SEQ ID NO: 166744 - DNA, 20 bp, Artificial Sequence
  Description of Artificial Sequence: Synthetic oligonucleotide
  Target: ATXN1; (-) strand; PAM type: YTN; PAM sequence: TTG
cagtaagccaaggttgcacc

SEQ ID NO: 166745 - DNA, 20 bp, Artificial Sequence
  Description of Artificial Sequence: Synthetic oligonucleotide
  Target: ATXN1; (-) strand; PAM type: YTN; PAM sequence: TTG
ggaggcagaggttgcagtaa

SEQ ID NO: 166746 - DNA, 20 bp, Artificial Sequence
  Description of Artificial Sequence: Synthetic oligonucleotide
  Target: ATXN1; (-) strand; PAM type: YTN; PAM sequence: CTT
gggaggcagaggttgcagta

SEQ ID NO: 166747 - DNA, 20 bp, Artificial Sequence
  Description of Artificial Sequence: Synthetic oligonucleotide
  Target: ATXN1; (-) strand; PAM type: YTN; PAM sequence: TTG
aacttgggaggcagaggttg

SEQ ID NO: 166748 - DNA, 20 bp, Artificial Sequence
  Description of Artificial Sequence: Synthetic oligonucleotide
  Target: ATXN1; (-) strand; PAM type: YTN; PAM sequence: CTT
gaacttgggaggcagaggtt

SEQ ID NO: 166749 - DNA, 20 bp, Artificial Sequence
  Description of Artificial Sequence: Synthetic oligonucleotide
  Target: ATXN1; (-) strand; PAM type: YTN; PAM sequence: CTG
aggcagaagaatcacttgaa

SEQ ID NO: 166750 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggcagaagaa

SEQ ID NO: 166751 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgaggcagaa

SEQ ID NO: 166752 - DNA, 20 bp, Artificial Sequence
  Description of Artificial Sequence: Synthetic oligonucleotide
  Target: ATXN1; (-) strand; PAM type: YTN; PAM sequence: CTG
cagtcccagctactcaggag

SEQ ID NO: 166753 - DNA, 20 bp, Artificial Sequence
  Description of Artificial Sequence: Synthetic oligonucleotide
  Target: ATXN1; (-) strand; PAM type: YTN; PAM sequence: TTA
ggcaggcgtggtgatgcgtg

SEQ ID NO: 166754 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaagttaggca

SEQ ID NO: 166755 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaagttag

SEQ ID NO: 166756 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaagtt

SEQ ID NO: 166757 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaacccca

SEQ ID NO: 166758 - DNA, 20 bp, Artificial Sequence
  Description of Artificial Sequence: Synthetic oligonucleotide
  Target: ATXN1; (-) strand; PAM type: YTN; PAM sequence: TTC
gagaccagcctggccaacat

SEQ ID NO: 166759 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttcgagacca

SEQ ID NO: 166760 - DNA, 20 bp, Artificial Sequence
  Description of Artificial Sequence: Synthetic oligonucleotide
  Target: ATXN1; (-) strand; PAM type: YTN; PAM sequence: TTG
ggaggccaatgtgggtggat

SEQ ID NO: 166761 - DNA, 20 bp, Artificial Sequence
  Description of Artificial Sequence: Synthetic oligonucleotide
  Target: ATXN1; (-) strand; PAM type: YTN; PAM sequence: TTT
gggaggccaatgtgggtgga

SEQ ID NO: 166762 - DNA, 20 bp, Artificial Sequence
  Description of Artificial Sequence: Synthetic oligonucleotide
  Target: ATXN1; (-) strand; PAM type: YTN; PAM sequence: CTT
tgggaggccaatgtgggtgg

SEQ ID NO: 166763 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 166764 - DNA, 20 bp, Artificial Sequence
  Description of Artificial Sequence: Synthetic oligonucleotide
  Target: ATXN1; (-) strand; PAM type: YTN; PAM sequence: CTC
aatgcctgtaatcccagcac

SEQ ID NO: 166765 - DNA, 20 bp, Artificial Sequence
  Description of Artificial Sequence: Synthetic oligonucleotide
  Target: ATXN1; (-) strand; PAM type: YTN; PAM sequence: TTC
ggccaggcgcagtggctcaa

SEQ ID NO: 166766 - DNA, 20 bp, Artificial Sequence
  Description of Artificial Sequence: Synthetic oligonucleotide
  Target: ATXN1; (-) strand; PAM type: YTN; PAM sequence: TTG
aaaaccaataattcggccag

SEQ ID NO: 166767 - DNA, 20 bp, Artificial Sequence
  Description of Artificial Sequence: Synthetic oligonucleotide
  Target: ATXN1; (-) strand; PAM type: YTN; PAM sequence: TTT
gaaaaccaataattcggcca

SEQ ID NO: 166768 - DNA, 20 bp, Artificial Sequence
  Description of Artificial Sequence: Synthetic oligonucleotide
  Target: ATXN1; (-) strand; PAM type: YTN; PAM sequence: CTT
tgaaaaccaataattcggcc

SEQ ID NO: 166769 - DNA, 20 bp, Artificial Sequence
  Description of Artificial Sequence: Synthetic oligonucleotide
  Target: ATXN1; (-) strand; PAM type: YTN; PAM sequence: TTA
cagtatgaagaagaggaaga

SEQ ID NO: 166770 - DNA, 20 bp, Artificial Sequence
  Description of Artificial Sequence: Synthetic oligonucleotide
  Target: ATXN1; (-) strand; PAM type: YTN; PAM sequence: CTT
acagtatgaagaagaggaag

SEQ ID NO: 166771 - DNA, 20 bp, Artificial Sequence
  Description of Artificial Sequence: Synthetic oligonucleotide
  Target: ATXN1; (-) strand; PAM type: YTN; PAM sequence: TTC
ttacagtatgaagaagagga

SEQ ID NO: 166772 - DNA, 20 bp, Artificial Sequence
  Description of Artificial Sequence: Synthetic oligonucleotide
  Target: ATXN1; (-) strand; PAM type: YTN; PAM sequence: TTG
aatgttcttacagtatgaag

SEQ ID NO: 166773 - DNA, 20 bp, Artificial Sequence
  Description of Artificial Sequence: Synthetic oligonucleotide
  Target: ATXN1; (-) strand; PAM type: YTN; PAM sequence: TTT
gaatgttcttacagtatgaa

SEQ ID NO: 166774 - DNA, 20 bp, Artificial Sequence
  Description of Artificial Sequence: Synthetic oligonucleotide
  Target: ATXN1; (-) strand; PAM type: YTN; PAM sequence: TTA
agcccccaaatgtcatttga

SEQ ID NO: 166775 - DNA, 20 bp, Artificial Sequence
  Description of Artificial Sequence: Synthetic oligonucleotide
  Target: ATXN1; (-) strand; PAM type: YTN; PAM sequence: CTA
aagccaaggggtgttaagcc

SEQ ID NO: 166776 - DNA, 20 bp, Artificial Sequence
  Description of Artificial Sequence: Synthetic oligonucleotide
  Target: ATXN1; (-) strand; PAM type: YTN; PAM sequence: CTG
gctaaagccaaggggtgtta

SEQ ID NO: 166777 - DNA, 20 bp, Artificial Sequence
  Description of Artificial Sequence: Synthetic oligonucleotide
  Target: ATXN1; (-) strand; PAM type: YTN; PAM sequence: TTC
catggacacatctggctaaa

SEQ ID NO: 166778 - DNA, 20 bp, Artificial Sequence
  Description of Artificial Sequence: Synthetic oligonucleotide
  Target: ATXN1; (-) strand; PAM type: YTN; PAM sequence: TTT
ccatggacacatctggctaa

SEQ ID NO: 166779 - DNA, 20 bp, Artificial Sequence
  Description of Artificial Sequence: Synthetic oligonucleotide
  Target: ATXN1; (-) strand; PAM type: YTN; PAM sequence: TTT
tccatggacacatctggcta

SEQ ID NO: 166780 - DNA, 20 bp, Artificial Sequence
  Description of Artificial Sequence: Synthetic oligonucleotide
  Target: ATXN1; (-) strand; PAM type: YTN; PAM sequence: TTT
ttccatggacacatctggct

SEQ ID NO: 166781 - DNA, 20 bp, Artificial Sequence
  Description of Artificial Sequence: Synthetic oligonucleotide
  Target: ATXN1; (-) strand; PAM type: YTN; PAM sequence: TTT
tttccatggacacatctggc

SEQ ID NO: 166782 - DNA, 20 bp, Artificial Sequence
  Description of Artificial Sequence: Synthetic oligonucleotide
  Target: ATXN1; (-) strand; PAM type: YTN; PAM sequence: TTT
ttttccatggacacatctgg

SEQ ID NO: 166783 - DNA, 20 bp, Artificial Sequence
  Description of Artificial Sequence: Synthetic oligonucleotide
  Target: ATXN1; (-) strand; PAM type: YTN; PAM sequence: TTA
tgtcatttttttccatggac

SEQ ID NO: 166784 - DNA, 20 bp, Artificial Sequence
  Description of Artificial Sequence: Synthetic oligonucleotide
  Target: ATXN1; (-) strand; PAM type: YTN; PAM sequence: TTG
gttatgtcatttttttccat

SEQ ID NO: 166785 - DNA, 20 bp, Artificial Sequence
  Description of Artificial Sequence: Synthetic oligonucleotide
  Target: ATXN1; (-) strand; PAM type: YTN; PAM sequence: TTT
ggttatgtcatttttttcca

SEQ ID NO: 166786 - DNA, 20 bp, Artificial Sequence
  Description of Artificial Sequence: Synthetic oligonucleotide
  Target: ATXN1; (-) strand; PAM type: YTN; PAM sequence: CTA
tttggttatgtcattttttt

SEQ ID NO: 166787 - DNA, 20 bp, Artificial Sequence
  Description of Artificial Sequence: Synthetic oligonucleotide
  Target: ATXN1; (-) strand; PAM type: YTN; PAM sequence: TTC
tatttggttatgtcattttt

SEQ ID NO: 166788 - DNA, 20 bp, Artificial Sequence
  Description of Artificial Sequence: Synthetic oligonucleotide
  Target: ATXN1; (-) strand; PAM type: YTN; PAM sequence: TTT
ctatttggttatgtcatttt

SEQ ID NO: 166789 - DNA, 20 bp, Artificial Sequence
  Description of Artificial Sequence: Synthetic oligonucleotide
  Target: ATXN1; (-) strand; PAM type: YTN; PAM sequence: TTT
tctatttggttatgtcattt

SEQ ID NO: 166790 - DNA, 20 bp, Artificial Sequence
  Description of Artificial Sequence: Synthetic oligonucleotide
  Target: ATXN1; (-) strand; PAM type: YTN; PAM sequence: CTA
gagattttctatttggttat

SEQ ID NO: 166791 - DNA, 20 bp, Artificial Sequence
  Description of Artificial Sequence: Synthetic oligonucleotide
  Target: ATXN1; (-) strand; PAM type: YTN; PAM sequence: TTC
tagagattttctatttggtt

SEQ ID NO: 166792 - DNA, 20 bp, Artificial Sequence
  Description of Artificial Sequence: Synthetic oligonucleotide
  Target: ATXN1; (-) strand; PAM type: YTN; PAM sequence: TTT
ctagagattttctatttggt

SEQ ID NO: 166793 - DNA, 20 bp, Artificial Sequence
  Description of Artificial Sequence: Synthetic oligonucleotide
  Target: ATXN1; (-) strand; PAM type: YTN; PAM sequence: CTG
acaaacagatgaaaagtaaa

SEQ ID NO: 166794 - DNA, 20 bp, Artificial Sequence
  Description of Artificial Sequence: Synthetic oligonucleotide
  Target: ATXN1; (-) strand; PAM type: YTN; PAM sequence: CTA
gaactgacaaacagatgaaa

SEQ ID NO: 166795 - DNA, 20 bp, Artificial Sequence
  Description of Artificial Sequence: Synthetic oligonucleotide
  Target: ATXN1; (-) strand; PAM type: YTN; PAM sequence: TTG
actagaactgacaaacagat

SEQ ID NO: 166796 - DNA, 20 bp, Artificial Sequence
  Description of Artificial Sequence: Synthetic oligonucleotide
  Target: ATXN1; (-) strand; PAM type: YTN; PAM sequence: TTA
cattgactagaactgacaaa

SEQ ID NO: 166797 - DNA, 20 bp, Artificial Sequence
  Description of Artificial Sequence: Synthetic oligonucleotide
  Target: ATXN1; (-) strand; PAM type: YTN; PAM sequence: TTT
acattgactagaactgacaa

SEQ ID NO: 166798 - DNA, 20 bp, Artificial Sequence
  Description of Artificial Sequence: Synthetic oligonucleotide
  Target: ATXN1; (-) strand; PAM type: YTN; PAM sequence: CTT
tacattgactagaactgaca

SEQ ID NO: 166799 - DNA, 20 bp, Artificial Sequence
  Description of Artificial Sequence: Synthetic oligonucleotide
  Target: ATXN1; (-) strand; PAM type: YTN; PAM sequence: CTA
tgctttacattgactagaac

SEQ ID NO: 166800 - DNA, 20 bp, Artificial Sequence
  Description of Artificial Sequence: Synthetic oligonucleotide
  Target: ATXN1; (-) strand; PAM type: YTN; PAM sequence: CTG
tagtctatgctttacattga

SEQ ID NO: 166801 - DNA, 20 bp, Artificial Sequence
  Description of Artificial Sequence: Synthetic oligonucleotide
  Target: ATXN1; (-) strand; PAM type: YTN; PAM sequence: TTG
actgtagtctatgctttaca

SEQ ID NO: 166802 - DNA, 20 bp, Artificial Sequence
  Description of Artificial Sequence: Synthetic oligonucleotide
  Target: ATXN1; (-) strand; PAM type: YTN; PAM sequence: TTT
gactgtagtctatgctttac

SEQ ID NO: 166803 - DNA, 20 bp, Artificial Sequence
  Description of Artificial Sequence: Synthetic oligonucleotide
  Target: ATXN1; (-) strand; PAM type: YTN; PAM sequence: CTT
tgactgtagtctatgcttta

SEQ ID NO: 166804 - DNA, 20 bp, Artificial Sequence
  Description of Artificial Sequence: Synthetic oligonucleotide
  Target: ATXN1; (-) strand; PAM type: YTN; PAM sequence: CTG
aatgcaccctttgactgtag

SEQ ID NO: 166805 - DNA, 20 bp, Artificial Sequence
  Description of Artificial Sequence: Synthetic oligonucleotide
  Target: ATXN1; (-) strand; PAM type: YTN; PAM sequence: TTG
ggactgaatgcaccctttga

SEQ ID NO: 166806 - DNA, 20 bp, Artificial Sequence
  Description of Artificial Sequence: Synthetic oligonucleotide
  Target: ATXN1; (-) strand; PAM type: YTN; PAM sequence: TTT
gggactgaatgcaccctttg

SEQ ID NO: 166807 - DNA, 20 bp, Artificial Sequence
  Description of Artificial Sequence: Synthetic oligonucleotide
  Target: ATXN1; (-) strand; PAM type: YTN; PAM sequence: TTT
tgggactgaatgcacccttt

SEQ ID NO: 166808 - DNA, 20 bp, Artificial Sequence
  Description of Artificial Sequence: Synthetic oligonucleotide
  Target: ATXN1; (-) strand; PAM type: YTN; PAM sequence: TTG
taaacagttttgggactgaa

SEQ ID NO: 166809 - DNA, 20 bp, Artificial Sequence
  Description of Artificial Sequence: Synthetic oligonucleotide
  Target: ATXN1; (-) strand; PAM type: YTN; PAM sequence: CTT
gtaaacagttttgggactga

SEQ ID NO: 166810 - DNA, 20 bp, Artificial Sequence
  Description of Artificial Sequence: Synthetic oligonucleotide
  Target: ATXN1; (-) strand; PAM type: YTN; PAM sequence: CTG
cttgtaaacagttttgggac

SEQ ID NO: 166811 - DNA, 20 bp, Artificial Sequence
  Description of Artificial Sequence: Synthetic oligonucleotide
  Target: ATXN1; (-) strand; PAM type: YTN; PAM sequence: CTA
aacactgcttgtaaacagtt

SEQ ID NO: 166812 - DNA, 20 bp, Artificial Sequence
  Description of Artificial Sequence: Synthetic oligonucleotide
  Target: ATXN1; (-) strand; PAM type: YTN; PAM sequence: CTC
cctaaacactgcttgtaaac

SEQ ID NO: 166813 - DNA, 20 bp, Artificial Sequence
  Description of Artificial Sequence: Synthetic oligonucleotide
  Target: ATXN1; (-) strand; PAM type: YTN; PAM sequence: TTG
tcctccctaaacactgcttg

SEQ ID NO: 166814 - DNA, 20 bp, Artificial Sequence
  Description of Artificial Sequence: Synthetic oligonucleotide
  Target: ATXN1; (-) strand; PAM type: YTN; PAM sequence: TTC
ccattgtcctccctaaacac

SEQ ID NO: 166815 - DNA, 20 bp, Artificial Sequence
  Description of Artificial Sequence: Synthetic oligonucleotide
  Target: ATXN1; (-) strand; PAM type: YTN; PAM sequence: TTG
ggtccaggcagattcccatt

SEQ ID NO: 166816 - DNA, 20 bp, Artificial Sequence
  Description of Artificial Sequence: Synthetic oligonucleotide
  Target: ATXN1; (-) strand; PAM type: YTN; PAM sequence: TTT
gggtccaggcagattcccat

SEQ ID NO: 166817 - DNA, 20 bp, Artificial Sequence
  Description of Artificial Sequence: Synthetic oligonucleotide
  Target: ATXN1; (-) strand; PAM type: YTN; PAM sequence: TTG
tttgggtccaggcagattcc

SEQ ID NO: 166818 - DNA, 20 bp, Artificial Sequence
  Description of Artificial Sequence: Synthetic oligonucleotide
  Target: ATXN1; (-) strand; PAM type: YTN; PAM sequence: TTA
caggttgtttgggtccaggc

SEQ ID NO: 166819 - DNA, 20 bp, Artificial Sequence
  Description of Artificial Sequence: Synthetic oligonucleotide
  Target: ATXN1; (-) strand; PAM type: YTN; PAM sequence: TTA
aaaatgaggtcattacaggt

SEQ ID NO: 166820 - DNA, 20 bp, Artificial Sequence
  Description of Artificial Sequence: Synthetic oligonucleotide
  Target: ATXN1; (-) strand; PAM type: YTN; PAM sequence: TTT
aaaaatgaggtcattacagg

SEQ ID NO: 166821 - DNA, 20 bp, Artificial Sequence
  Description of Artificial Sequence: Synthetic oligonucleotide
  Target: ATXN1; (-) strand; PAM type: YTN; PAM sequence: TTT
taaaaatgaggtcattacag

SEQ ID NO: 166822 - DNA, 20 bp, Artificial Sequence
  Description of Artificial Sequence: Synthetic oligonucleotide
  Target: ATXN1; (-) strand; PAM type: YTN; PAM sequence: TTT
ttaaaaatgaggtcattaca

SEQ ID NO: 166823 - DNA, 20 bp, Artificial Sequence
  Description of Artificial Sequence: Synthetic oligonucleotide
  Target: ATXN1; (-) strand; PAM type: YTN; PAM sequence: TTT
tttaaaaatgaggtcattac

SEQ ID NO: 166824 - DNA, 20 bp, Artificial Sequence
  Description of Artificial Sequence: Synthetic oligonucleotide
  Target: ATXN1; (-) strand; PAM type: YTN; PAM sequence: CTG
ggaaggaaaaggtaattttt

SEQ ID NO: 166825 - DNA, 20 bp, Artificial Sequence
  Description of Artificial Sequence: Synthetic oligonucleotide
  Target: ATXN1; (-) strand; PAM type: YTN; PAM sequence: CTA
cagctgggaaggaaaaggta

SEQ ID NO: 166826 - DNA, 20 bp, Artificial Sequence
  Description of Artificial Sequence: Synthetic oligonucleotide
  Target: ATXN1; (-) strand; PAM type: YTN; PAM sequence: TTC
tacagctgggaaggaaaagg

SEQ ID NO: 166827 - DNA, 20 bp, Artificial Sequence
  Description of Artificial Sequence: Synthetic oligonucleotide
  Target: ATXN1; (-) strand; PAM type: YTN; PAM sequence: TTT
ctacagctgggaaggaaaag

SEQ ID NO: 166828 - DNA, 20 bp, Artificial Sequence
  Description of Artificial Sequence: Synthetic oligonucleotide
  Target: ATXN1; (-) strand; PAM type: YTN; PAM sequence: CTA
tataaatgtggaagagcagc

SEQ ID NO: 166829 - DNA, 20 bp, Artificial Sequence
  Description of Artificial Sequence: Synthetic oligonucleotide
  Target: ATXN1; (-) strand; PAM type: YTN; PAM sequence: TTC
tatataaatgtggaagagca

SEQ ID NO: 166830 - DNA, 20 bp, Artificial Sequence
  Description of Artificial Sequence: Synthetic oligonucleotide
  Target: ATXN1; (-) strand; PAM type: YTN; PAM sequence: TTA
atatatagatgtagacacag

SEQ ID NO: 166831 - DNA, 20 bp, Artificial Sequence
  Description of Artificial Sequence: Synthetic oligonucleotide
  Target: ATXN1; (-) strand; PAM type: YTN; PAM sequence: TTA
caggcaggcatgtaagtgga

SEQ ID NO: 166832 - DNA, 20 bp, Artificial Sequence
  Description of Artificial Sequence: Synthetic oligonucleotide
  Target: ATXN1; (-) strand; PAM type: YTN; PAM sequence: CTG
aatagacccattacaggcag

SEQ ID NO: 166833 - DNA, 20 bp, Artificial Sequence
  Description of Artificial Sequence: Synthetic oligonucleotide
  Target: ATXN1; (-) strand; PAM type: YTN; PAM sequence: CTC
tgaatagacccattacaggc

SEQ ID NO: 166834 - DNA, 20 bp, Artificial Sequence
  Description of Artificial Sequence: Synthetic oligonucleotide
  Target: ATXN1; (-) strand; PAM type: YTN; PAM sequence: CTA
tatagatatataggactctg

SEQ ID NO: 166835 - DNA, 20 bp, Artificial Sequence
  Description of Artificial Sequence: Synthetic oligonucleotide
  Target: ATXN1; (-) strand; PAM type: YTN; PAM sequence: TTA
gatagatagacggctatata

SEQ ID NO: 166836 - DNA, 20 bp, Artificial Sequence
  Description of Artificial Sequence: Synthetic oligonucleotide
  Target: ATXN1; (-) strand; PAM type: YTN; PAM sequence: TTA
caatagtagatatggggatt

SEQ ID NO: 166837 - DNA, 20 bp, Artificial Sequence
  Description of Artificial Sequence: Synthetic oligonucleotide
  Target: ATXN1; (-) strand; PAM type: YTN; PAM sequence: TTT
acaatagtagatatggggat

SEQ ID NO: 166838 - DNA, 20 bp, Artificial Sequence
  Description of Artificial Sequence: Synthetic oligonucleotide
  Target: ATXN1; (-) strand; PAM type: YTN; PAM sequence: TTT
tacaatagtagatatgggga

SEQ ID NO: 166839 - DNA, 20 bp, Artificial Sequence
  Description of Artificial Sequence: Synthetic oligonucleotide
  Target: ATXN1; (-) strand; PAM type: YTN; PAM sequence: TTG
aaacacaggggaaaaaagaa

SEQ ID NO: 166840 - DNA, 20 bp, Artificial Sequence
  Description of Artificial Sequence: Synthetic oligonucleotide
  Target: ATXN1; (-) strand; PAM type: YTN; PAM sequence: CTG
agaagagatcagaatgagtt

SEQ ID NO: 166841 - DNA, 20 bp, Artificial Sequence
  Description of Artificial Sequence: Synthetic oligonucleotide
  Target: ATXN1; (-) strand; PAM type: YTN; PAM sequence: CTG
atgctgagaagagatcagaa

SEQ ID NO: 166842 - DNA, 20 bp, Artificial Sequence
  Description of Artificial Sequence: Synthetic oligonucleotide
  Target: ATXN1; (-) strand; PAM type: YTN; PAM sequence: CTC
tgatgctgagaagagatcag

SEQ ID NO: 166843 - DNA, 20 bp, Artificial Sequence
  Description of Artificial Sequence: Synthetic oligonucleotide
  Target: ATXN1; (-) strand; PAM type: YTN; PAM sequence: TTA
gccacaaaaataaacataat

SEQ ID NO: 166844 - DNA, 20 bp, Artificial Sequence
  Description of Artificial Sequence: Synthetic oligonucleotide
  Target: ATXN1; (-) strand; PAM type: YTN; PAM sequence: TTT
agccacaaaaataaacataa

SEQ ID NO: 166845 - DNA, 20 bp, Artificial Sequence
  Description of Artificial Sequence: Synthetic oligonucleotide
  Target: ATXN1; (-) strand; PAM type: YTN; PAM sequence: TTG
ggcagaccaagatttagcca

SEQ ID NO: 166846 - DNA, 20 bp, Artificial Sequence
  Description of Artificial Sequence: Synthetic oligonucleotide
  Target: ATXN1; (-) strand; PAM type: YTN; PAM sequence: CTG
ttgggcagaccaagatttag

SEQ ID NO: 166847 - DNA, 20 bp, Artificial Sequence
  Description of Artificial Sequence: Synthetic oligonucleotide
  Target: ATXN1; (-) strand; PAM type: YTN; PAM sequence: TTG
ctgttgggcagaccaagatt

SEQ ID NO: 166848 - DNA, 20 bp, Artificial Sequence
  Description of Artificial Sequence: Synthetic oligonucleotide
  Target: ATXN1; (-) strand; PAM type: YTN; PAM sequence: TTA
aagattgctgttgggcagac

SEQ ID NO: 166849 - DNA, 20 bp, Artificial Sequence
  Description of Artificial Sequence: Synthetic oligonucleotide
  Target: ATXN1; (-) strand; PAM type: YTN; PAM sequence: TTT
aaagattgctgttgggcaga

SEQ ID NO: 166850 - DNA, 20 bp, Artificial Sequence
  Description of Artificial Sequence: Synthetic oligonucleotide
  Target: ATXN1; (-) strand; PAM type: YTN; PAM sequence: CTT
taaagattgctgttgggcag

SEQ ID NO: 166851 - DNA, 20 bp, Artificial Sequence
  Description of Artificial Sequence: Synthetic oligonucleotide
  Target: ATXN1; (-) strand; PAM type: YTN; PAM sequence: TTC
tttaaagattgctgttgggc

SEQ ID NO: 166852 - DNA, 20 bp, Artificial Sequence
  Description of Artificial Sequence: Synthetic oligonucleotide
  Target: ATXN1; (-) strand; PAM type: YTN; PAM sequence: TTT
ctttaaagattgctgttggg

SEQ ID NO: 166853 - DNA, 20 bp, Artificial Sequence
  Description of Artificial Sequence: Synthetic oligonucleotide
  Target: ATXN1; (-) strand; PAM type: YTN; PAM sequence: TTG
tttctttaaagattgctgtt

SEQ ID NO: 166854 - DNA, 20 bp, Artificial Sequence
  Description of Artificial Sequence: Synthetic oligonucleotide
  Target: ATXN1; (-) strand; PAM type: YTN; PAM sequence: CTC
ataggtaagaaaaggtaaac

SEQ ID NO: 166855 - DNA, 20 bp, Artificial Sequence
  Description of Artificial Sequence: Synthetic oligonucleotide
  Target: ATXN1; (-) strand; PAM type: YTN; PAM sequence: TTC
catatatcaccaaagcctca

SEQ ID NO: 166856 - DNA, 20 bp, Artificial Sequence
  Description of Artificial Sequence: Synthetic oligonucleotide
  Target: ATXN1; (-) strand; PAM type: YTN; PAM sequence: TTT
ccatatatcaccaaagcctc

SEQ ID NO: 166857 - DNA, 20 bp, Artificial Sequence
  Description of Artificial Sequence: Synthetic oligonucleotide
  Target: ATXN1; (-) strand; PAM type: YTN; PAM sequence: TTT
tccatatatcaccaaagcct

SEQ ID NO: 166858 - DNA, 20 bp, Artificial Sequence
  Description of Artificial Sequence: Synthetic oligonucleotide
  Target: ATXN1; (-) strand; PAM type: YTN; PAM sequence: CTT
ttccatatatcaccaaagcc

SEQ ID NO: 166859 - DNA, 20 bp, Artificial Sequence
  Description of Artificial Sequence: Synthetic oligonucleotide
  Target: ATXN1; (-) strand; PAM type: YTN; PAM sequence: TTG
ccatagaggtccccttttcc

SEQ ID NO: 166860 - DNA, 20 bp, Artificial Sequence
  Description of Artificial Sequence: Synthetic oligonucleotide
  Target: ATXN1; (-) strand; PAM type: YTN; PAM sequence: CTT
gccatagaggtccccttttc

SEQ ID NO: 166861 - DNA, 20 bp, Artificial Sequence
  Description of Artificial Sequence: Synthetic oligonucleotide
  Target: ATXN1; (-) strand; PAM type: YTN; PAM sequence: CTG
tcatgaaacttgccatagag

SEQ ID NO: 166862 - DNA, 20 bp, Artificial Sequence
  Description of Artificial Sequence: Synthetic oligonucleotide
  Target: ATXN1; (-) strand; PAM type: YTN; PAM sequence: TTA
acaagcagacctgtcatgaa

SEQ ID NO: 166863 - DNA, 20 bp, Artificial Sequence
  Description of Artificial Sequence: Synthetic oligonucleotide
  Target: ATXN1; (-) strand; PAM type: YTN; PAM sequence: TTT
aacaagcagacctgtcatga

SEQ ID NO: 166864 - DNA, 20 bp, Artificial Sequence
  Description of Artificial Sequence: Synthetic oligonucleotide
  Target: ATXN1; (-) strand; PAM type: YTN; PAM sequence: TTT
taacaagcagacctgtcatg

SEQ ID NO: 166865 - DNA, 20 bp, Artificial Sequence
  Description of Artificial Sequence: Synthetic oligonucleotide
  Target: ATXN1; (-) strand; PAM type: YTN; PAM sequence: TTT
ttaacaagcagacctgtcat

SEQ ID NO: 166866 - DNA, 20 bp, Artificial Sequence
  Description of Artificial Sequence: Synthetic oligonucleotide
  Target: ATXN1; (-) strand; PAM type: YTN; PAM sequence: TTG
tttttaacaagcagacctgt

SEQ ID NO: 166867 - DNA, 20 bp, Artificial Sequence
  Description of Artificial Sequence: Synthetic oligonucleotide
  Target: ATXN1; (-) strand; PAM type: YTN; PAM sequence: TTG
ttgtttttaacaagcagacc

SEQ ID NO: 166868 - DNA, 20 bp, Artificial Sequence
  Description of Artificial Sequence: Synthetic oligonucleotide
  Target: ATXN1; (-) strand; PAM type: YTN; PAM sequence: TTG
ttgttgtttttaacaagcag

SEQ ID NO: 166869 - DNA, 20 bp, Artificial Sequence
  Description of Artificial Sequence: Synthetic oligonucleotide
  Target: ATXN1; (-) strand; PAM type: YTN; PAM sequence: TTA
ttgttgttgtttttaacaag

SEQ ID NO: 166870 - DNA, 20 bp, Artificial Sequence
  Description of Artificial Sequence: Synthetic oligonucleotide
  Target: ATXN1; (-) strand; PAM type: YTN; PAM sequence: TTA
ttattgttgttgtttttaac

SEQ ID NO: 166871 - DNA, 20 bp, Artificial Sequence
  Description of Artificial Sequence: Synthetic oligonucleotide
  Target: ATXN1; (-) strand; PAM type: YTN; PAM sequence: CTG
ttattattgttgttgttttt

SEQ ID NO: 166872 - DNA, 20 bp, Artificial Sequence
  Description of Artificial Sequence: Synthetic oligonucleotide
  Target: ATXN1; (-) strand; PAM type: YTN; PAM sequence: TTA
gaactgttattattgttgtt

SEQ ID NO: 166873 - DNA, 20 bp, Artificial Sequence
  Description of Artificial Sequence: Synthetic oligonucleotide
  Target: ATXN1; (-) strand; PAM type: YTN; PAM sequence: CTC
caagaggacaagtggtcagg

SEQ ID NO: 166874 - DNA, 20 bp, Artificial Sequence
  Description of Artificial Sequence: Synthetic oligonucleotide
  Target: ATXN1; (-) strand; PAM type: YTN; PAM sequence: CTG
acctccaagaggacaagtgg

SEQ ID NO: 166875 - DNA, 20 bp, Artificial Sequence
  Description of Artificial Sequence: Synthetic oligonucleotide
  Target: ATXN1; (-) strand; PAM type: YTN; PAM sequence: CTA
gctgacctccaagaggacaa

SEQ ID NO: 166876 - DNA, 20 bp, Artificial Sequence
  Description of Artificial Sequence: Synthetic oligonucleotide
  Target: ATXN1; (-) strand; PAM type: YTN; PAM sequence: CTG
ccagcatctagctgacctcc

SEQ ID NO: 166877 - DNA, 20 bp, Artificial Sequence
  Description of Artificial Sequence: Synthetic oligonucleotide
  Target: ATXN1; (-) strand; PAM type: YTN; PAM sequence: CTA
gggaactgccagcatctagc

SEQ ID NO: 166878 - DNA, 20 bp, Artificial Sequence
  Description of Artificial Sequence: Synthetic oligonucleotide
  Target: ATXN1; (-) strand; PAM type: YTN; PAM sequence: TTC
ctagggaactgccagcatct

SEQ ID NO: 166879 - DNA, 20 bp, Artificial Sequence
  Description of Artificial Sequence: Synthetic oligonucleotide
  Target: ATXN1; (-) strand; PAM type: YTN; PAM sequence: TTT
cctagggaactgccagcatc

SEQ ID NO: 166880 - DNA, 20 bp, Artificial Sequence
  Description of Artificial Sequence: Synthetic oligonucleotide
  Target: ATXN1; (-) strand; PAM type: YTN; PAM sequence: CTG
ggtaatataatgtcatttcc

SEQ ID NO: 166881 - DNA, 20 bp, Artificial Sequence
  Description of Artificial Sequence: Synthetic oligonucleotide
  Target: ATXN1; (-) strand; PAM type: YTN; PAM sequence: TTC
tgggtaatataatgtcattt

SEQ ID NO: 166882 - DNA, 20 bp, Artificial Sequence
  Description of Artificial Sequence: Synthetic oligonucleotide
  Target: ATXN1; (-) strand; PAM type: YTN; PAM sequence: TTA
atgtggtattctgggtaata

SEQ ID NO: 166883 - DNA, 20 bp, Artificial Sequence
  Description of Artificial Sequence: Synthetic oligonucleotide
  Target: ATXN1; (-) strand; PAM type: YTN; PAM sequence: CTG
aattaatgtggtattctggg

SEQ ID NO: 166884 - DNA, 20 bp, Artificial Sequence
  Description of Artificial Sequence: Synthetic oligonucleotide
  Target: ATXN1; (-) strand; PAM type: YTN; PAM sequence: TTC
tgaattaatgtggtattctg

SEQ ID NO: 166885 - DNA, 20 bp, Artificial Sequence
  Description of Artificial Sequence: Synthetic oligonucleotide
  Target: ATXN1; (-) strand; PAM type: YTN; PAM sequence: CTA
ggtggcaggttctgaattaa

SEQ ID NO: 166886 - DNA, 20 bp, Artificial Sequence
  Description of Artificial Sequence: Synthetic oligonucleotide
  Target: ATXN1; (-) strand; PAM type: YTN; PAM sequence: TTA
gctaggtggcaggttctgaa

SEQ ID NO: 166887 - DNA, 20 bp, Artificial Sequence
  Description of Artificial Sequence: Synthetic oligonucleotide
  Target: ATXN1; (-) strand; PAM type: YTN; PAM sequence: TTG
caaaggggtcagcggatagg

SEQ ID NO: 166888 - DNA, 20 bp, Artificial Sequence
  Description of Artificial Sequence: Synthetic oligonucleotide
  Target: ATXN1; (-) strand; PAM type: YTN; PAM sequence: TTG
ttgcaaaggggtcagcggat

SEQ ID NO: 166889 - DNA, 20 bp, Artificial Sequence
  Description of Artificial Sequence: Synthetic oligonucleotide
  Target: ATXN1; (-) strand; PAM type: YTN; PAM sequence: CTG
attgttgcaaaggggtcagc

SEQ ID NO: 166890 - DNA, 20 bp, Artificial Sequence
  Description of Artificial Sequence: Synthetic oligonucleotide
  Target: ATXN1; (-) strand; PAM type: YTN; PAM sequence: TTC
tgattgttgcaaaggggtca

SEQ ID NO: 166891 - DNA, 20 bp, Artificial Sequence
  Description of Artificial Sequence: Synthetic oligonucleotide
  Target: ATXN1; (-) strand; PAM type: YTN; PAM sequence: CTT
ctgattgttgcaaaggggtc

SEQ ID NO: 166892 - DNA, 20 bp, Artificial Sequence
  Description of Artificial Sequence: Synthetic oligonucleotide
  Target: ATXN1; (-) strand; PAM type: YTN; PAM sequence: CTG
cttctgattgttgcaaaggg

SEQ ID NO: 166893 - DNA, 20 bp, Artificial Sequence
  Description of Artificial Sequence: Synthetic oligonucleotide
  Target: ATXN1; (-) strand; PAM type: YTN; PAM sequence: TTC
ctgcttctgattgttgcaaa

SEQ ID NO: 166894 - DNA, 20 bp, Artificial Sequence
  Description of Artificial Sequence: Synthetic oligonucleotide
  Target: ATXN1; (-) strand; PAM type: YTN; PAM sequence: TTC
attcctgcttctgattgttg

SEQ ID NO: 166895 - DNA, 20 bp, Artificial Sequence
  Description of Artificial Sequence: Synthetic oligonucleotide
  Target: ATXN1; (-) strand; PAM type: YTN; PAM sequence: CTA
aattcattcctgcttctgat

SEQ ID NO: 166896 - DNA, 20 bp, Artificial Sequence
  Description of Artificial Sequence: Synthetic oligonucleotide
  Target: ATXN1; (-) strand; PAM type: YTN; PAM sequence: TTC
taaattcattcctgcttctg

SEQ ID NO: 166897 - DNA, 20 bp, Artificial Sequence
  Description of Artificial Sequence: Synthetic oligonucleotide
  Target: ATXN1; (-) strand; PAM type: YTN; PAM sequence: TTA
tattctaaattcattcctgc

SEQ ID NO: 166898 - DNA, 20 bp, Artificial Sequence
  Description of Artificial Sequence: Synthetic oligonucleotide
  Target: ATXN1; (-) strand; PAM type: YTN; PAM sequence: TTG
ttatattctaaattcattcc

SEQ ID NO: 166899 - DNA, 20 bp, Artificial Sequence
  Description of Artificial Sequence: Synthetic oligonucleotide
  Target: ATXN1; (-) strand; PAM type: YTN; PAM sequence: TTT
gttatattctaaattcattc

SEQ ID NO: 166900 - DNA, 20 bp, Artificial Sequence
  Description of Artificial Sequence: Synthetic oligonucleotide
  Target: ATXN1; (-) strand; PAM type: YTN; PAM sequence: TTT
tgttatattctaaattcatt

SEQ ID NO: 166901 - DNA, 20 bp, Artificial Sequence
  Description of Artificial Sequence: Synthetic oligonucleotide
  Target: ATXN1; (-) strand; PAM type: YTN; PAM sequence: CTT
ttgttatattctaaattcat

SEQ ID NO: 166902 - DNA, 20 bp, Artificial Sequence
  Description of Artificial Sequence: Synthetic oligonucleotide
  Target: ATXN1; (-) strand; PAM type: YTN; PAM sequence: CTA
acaaaatccaagaggccctt

SEQ ID NO: 166903 - DNA, 20 bp, Artificial Sequence
  Description of Artificial Sequence: Synthetic oligonucleotide
  Target: ATXN1; (-) strand; PAM type: YTN; PAM sequence: TTG
atcaactaacaaaatccaag

SEQ ID NO: 166904 - DNA, 20 bp, Artificial Sequence
  Description of Artificial Sequence: Synthetic oligonucleotide
  Target: ATXN1; (-) strand; PAM type: YTN; PAM sequence: CTT
gatcaactaacaaaatccaa

SEQ ID NO: 166905 - DNA, 20 bp, Artificial Sequence
  Description of Artificial Sequence: Synthetic oligonucleotide
  Target: ATXN1; (-) strand; PAM type: YTN; PAM sequence: TTC
ttgatcaactaacaaaatcc

SEQ ID NO: 166906 - DNA, 20 bp, Artificial Sequence
  Description of Artificial Sequence: Synthetic oligonucleotide
  Target: ATXN1; (-) strand; PAM type: YTN; PAM sequence: CTG
agattcttgatcaactaaca

SEQ ID NO: 166907 - DNA, 20 bp, Artificial Sequence
  Description of Artificial Sequence: Synthetic oligonucleotide
  Target: ATXN1; (-) strand; PAM type: YTN; PAM sequence: CTC
tgagattcttgatcaactaa

SEQ ID NO: 166908 - DNA, 20 bp, Artificial Sequence
  Description of Artificial Sequence: Synthetic oligonucleotide
  Target: ATXN1; (-) strand; PAM type: YTN; PAM sequence: TTA
agtgtctctgagattcttga

SEQ ID NO: 166909 - DNA, 20 bp, Artificial Sequence
  Description of Artificial Sequence: Synthetic oligonucleotide
  Target: ATXN1; (-) strand; PAM type: YTN; PAM sequence: TTT
aagtgtctctgagattcttg

SEQ ID NO: 166910 - DNA, 20 bp, Artificial Sequence
  Description of Artificial Sequence: Synthetic oligonucleotide
  Target: ATXN1; (-) strand; PAM type: YTN; PAM sequence: TTC
atgcatatatagtttaagtg

SEQ ID NO: 166911 - DNA, 20 bp, Artificial Sequence
  Description of Artificial Sequence: Synthetic oligonucleotide
  Target: ATXN1; (-) strand; PAM type: YTN; PAM sequence: TTT
catgcatatatagtttaagt

SEQ ID NO: 166912 - DNA, 20 bp, Artificial Sequence
  Description of Artificial Sequence: Synthetic oligonucleotide
  Target: ATXN1; (-) strand; PAM type: YTN; PAM sequence: TTA
tttcatgcatatatagttta

SEQ ID NO: 166913 - DNA, 20 bp, Artificial Sequence
  Description of Artificial Sequence: Synthetic oligonucleotide
  Target: ATXN1; (-) strand; PAM type: YTN; PAM sequence: TTT
atttcatgcatatatagttt

SEQ ID NO: 166914 - DNA, 20 bp, Artificial Sequence
  Description of Artificial Sequence: Synthetic oligonucleotide
  Target: ATXN1; (-) strand; PAM type: YTN; PAM sequence: TTT
tatttcatgcatatatagtt

SEQ ID NO: 166915 - DNA, 20 bp, Artificial Sequence
  Description of Artificial Sequence: Synthetic oligonucleotide
  Target: ATXN1; (-) strand; PAM type: YTN; PAM sequence: CTA
ttttatttcatgcatatata

SEQ ID NO: 166916 - DNA, 20 bp, Artificial Sequence
  Description of Artificial Sequence: Synthetic oligonucleotide
  Target: ATXN1; (-) strand; PAM type: YTN; PAM sequence: CTG
gcctattttatttcatgcat

SEQ ID NO: 166917 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccgtgcc

SEQ ID NO: 166918 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccac

SEQ ID NO: 166919 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 166920 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 166921 - DNA, 20 bp, Artificial Sequence
  Description of Artificial Sequence: Synthetic oligonucleotide
  Target: ATXN1; (-) strand; PAM type: YTN; PAM sequence: CTG
cctcggcctcccaaagtgct

SEQ ID NO: 166922 - DNA, 20 bp, Artificial Sequence
  Description of Artificial Sequence: Synthetic oligonucleotide
  Target: ATXN1; (-) strand; PAM type: YTN; PAM sequence: CTC
aagtgatccacctgcctcgg

SEQ ID NO: 166923 - DNA, 20 bp, Artificial Sequence
  Description of Artificial Sequence: Synthetic oligonucleotide
  Target: ATXN1; (-) strand; PAM type: YTN; PAM sequence: CTG
acctcaagtgatccacctgc

SEQ ID NO: 166924 - DNA, 20 bp, Artificial Sequence
  Description of Artificial Sequence: Synthetic oligonucleotide
  Target: ATXN1; (-) strand; PAM type: YTN; PAM sequence: CTC
caacacctgacctcaagtga

SEQ ID NO: 166925 - DNA, 20 bp, Artificial Sequence
  Description of Artificial Sequence: Synthetic oligonucleotide
  Target: ATXN1; (-) strand; PAM type: YTN; PAM sequence: CTG
gtctccaacacctgacctca

SEQ ID NO: 166926 - DNA, 20 bp, Artificial Sequence
  Description of Artificial Sequence: Synthetic oligonucleotide
  Target: ATXN1; (-) strand; PAM type: YTN; PAM sequence: CTA
gtctggtctccaacacctga

SEQ ID NO: 166927 - DNA, 20 bp, Artificial Sequence
  Description of Artificial Sequence: Synthetic oligonucleotide
  Target: ATXN1; (-) strand; PAM type: YTN; PAM sequence: TTG
gctagtctggtctccaacac

SEQ ID NO: 166928 - DNA, 20 bp, Artificial Sequence
  Description of Artificial Sequence: Synthetic oligonucleotide
  Target: ATXN1; (-) strand; PAM type: YTN; PAM sequence: TTC
aatatgttggctagtctggt

SEQ ID NO: 166929 - DNA, 20 bp, Artificial Sequence
  Description of Artificial Sequence: Synthetic oligonucleotide
  Target: ATXN1; (-) strand; PAM type: YTN; PAM sequence: TTT
caatatgttggctagtctgg

SEQ ID NO: 166930 - DNA, 20 bp, Artificial Sequence
  Description of Artificial Sequence: Synthetic oligonucleotide
  Target: ATXN1; (-) strand; PAM type: YTN; PAM sequence: TTA
atagagaaggggtttcaata

SEQ ID NO: 166931 - DNA, 20 bp, Artificial Sequence
  Description of Artificial Sequence: Synthetic oligonucleotide
  Target: ATXN1; (-) strand; PAM type: YTN; PAM sequence: TTT
aatagagaaggggtttcaat

SEQ ID NO: 166932 - DNA, 20 bp, Artificial Sequence
  Description of Artificial Sequence: Synthetic oligonucleotide
  Target: ATXN1; (-) strand; PAM type: YTN; PAM sequence: TTT
taatagagaaggggtttcaa

SEQ ID NO: 166933 - DNA, 20 bp, Artificial Sequence
  Description of Artificial Sequence: Synthetic oligonucleotide
  Target: ATXN1; (-) strand; PAM type: YTN; PAM sequence: TTT
ttaatagagaaggggtttca

SEQ ID NO: 166934 - DNA, 20 bp, Artificial Sequence
  Description of Artificial Sequence: Synthetic oligonucleotide
  Target: ATXN1; (-) strand; PAM type: YTN; PAM sequence: TTG
tatttttaatagagaagggg

SEQ ID NO: 166935 - DNA, 20 bp, Artificial Sequence
  Description of Artificial Sequence: Synthetic oligonucleotide
  Target: ATXN1; (-) strand; PAM type: YTN; PAM sequence: TTT
gtatttttaatagagaaggg

SEQ ID NO: 166936 - DNA, 20 bp, Artificial Sequence
  Description of Artificial Sequence: Synthetic oligonucleotide
  Target: ATXN1; (-) strand; PAM type: YTN; PAM sequence: TTT
tgtatttttaatagagaagg

SEQ ID NO: 166937 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttaatagagaag

SEQ ID NO: 166938 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttaataga

SEQ ID NO: 166939 - DNA, 20 bp, Artificial Sequence
  Description of Artificial Sequence: Synthetic oligonucleotide
  Target: ATXN1; (-) strand; PAM type: YTN; PAM sequence: TTA
caggtgcccgccatcatgcc

SEQ ID NO: 166940 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgcccgccat

SEQ ID NO: 166941 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgggattacag

SEQ ID NO: 166942 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctggga

SEQ ID NO: 166943 - DNA, 20 bp, Artificial Sequence
  Description of Artificial Sequence: Synthetic oligonucleotide
  Target: ATXN1; (-) strand; PAM type: YTN; PAM sequence: CTG
tctcagcctcccgagtagct

SEQ ID NO: 166944 - DNA, 20 bp, Artificial Sequence
  Description of Artificial Sequence: Synthetic oligonucleotide
  Target: ATXN1; (-) strand; PAM type: YTN; PAM sequence: CTC
ctgtctcagcctcccgagta

SEQ ID NO: 166945 - DNA, 20 bp, Artificial Sequence
  Description of Artificial Sequence: Synthetic oligonucleotide
  Target: ATXN1; (-) strand; PAM type: YTN; PAM sequence: TTC
tcctgtctcagcctcccgag

SEQ ID NO: 166946 - DNA, 20 bp, Artificial Sequence
  Description of Artificial Sequence: Synthetic oligonucleotide
  Target: ATXN1; (-) strand; PAM type: YTN; PAM sequence: TTC
aagtgattctcctgtctcag

SEQ ID NO: 166947 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagtgattctcc

SEQ ID NO: 166948 - DNA, 20 bp, Artificial Sequence
  Description of Artificial Sequence: Synthetic oligonucleotide
  Target: ATXN1; (-) strand; PAM type: YTN; PAM sequence: CTC
cacctcccgggttcaagtga

SEQ ID NO: 166949 - DNA, 20 bp, Artificial Sequence
  Description of Artificial Sequence: Synthetic oligonucleotide
  Target: ATXN1; (-) strand; PAM type: YTN; PAM sequence: CTG
caacctccacctcccgggtt

SEQ ID NO: 166950 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccacctcccg

SEQ ID NO: 166951 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctccacc

SEQ ID NO: 166952 - DNA, 20 bp, Artificial Sequence
  Description of Artificial Sequence: Synthetic oligonucleotide
  Target: ATXN1; (-) strand; PAM type: YTN; PAM sequence: CTG
gagtgtagtggtgtagtctc

SEQ ID NO: 166953 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggagtgtag

SEQ ID NO: 166954 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctggagtgt

SEQ ID NO: 166955 - DNA, 20 bp, Artificial Sequence
  Description of Artificial Sequence: Synthetic oligonucleotide
  Target: ATXN1; (-) strand; PAM type: YTN; PAM sequence: CTC
actctgtcacccaggctgga

SEQ ID NO: 166956 - DNA, 20 bp, Artificial Sequence
  Description of Artificial Sequence: Synthetic oligonucleotide
  Target: ATXN1; (-) strand; PAM type: YTN; PAM sequence: TTC
agacagagtctcactctgtc

SEQ ID NO: 166957 - DNA, 20 bp, Artificial Sequence
  Description of Artificial Sequence: Synthetic oligonucleotide
  Target: ATXN1; (-) strand; PAM type: YTN; PAM sequence: TTT
cagacagagtctcactctgt

SEQ ID NO: 166958 - DNA, 20 bp, Artificial Sequence
  Description of Artificial Sequence: Synthetic oligonucleotide
  Target: ATXN1; (-) strand; PAM type: YTN; PAM sequence: TTT
tcagacagagtctcactctg

SEQ ID NO: 166959 - DNA, 20 bp, Artificial Sequence
  Description of Artificial Sequence: Synthetic oligonucleotide
  Target: ATXN1; (-) strand; PAM type: YTN; PAM sequence: TTT
ttcagacagagtctcactct

SEQ ID NO: 166960 - DNA, 20 bp, Artificial Sequence
  Description of Artificial Sequence: Synthetic oligonucleotide
  Target: ATXN1; (-) strand; PAM type: YTN; PAM sequence: TTT
tttcagacagagtctcactc

SEQ ID NO: 166961 - DNA, 20 bp, Artificial Sequence
  Description of Artificial Sequence: Synthetic oligonucleotide
  Target: ATXN1; (-) strand; PAM type: YTN; PAM sequence: TTT
ttttcagacagagtctcact

SEQ ID NO: 166962 - DNA, 20 bp, Artificial Sequence
  Description of Artificial Sequence: Synthetic oligonucleotide
  Target: ATXN1; (-) strand; PAM type: YTN; PAM sequence: TTT
tttttcagacagagtctcac

SEQ ID NO: 166963 - DNA, 20 bp, Artificial Sequence
  Description of Artificial Sequence: Synthetic oligonucleotide
  Target: ATXN1; (-) strand; PAM type: YTN; PAM sequence: TTT
ttttttcagacagagtctca

SEQ ID NO: 166964 - DNA, 20 bp, Artificial Sequence
  Description of Artificial Sequence: Synthetic oligonucleotide
  Target: ATXN1; (-) strand; PAM type: YTN; PAM sequence: TTT
tttttttcagacagagtctc

SEQ ID NO: 166965 - DNA, 20 bp, Artificial Sequence
  Description of Artificial Sequence: Synthetic oligonucleotide
  Target: ATXN1; (-) strand; PAM type: YTN; PAM sequence: TTT
ttttttttcagacagagtct

SEQ ID NO: 166966 - DNA, 20 bp, Artificial Sequence
  Description of Artificial Sequence: Synthetic oligonucleotide
  Target: ATXN1; (-) strand; PAM type: YTN; PAM sequence: TTT
tttttttttcagacagagtc

SEQ ID NO: 166967 - DNA, 20 bp, Artificial Sequence
  Description of Artificial Sequence: Synthetic oligonucleotide
  Target: ATXN1; (-) strand; PAM type: YTN; PAM sequence: TTT
ttttttttttcagacagagt

SEQ ID NO: 166968 - DNA, 20 bp, Artificial Sequence
  Description of Artificial Sequence: Synthetic oligonucleotide
  Target: ATXN1; (-) strand; PAM type: YTN; PAM sequence: TTT
tttttttttttcagacagag

SEQ ID NO: 166969 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttcagacaga

SEQ ID NO: 166970 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttcagacag

SEQ ID NO: 166971 - DNA, 20 bp, Artificial Sequence
  Description of Artificial Sequence: Synthetic oligonucleotide
  Target: ATXN1; (-) strand; PAM type: YTN; PAM sequence: TTC
tttttttttttttttcagac

SEQ ID NO: 166972 - DNA, 20 bp, Artificial Sequence
  Description of Artificial Sequence: Synthetic oligonucleotide
  Target: ATXN1; (-) strand; PAM type: YTN; PAM sequence: TTT
ctttttttttttttttcaga

SEQ ID NO: 166973 - DNA, 20 bp, Artificial Sequence
  Description of Artificial Sequence: Synthetic oligonucleotide
  Target: ATXN1; (-) strand; PAM type: YTN; PAM sequence: TTT
tctttttttttttttttcag

SEQ ID NO: 166974 - DNA, 20 bp, Artificial Sequence
  Description of Artificial Sequence: Synthetic oligonucleotide
  Target: ATXN1; (-) strand; PAM type: YTN; PAM sequence: TTT
ttctttttttttttttttca

SEQ ID NO: 166975 - DNA, 20 bp, Artificial Sequence
  Description of Artificial Sequence: Synthetic oligonucleotide
  Target: ATXN1; (-) strand; PAM type: YTN; PAM sequence: CTT
tttctttttttttttttttc

SEQ ID NO: 166976 - DNA, 20 bp, Artificial Sequence
  Description of Artificial Sequence: Synthetic oligonucleotide
  Target: ATXN1; (-) strand; PAM type: YTN; PAM sequence: TTC
tttttctttttttttttttt

SEQ ID NO: 166977 - DNA, 20 bp, Artificial Sequence
  Description of Artificial Sequence: Synthetic oligonucleotide
  Target: ATXN1; (-) strand; PAM type: YTN; PAM sequence: TTT
ctttttcttttttttttttt

SEQ ID NO: 166978 - DNA, 20 bp, Artificial Sequence
  Description of Artificial Sequence: Synthetic oligonucleotide
  Target: ATXN1; (-) strand; PAM type: YTN; PAM sequence: TTT
tctttttctttttttttttt

SEQ ID NO: 166979 - DNA, 20 bp, Artificial Sequence
  Description of Artificial Sequence: Synthetic oligonucleotide
  Target: ATXN1; (-) strand; PAM type: YTN; PAM sequence: TTT
ttctttttcttttttttttt

SEQ ID NO: 166980 - DNA, 20 bp, Artificial Sequence
  Description of Artificial Sequence: Synthetic oligonucleotide
  Target: ATXN1; (-) strand; PAM type: YTN; PAM sequence: TTT
tttctttttctttttttttt

SEQ ID NO: 166981 - DNA, 20 bp, Artificial Sequence
  Description of Artificial Sequence: Synthetic oligonucleotide
  Target: ATXN1; (-) strand; PAM type: YTN; PAM sequence: TTT
ttttctttttcttttttttt

SEQ ID NO: 166982 - DNA, 20 bp, Artificial Sequence
  Description of Artificial Sequence: Synthetic oligonucleotide
  Target: ATXN1; (-) strand; PAM type: YTN; PAM sequence: CTG
tttttttctttttctttttt

SEQ ID NO: 166983 - DNA, 20 bp, Artificial Sequence
  Description of Artificial Sequence: Synthetic oligonucleotide
  Target: ATXN1; (-) strand; PAM type: YTN; PAM sequence: TTG
ggcctgtttttttctttttc

SEQ ID NO: 166984 - DNA, 20 bp, Artificial Sequence
  Description of Artificial Sequence: Synthetic oligonucleotide
  Target: ATXN1; (-) strand; PAM type: YTN; PAM sequence: TTT
gggcctgtttttttcttttt

SEQ ID NO: 166985 - DNA, 20 bp, Artificial Sequence
  Description of Artificial Sequence: Synthetic oligonucleotide
  Target: ATXN1; (-) strand; PAM type: YTN; PAM sequence: TTA
gaggtttgggcctgtttttt

SEQ ID NO: 166986 - DNA, 20 bp, Artificial Sequence
  Description of Artificial Sequence: Synthetic oligonucleotide
  Target: ATXN1; (-) strand; PAM type: YTN; PAM sequence: TTG
attagaggtttgggcctgtt

SEQ ID NO: 166987 - DNA, 20 bp, Artificial Sequence
  Description of Artificial Sequence: Synthetic oligonucleotide
  Target: ATXN1; (-) strand; PAM type: YTN; PAM sequence: TTG
tgaacatgtaacatgtgggt

SEQ ID NO: 166988 - DNA, 20 bp, Artificial Sequence
  Description of Artificial Sequence: Synthetic oligonucleotide
  Target: ATXN1; (-) strand; PAM type: YTN; PAM sequence: TTT
gtgaacatgtaacatgtggg

SEQ ID NO: 166989 - DNA, 20 bp, Artificial Sequence
  Description of Artificial Sequence: Synthetic oligonucleotide
  Target: ATXN1; (-) strand; PAM type: YTN; PAM sequence: TTT
tgtgaacatgtaacatgtgg

SEQ ID NO: 166990 - DNA, 20 bp, Artificial Sequence
  Description of Artificial Sequence: Synthetic oligonucleotide
  Target: ATXN1; (-) strand; PAM type: YTN; PAM sequence: TTT
ttgtgaacatgtaacatgtg

SEQ ID NO: 166991 - DNA, 20 bp, Artificial Sequence
  Description of Artificial Sequence: Synthetic oligonucleotide
  Target: ATXN1; (-) strand; PAM type: YTN; PAM sequence: TTG
gatatttttgtgaacatgta

SEQ ID NO: 166992 - DNA, 20 bp, Artificial Sequence
  Description of Artificial Sequence: Synthetic oligonucleotide
  Target: ATXN1; (-) strand; PAM type: YTN; PAM sequence: CTG
ggtcagaacccccattggat

SEQ ID NO: 166993 - DNA, 20 bp, Artificial Sequence
  Description of Artificial Sequence: Synthetic oligonucleotide
  Target: ATXN1; (-) strand; PAM type: YTN; PAM sequence: TTC
tgggtcagaacccccattgg

SEQ ID NO: 166994 - DNA, 20 bp, Artificial Sequence
  Description of Artificial Sequence: Synthetic oligonucleotide
  Target: ATXN1; (-) strand; PAM type: YTN; PAM sequence: TTA
atattctgggtcagaacccc

SEQ ID NO: 166995 - DNA, 20 bp, Artificial Sequence
  Description of Artificial Sequence: Synthetic oligonucleotide
  Target: ATXN1; (-) strand; PAM type: YTN; PAM sequence: TTT
aatattctgggtcagaaccc

SEQ ID NO: 166996 - DNA, 20 bp, Artificial Sequence
  Description of Artificial Sequence: Synthetic oligonucleotide
  Target: ATXN1; (-) strand; PAM type: YTN; PAM sequence: CTT
taatattctgggtcagaacc

SEQ ID NO: 166997 - DNA, 20 bp, Artificial Sequence
  Description of Artificial Sequence: Synthetic oligonucleotide
  Target: ATXN1; (-) strand; PAM type: YTN; PAM sequence: TTA
aaaccaggactttaatattc

SEQ ID NO: 166998 - DNA, 20 bp, Artificial Sequence
  Description of Artificial Sequence: Synthetic oligonucleotide
  Target: ATXN1; (-) strand; PAM type: YTN; PAM sequence: CTC
attaaaaccaggactttaat

SEQ ID NO: 166999 - DNA, 20 bp, Artificial Sequence
  Description of Artificial Sequence: Synthetic oligonucleotide
  Target: ATXN1; (-) strand; PAM type: YTN; PAM sequence: TTC
atagctcattaaaaccagga

SEQ ID NO: 167000 - DNA, 20 bp, Artificial Sequence
  Description of Artificial Sequence: Synthetic oligonucleotide
  Target: ATXN1; (-) strand; PAM type: YTN; PAM sequence: TTT
catagctcattaaaaccagg

SEQ ID NO: 167001 - DNA, 20 bp, Artificial Sequence
  Description of Artificial Sequence: Synthetic oligonucleotide
  Target: ATXN1; (-) strand; PAM type: YTN; PAM sequence: TTC
cccatttcatagctcattaa

SEQ ID NO: 167002 - DNA, 20 bp, Artificial Sequence
  Description of Artificial Sequence: Synthetic oligonucleotide
  Target: ATXN1; (-) strand; PAM type: YTN; PAM sequence: TTA
agttccccatttcatagctc

SEQ ID NO: 167003 - DNA, 20 bp, Artificial Sequence
  Description of Artificial Sequence: Synthetic oligonucleotide
  Target: ATXN1; (-) strand; PAM type: YTN; PAM sequence: TTT
aagttccccatttcatagct

SEQ ID NO: 167004 - DNA, 20 bp, Artificial Sequence
  Description of Artificial Sequence: Synthetic oligonucleotide
  Target: ATXN1; (-) strand; PAM type: YTN; PAM sequence: TTT
taagttccccatttcatagc

SEQ ID NO: 167005 - DNA, 20 bp, Artificial Sequence
  Description of Artificial Sequence: Synthetic oligonucleotide
  Target: ATXN1; (-) strand; PAM type: YTN; PAM sequence: TTT
ttaagttccccatttcatag

SEQ ID NO: 167006 - DNA, 20 bp, Artificial Sequence
  Description of Artificial Sequence: Synthetic oligonucleotide
  Target: ATXN1; (-) strand; PAM type: YTN; PAM sequence: TTT
tttaagttccccatttcata

SEQ ID NO: 167007 - DNA, 20 bp, Artificial Sequence
  Description of Artificial Sequence: Synthetic oligonucleotide
  Target: ATXN1; (-) strand; PAM type: YTN; PAM sequence: TTT
ttttaagttccccatttcat

SEQ ID NO: 167008 - DNA, 20 bp, Artificial Sequence
  Description of Artificial Sequence: Synthetic oligonucleotide
  Target: ATXN1; (-) strand; PAM type: YTN; PAM sequence: TTG
taatttttttaagttcccca

SEQ ID NO: 167009 - DNA, 20 bp, Artificial Sequence
  Description of Artificial Sequence: Synthetic oligonucleotide
  Target: ATXN1; (-) strand; PAM type: YTN; PAM sequence: TTT
gtaatttttttaagttcccc

SEQ ID NO: 167010 - DNA, 20 bp, Artificial Sequence
  Description of Artificial Sequence: Synthetic oligonucleotide
  Target: ATXN1; (-) strand; PAM type: YTN; PAM sequence: TTG
cacatttgtaatttttttaa

SEQ ID NO: 167011 - DNA, 20 bp, Artificial Sequence
  Description of Artificial Sequence: Synthetic oligonucleotide
  Target: ATXN1; (-) strand; PAM type: YTN; PAM sequence: TTA
aaagtcaaagaaatataaaa

SEQ ID NO: 167012 - DNA, 20 bp, Artificial Sequence
  Description of Artificial Sequence: Synthetic oligonucleotide
  Target: ATXN1; (-) strand; PAM type: YTN; PAM sequence: CTT
aaaagtcaaagaaatataaa

SEQ ID NO: 167013 - DNA, 20 bp, Artificial Sequence
  Description of Artificial Sequence: Synthetic oligonucleotide
  Target: ATXN1; (-) strand; PAM type: YTN; PAM sequence: TTC
ttaaaagtcaaagaaatata

SEQ ID NO: 167014 - DNA, 20 bp, Artificial Sequence
  Description of Artificial Sequence: Synthetic oligonucleotide
  Target: ATXN1; (-) strand; PAM type: YTN; PAM sequence: TTG
ttcttaaaagtcaaagaaat

SEQ ID NO: 167015 - DNA, 20 bp, Artificial Sequence
  Description of Artificial Sequence: Synthetic oligonucleotide
  Target: ATXN1; (-) strand; PAM type: YTN; PAM sequence: CTA
tgcatgagattgttcttaaa

SEQ ID NO: 167016 - DNA, 20 bp, Artificial Sequence
  Description of Artificial Sequence: Synthetic oligonucleotide
  Target: ATXN1; (-) strand; PAM type: YTN; PAM sequence: CTC
tatgcatgagattgttctta

SEQ ID NO: 167017 - DNA, 20 bp, Artificial Sequence
  Description of Artificial Sequence: Synthetic oligonucleotide
  Target: ATXN1; (-) strand; PAM type: YTN; PAM sequence: TTG
ggctctatgcatgagattgt

SEQ ID NO: 167018 - DNA, 20 bp, Artificial Sequence
  Description of Artificial Sequence: Synthetic oligonucleotide
  Target: ATXN1; (-) strand; PAM type: YTN; PAM sequence: TTT
gggctctatgcatgagattg

SEQ ID NO: 167019 - DNA, 20 bp, Artificial Sequence
  Description of Artificial Sequence: Synthetic oligonucleotide
  Target: ATXN1; (-) strand; PAM type: YTN; PAM sequence: CTC
cagtttgggctctatgcatg

SEQ ID NO: 167020 - DNA, 20 bp, Artificial Sequence
  Description of Artificial Sequence: Synthetic oligonucleotide
  Target: ATXN1; (-) strand; PAM type: YTN; PAM sequence: CTA
cagatctccagtttgggctc

SEQ ID NO: 167021 - DNA, 20 bp, Artificial Sequence
  Description of Artificial Sequence: Synthetic oligonucleotide
  Target: ATXN1; (-) strand; PAM type: YTN; PAM sequence: CTA
aaagctacagatctccagtt

SEQ ID NO: 167022 - DNA, 20 bp, Artificial Sequence
  Description of Artificial Sequence: Synthetic oligonucleotide
  Target: ATXN1; (-) strand; PAM type: YTN; PAM sequence: TTG
agagacaaagtcactaaaag

SEQ ID NO: 167023 - DNA, 20 bp, Artificial Sequence
  Description of Artificial Sequence: Synthetic oligonucleotide
  Target: ATXN1; (-) strand; PAM type: YTN; PAM sequence: TTC
ccccagggtaattgagagac

SEQ ID NO: 167024 - DNA, 20 bp, Artificial Sequence
  Description of Artificial Sequence: Synthetic oligonucleotide
  Target: ATXN1; (-) strand; PAM type: YTN; PAM sequence: CTT
cccccagggtaattgagaga

SEQ ID NO: 167025 - DNA, 20 bp, Artificial Sequence
  Description of Artificial Sequence: Synthetic oligonucleotide
  Target: ATXN1; (-) strand; PAM type: YTN; PAM sequence: TTA
agacaggtcggaggacaggg

SEQ ID NO: 167026 - DNA, 20 bp, Artificial Sequence
  Description of Artificial Sequence: Synthetic oligonucleotide
  Target: ATXN1; (-) strand; PAM type: YTN; PAM sequence: CTG
ttaagacaggtcggaggaca

SEQ ID NO: 167027 - DNA, 20 bp, Artificial Sequence
  Description of Artificial Sequence: Synthetic oligonucleotide
  Target: ATXN1; (-) strand; PAM type: YTN; PAM sequence: CTG
tgtctgttaagacaggtcgg

SEQ ID NO: 167028 - DNA, 20 bp, Artificial Sequence
  Description of Artificial Sequence: Synthetic oligonucleotide
  Target: ATXN1; (-) strand; PAM type: YTN; PAM sequence: CTA
tgtgtctgtgtctgttaaga

SEQ ID NO: 167029 - DNA, 20 bp, Artificial Sequence
  Description of Artificial Sequence: Synthetic oligonucleotide
  Target: ATXN1; (-) strand; PAM type: YTN; PAM sequence: TTA
tgctatgtgtctgtgtctgt

SEQ ID NO: 167030 - DNA, 20 bp, Artificial Sequence
  Description of Artificial Sequence: Synthetic oligonucleotide
  Target: ATXN1; (-) strand; PAM type: YTN; PAM sequence: TTG
aattatgctatgtgtctgtg

SEQ ID NO: 167031 - DNA, 20 bp, Artificial Sequence
  Description of Artificial Sequence: Synthetic oligonucleotide
  Target: ATXN1; (-) strand; PAM type: YTN; PAM sequence: CTA
ttgaattatgctatgtgtct

SEQ ID NO: 167032 - DNA, 20 bp, Artificial Sequence
  Description of Artificial Sequence: Synthetic oligonucleotide
  Target: ATXN1; (-) strand; PAM type: YTN; PAM sequence: CTA
ataacagcagcactattgaa

SEQ ID NO: 167033 - DNA, 20 bp, Artificial Sequence
  Description of Artificial Sequence: Synthetic oligonucleotide
  Target: ATXN1; (-) strand; PAM type: YTN; PAM sequence: CTG
ctaataacagcagcactatt

SEQ ID NO: 167034 - DNA, 20 bp, Artificial Sequence
  Description of Artificial Sequence: Synthetic oligonucleotide
  Target: ATXN1; (-) strand; PAM type: YTN; PAM sequence: TTC
acagaggctgctaataacag

SEQ ID NO: 167035 - DNA, 20 bp, Artificial Sequence
  Description of Artificial Sequence: Synthetic oligonucleotide
  Target: ATXN1; (-) strand; PAM type: YTN; PAM sequence: CTC
gggttcacagaggctgctaa

SEQ ID NO: 167036 - DNA, 20 bp, Artificial Sequence
  Description of Artificial Sequence: Synthetic oligonucleotide
  Target: ATXN1; (-) strand; PAM type: YTN; PAM sequence: TTA
ctcgggttcacagaggctgc

SEQ ID NO: 167037 - DNA, 20 bp, Artificial Sequence
  Description of Artificial Sequence: Synthetic oligonucleotide
  Target: ATXN1; (-) strand; PAM type: YTN; PAM sequence: TTG
tatgcaaggttactcgggtt

SEQ ID NO: 167038 - DNA, 20 bp, Artificial Sequence
  Description of Artificial Sequence: Synthetic oligonucleotide
  Target: ATXN1; (-) strand; PAM type: YTN; PAM sequence: CTT
gtatgcaaggttactcgggt

SEQ ID NO: 167039 - DNA, 20 bp, Artificial Sequence
  Description of Artificial Sequence: Synthetic oligonucleotide
  Target: ATXN1; (-) strand; PAM type: YTN; PAM sequence: TTC
catgagacttgtatgcaagg

SEQ ID NO: 167040 - DNA, 20 bp, Artificial Sequence
  Description of Artificial Sequence: Synthetic oligonucleotide
  Target: ATXN1; (-) strand; PAM type: YTN; PAM sequence: TTT
ccatgagacttgtatgcaag

SEQ ID NO: 167041 - DNA, 20 bp, Artificial Sequence
  Description of Artificial Sequence: Synthetic oligonucleotide
  Target: ATXN1; (-) strand; PAM type: YTN; PAM sequence: CTT
tccatgagacttgtatgcaa

SEQ ID NO: 167042 - DNA, 20 bp, Artificial Sequence
  Description of Artificial Sequence: Synthetic oligonucleotide
  Target: ATXN1; (-) strand; PAM type: YTN; PAM sequence: CTG
gcaaatgtgtgctttccatg

SEQ ID NO: 167043 - DNA, 20 bp, Artificial Sequence
  Description of Artificial Sequence: Synthetic oligonucleotide
  Target: ATXN1; (-) strand; PAM type: YTN; PAM sequence: TTA
atagcaactggcaaatgtgt

SEQ ID NO: 167044 - DNA, 20 bp, Artificial Sequence
  Description of Artificial Sequence: Synthetic oligonucleotide
  Target: ATXN1; (-) strand; PAM type: YTN; PAM sequence: CTA
tcaatatgtcaatgattaat

SEQ ID NO: 167045 - DNA, 20 bp, Artificial Sequence
  Description of Artificial Sequence: Synthetic oligonucleotide
  Target: ATXN1; (-) strand; PAM type: YTN; PAM sequence: TTA
cccccacactatcaatatgt

SEQ ID NO: 167046 - DNA, 20 bp, Artificial Sequence
  Description of Artificial Sequence: Synthetic oligonucleotide
  Target: ATXN1; (-) strand; PAM type: YTN; PAM sequence: CTC
cccagtatcagcatacgcag

SEQ ID NO: 167047 - DNA, 20 bp, Artificial Sequence
  Description of Artificial Sequence: Synthetic oligonucleotide
  Target: ATXN1; (-) strand; PAM type: YTN; PAM sequence: CTG
ccccctccccagtatcagca

SEQ ID NO: 167048 - DNA, 20 bp, Artificial Sequence
  Description of Artificial Sequence: Synthetic oligonucleotide
  Target: ATXN1; (-) strand; PAM type: YTN; PAM sequence: CTC
tgccccctccccagtatcag

SEQ ID NO: 167049 - DNA, 20 bp, Artificial Sequence
  Description of Artificial Sequence: Synthetic oligonucleotide
  Target: ATXN1; (-) strand; PAM type: YTN; PAM sequence: TTC
ccatctctgccccctcccca

SEQ ID NO: 167050 - DNA, 20 bp, Artificial Sequence
  Description of Artificial Sequence: Synthetic oligonucleotide
  Target: ATXN1; (-) strand; PAM type: YTN; PAM sequence: TTT
cccatctctgccccctcccc

SEQ ID NO: 167051 - DNA, 20 bp, Artificial Sequence
  Description of Artificial Sequence: Synthetic oligonucleotide
  Target: ATXN1; (-) strand; PAM type: YTN; PAM sequence: CTT
tcccatctctgccccctccc

SEQ ID NO: 167052 - DNA, 20 bp, Artificial Sequence
  Description of Artificial Sequence: Synthetic oligonucleotide
  Target: ATXN1; (-) strand; PAM type: YTN; PAM sequence: CTG
cccctttcccatctctgccc

SEQ ID NO: 167053 - DNA, 20 bp, Artificial Sequence
  Description of Artificial Sequence: Synthetic oligonucleotide
  Target: ATXN1; (-) strand; PAM type: YTN; PAM sequence: TTA
taactgcccctttcccatct

SEQ ID NO: 167054 - DNA, 20 bp, Artificial Sequence
  Description of Artificial Sequence: Synthetic oligonucleotide
  Target: ATXN1; (-) strand; PAM type: YTN; PAM sequence: TTT
ataactgcccctttcccatc

SEQ ID NO: 167055 - DNA, 20 bp, Artificial Sequence
  Description of Artificial Sequence: Synthetic oligonucleotide
  Target: ATXN1; (-) strand; PAM type: YTN; PAM sequence: TTA
gcaatttataactgcccctt

SEQ ID NO: 167056 - DNA, 20 bp, Artificial Sequence
  Description of Artificial Sequence: Synthetic oligonucleotide
  Target: ATXN1; (-) strand; PAM type: YTN; PAM sequence: CTT
agcaatttataactgcccct

SEQ ID NO: 167057 - DNA, 20 bp, Artificial Sequence
  Description of Artificial Sequence: Synthetic oligonucleotide
  Target: ATXN1; (-) strand; PAM type: YTN; PAM sequence: CTG
aatataaacacaataactta

SEQ ID NO: 167058 - DNA, 20 bp, Artificial Sequence
  Description of Artificial Sequence: Synthetic oligonucleotide
  Target: ATXN1; (-) strand; PAM type: YTN; PAM sequence: CTG
caagatgtgctgaatataaa

SEQ ID NO: 167059 - DNA, 20 bp, Artificial Sequence
  Description of Artificial Sequence: Synthetic oligonucleotide
  Target: ATXN1; (-) strand; PAM type: YTN; PAM sequence: TTG
gctgcaagatgtgctgaata

SEQ ID NO: 167060 - DNA, 20 bp, Artificial Sequence
  Description of Artificial Sequence: Synthetic oligonucleotide
  Target: ATXN1; (-) strand; PAM type: YTN; PAM sequence: CTT
ggctgcaagatgtgctgaat

SEQ ID NO: 167061 - DNA, 20 bp, Artificial Sequence
  Description of Artificial Sequence: Synthetic oligonucleotide
  Target: ATXN1; (-) strand; PAM type: YTN; PAM sequence: CTG
tatgtgtgtgtgtgtgtgtg

SEQ ID NO: 167062 - DNA, 20 bp, Artificial Sequence
  Description of Artificial Sequence: Synthetic oligonucleotide
  Target: ATXN1; (-) strand; PAM type: YTN; PAM sequence: TTG
tgtgtgtgtctgtatgtgtg

SEQ ID NO: 167063 - DNA, 20 bp, Artificial Sequence
  Description of Artificial Sequence: Synthetic oligonucleotide
  Target: ATXN1; (-) strand; PAM type: YTN; PAM sequence: CTG
attgtgtgtgtgtctgtatg

SEQ ID NO: 167064 - DNA, 20 bp, Artificial Sequence
  Description of Artificial Sequence: Synthetic oligonucleotide
  Target: ATXN1; (-) strand; PAM type: YTN; PAM sequence: TTA
cactgattgtgtgtgtgtct

SEQ ID NO: 167065 - DNA, 20 bp, Artificial Sequence
  Description of Artificial Sequence: Synthetic oligonucleotide
  Target: ATXN1; (-) strand; PAM type: YTN; PAM sequence: TTT
acactgattgtgtgtgtgtc

SEQ ID NO: 167066 - DNA, 20 bp, Artificial Sequence
  Description of Artificial Sequence: Synthetic oligonucleotide
  Target: ATXN1; (-) strand; PAM type: YTN; PAM sequence: CTT
tacactgattgtgtgtgtgt

SEQ ID NO: 167067 - DNA, 20 bp, Artificial Sequence
  Description of Artificial Sequence: Synthetic oligonucleotide
  Target: ATXN1; (-) strand; PAM type: YTN; PAM sequence: TTC
caggcataggtcagaatctt

SEQ ID NO: 167068 - DNA, 20 bp, Artificial Sequence
  Description of Artificial Sequence: Synthetic oligonucleotide
  Target: ATXN1; (-) strand; PAM type: YTN; PAM sequence: TTT
ccaggcataggtcagaatct

SEQ ID NO: 167069 - DNA, 20 bp, Artificial Sequence
  Description of Artificial Sequence: Synthetic oligonucleotide
  Target: ATXN1; (-) strand; PAM type: YTN; PAM sequence: TTG
tatttccaggcataggtcag

SEQ ID NO: 167070 - DNA, 20 bp, Artificial Sequence
  Description of Artificial Sequence: Synthetic oligonucleotide
  Target: ATXN1; (-) strand; PAM type: YTN; PAM sequence: TTA
ggattgtatttccaggcata

SEQ ID NO: 167071 - DNA, 20 bp, Artificial Sequence
  Description of Artificial Sequence: Synthetic oligonucleotide
  Target: ATXN1; (-) strand; PAM type: YTN; PAM sequence: CTT
aggattgtatttccaggcat

SEQ ID NO: 167072 - DNA, 20 bp, Artificial Sequence
  Description of Artificial Sequence: Synthetic oligonucleotide
  Target: ATXN1; (-) strand; PAM type: YTN; PAM sequence: CTA
gacttaggattgtatttcca

SEQ ID NO: 167073 - DNA, 20 bp, Artificial Sequence
  Description of Artificial Sequence: Synthetic oligonucleotide
  Target: ATXN1; (-) strand; PAM type: YTN; PAM sequence: TTA
tctagacttaggattgtatt

SEQ ID NO: 167074 - DNA, 20 bp, Artificial Sequence
  Description of Artificial Sequence: Synthetic oligonucleotide
  Target: ATXN1; (-) strand; PAM type: YTN; PAM sequence: TTT
atctagacttaggattgtat

SEQ ID NO: 167075 - DNA, 20 bp, Artificial Sequence
  Description of Artificial Sequence: Synthetic oligonucleotide
  Target: ATXN1; (-) strand; PAM type: YTN; PAM sequence: CTT
tatctagacttaggattgta

SEQ ID NO: 167076 - DNA, 20 bp, Artificial Sequence
  Description of Artificial Sequence: Synthetic oligonucleotide
  Target: ATXN1; (-) strand; PAM type: YTN; PAM sequence: CTC
ccctttatctagacttagga

SEQ ID NO: 167077 - DNA, 20 bp, Artificial Sequence
  Description of Artificial Sequence: Synthetic oligonucleotide
  Target: ATXN1; (-) strand; PAM type: YTN; PAM sequence: CTC
tcccctttatctagacttag

SEQ ID NO: 167078 - DNA, 20 bp, Artificial Sequence
  Description of Artificial Sequence: Synthetic oligonucleotide
  Target: ATXN1; (-) strand; PAM type: YTN; PAM sequence: TTA
gctctcccctttatctagac

SEQ ID NO: 167079 - DNA, 20 bp, Artificial Sequence
  Description of Artificial Sequence: Synthetic oligonucleotide
  Target: ATXN1; (-) strand; PAM type: YTN; PAM sequence: TTC
attagctctcccctttatct

SEQ ID NO: 167080 - DNA, 20 bp, Artificial Sequence
  Description of Artificial Sequence: Synthetic oligonucleotide
  Target: ATXN1; (-) strand; PAM type: YTN; PAM sequence: CTT
cattagctctcccctttatc

SEQ ID NO: 167081 - DNA, 20 bp, Artificial Sequence
  Description of Artificial Sequence: Synthetic oligonucleotide
  Target: ATXN1; (-) strand; PAM type: YTN; PAM sequence: CTG
tgagccttcattagctctcc

SEQ ID NO: 167082 - DNA, 20 bp, Artificial Sequence
  Description of Artificial Sequence: Synthetic oligonucleotide
  Target: ATXN1; (-) strand; PAM type: YTN; PAM sequence: TTC
aactgtgagccttcattagc

SEQ ID NO: 167083 - DNA, 20 bp, Artificial Sequence
  Description of Artificial Sequence: Synthetic oligonucleotide
  Target: ATXN1; (-) strand; PAM type: YTN; PAM sequence: CTT
caactgtgagccttcattag

SEQ ID NO: 167084 - DNA, 20 bp, Artificial Sequence
  Description of Artificial Sequence: Synthetic oligonucleotide
  Target: ATXN1; (-) strand; PAM type: YTN; PAM sequence: CTG
ggtgtgtacaaatcagacaa

SEQ ID NO: 167085 - DNA, 20 bp, Artificial Sequence
  Description of Artificial Sequence: Synthetic oligonucleotide
  Target: ATXN1; (-) strand; PAM type: YTN; PAM sequence: CTG
aatgtgtgctgggtgtgtac

SEQ ID NO: 167086 - DNA, 20 bp, Artificial Sequence
  Description of Artificial Sequence: Synthetic oligonucleotide
  Target: ATXN1; (-) strand; PAM type: YTN; PAM sequence: CTA
tacaatcgagtctgaatgtg

SEQ ID NO: 167087 - DNA, 20 bp, Artificial Sequence
  Description of Artificial Sequence: Synthetic oligonucleotide
  Target: ATXN1; (-) strand; PAM type: YTN; PAM sequence: TTG
acctatacaatcgagtctga

SEQ ID NO: 167088 - DNA, 20 bp, Artificial Sequence
  Description of Artificial Sequence: Synthetic oligonucleotide
  Target: ATXN1; (-) strand; PAM type: YTN; PAM sequence: TTT
gacctatacaatcgagtctg

SEQ ID NO: 167089 - DNA, 20 bp, Artificial Sequence
  Description of Artificial Sequence: Synthetic oligonucleotide
  Target: ATXN1; (-) strand; PAM type: YTN; PAM sequence: CTG
ggaaaatttgacctatacaa

SEQ ID NO: 167090 - DNA, 20 bp, Artificial Sequence
  Description of Artificial Sequence: Synthetic oligonucleotide
  Target: ATXN1; (-) strand; PAM type: YTN; PAM sequence: TTC
tgggaaaatttgacctatac

SEQ ID NO: 167091 - DNA, 20 bp, Artificial Sequence
  Description of Artificial Sequence: Synthetic oligonucleotide
  Target: ATXN1; (-) strand; PAM type: YTN; PAM sequence: TTT
ctgggaaaatttgacctata

SEQ ID NO: 167092 - DNA, 20 bp, Artificial Sequence
  Description of Artificial Sequence: Synthetic oligonucleotide
  Target: ATXN1; (-) strand; PAM type: YTN; PAM sequence: CTC
aaaaagccgtgatcgcatgt

SEQ ID NO: 167093 - DNA, 20 bp, Artificial Sequence
  Description of Artificial Sequence: Synthetic oligonucleotide
  Target: ATXN1; (-) strand; PAM type: YTN; PAM sequence: TTG
agctcaaaaagccgtgatcg

SEQ ID NO: 167094 - DNA, 20 bp, Artificial Sequence
  Description of Artificial Sequence: Synthetic oligonucleotide
  Target: ATXN1; (-) strand; PAM type: YTN; PAM sequence: TTT
gagctcaaaaagccgtgatc

SEQ ID NO: 167095 - DNA, 20 bp, Artificial Sequence
  Description of Artificial Sequence: Synthetic oligonucleotide
  Target: ATXN1; (-) strand; PAM type: YTN; PAM sequence: TTT
tgagctcaaaaagccgtgat

SEQ ID NO: 167096 - DNA, 20 bp, Artificial Sequence
  Description of Artificial Sequence: Synthetic oligonucleotide
  Target: ATXN1; (-) strand; PAM type: YTN; PAM sequence: TTA
tccacaggttttgagctcaa

SEQ ID NO: 167097 - DNA, 20 bp, Artificial Sequence
  Description of Artificial Sequence: Synthetic oligonucleotide
  Target: ATXN1; (-) strand; PAM type: YTN; PAM sequence: TTG
gggtaagcaacaattatcca

SEQ ID NO: 167098 - DNA, 20 bp, Artificial Sequence
  Description of Artificial Sequence: Synthetic oligonucleotide
  Target: ATXN1; (-) strand; PAM type: YTN; PAM sequence: CTA
aggaaaagaaggaaagtggg

SEQ ID NO: 167099 - DNA, 20 bp, Artificial Sequence
  Description of Artificial Sequence: Synthetic oligonucleotide
  Target: ATXN1; (-) strand; PAM type: YTN; PAM sequence: TTC
taaggaaaagaaggaaagtg

SEQ ID NO: 167100 - DNA, 20 bp, Artificial Sequence
  Description of Artificial Sequence: Synthetic oligonucleotide
  Target: ATXN1; (-) strand; PAM type: YTN; PAM sequence: CTT
ctaaggaaaagaaggaaagt

SEQ ID NO: 167101 - DNA, 20 bp, Artificial Sequence
  Description of Artificial Sequence: Synthetic oligonucleotide
  Target: ATXN1; (-) strand; PAM type: YTN; PAM sequence: CTA
cttctaaggaaaagaaggaa

SEQ ID NO: 167102 - DNA, 20 bp, Artificial Sequence
  Description of Artificial Sequence: Synthetic oligonucleotide
  Target: ATXN1; (-) strand; PAM type: YTN; PAM sequence: TTC
tacttctaaggaaaagaagg

SEQ ID NO: 167103 - DNA, 20 bp, Artificial Sequence
  Description of Artificial Sequence: Synthetic oligonucleotide
  Target: ATXN1; (-) strand; PAM type: YTN; PAM sequence: TTT
ctacttctaaggaaaagaag

SEQ ID NO: 167104 - DNA, 20 bp, Artificial Sequence
  Description of Artificial Sequence: Synthetic oligonucleotide
  Target: ATXN1; (-) strand; PAM type: YTN; PAM sequence: CTC
aaaaccaaggtttctacttc

SEQ ID NO: 167105 - DNA, 20 bp, Artificial Sequence
  Description of Artificial Sequence: Synthetic oligonucleotide
  Target: ATXN1; (-) strand; PAM type: YTN; PAM sequence: CTA
cctcaaaaccaaggtttcta

SEQ ID NO: 167106 - DNA, 20 bp, Artificial Sequence
  Description of Artificial Sequence: Synthetic oligonucleotide
  Target: ATXN1; (-) strand; PAM type: YTN; PAM sequence: TTG
ggcagcaatgtgtctacctc

SEQ ID NO: 167107 - DNA, 20 bp, Artificial Sequence
  Description of Artificial Sequence: Synthetic oligonucleotide
  Target: ATXN1; (-) strand; PAM type: YTN; PAM sequence: TTC
agttgggcagcaatgtgtct

SEQ ID NO: 167108 - DNA, 20 bp, Artificial Sequence
  Description of Artificial Sequence: Synthetic oligonucleotide
  Target: ATXN1; (-) strand; PAM type: YTN; PAM sequence: TTG
caaggcaagaagaagatcag

SEQ ID NO: 167109 - DNA, 20 bp, Artificial Sequence
  Description of Artificial Sequence: Synthetic oligonucleotide
  Target: ATXN1; (-) strand; PAM type: YTN; PAM sequence: CTT
gcaaggcaagaagaagatca

SEQ ID NO: 167110 - DNA, 20 bp, Artificial Sequence
  Description of Artificial Sequence: Synthetic oligonucleotide
  Target: ATXN1; (-) strand; PAM type: YTN; PAM sequence: TTC
ttgcaaggcaagaagaagat

SEQ ID NO: 167111 - DNA, 20 bp, Artificial Sequence
  Description of Artificial Sequence: Synthetic oligonucleotide
  Target: ATXN1; (-) strand; PAM type: YTN; PAM sequence: CTT
cttgcaaggcaagaagaaga

SEQ ID NO: 167112 - DNA, 20 bp, Artificial Sequence
  Description of Artificial Sequence: Synthetic oligonucleotide
  Target: ATXN1; (-) strand; PAM type: YTN; PAM sequence: CTA
ggcataccttcttgcaaggc

SEQ ID NO: 167113 - DNA, 20 bp, Artificial Sequence
  Description of Artificial Sequence: Synthetic oligonucleotide
  Target: ATXN1; (-) strand; PAM type: YTN; PAM sequence: TTG
caagtctaggcataccttct

SEQ ID NO: 167114 - DNA, 20 bp, Artificial Sequence
  Description of Artificial Sequence: Synthetic oligonucleotide
  Target: ATXN1; (-) strand; PAM type: YTN; PAM sequence: CTT
gcaagtctaggcataccttc

SEQ ID NO: 167115 - DNA, 20 bp, Artificial Sequence
  Description of Artificial Sequence: Synthetic oligonucleotide
  Target: ATXN1; (-) strand; PAM type: YTN; PAM sequence: TTC
ttgcaagtctaggcatacct

SEQ ID NO: 167116 - DNA, 20 bp, Artificial Sequence
  Description of Artificial Sequence: Synthetic oligonucleotide
  Target: ATXN1; (-) strand; PAM type: YTN; PAM sequence: CTT
cttgcaagtctaggcatacc

SEQ ID NO: 167117 - DNA, 20 bp, Artificial Sequence
  Description of Artificial Sequence: Synthetic oligonucleotide
  Target: ATXN1; (-) strand; PAM type: YTN; PAM sequence: CTA
ggcataccttcttgcaagtc

SEQ ID NO: 167118 - DNA, 20 bp, Artificial Sequence
  Description of Artificial Sequence: Synthetic oligonucleotide
  Target: ATXN1; (-) strand; PAM type: YTN; PAM sequence: CTG
caaggctaggcataccttct

SEQ ID NO: 167119 - DNA, 20 bp, Artificial Sequence
  Description of Artificial Sequence: Synthetic oligonucleotide
  Target: ATXN1; (-) strand; PAM type: YTN; PAM sequence: CTA
gctgcaaggctaggcatacc

SEQ ID NO: 167120 - DNA, 20 bp, Artificial Sequence
  Description of Artificial Sequence: Synthetic oligonucleotide
  Target: ATXN1; (-) strand; PAM type: YTN; PAM sequence: CTA
ggcatacctagctgcaaggc

SEQ ID NO: 167121 - DNA, 20 bp, Artificial Sequence
  Description of Artificial Sequence: Synthetic oligonucleotide
  Target: ATXN1; (-) strand; PAM type: YTN; PAM sequence: TTA
gtctaggcatacctagctgc

SEQ ID NO: 167122 - DNA, 20 bp, Artificial Sequence
  Description of Artificial Sequence: Synthetic oligonucleotide
  Target: ATXN1; (-) strand; PAM type: YTN; PAM sequence: TTT
agtctaggcatacctagctg

SEQ ID NO: 167123 - DNA, 20 bp, Artificial Sequence
  Description of Artificial Sequence: Synthetic oligonucleotide
  Target: ATXN1; (-) strand; PAM type: YTN; PAM sequence: TTC
atgtcaacaagaatttagtc

SEQ ID NO: 167124 - DNA, 20 bp, Artificial Sequence
  Description of Artificial Sequence: Synthetic oligonucleotide
  Target: ATXN1; (-) strand; PAM type: YTN; PAM sequence: CTT
catgtcaacaagaatttagt

SEQ ID NO: 167125 - DNA, 20 bp, Artificial Sequence
  Description of Artificial Sequence: Synthetic oligonucleotide
  Target: ATXN1; (-) strand; PAM type: YTN; PAM sequence: TTA
cttcatgtcaacaagaattt

SEQ ID NO: 167126 - DNA, 20 bp, Artificial Sequence
  Description of Artificial Sequence: Synthetic oligonucleotide
  Target: ATXN1; (-) strand; PAM type: YTN; PAM sequence: TTT
acttcatgtcaacaagaatt

SEQ ID NO: 167127 - DNA, 20 bp, Artificial Sequence
  Description of Artificial Sequence: Synthetic oligonucleotide
  Target: ATXN1; (-) strand; PAM type: YTN; PAM sequence: TTG
tttacttcatgtcaacaaga

SEQ ID NO: 167128 - DNA, 20 bp, Artificial Sequence
  Description of Artificial Sequence: Synthetic oligonucleotide
  Target: ATXN1; (-) strand; PAM type: YTN; PAM sequence: TTT
gtttacttcatgtcaacaag

SEQ ID NO: 167129 - DNA, 20 bp, Artificial Sequence
  Description of Artificial Sequence: Synthetic oligonucleotide
  Target: ATXN1; (-) strand; PAM type: YTN; PAM sequence: TTT
tgtttacttcatgtcaacaa

SEQ ID NO: 167130 - DNA, 20 bp, Artificial Sequence
  Description of Artificial Sequence: Synthetic oligonucleotide
  Target: ATXN1; (-) strand; PAM type: YTN; PAM sequence: TTT
ttgtttacttcatgtcaaca

SEQ ID NO: 167131 - DNA, 20 bp, Artificial Sequence
  Description of Artificial Sequence: Synthetic oligonucleotide
  Target: ATXN1; (-) strand; PAM type: YTN; PAM sequence: TTG
ccagaggaaccataccacat

SEQ ID NO: 167132 - DNA, 20 bp, Artificial Sequence
  Description of Artificial Sequence: Synthetic oligonucleotide
  Target: ATXN1; (-) strand; PAM type: YTN; PAM sequence: CTT
gccagaggaaccataccaca

SEQ ID NO: 167133 - DNA, 20 bp, Artificial Sequence
  Description of Artificial Sequence: Synthetic oligonucleotide
  Target: ATXN1; (-) strand; PAM type: YTN; PAM sequence: TTC
caaagacacttgccagagga

SEQ ID NO: 167134 - DNA, 20 bp, Artificial Sequence
  Description of Artificial Sequence: Synthetic oligonucleotide
  Target: ATXN1; (-) strand; PAM type: YTN; PAM sequence: TTT
ccaaagacacttgccagagg

SEQ ID NO: 167135 - DNA, 20 bp, Artificial Sequence
  Description of Artificial Sequence: Synthetic oligonucleotide
  Target: ATXN1; (-) strand; PAM type: YTN; PAM sequence: CTT
tccaaagacacttgccagag

SEQ ID NO: 167136 - DNA, 20 bp, Artificial Sequence
  Description of Artificial Sequence: Synthetic oligonucleotide
  Target: ATXN1; (-) strand; PAM type: YTN; PAM sequence: CTA
ccccctttccaaagacactt

SEQ ID NO: 167137 - DNA, 20 bp, Artificial Sequence
  Description of Artificial Sequence: Synthetic oligonucleotide
  Target: ATXN1; (-) strand; PAM type: YTN; PAM sequence: TTC
cagaaagcagaaaggaggaa

SEQ ID NO: 167138 - DNA, 20 bp, Artificial Sequence
  Description of Artificial Sequence: Synthetic oligonucleotide
  Target: ATXN1; (-) strand; PAM type: YTN; PAM sequence: TTA
ccattccagaaagcagaaag

SEQ ID NO: 167139 - DNA, 20 bp, Artificial Sequence
  Description of Artificial Sequence: Synthetic oligonucleotide
  Target: ATXN1; (-) strand; PAM type: YTN; PAM sequence: TTA
acattaccattccagaaagc

SEQ ID NO: 167140 - DNA, 20 bp, Artificial Sequence
  Description of Artificial Sequence: Synthetic oligonucleotide
  Target: ATXN1; (-) strand; PAM type: YTN; PAM sequence: TTT
aacattaccattccagaaag

SEQ ID NO: 167141 - DNA, 20 bp, Artificial Sequence
  Description of Artificial Sequence: Synthetic oligonucleotide
  Target: ATXN1; (-) strand; PAM type: YTN; PAM sequence: CTT
taacattaccattccagaaa

SEQ ID NO: 167142 - DNA, 20 bp, Artificial Sequence
  Description of Artificial Sequence: Synthetic oligonucleotide
  Target: ATXN1; (-) strand; PAM type: YTN; PAM sequence: CTA
gcctttaacattaccattcc

SEQ ID NO: 167143 - DNA, 20 bp, Artificial Sequence
  Description of Artificial Sequence: Synthetic oligonucleotide
  Target: ATXN1; (-) strand; PAM type: YTN; PAM sequence: CTC
tagcctttaacattaccatt

SEQ ID NO: 167144 - DNA, 20 bp, Artificial Sequence
  Description of Artificial Sequence: Synthetic oligonucleotide
  Target: ATXN1; (-) strand; PAM type: YTN; PAM sequence: CTG
catagctctagcctttaaca

SEQ ID NO: 167145 - DNA, 20 bp, Artificial Sequence
  Description of Artificial Sequence: Synthetic oligonucleotide
  Target: ATXN1; (-) strand; PAM type: YTN; PAM sequence: CTC
acatacaagatggctgcata

SEQ ID NO: 167146 - DNA, 20 bp, Artificial Sequence
  Description of Artificial Sequence: Synthetic oligonucleotide
  Target: ATXN1; (-) strand; PAM type: YTN; PAM sequence: CTA
tgtctcacatacaagatggc

SEQ ID NO: 167147 - DNA, 20 bp, Artificial Sequence
  Description of Artificial Sequence: Synthetic oligonucleotide
  Target: ATXN1; (-) strand; PAM type: YTN; PAM sequence: CTC
agcctatgtctcacatacaa

SEQ ID NO: 167148 - DNA, 20 bp, Artificial Sequence
  Description of Artificial Sequence: Synthetic oligonucleotide
  Target: ATXN1; (-) strand; PAM type: YTN; PAM sequence: CTC
aagtgatgcacccgcctcag

SEQ ID NO: 167149 - DNA, 20 bp, Artificial Sequence
  Description of Artificial Sequence: Synthetic oligonucleotide
  Target: ATXN1; (-) strand; PAM type: YTN; PAM sequence: CTG
acctcaagtgatgcacccgc

SEQ ID NO: 167150 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaagtgatgcacc

SEQ ID NO: 167151 - DNA, 20 bp, Artificial Sequence
  Description of Artificial Sequence: Synthetic oligonucleotide
  Target: ATXN1; (-) strand; PAM type: YTN; PAM sequence: CTC
gaactcctgacctcaagtga

SEQ ID NO: 167152 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctgacctca

SEQ ID NO: 167153 - DNA, 20 bp, Artificial Sequence
  Description of Artificial Sequence: Synthetic oligonucleotide
  Target: ATXN1; (-) strand; PAM type: YTN; PAM sequence: TTG
gccaagctggtctcgaactc

SEQ ID NO: 167154 - DNA, 20 bp, Artificial Sequence
  Description of Artificial Sequence: Synthetic oligonucleotide
  Target: ATXN1; (-) strand; PAM type: YTN; PAM sequence: TTC
acatgttggccaagctggtc

SEQ ID NO: 167155 - DNA, 20 bp, Artificial Sequence
  Description of Artificial Sequence: Synthetic oligonucleotide
  Target: ATXN1; (-) strand; PAM type: YTN; PAM sequence: TTT
cacatgttggccaagctggt

SEQ ID NO: 167156 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcacat

SEQ ID NO: 167157 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcaca

SEQ ID NO: 167158 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagggtttcac

SEQ ID NO: 167159 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagggtttca

SEQ ID NO: 167160 - DNA, 20 bp, Artificial Sequence
  Description of Artificial Sequence: Synthetic oligonucleotide
  Target: ATXN1; (-) strand; PAM type: YTN; PAM sequence: TTT
tttagtagagacagggtttc

SEQ ID NO: 167161 - DNA, 20 bp, Artificial Sequence
  Description of Artificial Sequence: Synthetic oligonucleotide
  Target: ATXN1; (-) strand; PAM type: YTN; PAM sequence: TTA
tgtattttttagtagagaca

SEQ ID NO: 167162 - DNA, 20 bp, Artificial Sequence
  Description of Artificial Sequence: Synthetic oligonucleotide
  Target: ATXN1; (-) strand; PAM type: YTN; PAM sequence: TTT
atgtattttttagtagagac

SEQ ID NO: 167163 - DNA, 20 bp, Artificial Sequence
  Description of Artificial Sequence: Synthetic oligonucleotide
  Target: ATXN1; (-) strand; PAM type: YTN; PAM sequence: TTT
tatgtattttttagtagaga

SEQ ID NO: 167164 - DNA, 20 bp, Artificial Sequence
  Description of Artificial Sequence: Synthetic oligonucleotide
  Target: ATXN1; (-) strand; PAM type: YTN; PAM sequence: TTT
ttatgtattttttagtagag

SEQ ID NO: 167165 - DNA, 20 bp, Artificial Sequence
  Description of Artificial Sequence: Synthetic oligonucleotide
  Target: ATXN1; (-) strand; PAM type: YTN; PAM sequence: CTA
atttttatgtattttttagt

SEQ ID NO: 167166 - DNA, 20 bp, Artificial Sequence
  Description of Artificial Sequence: Synthetic oligonucleotide
  Target: ATXN1; (-) strand; PAM type: YTN; PAM sequence: CTG
gctaatttttatgtattttt

SEQ ID NO: 167167 - DNA, 20 bp, Artificial Sequence
  Description of Artificial Sequence: Synthetic oligonucleotide
  Target: ATXN1; (-) strand; PAM type: YTN; PAM sequence: CTA
caggtgcgcaccaacatgtc

SEQ ID NO: 167168 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgcgcaccaa

SEQ ID NO: 167169 - DNA, 20 bp, Artificial Sequence
  Description of Artificial Sequence: Synthetic oligonucleotide
  Target: ATXN1; (-) strand; PAM type: YTN; PAM sequence: CTC
ccgagtaactgggactacag

SEQ ID NO: 167170 - DNA, 20 bp, Artificial Sequence
  Description of Artificial Sequence: Synthetic oligonucleotide
  Target: ATXN1; (-) strand; PAM type: YTN; PAM sequence: CTC
aggctcccgagtaactggga

SEQ ID NO: 167171 - DNA, 20 bp, Artificial Sequence
  Description of Artificial Sequence: Synthetic oligonucleotide
  Target: ATXN1; (-) strand; PAM type: YTN; PAM sequence: CTG
cctcaggctcccgagtaact

SEQ ID NO: 167172 - DNA, 20 bp, Artificial Sequence
  Description of Artificial Sequence: Synthetic oligonucleotide
  Target: ATXN1; (-) strand; PAM type: YTN; PAM sequence: TTG
tcctgcctcaggctcccgag

SEQ ID NO: 167173 - DNA, 20 bp, Artificial Sequence
  Description of Artificial Sequence: Synthetic oligonucleotide
  Target: ATXN1; (-) strand; PAM type: YTN; PAM sequence: TTC
gagcaattgtcctgcctcag

SEQ ID NO: 167174 - DNA, 20 bp, Artificial Sequence
  Description of Artificial Sequence: Synthetic oligonucleotide
  Target: ATXN1; (-) strand; PAM type: YTN; PAM sequence: TTG
ggttcgagcaattgtcctgc

SEQ ID NO: 167175 - DNA, 20 bp, Artificial Sequence
  Description of Artificial Sequence: Synthetic oligonucleotide
  Target: ATXN1; (-) strand; PAM type: YTN; PAM sequence: CTT
gggttcgagcaattgtcctg

SEQ ID NO: 167176 - DNA, 20 bp, Artificial Sequence
  Description of Artificial Sequence: Synthetic oligonucleotide
  Target: ATXN1; (-) strand; PAM type: YTN; PAM sequence: CTC
ttgggttcgagcaattgtcc

SEQ ID NO: 167177 - DNA, 20 bp, Artificial Sequence
  Description of Artificial Sequence: Synthetic oligonucleotide
  Target: ATXN1; (-) strand; PAM type: YTN; PAM sequence: TTC
ctcttgggttcgagcaattg

SEQ ID NO: 167178 - DNA, 20 bp, Artificial Sequence
  Description of Artificial Sequence: Synthetic oligonucleotide
  Target: ATXN1; (-) strand; PAM type: YTN; PAM sequence: CTT
cctcttgggttcgagcaatt

SEQ ID NO: 167179 - DNA, 20 bp, Artificial Sequence
  Description of Artificial Sequence: Synthetic oligonucleotide
  Target: ATXN1; (-) strand; PAM type: YTN; PAM sequence: CTC
ttcctcttgggttcgagcaa

SEQ ID NO: 167180 - DNA, 20 bp, Artificial Sequence
  Description of Artificial Sequence: Synthetic oligonucleotide
  Target: ATXN1; (-) strand; PAM type: YTN; PAM sequence: CTG
caacctcttcctcttgggtt

SEQ ID NO: 167181 - DNA, 20 bp, Artificial Sequence
  Description of Artificial Sequence: Synthetic oligonucleotide
  Target: ATXN1; (-) strand; PAM type: YTN; PAM sequence: CTC
actgcaacctcttcctcttg

SEQ ID NO: 167182 - DNA, 20 bp, Artificial Sequence
  Description of Artificial Sequence: Synthetic oligonucleotide
  Target: ATXN1; (-) strand; PAM type: YTN; PAM sequence: TTC
agctcactgcaacctcttcc

SEQ ID NO: 167183 - DNA, 20 bp, Artificial Sequence
  Description of Artificial Sequence: Synthetic oligonucleotide
  Target: ATXN1; (-) strand; PAM type: YTN; PAM sequence: TTT
cagctcactgcaacctcttc

SEQ ID NO: 167184 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcatgatttc

SEQ ID NO: 167185 - DNA, 20 bp, Artificial Sequence
  Description of Artificial Sequence: Synthetic oligonucleotide
  Target: ATXN1; (-) strand; PAM type: YTN; PAM sequence: CTC
ccaggctggagtgcagtggc

SEQ ID NO: 167186 - DNA, 20 bp, Artificial Sequence
  Description of Artificial Sequence: Synthetic oligonucleotide
  Target: ATXN1; (-) strand; PAM type: YTN; PAM sequence: CTG
tctcccaggctggagtgcag

SEQ ID NO: 167187 - DNA, 20 bp, Artificial Sequence
  Description of Artificial Sequence: Synthetic oligonucleotide
  Target: ATXN1; (-) strand; PAM type: YTN; PAM sequence: CTC
tgtctcccaggctggagtgc

SEQ ID NO: 167188 - DNA, 20 bp, Artificial Sequence
  Description of Artificial Sequence: Synthetic oligonucleotide
  Target: ATXN1; (-) strand; PAM type: YTN; PAM sequence: TTG
ctctgtctcccaggctggag

SEQ ID NO: 167189 - DNA, 20 bp, Artificial Sequence
  Description of Artificial Sequence: Synthetic oligonucleotide
  Target: ATXN1; (-) strand; PAM type: YTN; PAM sequence: CTT
gctctgtctcccaggctgga

SEQ ID NO: 167190 - DNA, 20 bp, Artificial Sequence
  Description of Artificial Sequence: Synthetic oligonucleotide
  Target: ATXN1; (-) strand; PAM type: YTN; PAM sequence: TTC
ttgctctgtctcccaggctg

SEQ ID NO: 167191 - DNA, 20 bp, Artificial Sequence
  Description of Artificial Sequence: Synthetic oligonucleotide
  Target: ATXN1; (-) strand; PAM type: YTN; PAM sequence: TTG
agacagattcttgctctgtc

SEQ ID NO: 167192 - DNA, 20 bp, Artificial Sequence
  Description of Artificial Sequence: Synthetic oligonucleotide
  Target: ATXN1; (-) strand; PAM type: YTN; PAM sequence: TTT
gagacagattcttgctctgt

SEQ ID NO: 167193 - DNA, 20 bp, Artificial Sequence
  Description of Artificial Sequence: Synthetic oligonucleotide
  Target: ATXN1; (-) strand; PAM type: YTN; PAM sequence: TTT
tgagacagattcttgctctg

SEQ ID NO: 167194 - DNA, 20 bp, Artificial Sequence
  Description of Artificial Sequence: Synthetic oligonucleotide
  Target: ATXN1; (-) strand; PAM type: YTN; PAM sequence: TTT
ttgagacagattcttgctct

SEQ ID NO: 167195 - DNA, 20 bp, Artificial Sequence
  Description of Artificial Sequence: Synthetic oligonucleotide
  Target: ATXN1; (-) strand; PAM type: YTN; PAM sequence: TTT
tttgagacagattcttgctc

SEQ ID NO: 167196 - DNA, 20 bp, Artificial Sequence
  Description of Artificial Sequence: Synthetic oligonucleotide
  Target: ATXN1; (-) strand; PAM type: YTN; PAM sequence: TTT
ttttgagacagattcttgct

SEQ ID NO: 167197 - DNA, 20 bp, Artificial Sequence
  Description of Artificial Sequence: Synthetic oligonucleotide
  Target: ATXN1; (-) strand; PAM type: YTN; PAM sequence: TTT
tttttgagacagattcttgc

SEQ ID NO: 167198 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacagattcttg

SEQ ID NO: 167199 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacagattctt

SEQ ID NO: 167200 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacagattct

SEQ ID NO: 167201 - DNA, 20 bp, Artificial Sequence
  Description of Artificial Sequence: Synthetic oligonucleotide
  Target: ATXN1; (-) strand; PAM type: YTN; PAM sequence: CTT
tttttttttgagacagattc

SEQ ID NO: 167202 - DNA, 20 bp, Artificial Sequence
  Description of Artificial Sequence: Synthetic oligonucleotide
  Target: ATXN1; (-) strand; PAM type: YTN; PAM sequence: TTC
tttttttttttgagacagat

SEQ ID NO: 167203 - DNA, 20 bp, Artificial Sequence
  Description of Artificial Sequence: Synthetic oligonucleotide
  Target: ATXN1; (-) strand; PAM type: YTN; PAM sequence: TTT
ctttttttttttgagacaga

SEQ ID NO: 167204 - DNA, 20 bp, Artificial Sequence
  Description of Artificial Sequence: Synthetic oligonucleotide
  Target: ATXN1; (-) strand; PAM type: YTN; PAM sequence: CTT
tctttttttttttgagacag

SEQ ID NO: 167205 - DNA, 20 bp, Artificial Sequence
  Description of Artificial Sequence: Synthetic oligonucleotide
  Target: ATXN1; (-) strand; PAM type: YTN; PAM sequence: TTC
tttctttttttttttgagac

SEQ ID NO: 167206 - DNA, 20 bp, Artificial Sequence
  Description of Artificial Sequence: Synthetic oligonucleotide
  Target: ATXN1; (-) strand; PAM type: YTN; PAM sequence: TTT
ctttctttttttttttgaga

SEQ ID NO: 167207 - DNA, 20 bp, Artificial Sequence
  Description of Artificial Sequence: Synthetic oligonucleotide
  Target: ATXN1; (-) strand; PAM type: YTN; PAM sequence: TTT
tctttctttttttttttgag

SEQ ID NO: 167208 - DNA, 20 bp, Artificial Sequence
  Description of Artificial Sequence: Synthetic oligonucleotide
  Target: ATXN1; (-) strand; PAM type: YTN; PAM sequence: CTT
ttctttctttttttttttga

SEQ ID NO: 167209 - DNA, 20 bp, Artificial Sequence
  Description of Artificial Sequence: Synthetic oligonucleotide
  Target: ATXN1; (-) strand; PAM type: YTN; PAM sequence: TTC
ttttctttcttttttttttt

SEQ ID NO: 167210 - DNA, 20 bp, Artificial Sequence
  Description of Artificial Sequence: Synthetic oligonucleotide
  Target: ATXN1; (-) strand; PAM type: YTN; PAM sequence: TTT
cttttctttctttttttttt

SEQ ID NO: 167211 - DNA, 20 bp, Artificial Sequence
  Description of Artificial Sequence: Synthetic oligonucleotide
  Target: ATXN1; (-) strand; PAM type: YTN; PAM sequence: TTT
tcttttctttcttttttttt

SEQ ID NO: 167212 - DNA, 20 bp, Artificial Sequence
  Description of Artificial Sequence: Synthetic oligonucleotide
  Target: ATXN1; (-) strand; PAM type: YTN; PAM sequence: CTT
ttcttttctttctttttttt

SEQ ID NO: 167213 - DNA, 20 bp, Artificial Sequence
  Description of Artificial Sequence: Synthetic oligonucleotide
  Target: ATXN1; (-) strand; PAM type: YTN; PAM sequence: TTC
ttttcttttctttctttttt

SEQ ID NO: 167214 - DNA, 20 bp, Artificial Sequence
  Description of Artificial Sequence: Synthetic oligonucleotide
  Target: ATXN1; (-) strand; PAM type: YTN; PAM sequence: TTT
cttttcttttctttcttttt

SEQ ID NO: 167215 - DNA, 20 bp, Artificial Sequence
  Description of Artificial Sequence: Synthetic oligonucleotide
  Target: ATXN1; (-) strand; PAM type: YTN; PAM sequence: CTG
tagtatatttcttttctttt

SEQ ID NO: 167216 - DNA, 20 bp, Artificial Sequence
  Description of Artificial Sequence: Synthetic oligonucleotide
  Target: ATXN1; (-) strand; PAM type: YTN; PAM sequence: CTG
ccatgctgtagtatatttct

SEQ ID NO: 167217 - DNA, 20 bp, Artificial Sequence
  Description of Artificial Sequence: Synthetic oligonucleotide
  Target: ATXN1; (-) strand; PAM type: YTN; PAM sequence: TTC
tgccatgctgtagtatattt

SEQ ID NO: 167218 - DNA, 20 bp, Artificial Sequence
  Description of Artificial Sequence: Synthetic oligonucleotide
  Target: ATXN1; (-) strand; PAM type: YTN; PAM sequence: CTA
ttctgccatgctgtagtata

SEQ ID NO: 167219 - DNA, 20 bp, Artificial Sequence
  Description of Artificial Sequence: Synthetic oligonucleotide
  Target: ATXN1; (-) strand; PAM type: YTN; PAM sequence: TTC
tattctgccatgctgtagta

SEQ ID NO: 167220 - DNA, 20 bp, Artificial Sequence
  Description of Artificial Sequence: Synthetic oligonucleotide
  Target: ATXN1; (-) strand; PAM type: YTN; PAM sequence: TTT
ctattctgccatgctgtagt

SEQ ID NO: 167221 - DNA, 20 bp, Artificial Sequence
  Description of Artificial Sequence: Synthetic oligonucleotide
  Target: ATXN1; (-) strand; PAM type: YTN; PAM sequence: CTT
tctattctgccatgctgtag

SEQ ID NO: 167222 - DNA, 20 bp, Artificial Sequence
  Description of Artificial Sequence: Synthetic oligonucleotide
  Target: ATXN1; (-) strand; PAM type: YTN; PAM sequence: TTG
tcacctttctattctgccat

SEQ ID NO: 167223 - DNA, 20 bp, Artificial Sequence
  Description of Artificial Sequence: Synthetic oligonucleotide
  Target: ATXN1; (-) strand; PAM type: YTN; PAM sequence: CTC
agaaacattgtcacctttct

SEQ ID NO: 167224 - DNA, 20 bp, Artificial Sequence
  Description of Artificial Sequence: Synthetic oligonucleotide
  Target: ATXN1; (-) strand; PAM type: YTN; PAM sequence: CTG
cacaggctcagaaacattgt

SEQ ID NO: 167225 - DNA, 20 bp, Artificial Sequence
  Description of Artificial Sequence: Synthetic oligonucleotide
  Target: ATXN1; (-) strand; PAM type: YTN; PAM sequence: TTA
tggtcactgcacaggctcag

SEQ ID NO: 167226 - DNA, 20 bp, Artificial Sequence
  Description of Artificial Sequence: Synthetic oligonucleotide
  Target: ATXN1; (-) strand; PAM type: YTN; PAM sequence: TTG
agaggtaagcagtccagggt

SEQ ID NO: 167227 - DNA, 20 bp, Artificial Sequence
  Description of Artificial Sequence: Synthetic oligonucleotide
  Target: ATXN1; (-) strand; PAM type: YTN; PAM sequence: TTT
gagaggtaagcagtccaggg

SEQ ID NO: 167228 - DNA, 20 bp, Artificial Sequence
  Description of Artificial Sequence: Synthetic oligonucleotide
  Target: ATXN1; (-) strand; PAM type: YTN; PAM sequence: TTT
tgagaggtaagcagtccagg

SEQ ID NO: 167229 - DNA, 20 bp, Artificial Sequence
  Description of Artificial Sequence: Synthetic oligonucleotide
  Target: ATXN1; (-) strand; PAM type: YTN; PAM sequence: CTC
acataaaagtggttttgaga

SEQ ID NO: 167230 - DNA, 20 bp, Artificial Sequence
  Description of Artificial Sequence: Synthetic oligonucleotide
  Target: ATXN1; (-) strand; PAM type: YTN; PAM sequence: CTC
tcacataaaagtggttttga

SEQ ID NO: 167231 - DNA, 20 bp, Artificial Sequence
  Description of Artificial Sequence: Synthetic oligonucleotide
  Target: ATXN1; (-) strand; PAM type: YTN; PAM sequence: TTC
tctcacataaaagtggtttt

SEQ ID NO: 167232 - DNA, 20 bp, Artificial Sequence
  Description of Artificial Sequence: Synthetic oligonucleotide
  Target: ATXN1; (-) strand; PAM type: YTN; PAM sequence: TTT
ctctcacataaaagtggttt

SEQ ID NO: 167233 - DNA, 20 bp, Artificial Sequence
  Description of Artificial Sequence: Synthetic oligonucleotide
  Target: ATXN1; (-) strand; PAM type: YTN; PAM sequence: TTT
tctctcacataaaagtggtt

SEQ ID NO: 167234 - DNA, 20 bp, Artificial Sequence
  Description of Artificial Sequence: Synthetic oligonucleotide
  Target: ATXN1; (-) strand; PAM type: YTN; PAM sequence: TTT
ttctctcacataaaagtggt

SEQ ID NO: 167235 - DNA, 20 bp, Artificial Sequence
  Description of Artificial Sequence: Synthetic oligonucleotide
  Target: ATXN1; (-) strand; PAM type: YTN; PAM sequence: TTA
tttttctctcacataaaagt

SEQ ID NO: 167236 - DNA, 20 bp, Artificial Sequence
  Description of Artificial Sequence: Synthetic oligonucleotide
  Target: ATXN1; (-) strand; PAM type: YTN; PAM sequence: TTT
atttttctctcacataaaag

SEQ ID NO: 167237 - DNA, 20 bp, Artificial Sequence
  Description of Artificial Sequence: Synthetic oligonucleotide
  Target: ATXN1; (-) strand; PAM type: YTN; PAM sequence: TTC
catatcaccaaaaaaaaaaa

SEQ ID NO: 167238 - DNA, 20 bp, Artificial Sequence
  Description of Artificial Sequence: Synthetic oligonucleotide
  Target: ATXN1; (-) strand; PAM type: YTN; PAM sequence: TTC
agttccatatcaccaaaaaa

SEQ ID NO: 167239 - DNA, 20 bp, Artificial Sequence
  Description of Artificial Sequence: Synthetic oligonucleotide
  Target: ATXN1; (-) strand; PAM type: YTN; PAM sequence: TTA
ggttcagttccatatcacca

SEQ ID NO: 167240 - DNA, 20 bp, Artificial Sequence
  Description of Artificial Sequence: Synthetic oligonucleotide
  Target: ATXN1; (-) strand; PAM type: YTN; PAM sequence: TTA
ggattaggttcagttccata

SEQ ID NO: 167241 - DNA, 20 bp, Artificial Sequence
  Description of Artificial Sequence: Synthetic oligonucleotide
  Target: ATXN1; (-) strand; PAM type: YTN; PAM sequence: TTG
taacagttaggattaggttc

SEQ ID NO: 167242 - DNA, 20 bp, Artificial Sequence
  Description of Artificial Sequence: Synthetic oligonucleotide
  Target: ATXN1; (-) strand; PAM type: YTN; PAM sequence: TTT
gtaacagttaggattaggtt

SEQ ID NO: 167243 - DNA, 20 bp, Artificial Sequence
  Description of Artificial Sequence: Synthetic oligonucleotide
  Target: ATXN1; (-) strand; PAM type: YTN; PAM sequence: CTA
tttgtaacagttaggattag

SEQ ID NO: 167244 - DNA, 20 bp, Artificial Sequence
  Description of Artificial Sequence: Synthetic oligonucleotide
  Target: ATXN1; (-) strand; PAM type: YTN; PAM sequence: CTA
aggtctatttgtaacagtta

SEQ ID NO: 167245 - DNA, 20 bp, Artificial Sequence
  Description of Artificial Sequence: Synthetic oligonucleotide
  Target: ATXN1; (-) strand; PAM type: YTN; PAM sequence: CTC
taaggtctatttgtaacagt

SEQ ID NO: 167246 - DNA, 20 bp, Artificial Sequence
  Description of Artificial Sequence: Synthetic oligonucleotide
  Target: ATXN1; (-) strand; PAM type: YTN; PAM sequence: TTA
tgacctctaaggtctatttg

SEQ ID NO: 167247 - DNA, 20 bp, Artificial Sequence
  Description of Artificial Sequence: Synthetic oligonucleotide
  Target: ATXN1; (-) strand; PAM type: YTN; PAM sequence: CTA
ttatgacctctaaggtctat

SEQ ID NO: 167248 - DNA, 20 bp, Artificial Sequence
  Description of Artificial Sequence: Synthetic oligonucleotide
  Target: ATXN1; (-) strand; PAM type: YTN; PAM sequence: CTG
taaaatgaagtctattatga

SEQ ID NO: 167249 - DNA, 20 bp, Artificial Sequence
  Description of Artificial Sequence: Synthetic oligonucleotide
  Target: ATXN1; (-) strand; PAM type: YTN; PAM sequence: CTA
atctgtaaaatgaagtctat

SEQ ID NO: 167250 - DNA, 20 bp, Artificial Sequence
  Description of Artificial Sequence: Synthetic oligonucleotide
  Target: ATXN1; (-) strand; PAM type: YTN; PAM sequence: TTC
ctaatctgtaaaatgaagtc

SEQ ID NO: 167251 - DNA, 20 bp, Artificial Sequence
  Description of Artificial Sequence: Synthetic oligonucleotide
  Target: ATXN1; (-) strand; PAM type: YTN; PAM sequence: TTT
cctaatctgtaaaatgaagt

SEQ ID NO: 167252 - DNA, 20 bp, Artificial Sequence
  Description of Artificial Sequence: Synthetic oligonucleotide
  Target: ATXN1; (-) strand; PAM type: YTN; PAM sequence: TTA
gtttcctaatctgtaaaatg

SEQ ID NO: 167253 - DNA, 20 bp, Artificial Sequence
  Description of Artificial Sequence: Synthetic oligonucleotide
  Target: ATXN1; (-) strand; PAM type: YTN; PAM sequence: TTA
atcattagtttcctaatctg

SEQ ID NO: 167254 - DNA, 20 bp, Artificial Sequence
  Description of Artificial Sequence: Synthetic oligonucleotide
  Target: ATXN1; (-) strand; PAM type: YTN; PAM sequence: TTT
aatcattagtttcctaatct

SEQ ID NO: 167255 - DNA, 20 bp, Artificial Sequence
  Description of Artificial Sequence: Synthetic oligonucleotide
  Target: ATXN1; (-) strand; PAM type: YTN; PAM sequence: CTT
taatcattagtttcctaatc

SEQ ID NO: 167256 - DNA, 20 bp, Artificial Sequence
  Description of Artificial Sequence: Synthetic oligonucleotide
  Target: ATXN1; (-) strand; PAM type: YTN; PAM sequence: TTG
atctttaatcattagtttcc

SEQ ID NO: 167257 - DNA, 20 bp, Artificial Sequence
  Description of Artificial Sequence: Synthetic oligonucleotide
  Target: ATXN1; (-) strand; PAM type: YTN; PAM sequence: TTA
tcaaagttgatctttaatca

SEQ ID NO: 167258 - DNA, 20 bp, Artificial Sequence
  Description of Artificial Sequence: Synthetic oligonucleotide
  Target: ATXN1; (-) strand; PAM type: YTN; PAM sequence: TTT
atcaaagttgatctttaatc

SEQ ID NO: 167259 - DNA, 20 bp, Artificial Sequence
  Description of Artificial Sequence: Synthetic oligonucleotide
  Target: ATXN1; (-) strand; PAM type: YTN; PAM sequence: TTG
agacatttatcaaagttgat

SEQ ID NO: 167260 - DNA, 20 bp, Artificial Sequence
  Description of Artificial Sequence: Synthetic oligonucleotide
  Target: ATXN1; (-) strand; PAM type: YTN; PAM sequence: TTC
ccgattgagacatttatcaa

SEQ ID NO: 167261 - DNA, 20 bp, Artificial Sequence
  Description of Artificial Sequence: Synthetic oligonucleotide
  Target: ATXN1; (-) strand; PAM type: YTN; PAM sequence: CTT
cccgattgagacatttatca

SEQ ID NO: 167262 - DNA, 20 bp, Artificial Sequence
  Description of Artificial Sequence: Synthetic oligonucleotide
  Target: ATXN1; (-) strand; PAM type: YTN; PAM sequence: CTG
cttcccgattgagacattta

SEQ ID NO: 167263 - DNA, 20 bp, Artificial Sequence
  Description of Artificial Sequence: Synthetic oligonucleotide
  Target: ATXN1; (-) strand; PAM type: YTN; PAM sequence: CTC
tgcttcccgattgagacatt

SEQ ID NO: 167264 - DNA, 20 bp, Artificial Sequence
  Description of Artificial Sequence: Synthetic oligonucleotide
  Target: ATXN1; (-) strand; PAM type: YTN; PAM sequence: TTG
ccaactctgcttcccgattg

SEQ ID NO: 167265 - DNA, 20 bp, Artificial Sequence
  Description of Artificial Sequence: Synthetic oligonucleotide
  Target: ATXN1; (-) strand; PAM type: YTN; PAM sequence: TTT
gccaactctgcttcccgatt

SEQ ID NO: 167266 - DNA, 20 bp, Artificial Sequence
  Description of Artificial Sequence: Synthetic oligonucleotide
  Target: ATXN1; (-) strand; PAM type: YTN; PAM sequence: TTA
atttgccaactctgcttccc

SEQ ID NO: 167267 - DNA, 20 bp, Artificial Sequence
  Description of Artificial Sequence: Synthetic oligonucleotide
  Target: ATXN1; (-) strand; PAM type: YTN; PAM sequence: TTA
aacagaagtgtaattaattt

SEQ ID NO: 167268 - DNA, 20 bp, Artificial Sequence
  Description of Artificial Sequence: Synthetic oligonucleotide
  Target: ATXN1; (-) strand; PAM type: YTN; PAM sequence: TTA
gaaaaagaagattaaacaga

SEQ ID NO: 167269 - DNA, 20 bp, Artificial Sequence
  Description of Artificial Sequence: Synthetic oligonucleotide
  Target: ATXN1; (-) strand; PAM type: YTN; PAM sequence: TTT
agaaaaagaagattaaacag

SEQ ID NO: 167270 - DNA, 20 bp, Artificial Sequence
  Description of Artificial Sequence: Synthetic oligonucleotide
  Target: ATXN1; (-) strand; PAM type: YTN; PAM sequence: CTT
tagaaaaagaagattaaaca

SEQ ID NO: 167271 - DNA, 20 bp, Artificial Sequence
  Description of Artificial Sequence: Synthetic oligonucleotide
  Target: ATXN1; (-) strand; PAM type: YTN; PAM sequence: CTA
tctttagaaaaagaagatta

SEQ ID NO: 167272 - DNA, 20 bp, Artificial Sequence
  Description of Artificial Sequence: Synthetic oligonucleotide
  Target: ATXN1; (-) strand; PAM type: YTN; PAM sequence: TTC
atcatctatctttagaaaaa

SEQ ID NO: 167273 - DNA, 20 bp, Artificial Sequence
  Description of Artificial Sequence: Synthetic oligonucleotide
  Target: ATXN1; (-) strand; PAM type: YTN; PAM sequence: CTT
catcatctatctttagaaaa

SEQ ID NO: 167274 - DNA, 20 bp, Artificial Sequence
  Description of Artificial Sequence: Synthetic oligonucleotide
  Target: ATXN1; (-) strand; PAM type: YTN; PAM sequence: CTG
ataggcatataaaatagaac

SEQ ID NO: 167275 - DNA, 20 bp, Artificial Sequence
  Description of Artificial Sequence: Synthetic oligonucleotide
  Target: ATXN1; (-) strand; PAM type: YTN; PAM sequence: TTA
gcagatactgataggcatat

SEQ ID NO: 167276 - DNA, 20 bp, Artificial Sequence
  Description of Artificial Sequence: Synthetic oligonucleotide
  Target: ATXN1; (-) strand; PAM type: YTN; PAM sequence: TTT
agcagatactgataggcata

SEQ ID NO: 167277 - DNA, 20 bp, Artificial Sequence
  Description of Artificial Sequence: Synthetic oligonucleotide
  Target: ATXN1; (-) strand; PAM type: YTN; PAM sequence: TTC
atttagcagatactgatagg

SEQ ID NO: 167278 - DNA, 20 bp, Artificial Sequence
  Description of Artificial Sequence: Synthetic oligonucleotide
  Target: ATXN1; (-) strand; PAM type: YTN; PAM sequence: TTC
acagacatgtgaaatataaa

SEQ ID NO: 167279 - DNA, 20 bp, Artificial Sequence
  Description of Artificial Sequence: Synthetic oligonucleotide
  Target: ATXN1; (-) strand; PAM type: YTN; PAM sequence: TTC
agaaattcacagacatgtga

SEQ ID NO: 167280 - DNA, 20 bp, Artificial Sequence
  Description of Artificial Sequence: Synthetic oligonucleotide
  Target: ATXN1; (-) strand; PAM type: YTN; PAM sequence: CTC
agaggttcagaaattcacag

SEQ ID NO: 167281 - DNA, 20 bp, Artificial Sequence
  Description of Artificial Sequence: Synthetic oligonucleotide
  Target: ATXN1; (-) strand; PAM type: YTN; PAM sequence: TTG
gaagacctcagaggttcaga

SEQ ID NO: 167282 - DNA, 20 bp, Artificial Sequence
  Description of Artificial Sequence: Synthetic oligonucleotide
  Target: ATXN1; (-) strand; PAM type: YTN; PAM sequence: TTA
gatgtgccagttggaagacc

SEQ ID NO: 167283 - DNA, 20 bp, Artificial Sequence
  Description of Artificial Sequence: Synthetic oligonucleotide
  Target: ATXN1; (-) strand; PAM type: YTN; PAM sequence: TTG
ggattagatgtgccagttgg

SEQ ID NO: 167284 - DNA, 20 bp, Artificial Sequence
  Description of Artificial Sequence: Synthetic oligonucleotide
  Target: ATXN1; (-) strand; PAM type: YTN; PAM sequence: CTT
gggattagatgtgccagttg

SEQ ID NO: 167285 - DNA, 20 bp, Artificial Sequence
  Description of Artificial Sequence: Synthetic oligonucleotide
  Target: ATXN1; (-) strand; PAM type: YTN; PAM sequence: TTG
aatatgtgtgacttgggatt

SEQ ID NO: 167286 - DNA, 20 bp, Artificial Sequence
  Description of Artificial Sequence: Synthetic oligonucleotide
  Target: ATXN1; (-) strand; PAM type: YTN; PAM sequence: CTT
gaatatgtgtgacttgggat

SEQ ID NO: 167287 - DNA, 20 bp, Artificial Sequence
  Description of Artificial Sequence: Synthetic oligonucleotide
  Target: ATXN1; (-) strand; PAM type: YTN; PAM sequence: TTC
cttgaatatgtgtgacttgg

SEQ ID NO: 167288 - DNA, 20 bp, Artificial Sequence
  Description of Artificial Sequence: Synthetic oligonucleotide
  Target: ATXN1; (-) strand; PAM type: YTN; PAM sequence: TTA
ttccttgaatatgtgtgact

SEQ ID NO: 167289 - DNA, 20 bp, Artificial Sequence
  Description of Artificial Sequence: Synthetic oligonucleotide
  Target: ATXN1; (-) strand; PAM type: YTN; PAM sequence: CTT
attccttgaatatgtgtgac

SEQ ID NO: 167290 - DNA, 20 bp, Artificial Sequence
  Description of Artificial Sequence: Synthetic oligonucleotide
  Target: ATXN1; (-) strand; PAM type: YTN; PAM sequence: TTA
atagcttattccttgaatat

SEQ ID NO: 167291 - DNA, 20 bp, Artificial Sequence
  Description of Artificial Sequence: Synthetic oligonucleotide
  Target: ATXN1; (-) strand; PAM type: YTN; PAM sequence: TTT
aatagcttattccttgaata

SEQ ID NO: 167292 - DNA, 20 bp, Artificial Sequence
  Description of Artificial Sequence: Synthetic oligonucleotide
  Target: ATXN1; (-) strand; PAM type: YTN; PAM sequence: TTA
tttaatagcttattccttga

SEQ ID NO: 167293 - DNA, 20 bp, Artificial Sequence
  Description of Artificial Sequence: Synthetic oligonucleotide
  Target: ATXN1; (-) strand; PAM type: YTN; PAM sequence: TTA
ttatttaatagcttattcct

SEQ ID NO: 167294 - DNA, 20 bp, Artificial Sequence
  Description of Artificial Sequence: Synthetic oligonucleotide
  Target: ATXN1; (-) strand; PAM type: YTN; PAM sequence: TTT
attatttaatagcttattcc

SEQ ID NO: 167295 - DNA, 20 bp, Artificial Sequence
  Description of Artificial Sequence: Synthetic oligonucleotide
  Target: ATXN1; (-) strand; PAM type: YTN; PAM sequence: TTT
tattatttaatagcttattc

SEQ ID NO: 167296 - DNA, 20 bp, Artificial Sequence
  Description of Artificial Sequence: Synthetic oligonucleotide
  Target: ATXN1; (-) strand; PAM type: YTN; PAM sequence: TTT
ttattatttaatagcttatt

SEQ ID NO: 167297 - DNA, 20 bp, Artificial Sequence
  Description of Artificial Sequence: Synthetic oligonucleotide
  Target: ATXN1; (-) strand; PAM type: YTN; PAM sequence: TTT
tttattatttaatagcttat

SEQ ID NO: 167298 - DNA, 20 bp, Artificial Sequence
  Description of Artificial Sequence: Synthetic oligonucleotide
  Target: ATXN1; (-) strand; PAM type: YTN; PAM sequence: CTC
atcacattttttattattta

SEQ ID NO: 167299 - DNA, 20 bp, Artificial Sequence
  Description of Artificial Sequence: Synthetic oligonucleotide
  Target: ATXN1; (-) strand; PAM type: YTN; PAM sequence: TTC
ctcatcacattttttattat

SEQ ID NO: 167300 - DNA, 20 bp, Artificial Sequence
  Description of Artificial Sequence: Synthetic oligonucleotide
  Target: ATXN1; (-) strand; PAM type: YTN; PAM sequence: CTA
ttcctcatcacattttttat

SEQ ID NO: 167301 - DNA, 20 bp, Artificial Sequence
  Description of Artificial Sequence: Synthetic oligonucleotide
  Target: ATXN1; (-) strand; PAM type: YTN; PAM sequence: TTA
ctattcctcatcacattttt

SEQ ID NO: 167302 - DNA, 20 bp, Artificial Sequence
  Description of Artificial Sequence: Synthetic oligonucleotide
  Target: ATXN1; (-) strand; PAM type: YTN; PAM sequence: TTC
attactattcctcatcacat

SEQ ID NO: 167303 - DNA, 20 bp, Artificial Sequence
  Description of Artificial Sequence: Synthetic oligonucleotide
  Target: ATXN1; (-) strand; PAM type: YTN; PAM sequence: CTG
ttcattactattcctcatca

SEQ ID NO: 167304 - DNA, 20 bp, Artificial Sequence
  Description of Artificial Sequence: Synthetic oligonucleotide
  Target: ATXN1; (-) strand; PAM type: YTN; PAM sequence: CTC
aagtctgttcattactattc

SEQ ID NO: 167305 - DNA, 20 bp, Artificial Sequence
  Description of Artificial Sequence: Synthetic oligonucleotide
  Target: ATXN1; (-) strand; PAM type: YTN; PAM sequence: TTC
tcaagtctgttcattactat

SEQ ID NO: 167306 - DNA, 20 bp, Artificial Sequence
  Description of Artificial Sequence: Synthetic oligonucleotide
  Target: ATXN1; (-) strand; PAM type: YTN; PAM sequence: TTT
ctcaagtctgttcattacta

SEQ ID NO: 167307 - DNA, 20 bp, Artificial Sequence
  Description of Artificial Sequence: Synthetic oligonucleotide
  Target: ATXN1; (-) strand; PAM type: YTN; PAM sequence: TTT
tctcaagtctgttcattact

SEQ ID NO: 167308 - DNA, 20 bp, Artificial Sequence
  Description of Artificial Sequence: Synthetic oligonucleotide
  Target: ATXN1; (-) strand; PAM type: YTN; PAM sequence: CTA
atgaacatagcaggaaaaga

SEQ ID NO: 167309 - DNA, 20 bp, Artificial Sequence
  Description of Artificial Sequence: Synthetic oligonucleotide
  Target: ATXN1; (-) strand; PAM type: YTN; PAM sequence: TTA
agacatgtggaatctaatga

SEQ ID NO: 167310 - DNA, 20 bp, Artificial Sequence
  Description of Artificial Sequence: Synthetic oligonucleotide
  Target: ATXN1; (-) strand; PAM type: YTN; PAM sequence: CTA
agatgcagattaagacatgt

SEQ ID NO: 167311 - DNA, 20 bp, Artificial Sequence
  Description of Artificial Sequence: Synthetic oligonucleotide
  Target: ATXN1; (-) strand; PAM type: YTN; PAM sequence: TTA
tgtactaagatgcagattaa

SEQ ID NO: 167312 - DNA, 20 bp, Artificial Sequence
  Description of Artificial Sequence: Synthetic oligonucleotide
  Target: ATXN1; (-) strand; PAM type: YTN; PAM sequence: TTT
atgtactaagatgcagatta

SEQ ID NO: 167313 - DNA, 20 bp, Artificial Sequence
  Description of Artificial Sequence: Synthetic oligonucleotide
  Target: ATXN1; (-) strand; PAM type: YTN; PAM sequence: TTG
tagatttatgtactaagatg

SEQ ID NO: 167314 - DNA, 20 bp, Artificial Sequence
  Description of Artificial Sequence: Synthetic oligonucleotide
  Target: ATXN1; (-) strand; PAM type: YTN; PAM sequence: TTT
gtagatttatgtactaagat

SEQ ID NO: 167315 - DNA, 20 bp, Artificial Sequence
  Description of Artificial Sequence: Synthetic oligonucleotide
  Target: ATXN1; (-) strand; PAM type: YTN; PAM sequence: TTT
tgtagatttatgtactaaga

SEQ ID NO: 167316 - DNA, 20 bp, Artificial Sequence
  Description of Artificial Sequence: Synthetic oligonucleotide
  Target: ATXN1; (-) strand; PAM type: YTN; PAM sequence: TTA
atatagttttgtagatttat

SEQ ID NO: 167317 - DNA, 20 bp, Artificial Sequence
  Description of Artificial Sequence: Synthetic oligonucleotide
  Target: ATXN1; (-) strand; PAM type: YTN; PAM sequence: CTA
aaataccagtgaaaattaat

SEQ ID NO: 167318 - DNA, 20 bp, Artificial Sequence
  Description of Artificial Sequence: Synthetic oligonucleotide
  Target: ATXN1; (-) strand; PAM type: YTN; PAM sequence: TTC
taaaataccagtgaaaatta

SEQ ID NO: 167319 - DNA, 20 bp, Artificial Sequence
  Description of Artificial Sequence: Synthetic oligonucleotide
  Target: ATXN1; (-) strand; PAM type: YTN; PAM sequence: TTT
ctaaaataccagtgaaaatt

SEQ ID NO: 167320 - DNA, 20 bp, Artificial Sequence
  Description of Artificial Sequence: Synthetic oligonucleotide
  Target: ATXN1; (-) strand; PAM type: YTN; PAM sequence: CTT
tctaaaataccagtgaaaat

SEQ ID NO: 167321 - DNA, 20 bp, Artificial Sequence
  Description of Artificial Sequence: Synthetic oligonucleotide
  Target: ATXN1; (-) strand; PAM type: YTN; PAM sequence: TTA
gcactttctaaaataccagt

SEQ ID NO: 167322 - DNA, 20 bp, Artificial Sequence
  Description of Artificial Sequence: Synthetic oligonucleotide
  Target: ATXN1; (-) strand; PAM type: YTN; PAM sequence: TTT
agcactttctaaaataccag

SEQ ID NO: 167323 - DNA, 20 bp, Artificial Sequence
  Description of Artificial Sequence: Synthetic oligonucleotide
  Target: ATXN1; (-) strand; PAM type: YTN; PAM sequence: CTC
catttagcactttctaaaat

SEQ ID NO: 167324 - DNA, 20 bp, Artificial Sequence
  Description of Artificial Sequence: Synthetic oligonucleotide
  Target: ATXN1; (-) strand; PAM type: YTN; PAM sequence: TTG
aaaatctccatttagcactt

SEQ ID NO: 167325 - DNA, 20 bp, Artificial Sequence
  Description of Artificial Sequence: Synthetic oligonucleotide
  Target: ATXN1; (-) strand; PAM type: YTN; PAM sequence: TTT
gaaaatctccatttagcact

SEQ ID NO: 167326 - DNA, 20 bp, Artificial Sequence
  Description of Artificial Sequence: Synthetic oligonucleotide
  Target: ATXN1; (-) strand; PAM type: YTN; PAM sequence: TTC
acccaaatttgaaaatctcc

SEQ ID NO: 167327 - DNA, 20 bp, Artificial Sequence
  Description of Artificial Sequence: Synthetic oligonucleotide
  Target: ATXN1; (-) strand; PAM type: YTN; PAM sequence: TTT
cacccaaatttgaaaatctc

SEQ ID NO: 167328 - DNA, 20 bp, Artificial Sequence
  Description of Artificial Sequence: Synthetic oligonucleotide
  Target: ATXN1; (-) strand; PAM type: YTN; PAM sequence: TTT
tcacccaaatttgaaaatct

SEQ ID NO: 167329 - DNA, 20 bp, Artificial Sequence
  Description of Artificial Sequence: Synthetic oligonucleotide
  Target: ATXN1; (-) strand; PAM type: YTN; PAM sequence: CTT
ttcacccaaatttgaaaatc

SEQ ID NO: 167330 - DNA, 20 bp, Artificial Sequence
  Description of Artificial Sequence: Synthetic oligonucleotide
  Target: ATXN1; (-) strand; PAM type: YTN; PAM sequence: CTG
acttttcacccaaatttgaa

SEQ ID NO: 167331 - DNA, 20 bp, Artificial Sequence
  Description of Artificial Sequence: Synthetic oligonucleotide
  Target: ATXN1; (-) strand; PAM type: YTN; PAM sequence: TTC
cagatactgacttttcaccc

SEQ ID NO: 167332 - DNA, 20 bp, Artificial Sequence
  Description of Artificial Sequence: Synthetic oligonucleotide
  Target: ATXN1; (-) strand; PAM type: YTN; PAM sequence: TTC
aacattccagatactgactt

SEQ ID NO: 167333 - DNA, 20 bp, Artificial Sequence
  Description of Artificial Sequence: Synthetic oligonucleotide
  Target: ATXN1; (-) strand; PAM type: YTN; PAM sequence: TTT
caacattccagatactgact

SEQ ID NO: 167334 - DNA, 20 bp, Artificial Sequence
  Description of Artificial Sequence: Synthetic oligonucleotide
  Target: ATXN1; (-) strand; PAM type: YTN; PAM sequence: CTT
tcaacattccagatactgac

SEQ ID NO: 167335 - DNA, 20 bp, Artificial Sequence
  Description of Artificial Sequence: Synthetic oligonucleotide
  Target: ATXN1; (-) strand; PAM type: YTN; PAM sequence: TTG
aagtaaagatacctttcaac

SEQ ID NO: 167336 - DNA, 20 bp, Artificial Sequence
  Description of Artificial Sequence: Synthetic oligonucleotide
  Target: ATXN1; (-) strand; PAM type: YTN; PAM sequence: TTG
cacacatattgaagtaaaga

SEQ ID NO: 167337 - DNA, 20 bp, Artificial Sequence
  Description of Artificial Sequence: Synthetic oligonucleotide
  Target: ATXN1; (-) strand; PAM type: YTN; PAM sequence: CTT
gcacacatattgaagtaaag

SEQ ID NO: 167338 - DNA, 20 bp, Artificial Sequence
  Description of Artificial Sequence: Synthetic oligonucleotide
  Target: ATXN1; (-) strand; PAM type: YTN; PAM sequence: TTA
tcttgcacacatattgaagt

SEQ ID NO: 167339 - DNA, 20 bp, Artificial Sequence
  Description of Artificial Sequence: Synthetic oligonucleotide
  Target: ATXN1; (-) strand; PAM type: YTN; PAM sequence: CTA
cagcatagattatcttgcac

SEQ ID NO: 167340 - DNA, 20 bp, Artificial Sequence
  Description of Artificial Sequence: Synthetic oligonucleotide
  Target: ATXN1; (-) strand; PAM type: YTN; PAM sequence: TTA
cagctacagcatagattatc

SEQ ID NO: 167341 - DNA, 20 bp, Artificial Sequence
  Description of Artificial Sequence: Synthetic oligonucleotide
  Target: ATXN1; (-) strand; PAM type: YTN; PAM sequence: TTT
acagctacagcatagattat

SEQ ID NO: 167342 - DNA, 20 bp, Artificial Sequence
  Description of Artificial Sequence: Synthetic oligonucleotide
  Target: ATXN1; (-) strand; PAM type: YTN; PAM sequence: TTT
tacagctacagcatagatta

SEQ ID NO: 167343 - DNA, 20 bp, Artificial Sequence
  Description of Artificial Sequence: Synthetic oligonucleotide
  Target: ATXN1; (-) strand; PAM type: YTN; PAM sequence: CTG
taaaagcatccagggatata

SEQ ID NO: 167344 - DNA, 20 bp, Artificial Sequence
  Description of Artificial Sequence: Synthetic oligonucleotide
  Target: ATXN1; (-) strand; PAM type: YTN; PAM sequence: TTC
tgtaaaagcatccagggata

SEQ ID NO: 167345 - DNA, 20 bp, Artificial Sequence
  Description of Artificial Sequence: Synthetic oligonucleotide
  Target: ATXN1; (-) strand; PAM type: YTN; PAM sequence: TTA
ttctgtaaaagcatccaggg

SEQ ID NO: 167346 - DNA, 20 bp, Artificial Sequence
  Description of Artificial Sequence: Synthetic oligonucleotide
  Target: ATXN1; (-) strand; PAM type: YTN; PAM sequence: TTC
agtattattctgtaaaagca

SEQ ID NO: 167347 - DNA, 20 bp, Artificial Sequence
  Description of Artificial Sequence: Synthetic oligonucleotide
  Target: ATXN1; (-) strand; PAM type: YTN; PAM sequence: TTT
cagtattattctgtaaaagc

SEQ ID NO: 167348 - DNA, 20 bp, Artificial Sequence
  Description of Artificial Sequence: Synthetic oligonucleotide
  Target: ATXN1; (-) strand; PAM type: YTN; PAM sequence: TTC
agagagtgtttcagtattat

SEQ ID NO: 167349 - DNA, 20 bp, Artificial Sequence
  Description of Artificial Sequence: Synthetic oligonucleotide
  Target: ATXN1; (-) strand; PAM type: YTN; PAM sequence: TTT
cagagagtgtttcagtatta

SEQ ID NO: 167350 - DNA, 20 bp, Artificial Sequence
  Description of Artificial Sequence: Synthetic oligonucleotide
  Target: ATXN1; (-) strand; PAM type: YTN; PAM sequence: TTA
gtttcagagagtgtttcagt

SEQ ID NO: 167351 - DNA, 20 bp, Artificial Sequence
  Description of Artificial Sequence: Synthetic oligonucleotide
  Target: ATXN1; (-) strand; PAM type: YTN; PAM sequence: TTA
gcaatatccattagtttcag

SEQ ID NO: 167352 - DNA, 20 bp, Artificial Sequence
  Description of Artificial Sequence: Synthetic oligonucleotide
  Target: ATXN1; (-) strand; PAM type: YTN; PAM sequence: TTT
agcaatatccattagtttca

SEQ ID NO: 167353 - DNA, 20 bp, Artificial Sequence
  Description of Artificial Sequence: Synthetic oligonucleotide
  Target: ATXN1; (-) strand; PAM type: YTN; PAM sequence: TTG
tcagtttagcaatatccatt

SEQ ID NO: 167354 - DNA, 20 bp, Artificial Sequence
  Description of Artificial Sequence: Synthetic oligonucleotide
  Target: ATXN1; (-) strand; PAM type: YTN; PAM sequence: TTT
gtcagtttagcaatatccat

SEQ ID NO: 167355 - DNA, 20 bp, Artificial Sequence
  Description of Artificial Sequence: Synthetic oligonucleotide
  Target: ATXN1; (-) strand; PAM type: YTN; PAM sequence: TTT
tgtcagtttagcaatatcca

SEQ ID NO: 167356 - DNA, 20 bp, Artificial Sequence
  Description of Artificial Sequence: Synthetic oligonucleotide
  Target: ATXN1; (-) strand; PAM type: YTN; PAM sequence: TTA
ataagtgagttttgtcagtt

SEQ ID NO: 167357 - DNA, 20 bp, Artificial Sequence
  Description of Artificial Sequence: Synthetic oligonucleotide
  Target: ATXN1; (-) strand; PAM type: YTN; PAM sequence: TTT
aataagtgagttttgtcagt

SEQ ID NO: 167358 - DNA, 20 bp, Artificial Sequence
  Description of Artificial Sequence: Synthetic oligonucleotide
  Target: ATXN1; (-) strand; PAM type: YTN; PAM sequence: TTG
aatttaataagtgagttttg

SEQ ID NO: 167359 - DNA, 20 bp, Artificial Sequence
  Description of Artificial Sequence: Synthetic oligonucleotide
  Target: ATXN1; (-) strand; PAM type: YTN; PAM sequence: TTA
attgaatttaataagtgagt

SEQ ID NO: 167360 - DNA, 20 bp, Artificial Sequence
  Description of Artificial Sequence: Synthetic oligonucleotide
  Target: ATXN1; (-) strand; PAM type: YTN; PAM sequence: TTG
gtccccattaattgaattta

SEQ ID NO: 167361 - DNA, 20 bp, Artificial Sequence
  Description of Artificial Sequence: Synthetic oligonucleotide
  Target: ATXN1; (-) strand; PAM type: YTN; PAM sequence: TTA
ttggtccccattaattgaat

SEQ ID NO: 167362 - DNA, 20 bp, Artificial Sequence
  Description of Artificial Sequence: Synthetic oligonucleotide
  Target: ATXN1; (-) strand; PAM type: YTN; PAM sequence: TTT
attggtccccattaattgaa

SEQ ID NO: 167363 - DNA, 20 bp, Artificial Sequence
  Description of Artificial Sequence: Synthetic oligonucleotide
  Target: ATXN1; (-) strand; PAM type: YTN; PAM sequence: TTA
atttattggtccccattaat

SEQ ID NO: 167364 - DNA, 20 bp, Artificial Sequence
  Description of Artificial Sequence: Synthetic oligonucleotide
  Target: ATXN1; (-) strand; PAM type: YTN; PAM sequence: TTG
ggagggggcacggacgaaca

SEQ ID NO: 167365 - DNA, 20 bp, Artificial Sequence
  Description of Artificial Sequence: Synthetic oligonucleotide
  Target: ATXN1; (-) strand; PAM type: YTN; PAM sequence: TTG
tgggagtgaagattgggagg

SEQ ID NO: 167366 - DNA, 20 bp, Artificial Sequence
  Description of Artificial Sequence: Synthetic oligonucleotide
  Target: ATXN1; (-) strand; PAM type: YTN; PAM sequence: TTT
gtgggagtgaagattgggag

SEQ ID NO: 167367 - DNA, 20 bp, Artificial Sequence
  Description of Artificial Sequence: Synthetic oligonucleotide
  Target: ATXN1; (-) strand; PAM type: YTN; PAM sequence: CTA
gtgcatgatttgtgggagtg

SEQ ID NO: 167368 - DNA, 20 bp, Artificial Sequence
  Description of Artificial Sequence: Synthetic oligonucleotide
  Target: ATXN1; (-) strand; PAM type: YTN; PAM sequence: TTA
atggctagtgcatgatttgt

SEQ ID NO: 167369 - DNA, 20 bp, Artificial Sequence
  Description of Artificial Sequence: Synthetic oligonucleotide
  Target: ATXN1; (-) strand; PAM type: YTN; PAM sequence: TTT
aatggctagtgcatgatttg

SEQ ID NO: 167370 - DNA, 20 bp, Artificial Sequence
  Description of Artificial Sequence: Synthetic oligonucleotide
  Target: ATXN1; (-) strand; PAM type: YTN; PAM sequence: TTT
taatggctagtgcatgattt

SEQ ID NO: 167371 - DNA, 20 bp, Artificial Sequence
  Description of Artificial Sequence: Synthetic oligonucleotide
  Target: ATXN1; (-) strand; PAM type: YTN; PAM sequence: TTT
ttaatggctagtgcatgatt

SEQ ID NO: 167372 - DNA, 20 bp, Artificial Sequence
  Description of Artificial Sequence: Synthetic oligonucleotide
  Target: ATXN1; (-) strand; PAM type: YTN; PAM sequence: CTA
tttttaatggctagtgcatg

SEQ ID NO: 167373 - DNA, 20 bp, Artificial Sequence
  Description of Artificial Sequence: Synthetic oligonucleotide
  Target: ATXN1; (-) strand; PAM type: YTN; PAM sequence: TTC
tatttttaatggctagtgca

SEQ ID NO: 167374 - DNA, 20 bp, Artificial Sequence
  Description of Artificial Sequence: Synthetic oligonucleotide
  Target: ATXN1; (-) strand; PAM type: YTN; PAM sequence: CTT
ctatttttaatggctagtgc

SEQ ID NO: 167375 - DNA, 20 bp, Artificial Sequence
  Description of Artificial Sequence: Synthetic oligonucleotide
  Target: ATXN1; (-) strand; PAM type: YTN; PAM sequence: TTC
cttctatttttaatggctag

SEQ ID NO: 167376 - DNA, 20 bp, Artificial Sequence
  Description of Artificial Sequence: Synthetic oligonucleotide
  Target: ATXN1; (-) strand; PAM type: YTN; PAM sequence: TTT
ccttctatttttaatggcta

SEQ ID NO: 167377 - DNA, 20 bp, Artificial Sequence
  Description of Artificial Sequence: Synthetic oligonucleotide
  Target: ATXN1; (-) strand; PAM type: YTN; PAM sequence: TTA
acatagaggaagaaagtttc

SEQ ID NO: 167378 - DNA, 20 bp, Artificial Sequence
  Description of Artificial Sequence: Synthetic oligonucleotide
  Target: ATXN1; (-) strand; PAM type: YTN; PAM sequence: TTT
aacatagaggaagaaagttt

SEQ ID NO: 167379 - DNA, 20 bp, Artificial Sequence
  Description of Artificial Sequence: Synthetic oligonucleotide
  Target: ATXN1; (-) strand; PAM type: YTN; PAM sequence: CTT
taacatagaggaagaaagtt

SEQ ID NO: 167380 - DNA, 20 bp, Artificial Sequence
  Description of Artificial Sequence: Synthetic oligonucleotide
  Target: ATXN1; (-) strand; PAM type: YTN; PAM sequence: TTA
ctttaacatagaggaagaaa

SEQ ID NO: 167381 - DNA, 20 bp, Artificial Sequence
  Description of Artificial Sequence: Synthetic oligonucleotide
  Target: ATXN1; (-) strand; PAM type: YTN; PAM sequence: TTC
aagttactttaacatagagg

SEQ ID NO: 167382 - DNA, 20 bp, Artificial Sequence
  Description of Artificial Sequence: Synthetic oligonucleotide
  Target: ATXN1; (-) strand; PAM type: YTN; PAM sequence: TTT
caagttactttaacatagag

SEQ ID NO: 167383 - DNA, 20 bp, Artificial Sequence
  Description of Artificial Sequence: Synthetic oligonucleotide
  Target: ATXN1; (-) strand; PAM type: YTN; PAM sequence: TTA
gaagacaaggtagatgattt

SEQ ID NO: 167384 - DNA, 20 bp, Artificial Sequence
  Description of Artificial Sequence: Synthetic oligonucleotide
  Target: ATXN1; (-) strand; PAM type: YTN; PAM sequence: TTT
agaagacaaggtagatgatt

SEQ ID NO: 167385 - DNA, 20 bp, Artificial Sequence
  Description of Artificial Sequence: Synthetic oligonucleotide
  Target: ATXN1; (-) strand; PAM type: YTN; PAM sequence: TTT
tagaagacaaggtagatgat

SEQ ID NO: 167386 - DNA, 20 bp, Artificial Sequence
  Description of Artificial Sequence: Synthetic oligonucleotide
  Target: ATXN1; (-) strand; PAM type: YTN; PAM sequence: TTA
gaaagcaacaagagaggagt

SEQ ID NO: 167387 - DNA, 20 bp, Artificial Sequence
  Description of Artificial Sequence: Synthetic oligonucleotide
  Target: ATXN1; (-) strand; PAM type: YTN; PAM sequence: TTT
agaaagcaacaagagaggag

SEQ ID NO: 167388 - DNA, 20 bp, Artificial Sequence
  Description of Artificial Sequence: Synthetic oligonucleotide
  Target: ATXN1; (-) strand; PAM type: YTN; PAM sequence: TTG
gatatttagaaagcaacaag

SEQ ID NO: 167389 - DNA, 20 bp, Artificial Sequence
  Description of Artificial Sequence: Synthetic oligonucleotide
  Target: ATXN1; (-) strand; PAM type: YTN; PAM sequence: TTT
ggatatttagaaagcaacaa

SEQ ID NO: 167390 - DNA, 20 bp, Artificial Sequence
  Description of Artificial Sequence: Synthetic oligonucleotide
  Target: ATXN1; (-) strand; PAM type: YTN; PAM sequence: TTC
catttggatatttagaaagc

SEQ ID NO: 167391 - DNA, 20 bp, Artificial Sequence
  Description of Artificial Sequence: Synthetic oligonucleotide
  Target: ATXN1; (-) strand; PAM type: YTN; PAM sequence: TTT
ccatttggatatttagaaag

SEQ ID NO: 167392 - DNA, 20 bp, Artificial Sequence
  Description of Artificial Sequence: Synthetic oligonucleotide
  Target: ATXN1; (-) strand; PAM type: YTN; PAM sequence: TTT
tccatttggatatttagaaa

SEQ ID NO: 167393 - DNA, 20 bp, Artificial Sequence
  Description of Artificial Sequence: Synthetic oligonucleotide
  Target: ATXN1; (-) strand; PAM type: YTN; PAM sequence: CTC
caggatcattttccatttgg

SEQ ID NO: 167394 - DNA, 20 bp, Artificial Sequence
  Description of Artificial Sequence: Synthetic oligonucleotide
  Target: ATXN1; (-) strand; PAM type: YTN; PAM sequence: TTC
ctccaggatcattttccatt

SEQ ID NO: 167395 - DNA, 20 bp, Artificial Sequence
  Description of Artificial Sequence: Synthetic oligonucleotide
  Target: ATXN1; (-) strand; PAM type: YTN; PAM sequence: CTG
cccattcctccaggatcatt

SEQ ID NO: 167396 - DNA, 20 bp, Artificial Sequence
  Description of Artificial Sequence: Synthetic oligonucleotide
  Target: ATXN1; (-) strand; PAM type: YTN; PAM sequence: CTA
gtagaataggggaaaccaca

SEQ ID NO: 167397 - DNA, 20 bp, Artificial Sequence
  Description of Artificial Sequence: Synthetic oligonucleotide
  Target: ATXN1; (-) strand; PAM type: YTN; PAM sequence: TTG
gagactagtagaatagggga

SEQ ID NO: 167398 - DNA, 20 bp, Artificial Sequence
  Description of Artificial Sequence: Synthetic oligonucleotide
  Target: ATXN1; (-) strand; PAM type: YTN; PAM sequence: CTG
tgtgggttggagactagtag

SEQ ID NO: 167399 - DNA, 20 bp, Artificial Sequence
  Description of Artificial Sequence: Synthetic oligonucleotide
  Target: ATXN1; (-) strand; PAM type: YTN; PAM sequence: TTG
tctgtgtgggttggagacta

SEQ ID NO: 167400 - DNA, 20 bp, Artificial Sequence
  Description of Artificial Sequence: Synthetic oligonucleotide
  Target: ATXN1; (-) strand; PAM type: YTN; PAM sequence: TTT
gtctgtgtgggttggagact

SEQ ID NO: 167401 - DNA, 20 bp, Artificial Sequence
  Description of Artificial Sequence: Synthetic oligonucleotide
  Target: ATXN1; (-) strand; PAM type: YTN; PAM sequence: CTT
tgtctgtgtgggttggagac

SEQ ID NO: 167402 - DNA, 20 bp, Artificial Sequence
  Description of Artificial Sequence: Synthetic oligonucleotide
  Target: ATXN1; (-) strand; PAM type: YTN; PAM sequence: TTC
tttgtctgtgtgggttggag

SEQ ID NO: 167403 - DNA, 20 bp, Artificial Sequence
  Description of Artificial Sequence: Synthetic oligonucleotide
  Target: ATXN1; (-) strand; PAM type: YTN; PAM sequence: TTT
ctttgtctgtgtgggttgga

SEQ ID NO: 167404 - DNA, 20 bp, Artificial Sequence
  Description of Artificial Sequence: Synthetic oligonucleotide
  Target: ATXN1; (-) strand; PAM type: YTN; PAM sequence: TTG
gatatcgggtttctttgtct

SEQ ID NO: 167405 - DNA, 20 bp, Artificial Sequence
  Description of Artificial Sequence: Synthetic oligonucleotide
  Target: ATXN1; (-) strand; PAM type: YTN; PAM sequence: CTG
ttggatatcgggtttctttg

SEQ ID NO: 167406 - DNA, 20 bp, Artificial Sequence
  Description of Artificial Sequence: Synthetic oligonucleotide
  Target: ATXN1; (-) strand; PAM type: YTN; PAM sequence: CTC
tgttggatatcgggtttctt

SEQ ID NO: 167407 - DNA, 20 bp, Artificial Sequence
  Description of Artificial Sequence: Synthetic oligonucleotide
  Target: ATXN1; (-) strand; PAM type: YTN; PAM sequence: TTC
atccatgtgggtggaggtac

SEQ ID NO: 167408 - DNA, 20 bp, Artificial Sequence
  Description of Artificial Sequence: Synthetic oligonucleotide
  Target: ATXN1; (-) strand; PAM type: YTN; PAM sequence: TTA
ttcatccatgtgggtggagg

SEQ ID NO: 167409 - DNA, 20 bp, Artificial Sequence
  Description of Artificial Sequence: Synthetic oligonucleotide
  Target: ATXN1; (-) strand; PAM type: YTN; PAM sequence: TTT
attcatccatgtgggtggag

SEQ ID NO: 167410 - DNA, 20 bp, Artificial Sequence
  Description of Artificial Sequence: Synthetic oligonucleotide
  Target: ATXN1; (-) strand; PAM type: YTN; PAM sequence: TTG
gagatcaggtttattcatcc

SEQ ID NO: 167411 - DNA, 20 bp, Artificial Sequence
  Description of Artificial Sequence: Synthetic oligonucleotide
  Target: ATXN1; (-) strand; PAM type: YTN; PAM sequence: CTG
ttggagatcaggtttattca

SEQ ID NO: 167412 - DNA, 20 bp, Artificial Sequence
  Description of Artificial Sequence: Synthetic oligonucleotide
  Target: ATXN1; (-) strand; PAM type: YTN; PAM sequence: CTC
tgttggagatcaggtttatt

SEQ ID NO: 167413 - DNA, 20 bp, Artificial Sequence
  Description of Artificial Sequence: Synthetic oligonucleotide
  Target: ATXN1; (-) strand; PAM type: YTN; PAM sequence: TTG
ggccataaccgtgagggaag

SEQ ID NO: 167414 - DNA, 20 bp, Artificial Sequence
  Description of Artificial Sequence: Synthetic oligonucleotide
  Target: ATXN1; (-) strand; PAM type: YTN; PAM sequence: TTT
gggccataaccgtgagggaa

SEQ ID NO: 167415 - DNA, 20 bp, Artificial Sequence
  Description of Artificial Sequence: Synthetic oligonucleotide
  Target: ATXN1; (-) strand; PAM type: YTN; PAM sequence: TTT
tgggccataaccgtgaggga

SEQ ID NO: 167416 - DNA, 20 bp, Artificial Sequence
  Description of Artificial Sequence: Synthetic oligonucleotide
  Target: ATXN1; (-) strand; PAM type: YTN; PAM sequence: TTT
ttgggccataaccgtgaggg

SEQ ID NO: 167417 - DNA, 20 bp, Artificial Sequence
  Description of Artificial Sequence: Synthetic oligonucleotide
  Target: ATXN1; (-) strand; PAM type: YTN; PAM sequence: CTT
tttgggccataaccgtgagg

SEQ ID NO: 167418 - DNA, 20 bp, Artificial Sequence
  Description of Artificial Sequence: Synthetic oligonucleotide
  Target: ATXN1; (-) strand; PAM type: YTN; PAM sequence: CTA
gctttttgggccataaccgt

SEQ ID NO: 167419 - DNA, 20 bp, Artificial Sequence
  Description of Artificial Sequence: Synthetic oligonucleotide
  Target: ATXN1; (-) strand; PAM type: YTN; PAM sequence: TTC
tagctttttgggccataacc

SEQ ID NO: 167420 - DNA, 20 bp, Artificial Sequence
  Description of Artificial Sequence: Synthetic oligonucleotide
  Target: ATXN1; (-) strand; PAM type: YTN; PAM sequence: TTT
ctagctttttgggccataac

SEQ ID NO: 167421 - DNA, 20 bp, Artificial Sequence
  Description of Artificial Sequence: Synthetic oligonucleotide
  Target: ATXN1; (-) strand; PAM type: YTN; PAM sequence: CTT
tctagctttttgggccataa

SEQ ID NO: 167422 - DNA, 20 bp, Artificial Sequence
  Description of Artificial Sequence: Synthetic oligonucleotide
  Target: ATXN1; (-) strand; PAM type: YTN; PAM sequence: TTG
tcctttctagctttttgggc

SEQ ID NO: 167423 - DNA, 20 bp, Artificial Sequence
  Description of Artificial Sequence: Synthetic oligonucleotide
  Target: ATXN1; (-) strand; PAM type: YTN; PAM sequence: CTG
aaaggatgcccattgtcctt

SEQ ID NO: 167424 - DNA, 20 bp, Artificial Sequence
  Description of Artificial Sequence: Synthetic oligonucleotide
  Target: ATXN1; (-) strand; PAM type: YTN; PAM sequence: TTA
tctgaaaggatgcccattgt

SEQ ID NO: 167425 - DNA, 20 bp, Artificial Sequence
  Description of Artificial Sequence: Synthetic oligonucleotide
  Target: ATXN1; (-) strand; PAM type: YTN; PAM sequence: TTT
atctgaaaggatgcccattg

SEQ ID NO: 167426 - DNA, 20 bp, Artificial Sequence
  Description of Artificial Sequence: Synthetic oligonucleotide
  Target: ATXN1; (-) strand; PAM type: YTN; PAM sequence: CTT
tatctgaaaggatgcccatt

SEQ ID NO: 167427 - DNA, 20 bp, Artificial Sequence
  Description of Artificial Sequence: Synthetic oligonucleotide
  Target: ATXN1; (-) strand; PAM type: YTN; PAM sequence: TTC
tttatctgaaaggatgccca

SEQ ID NO: 167428 - DNA, 20 bp, Artificial Sequence
  Description of Artificial Sequence: Synthetic oligonucleotide
  Target: ATXN1; (-) strand; PAM type: YTN; PAM sequence: TTT
ctttatctgaaaggatgccc

SEQ ID NO: 167429 - DNA, 20 bp, Artificial Sequence
  Description of Artificial Sequence: Synthetic oligonucleotide
  Target: ATXN1; (-) strand; PAM type: YTN; PAM sequence: CTG
tagcgtatttctttatctga

SEQ ID NO: 167430 - DNA, 20 bp, Artificial Sequence
  Description of Artificial Sequence: Synthetic oligonucleotide
  Target: ATXN1; (-) strand; PAM type: YTN; PAM sequence: TTC
tgtagcgtatttctttatct

SEQ ID NO: 167431 - DNA, 20 bp, Artificial Sequence
  Description of Artificial Sequence: Synthetic oligonucleotide
  Target: ATXN1; (-) strand; PAM type: YTN; PAM sequence: TTT
ctgtagcgtatttctttatc

SEQ ID NO: 167432 - DNA, 20 bp, Artificial Sequence
  Description of Artificial Sequence: Synthetic oligonucleotide
  Target: ATXN1; (-) strand; PAM type: YTN; PAM sequence: CTC
atttctgtagcgtatttctt

SEQ ID NO: 167433 - DNA, 20 bp, Artificial Sequence
  Description of Artificial Sequence: Synthetic oligonucleotide
  Target: ATXN1; (-) strand; PAM type: YTN; PAM sequence: CTG
ctcatttctgtagcgtattt

SEQ ID NO: 167434 - DNA, 20 bp, Artificial Sequence
  Description of Artificial Sequence: Synthetic oligonucleotide
  Target: ATXN1; (-) strand; PAM type: YTN; PAM sequence: CTG
ctgctcatttctgtagcgta

SEQ ID NO: 167435 - DNA, 20 bp, Artificial Sequence
  Description of Artificial Sequence: Synthetic oligonucleotide
  Target: ATXN1; (-) strand; PAM type: YTN; PAM sequence: TTC
tgctgctcatttctgtagcg

SEQ ID NO: 167436 - DNA, 20 bp, Artificial Sequence
  Description of Artificial Sequence: Synthetic oligonucleotide
  Target: ATXN1; (-) strand; PAM type: YTN; PAM sequence: CTG
tgattctgctgctcatttct

SEQ ID NO: 167437 - DNA, 20 bp, Artificial Sequence
  Description of Artificial Sequence: Synthetic oligonucleotide
  Target: ATXN1; (-) strand; PAM type: YTN; PAM sequence: TTC
aggactgtgattctgctgct

SEQ ID NO: 167438 - DNA, 20 bp, Artificial Sequence
  Description of Artificial Sequence: Synthetic oligonucleotide
  Target: ATXN1; (-) strand; PAM type: YTN; PAM sequence: TTG
cagagttcaggactgtgatt

SEQ ID NO: 167439 - DNA, 20 bp, Artificial Sequence
  Description of Artificial Sequence: Synthetic oligonucleotide
  Target: ATXN1; (-) strand; PAM type: YTN; PAM sequence: TTA
ttgcagagttcaggactgtg

SEQ ID NO: 167440 - DNA, 20 bp, Artificial Sequence
  Description of Artificial Sequence: Synthetic oligonucleotide
  Target: ATXN1; (-) strand; PAM type: YTN; PAM sequence: TTT
attgcagagttcaggactgt

SEQ ID NO: 167441 - DNA, 20 bp, Artificial Sequence
  Description of Artificial Sequence: Synthetic oligonucleotide
  Target: ATXN1; (-) strand; PAM type: YTN; PAM sequence: TTA
ccgcatgagtaaaaatttat

SEQ ID NO: 167442 - DNA, 20 bp, Artificial Sequence
  Description of Artificial Sequence: Synthetic oligonucleotide
  Target: ATXN1; (-) strand; PAM type: YTN; PAM sequence: TTT
accgcatgagtaaaaattta

SEQ ID NO: 167443 - DNA, 20 bp, Artificial Sequence
  Description of Artificial Sequence: Synthetic oligonucleotide
  Target: ATXN1; (-) strand; PAM type: YTN; PAM sequence: CTG
tccatgggcatttaccgcat

SEQ ID NO: 167444 - DNA, 20 bp, Artificial Sequence
  Description of Artificial Sequence: Synthetic oligonucleotide
  Target: ATXN1; (-) strand; PAM type: YTN; PAM sequence: TTA
acccctgtccatgggcattt

SEQ ID NO: 167445 - DNA, 20 bp, Artificial Sequence
  Description of Artificial Sequence: Synthetic oligonucleotide
  Target: ATXN1; (-) strand; PAM type: YTN; PAM sequence: CTA
gaggttaacccctgtccatg

SEQ ID NO: 167446 - DNA, 20 bp, Artificial Sequence
  Description of Artificial Sequence: Synthetic oligonucleotide
  Target: ATXN1; (-) strand; PAM type: YTN; PAM sequence: CTG
cgtgcaaatgctagaggtta

SEQ ID NO: 167447 - DNA, 20 bp, Artificial Sequence
  Description of Artificial Sequence: Synthetic oligonucleotide
  Target: ATXN1; (-) strand; PAM type: YTN; PAM sequence: TTA
ccaggagccaagagcgaacg

SEQ ID NO: 167448 - DNA, 20 bp, Artificial Sequence
  Description of Artificial Sequence: Synthetic oligonucleotide
  Target: ATXN1; (-) strand; PAM type: YTN; PAM sequence: CTT
accaggagccaagagcgaac

SEQ ID NO: 167449 - DNA, 20 bp, Artificial Sequence
  Description of Artificial Sequence: Synthetic oligonucleotide
  Target: ATXN1; (-) strand; PAM type: YTN; PAM sequence: CTG
taagtgcttaccaggagcca

SEQ ID NO: 167450 - DNA, 20 bp, Artificial Sequence
  Description of Artificial Sequence: Synthetic oligonucleotide
  Target: ATXN1; (-) strand; PAM type: YTN; PAM sequence: TTA
aatgcctgtaagtgcttacc

SEQ ID NO: 167451 - DNA, 20 bp, Artificial Sequence
  Description of Artificial Sequence: Synthetic oligonucleotide
  Target: ATXN1; (-) strand; PAM type: YTN; PAM sequence: TTT
aaatgcctgtaagtgcttac

SEQ ID NO: 167452 - DNA, 20 bp, Artificial Sequence
  Description of Artificial Sequence: Synthetic oligonucleotide
  Target: ATXN1; (-) strand; PAM type: YTN; PAM sequence: CTT
taaatgcctgtaagtgctta

SEQ ID NO: 167453 - DNA, 20 bp, Artificial Sequence
  Description of Artificial Sequence: Synthetic oligonucleotide
  Target: ATXN1; (-) strand; PAM type: YTN; PAM sequence: TTG
cacatctttaaatgcctgta

SEQ ID NO: 167454 - DNA, 20 bp, Artificial Sequence
  Description of Artificial Sequence: Synthetic oligonucleotide
  Target: ATXN1; (-) strand; PAM type: YTN; PAM sequence: TTT
gcacatctttaaatgcctgt

SEQ ID NO: 167455 - DNA, 20 bp, Artificial Sequence
  Description of Artificial Sequence: Synthetic oligonucleotide
  Target: ATXN1; (-) strand; PAM type: YTN; PAM sequence: CTT
tgcacatctttaaatgcctg

SEQ ID NO: 167456 - DNA, 20 bp, Artificial Sequence
  Description of Artificial Sequence: Synthetic oligonucleotide
  Target: ATXN1; (-) strand; PAM type: YTN; PAM sequence: TTA
taccctttgcacatctttaa

SEQ ID NO: 167457 - DNA, 20 bp, Artificial Sequence
  Description of Artificial Sequence: Synthetic oligonucleotide
  Target: ATXN1; (-) strand; PAM type: YTN; PAM sequence: CTT
ataccctttgcacatcttta

SEQ ID NO: 167458 - DNA, 20 bp, Artificial Sequence
  Description of Artificial Sequence: Synthetic oligonucleotide
  Target: ATXN1; (-) strand; PAM type: YTN; PAM sequence: TTG
aagacttataccctttgcac

SEQ ID NO: 167459 - DNA, 20 bp, Artificial Sequence
  Description of Artificial Sequence: Synthetic oligonucleotide
  Target: ATXN1; (-) strand; PAM type: YTN; PAM sequence: TTA
tgaggggcagagagcattga

SEQ ID NO: 167460 - DNA, 20 bp, Artificial Sequence
  Description of Artificial Sequence: Synthetic oligonucleotide
  Target: ATXN1; (-) strand; PAM type: YTN; PAM sequence: CTT
atgaggggcagagagcattg

SEQ ID NO: 167461 - DNA, 20 bp, Artificial Sequence
  Description of Artificial Sequence: Synthetic oligonucleotide
  Target: ATXN1; (-) strand; PAM type: YTN; PAM sequence: TTA
tcagagatgcttatgagggg

SEQ ID NO: 167462 - DNA, 20 bp, Artificial Sequence
  Description of Artificial Sequence: Synthetic oligonucleotide
  Target: ATXN1; (-) strand; PAM type: YTN; PAM sequence: TTG
gatattatcagagatgctta

SEQ ID NO: 167463 - DNA, 20 bp, Artificial Sequence
  Description of Artificial Sequence: Synthetic oligonucleotide
  Target: ATXN1; (-) strand; PAM type: YTN; PAM sequence: TTA
agtagatgttggatattatc

SEQ ID NO: 167464 - DNA, 20 bp, Artificial Sequence
  Description of Artificial Sequence: Synthetic oligonucleotide
  Target: ATXN1; (-) strand; PAM type: YTN; PAM sequence: TTT
aagtagatgttggatattat

SEQ ID NO: 167465 - DNA, 20 bp, Artificial Sequence
  Description of Artificial Sequence: Synthetic oligonucleotide
  Target: ATXN1; (-) strand; PAM type: YTN; PAM sequence: CTA
gcatttaagtagatgttgga

SEQ ID NO: 167466 - DNA, 20 bp, Artificial Sequence
  Description of Artificial Sequence: Synthetic oligonucleotide
  Target: ATXN1; (-) strand; PAM type: YTN; PAM sequence: TTA
aggtaagctagcatttaagt

SEQ ID NO: 167467 - DNA, 20 bp, Artificial Sequence
  Description of Artificial Sequence: Synthetic oligonucleotide
  Target: ATXN1; (-) strand; PAM type: YTN; PAM sequence: TTT
aaggtaagctagcatttaag

SEQ ID NO: 167468 - DNA, 20 bp, Artificial Sequence
  Description of Artificial Sequence: Synthetic oligonucleotide
  Target: ATXN1; (-) strand; PAM type: YTN; PAM sequence: CTT
taaggtaagctagcatttaa

SEQ ID NO: 167469 - DNA, 20 bp, Artificial Sequence
  Description of Artificial Sequence: Synthetic oligonucleotide
  Target: ATXN1; (-) strand; PAM type: YTN; PAM sequence: TTA
tctttaaggtaagctagcat

SEQ ID NO: 167470 - DNA, 20 bp, Artificial Sequence
  Description of Artificial Sequence: Synthetic oligonucleotide
  Target: ATXN1; (-) strand; PAM type: YTN; PAM sequence: TTT
atctttaaggtaagctagca

SEQ ID NO: 167471 - DNA, 20 bp, Artificial Sequence
  Description of Artificial Sequence: Synthetic oligonucleotide
  Target: ATXN1; (-) strand; PAM type: YTN; PAM sequence: CTG
gtggaatgaaataaagaagg

SEQ ID NO: 167472 - DNA, 20 bp, Artificial Sequence
  Description of Artificial Sequence: Synthetic oligonucleotide
  Target: ATXN1; (-) strand; PAM type: YTN; PAM sequence: TTC
agtcctggtggaatgaaata

SEQ ID NO: 167473 - DNA, 20 bp, Artificial Sequence
  Description of Artificial Sequence: Synthetic oligonucleotide
  Target: ATXN1; (-) strand; PAM type: YTN; PAM sequence: TTC
aaggcaaatagtcccaagtc

SEQ ID NO: 167474 - DNA, 20 bp, Artificial Sequence
  Description of Artificial Sequence: Synthetic oligonucleotide
  Target: ATXN1; (-) strand; PAM type: YTN; PAM sequence: TTT
caaggcaaatagtcccaagt

SEQ ID NO: 167475 - DNA, 20 bp, Artificial Sequence
  Description of Artificial Sequence: Synthetic oligonucleotide
  Target: ATXN1; (-) strand; PAM type: YTN; PAM sequence: TTT
tcaaggcaaatagtcccaag

SEQ ID NO: 167476 - DNA, 20 bp, Artificial Sequence
  Description of Artificial Sequence: Synthetic oligonucleotide
  Target: ATXN1; (-) strand; PAM type: YTN; PAM sequence: TTT
ttcaaggcaaatagtcccaa

SEQ ID NO: 167477 - DNA, 20 bp, Artificial Sequence
  Description of Artificial Sequence: Synthetic oligonucleotide
  Target: ATXN1; (-) strand; PAM type: YTN; PAM sequence: CTC
atttttcaaggcaaatagtc

SEQ ID NO: 167478 - DNA, 20 bp, Artificial Sequence
  Description of Artificial Sequence: Synthetic oligonucleotide
  Target: ATXN1; (-) strand; PAM type: YTN; PAM sequence: CTG
gagaaaactcatttttcaag

SEQ ID NO: 167479 - DNA, 20 bp, Artificial Sequence
  Description of Artificial Sequence: Synthetic oligonucleotide
  Target: ATXN1; (-) strand; PAM type: YTN; PAM sequence: CTG
cagagctggagaaaactcat

SEQ ID NO: 167480 - DNA, 20 bp, Artificial Sequence
  Description of Artificial Sequence: Synthetic oligonucleotide
  Target: ATXN1; (-) strand; PAM type: YTN; PAM sequence: CTC
tgcagagctggagaaaactc

SEQ ID NO: 167481 - DNA, 20 bp, Artificial Sequence
  Description of Artificial Sequence: Synthetic oligonucleotide
  Target: ATXN1; (-) strand; PAM type: YTN; PAM sequence: TTA
tacacagcagccatcctctg

SEQ ID NO: 167482 - DNA, 20 bp, Artificial Sequence
  Description of Artificial Sequence: Synthetic oligonucleotide
  Target: ATXN1; (-) strand; PAM type: YTN; PAM sequence: TTC
agagaccattatacacagca

SEQ ID NO: 167483 - DNA, 20 bp, Artificial Sequence
  Description of Artificial Sequence: Synthetic oligonucleotide
  Target: ATXN1; (-) strand; PAM type: YTN; PAM sequence: TTT
cagagaccattatacacagc

SEQ ID NO: 167484 - DNA, 20 bp, Artificial Sequence
  Description of Artificial Sequence: Synthetic oligonucleotide
  Target: ATXN1; (-) strand; PAM type: YTN; PAM sequence: TTA
gcatttcagagaccattata

SEQ ID NO: 167485 - DNA, 20 bp, Artificial Sequence
  Description of Artificial Sequence: Synthetic oligonucleotide
  Target: ATXN1; (-) strand; PAM type: YTN; PAM sequence: TTC
cgttagcatttcagagacca

SEQ ID NO: 167486 - DNA, 20 bp, Artificial Sequence
  Description of Artificial Sequence: Synthetic oligonucleotide
  Target: ATXN1; (-) strand; PAM type: YTN; PAM sequence: CTT
ccgttagcatttcagagacc

SEQ ID NO: 167487 - DNA, 20 bp, Artificial Sequence
  Description of Artificial Sequence: Synthetic oligonucleotide
  Target: ATXN1; (-) strand; PAM type: YTN; PAM sequence: TTG
gcttccgttagcatttcaga

SEQ ID NO: 167488 - DNA, 20 bp, Artificial Sequence
  Description of Artificial Sequence: Synthetic oligonucleotide
  Target: ATXN1; (-) strand; PAM type: YTN; PAM sequence: CTT
ggcttccgttagcatttcag

SEQ ID NO: 167489 - DNA, 20 bp, Artificial Sequence
  Description of Artificial Sequence: Synthetic oligonucleotide
  Target: ATXN1; (-) strand; PAM type: YTN; PAM sequence: TTC
ttggcttccgttagcatttc

SEQ ID NO: 167490 - DNA, 20 bp, Artificial Sequence
  Description of Artificial Sequence: Synthetic oligonucleotide
  Target: ATXN1; (-) strand; PAM type: YTN; PAM sequence: TTT
cttggcttccgttagcattt

SEQ ID NO: 167491 - DNA, 20 bp, Artificial Sequence
  Description of Artificial Sequence: Synthetic oligonucleotide
  Target: ATXN1; (-) strand; PAM type: YTN; PAM sequence: TTC
atgtcaggtgatttcttggc

SEQ ID NO: 167492 - DNA, 20 bp, Artificial Sequence
  Description of Artificial Sequence: Synthetic oligonucleotide
  Target: ATXN1; (-) strand; PAM type: YTN; PAM sequence: TTC
atagttcatgtcaggtgatt

SEQ ID NO: 167493 - DNA, 20 bp, Artificial Sequence
  Description of Artificial Sequence: Synthetic oligonucleotide
  Target: ATXN1; (-) strand; PAM type: YTN; PAM sequence: CTT
catagttcatgtcaggtgat

SEQ ID NO: 167494 - DNA, 20 bp, Artificial Sequence
  Description of Artificial Sequence: Synthetic oligonucleotide
  Target: ATXN1; (-) strand; PAM type: YTN; PAM sequence: CTA
atagcttcatagttcatgtc

SEQ ID NO: 167495 - DNA, 20 bp, Artificial Sequence
  Description of Artificial Sequence: Synthetic oligonucleotide
  Target: ATXN1; (-) strand; PAM type: YTN; PAM sequence: TTC
ataactaatagcttcatagt

SEQ ID NO: 167496 - DNA, 20 bp, Artificial Sequence
  Description of Artificial Sequence: Synthetic oligonucleotide
  Target: ATXN1; (-) strand; PAM type: YTN; PAM sequence: TTT
cataactaatagcttcatag

SEQ ID NO: 167497 - DNA, 20 bp, Artificial Sequence
  Description of Artificial Sequence: Synthetic oligonucleotide
  Target: ATXN1; (-) strand; PAM type: YTN; PAM sequence: TTT
tcataactaatagcttcata

SEQ ID NO: 167498 - DNA, 20 bp, Artificial Sequence
  Description of Artificial Sequence: Synthetic oligonucleotide
  Target: ATXN1; (-) strand; PAM type: YTN; PAM sequence: CTT
ttcataactaatagcttcat

SEQ ID NO: 167499 - DNA, 20 bp, Artificial Sequence
  Description of Artificial Sequence: Synthetic oligonucleotide
  Target: ATXN1; (-) strand; PAM type: YTN; PAM sequence: TTG
cttttcataactaatagctt

SEQ ID NO: 167500 - DNA, 20 bp, Artificial Sequence
  Description of Artificial Sequence: Synthetic oligonucleotide
  Target: ATXN1; (-) strand; PAM type: YTN; PAM sequence: TTA
gaaggtaaatatcgatattg

SEQ ID NO: 167501 - DNA, 20 bp, Artificial Sequence
  Description of Artificial Sequence: Synthetic oligonucleotide
  Target: ATXN1; (-) strand; PAM type: YTN; PAM sequence: CTC
cagcatgaagagttagaagg

SEQ ID NO: 167502 - DNA, 20 bp, Artificial Sequence
  Description of Artificial Sequence: Synthetic oligonucleotide
  Target: ATXN1; (-) strand; PAM type: YTN; PAM sequence: TTA
ccctccagcatgaagagtta

SEQ ID NO: 167503 - DNA, 20 bp, Artificial Sequence
  Description of Artificial Sequence: Synthetic oligonucleotide
  Target: ATXN1; (-) strand; PAM type: YTN; PAM sequence: TTT
accctccagcatgaagagtt

SEQ ID NO: 167504 - DNA, 20 bp, Artificial Sequence
  Description of Artificial Sequence: Synthetic oligonucleotide
  Target: ATXN1; (-) strand; PAM type: YTN; PAM sequence: CTT
taccctccagcatgaagagt

SEQ ID NO: 167505 - DNA, 20 bp, Artificial Sequence
  Description of Artificial Sequence: Synthetic oligonucleotide
  Target: ATXN1; (-) strand; PAM type: YTN; PAM sequence: CTG
ctttaccctccagcatgaag

SEQ ID NO: 167506 - DNA, 20 bp, Artificial Sequence
  Description of Artificial Sequence: Synthetic oligonucleotide
  Target: ATXN1; (-) strand; PAM type: YTN; PAM sequence: TTG
tgctgctttaccctccagca

SEQ ID NO: 167507 - DNA, 20 bp, Artificial Sequence
  Description of Artificial Sequence: Synthetic oligonucleotide
  Target: ATXN1; (-) strand; PAM type: YTN; PAM sequence: CTC
ggcaccaggcacgtccaggt

SEQ ID NO: 167508 - DNA, 20 bp, Artificial Sequence
  Description of Artificial Sequence: Synthetic oligonucleotide
  Target: ATXN1; (-) strand; PAM type: YTN; PAM sequence: TTG
gctcggcaccaggcacgtcc

SEQ ID NO: 167509 - DNA, 20 bp, Artificial Sequence
  Description of Artificial Sequence: Synthetic oligonucleotide
  Target: ATXN1; (-) strand; PAM type: YTN; PAM sequence: TTA
tgttggctcggcaccaggca

SEQ ID NO: 167510 - DNA, 20 bp, Artificial Sequence
  Description of Artificial Sequence: Synthetic oligonucleotide
  Target: ATXN1; (-) strand; PAM type: YTN; PAM sequence: TTT
atgttggctcggcaccaggc

SEQ ID NO: 167511 - DNA, 20 bp, Artificial Sequence
  Description of Artificial Sequence: Synthetic oligonucleotide
  Target: ATXN1; (-) strand; PAM type: YTN; PAM sequence: CTT
tatgttggctcggcaccagg

SEQ ID NO: 167512 - DNA, 20 bp, Artificial Sequence
  Description of Artificial Sequence: Synthetic oligonucleotide
  Target: ATXN1; (-) strand; PAM type: YTN; PAM sequence: CTC
tttatgttggctcggcacca

SEQ ID NO: 167513 - DNA, 20 bp, Artificial Sequence
  Description of Artificial Sequence: Synthetic oligonucleotide
  Target: ATXN1; (-) strand; PAM type: YTN; PAM sequence: TTC
tctttatgttggctcggcac

SEQ ID NO: 167514 - DNA, 20 bp, Artificial Sequence
  Description of Artificial Sequence: Synthetic oligonucleotide
  Target: ATXN1; (-) strand; PAM type: YTN; PAM sequence: TTC
aaaaatggtagaggagggaa

SEQ ID NO: 167515 - DNA, 20 bp, Artificial Sequence
  Description of Artificial Sequence: Synthetic oligonucleotide
  Target: ATXN1; (-) strand; PAM type: YTN; PAM sequence: TTT
caaaaatggtagaggaggga

SEQ ID NO: 167516 - DNA, 20 bp, Artificial Sequence
  Description of Artificial Sequence: Synthetic oligonucleotide
  Target: ATXN1; (-) strand; PAM type: YTN; PAM sequence: TTC
catttcaaaaatggtagagg

SEQ ID NO: 167517 - DNA, 20 bp, Artificial Sequence
  Description of Artificial Sequence: Synthetic oligonucleotide
  Target: ATXN1; (-) strand; PAM type: YTN; PAM sequence: TTT
ccatttcaaaaatggtagag

SEQ ID NO: 167518 - DNA, 20 bp, Artificial Sequence
  Description of Artificial Sequence: Synthetic oligonucleotide
  Target: ATXN1; (-) strand; PAM type: YTN; PAM sequence: TTA
tttccatttcaaaaatggta

SEQ ID NO: 167519 - DNA, 20 bp, Artificial Sequence
  Description of Artificial Sequence: Synthetic oligonucleotide
  Target: ATXN1; (-) strand; PAM type: YTN; PAM sequence: TTA
ccaccataagcattatttcc

SEQ ID NO: 167520 - DNA, 20 bp, Artificial Sequence
  Description of Artificial Sequence: Synthetic oligonucleotide
  Target: ATXN1; (-) strand; PAM type: YTN; PAM sequence: TTA
ttaccaccataagcattatt

SEQ ID NO: 167521 - DNA, 20 bp, Artificial Sequence
  Description of Artificial Sequence: Synthetic oligonucleotide
  Target: ATXN1; (-) strand; PAM type: YTN; PAM sequence: TTG
aacgacagtcaccacattat

SEQ ID NO: 167522 - DNA, 20 bp, Artificial Sequence
  Description of Artificial Sequence: Synthetic oligonucleotide
  Target: ATXN1; (-) strand; PAM type: YTN; PAM sequence: TTT
gaacgacagtcaccacatta

SEQ ID NO: 167523 - DNA, 20 bp, Artificial Sequence
  Description of Artificial Sequence: Synthetic oligonucleotide
  Target: ATXN1; (-) strand; PAM type: YTN; PAM sequence: CTT
tgaacgacagtcaccacatt

SEQ ID NO: 167524 - DNA, 20 bp, Artificial Sequence
  Description of Artificial Sequence: Synthetic oligonucleotide
  Target: ATXN1; (-) strand; PAM type: YTN; PAM sequence: CTG
ggaggagcagatcagatcat

SEQ ID NO: 167525 - DNA, 20 bp, Artificial Sequence
  Description of Artificial Sequence: Synthetic oligonucleotide
  Target: ATXN1; (-) strand; PAM type: YTN; PAM sequence: TTC
ctgggaggagcagatcagat

SEQ ID NO: 167526 - DNA, 20 bp, Artificial Sequence
  Description of Artificial Sequence: Synthetic oligonucleotide
  Target: ATXN1; (-) strand; PAM type: YTN; PAM sequence: CTC
atgcaggattcctgggagga

SEQ ID NO: 167527 - DNA, 20 bp, Artificial Sequence
  Description of Artificial Sequence: Synthetic oligonucleotide
  Target: ATXN1; (-) strand; PAM type: YTN; PAM sequence: TTC
atgatatccacctcatgcag

SEQ ID NO: 167528 - DNA, 20 bp, Artificial Sequence
  Description of Artificial Sequence: Synthetic oligonucleotide
  Target: ATXN1; (-) strand; PAM type: YTN; PAM sequence: TTA
taacattcatgatatccacc

SEQ ID NO: 167529 - DNA, 20 bp, Artificial Sequence
  Description of Artificial Sequence: Synthetic oligonucleotide
  Target: ATXN1; (-) strand; PAM type: YTN; PAM sequence: CTG
gacattataacattcatgat

SEQ ID NO: 167530 - DNA, 20 bp, Artificial Sequence
  Description of Artificial Sequence: Synthetic oligonucleotide
  Target: ATXN1; (-) strand; PAM type: YTN; PAM sequence: TTC
tggacattataacattcatg

SEQ ID NO: 167531 - DNA, 20 bp, Artificial Sequence
  Description of Artificial Sequence: Synthetic oligonucleotide
  Target: ATXN1; (-) strand; PAM type: YTN; PAM sequence: CTT
ctggacattataacattcat

SEQ ID NO: 167532 - DNA, 20 bp, Artificial Sequence
  Description of Artificial Sequence: Synthetic oligonucleotide
  Target: ATXN1; (-) strand; PAM type: YTN; PAM sequence: CTG
cttctggacattataacatt

SEQ ID NO: 167533 - DNA, 20 bp, Artificial Sequence
  Description of Artificial Sequence: Synthetic oligonucleotide
  Target: ATXN1; (-) strand; PAM type: YTN; PAM sequence: TTC
ctgcttctggacattataac

SEQ ID NO: 167534 - DNA, 20 bp, Artificial Sequence
  Description of Artificial Sequence: Synthetic oligonucleotide
  Target: ATXN1; (-) strand; PAM type: YTN; PAM sequence: CTA
catcagttcctgcttctgga

SEQ ID NO: 167535 - DNA, 20 bp, Artificial Sequence
  Description of Artificial Sequence: Synthetic oligonucleotide
  Target: ATXN1; (-) strand; PAM type: YTN; PAM sequence: TTC
tacatcagttcctgcttctg

SEQ ID NO: 167536 - DNA, 20 bp, Artificial Sequence
  Description of Artificial Sequence: Synthetic oligonucleotide
  Target: ATXN1; (-) strand; PAM type: YTN; PAM sequence: TTT
ctacatcagttcctgcttct

SEQ ID NO: 167537 - DNA, 20 bp, Artificial Sequence
  Description of Artificial Sequence: Synthetic oligonucleotide
  Target: ATXN1; (-) strand; PAM type: YTN; PAM sequence: CTT
tctacatcagttcctgcttc

SEQ ID NO: 167538 - DNA, 20 bp, Artificial Sequence
  Description of Artificial Sequence: Synthetic oligonucleotide
  Target: ATXN1; (-) strand; PAM type: YTN; PAM sequence: TTA
actttctacatcagttcctg

SEQ ID NO: 167539 - DNA, 20 bp, Artificial Sequence
  Description of Artificial Sequence: Synthetic oligonucleotide
  Target: ATXN1; (-) strand; PAM type: YTN; PAM sequence: CTT
aactttctacatcagttcct

SEQ ID NO: 167540 - DNA, 20 bp, Artificial Sequence
  Description of Artificial Sequence: Synthetic oligonucleotide
  Target: ATXN1; (-) strand; PAM type: YTN; PAM sequence: CTG
gagaacatcacttaactttc

SEQ ID NO: 167541 - DNA, 20 bp, Artificial Sequence
  Description of Artificial Sequence: Synthetic oligonucleotide
  Target: ATXN1; (-) strand; PAM type: YTN; PAM sequence: CTG
tcggggtcgcctggagaaca

SEQ ID NO: 167542 - DNA, 20 bp, Artificial Sequence
  Description of Artificial Sequence: Synthetic oligonucleotide
  Target: ATXN1; (-) strand; PAM type: YTN; PAM sequence: CTC
tgtcggggtcgcctggagaa

SEQ ID NO: 167543 - DNA, 20 bp, Artificial Sequence
  Description of Artificial Sequence: Synthetic oligonucleotide
  Target: ATXN1; (-) strand; PAM type: YTN; PAM sequence: CTG
ccaggctctgtcggggtcgc

SEQ ID NO: 167544 - DNA, 20 bp, Artificial Sequence
  Description of Artificial Sequence: Synthetic oligonucleotide
  Target: ATXN1; (-) strand; PAM type: YTN; PAM sequence: CTC
cagggtcaaagcagcagccc

SEQ ID NO: 167545 - DNA, 20 bp, Artificial Sequence
  Description of Artificial Sequence: Synthetic oligonucleotide
  Target: ATXN1; (-) strand; PAM type: YTN; PAM sequence: CTC
aactccagggtcaaagcagc

SEQ ID NO: 167546 - DNA, 20 bp, Artificial Sequence
  Description of Artificial Sequence: Synthetic oligonucleotide
  Target: ATXN1; (-) strand; PAM type: YTN; PAM sequence: CTC
tcaactccagggtcaaagca

SEQ ID NO: 167547 - DNA, 20 bp, Artificial Sequence
  Description of Artificial Sequence: Synthetic oligonucleotide
  Target: ATXN1; (-) strand; PAM type: YTN; PAM sequence: TTC
ctctcaactccagggtcaaa

SEQ ID NO: 167548 - DNA, 20 bp, Artificial Sequence
  Description of Artificial Sequence: Synthetic oligonucleotide
  Target: ATXN1; (-) strand; PAM type: YTN; PAM sequence: TTG
atgtggaaagaacaattcct

SEQ ID NO: 167549 - DNA, 20 bp, Artificial Sequence
  Description of Artificial Sequence: Synthetic oligonucleotide
  Target: ATXN1; (-) strand; PAM type: YTN; PAM sequence: TTG
aaatatgtccggcgggggtt

SEQ ID NO: 167550 - DNA, 20 bp, Artificial Sequence
  Description of Artificial Sequence: Synthetic oligonucleotide
  Target: ATXN1; (-) strand; PAM type: YTN; PAM sequence: TTT
gaaatatgtccggcgggggt

SEQ ID NO: 167551 - DNA, 20 bp, Artificial Sequence
  Description of Artificial Sequence: Synthetic oligonucleotide
  Target: ATXN1; (-) strand; PAM type: YTN; PAM sequence: TTT
tgaaatatgtccggcggggg

SEQ ID NO: 167552 - DNA, 20 bp, Artificial Sequence
  Description of Artificial Sequence: Synthetic oligonucleotide
  Target: ATXN1; (-) strand; PAM type: YTN; PAM sequence: TTT
ttgaaatatgtccggcgggg

SEQ ID NO: 167553 - DNA, 20 bp, Artificial Sequence
  Description of Artificial Sequence: Synthetic oligonucleotide
  Target: ATXN1; (-) strand; PAM type: YTN; PAM sequence: TTG
catttttgaaatatgtccgg

SEQ ID NO: 167554 - DNA, 20 bp, Artificial Sequence
  Description of Artificial Sequence: Synthetic oligonucleotide
  Target: ATXN1; (-) strand; PAM type: YTN; PAM sequence: TTA
gcaaagaaaagatagaccca

SEQ ID NO: 167555 - DNA, 20 bp, Artificial Sequence
  Description of Artificial Sequence: Synthetic oligonucleotide
  Target: ATXN1; (-) strand; PAM type: YTN; PAM sequence: CTA
ttagcaaagaaaagatagac

SEQ ID NO: 167556 - DNA, 20 bp, Artificial Sequence
  Description of Artificial Sequence: Synthetic oligonucleotide
  Target: ATXN1; (-) strand; PAM type: YTN; PAM sequence: TTA
ctattagcaaagaaaagata

SEQ ID NO: 167557 - DNA, 20 bp, Artificial Sequence
  Description of Artificial Sequence: Synthetic oligonucleotide
  Target: ATXN1; (-) strand; PAM type: YTN; PAM sequence: TTG
attactattagcaaagaaaa

SEQ ID NO: 167558 - DNA, 20 bp, Artificial Sequence
  Description of Artificial Sequence: Synthetic oligonucleotide
  Target: ATXN1; (-) strand; PAM type: YTN; PAM sequence: TTT
gattactattagcaaagaaa

SEQ ID NO: 167559 - DNA, 20 bp, Artificial Sequence
  Description of Artificial Sequence: Synthetic oligonucleotide
  Target: ATXN1; (-) strand; PAM type: YTN; PAM sequence: CTT
tgattactattagcaaagaa

SEQ ID NO: 167560 - DNA, 20 bp, Artificial Sequence
  Description of Artificial Sequence: Synthetic oligonucleotide
  Target: ATXN1; (-) strand; PAM type: YTN; PAM sequence: TTA
gatctttgattactattagc

SEQ ID NO: 167561 - DNA, 20 bp, Artificial Sequence
  Description of Artificial Sequence: Synthetic oligonucleotide
  Target: ATXN1; (-) strand; PAM type: YTN; PAM sequence: TTT
agatctttgattactattag

SEQ ID NO: 167562 - DNA, 20 bp, Artificial Sequence
  Description of Artificial Sequence: Synthetic oligonucleotide
  Target: ATXN1; (-) strand; PAM type: YTN; PAM sequence: TTT
tagatctttgattactatta

SEQ ID NO: 167563 - DNA, 20 bp, Artificial Sequence
  Description of Artificial Sequence: Synthetic oligonucleotide
  Target: ATXN1; (-) strand; PAM type: YTN; PAM sequence: CTT
ttagatctttgattactatt

SEQ ID NO: 167564 - DNA, 20 bp, Artificial Sequence
  Description of Artificial Sequence: Synthetic oligonucleotide
  Target: ATXN1; (-) strand; PAM type: YTN; PAM sequence: CTG
tagcttttagatctttgatt

SEQ ID NO: 167565 - DNA, 20 bp, Artificial Sequence
  Description of Artificial Sequence: Synthetic oligonucleotide
  Target: ATXN1; (-) strand; PAM type: YTN; PAM sequence: TTG
ataaatctgtagcttttaga

SEQ ID NO: 167566 - DNA, 20 bp, Artificial Sequence
  Description of Artificial Sequence: Synthetic oligonucleotide
  Target: ATXN1; (-) strand; PAM type: YTN; PAM sequence: TTT
gataaatctgtagcttttag

SEQ ID NO: 167567 - DNA, 20 bp, Artificial Sequence
  Description of Artificial Sequence: Synthetic oligonucleotide
  Target: ATXN1; (-) strand; PAM type: YTN; PAM sequence: CTT
tgataaatctgtagctttta

SEQ ID NO: 167568 - DNA, 20 bp, Artificial Sequence
  Description of Artificial Sequence: Synthetic oligonucleotide
  Target: ATXN1; (-) strand; PAM type: YTN; PAM sequence: TTC
tttgataaatctgtagcttt

SEQ ID NO: 167569 - DNA, 20 bp, Artificial Sequence
  Description of Artificial Sequence: Synthetic oligonucleotide
  Target: ATXN1; (-) strand; PAM type: YTN; PAM sequence: TTC
agttctttgataaatctgta

SEQ ID NO: 167570 - DNA, 20 bp, Artificial Sequence
  Description of Artificial Sequence: Synthetic oligonucleotide
  Target: ATXN1; (-) strand; PAM type: YTN; PAM sequence: CTT
cagttctttgataaatctgt

SEQ ID NO: 167571 - DNA, 20 bp, Artificial Sequence
  Description of Artificial Sequence: Synthetic oligonucleotide
  Target: ATXN1; (-) strand; PAM type: YTN; PAM sequence: TTA
gtagcttcagttctttgata

SEQ ID NO: 167572 - DNA, 20 bp, Artificial Sequence
  Description of Artificial Sequence: Synthetic oligonucleotide
  Target: ATXN1; (-) strand; PAM type: YTN; PAM sequence: TTT
agtagcttcagttctttgat

SEQ ID NO: 167573 - DNA, 20 bp, Artificial Sequence
  Description of Artificial Sequence: Synthetic oligonucleotide
  Target: ATXN1; (-) strand; PAM type: YTN; PAM sequence: TTT
tagtagcttcagttctttga

SEQ ID NO: 167574 - DNA, 20 bp, Artificial Sequence
  Description of Artificial Sequence: Synthetic oligonucleotide
  Target: ATXN1; (-) strand; PAM type: YTN; PAM sequence: CTG
caaacaattttagtagcttc

SEQ ID NO: 167575 - DNA, 20 bp, Artificial Sequence
  Description of Artificial Sequence: Synthetic oligonucleotide
  Target: ATXN1; (-) strand; PAM type: YTN; PAM sequence: TTC
acgacactgcaaacaatttt

SEQ ID NO: 167576 - DNA, 20 bp, Artificial Sequence
  Description of Artificial Sequence: Synthetic oligonucleotide
  Target: ATXN1; (-) strand; PAM type: YTN; PAM sequence: TTT
cacgacactgcaaacaattt

SEQ ID NO: 167577 - DNA, 20 bp, Artificial Sequence
  Description of Artificial Sequence: Synthetic oligonucleotide
  Target: ATXN1; (-) strand; PAM type: YTN; PAM sequence: CTT
tcacgacactgcaaacaatt

SEQ ID NO: 167578 - DNA, 20 bp, Artificial Sequence
  Description of Artificial Sequence: Synthetic oligonucleotide
  Target: ATXN1; (-) strand; PAM type: YTN; PAM sequence: TTC
tttcacgacactgcaaacaa

SEQ ID NO: 167579 - DNA, 20 bp, Artificial Sequence
  Description of Artificial Sequence: Synthetic oligonucleotide
  Target: ATXN1; (-) strand; PAM type: YTN; PAM sequence: TTT
ctttcacgacactgcaaaca

SEQ ID NO: 167580 - DNA, 20 bp, Artificial Sequence
  Description of Artificial Sequence: Synthetic oligonucleotide
  Target: ATXN1; (-) strand; PAM type: YTN; PAM sequence: TTG
ccagtttctttcacgacact

SEQ ID NO: 167581 - DNA, 20 bp, Artificial Sequence
  Description of Artificial Sequence: Synthetic oligonucleotide
  Target: ATXN1; (-) strand; PAM type: YTN; PAM sequence: TTT
gccagtttctttcacgacac

SEQ ID NO: 167582 - DNA, 20 bp, Artificial Sequence
  Description of Artificial Sequence: Synthetic oligonucleotide
  Target: ATXN1; (-) strand; PAM type: YTN; PAM sequence: TTA
aaatcgtgtttgccagtttc

SEQ ID NO: 167583 - DNA, 20 bp, Artificial Sequence
  Description of Artificial Sequence: Synthetic oligonucleotide
  Target: ATXN1; (-) strand; PAM type: YTN; PAM sequence: CTT
aaaatcgtgtttgccagttt

SEQ ID NO: 167584 - DNA, 20 bp, Artificial Sequence
  Description of Artificial Sequence: Synthetic oligonucleotide
  Target: ATXN1; (-) strand; PAM type: YTN; PAM sequence: TTC
ttaaaatcgtgtttgccagt

SEQ ID NO: 167585 - DNA, 20 bp, Artificial Sequence
  Description of Artificial Sequence: Synthetic oligonucleotide
  Target: ATXN1; (-) strand; PAM type: YTN; PAM sequence: TTT
cttaaaatcgtgtttgccag

SEQ ID NO: 167586 - DNA, 20 bp, Artificial Sequence
  Description of Artificial Sequence: Synthetic oligonucleotide
  Target: ATXN1; (-) strand; PAM type: YTN; PAM sequence: TTT
tcttaaaatcgtgtttgcca

SEQ ID NO: 167587 - DNA, 20 bp, Artificial Sequence
  Description of Artificial Sequence: Synthetic oligonucleotide
  Target: ATXN1; (-) strand; PAM type: YTN; PAM sequence: CTT
ttcttaaaatcgtgtttgcc

SEQ ID NO: 167588 - DNA, 20 bp, Artificial Sequence
  Description of Artificial Sequence: Synthetic oligonucleotide
  Target: ATXN1; (-) strand; PAM type: YTN; PAM sequence: CTC
ttttcttaaaatcgtgtttg

SEQ ID NO: 167589 - DNA, 20 bp, Artificial Sequence
  Description of Artificial Sequence: Synthetic oligonucleotide
  Target: ATXN1; (-) strand; PAM type: YTN; PAM sequence: TTG
cctcttttcttaaaatcgtg

SEQ ID NO: 167590 - DNA, 20 bp, Artificial Sequence
  Description of Artificial Sequence: Synthetic oligonucleotide
  Target: ATXN1; (-) strand; PAM type: YTN; PAM sequence: CTG
tcacagttgcctcttttctt

SEQ ID NO: 167591 - DNA, 20 bp, Artificial Sequence
  Description of Artificial Sequence: Synthetic oligonucleotide
  Target: ATXN1; (-) strand; PAM type: YTN; PAM sequence: TTC
tgtcacagttgcctcttttc

SEQ ID NO: 167592 - DNA, 20 bp, Artificial Sequence
  Description of Artificial Sequence: Synthetic oligonucleotide
  Target: ATXN1; (-) strand; PAM type: YTN; PAM sequence: CTT
ctgtcacagttgcctctttt

SEQ ID NO: 167593 - DNA, 20 bp, Artificial Sequence
  Description of Artificial Sequence: Synthetic oligonucleotide
  Target: ATXN1; (-) strand; PAM type: YTN; PAM sequence: TTC
ttctgtcacagttgcctctt

SEQ ID NO: 167594 - DNA, 20 bp, Artificial Sequence
  Description of Artificial Sequence: Synthetic oligonucleotide
  Target: ATXN1; (-) strand; PAM type: YTN; PAM sequence: TTT
cttctgtcacagttgcctct

SEQ ID NO: 167595 - DNA, 20 bp, Artificial Sequence
  Description of Artificial Sequence: Synthetic oligonucleotide
  Target: ATXN1; (-) strand; PAM type: YTN; PAM sequence: TTA
tttcttctgtcacagttgcc

SEQ ID NO: 167596 - DNA, 20 bp, Artificial Sequence
  Description of Artificial Sequence: Synthetic oligonucleotide
  Target: ATXN1; (-) strand; PAM type: YTN; PAM sequence: TTT
atttcttctgtcacagttgc

SEQ ID NO: 167597 - DNA, 20 bp, Artificial Sequence
  Description of Artificial Sequence: Synthetic oligonucleotide
  Target: ATXN1; (-) strand; PAM type: YTN; PAM sequence: TTT
tatttcttctgtcacagttg

SEQ ID NO: 167598 - DNA, 20 bp, Artificial Sequence
  Description of Artificial Sequence: Synthetic oligonucleotide
  Target: ATXN1; (-) strand; PAM type: YTN; PAM sequence: TTT
ttatttcttctgtcacagtt

SEQ ID NO: 167599 - DNA, 20 bp, Artificial Sequence
  Description of Artificial Sequence: Synthetic oligonucleotide
  Target: ATXN1; (-) strand; PAM type: YTN; PAM sequence: CTA
aacacaagtttttatttctt

SEQ ID NO: 167600 - DNA, 20 bp, Artificial Sequence
  Description of Artificial Sequence: Synthetic oligonucleotide
  Target: ATXN1; (-) strand; PAM type: YTN; PAM sequence: TTG
aagataacctaaacacaagt

SEQ ID NO: 167601 - DNA, 20 bp, Artificial Sequence
  Description of Artificial Sequence: Synthetic oligonucleotide
  Target: ATXN1; (-) strand; PAM type: YTN; PAM sequence: TTT
gaagataacctaaacacaag

SEQ ID NO: 167602 - DNA, 20 bp, Artificial Sequence
  Description of Artificial Sequence: Synthetic oligonucleotide
  Target: ATXN1; (-) strand; PAM type: YTN; PAM sequence: TTT
tgaagataacctaaacacaa

SEQ ID NO: 167603 - DNA, 20 bp, Artificial Sequence
  Description of Artificial Sequence: Synthetic oligonucleotide
  Target: ATXN1; (-) strand; PAM type: YTN; PAM sequence: TTA
gttttgaagataacctaaac

SEQ ID NO: 167604 - DNA, 20 bp, Artificial Sequence
  Description of Artificial Sequence: Synthetic oligonucleotide
  Target: ATXN1; (-) strand; PAM type: YTN; PAM sequence: TTA
gaaatattagttttgaagat

SEQ ID NO: 167605 - DNA, 20 bp, Artificial Sequence
  Description of Artificial Sequence: Synthetic oligonucleotide
  Target: ATXN1; (-) strand; PAM type: YTN; PAM sequence: TTG
tacattagaaatattagttt

SEQ ID NO: 167606 - DNA, 20 bp, Artificial Sequence
  Description of Artificial Sequence: Synthetic oligonucleotide
  Target: ATXN1; (-) strand; PAM type: YTN; PAM sequence: TTG
tgcattgtacattagaaata

SEQ ID NO: 167607 - DNA, 20 bp, Artificial Sequence
  Description of Artificial Sequence: Synthetic oligonucleotide
  Target: ATXN1; (-) strand; PAM type: YTN; PAM sequence: TTA
gttgtgcattgtacattaga

SEQ ID NO: 167608 - DNA, 20 bp, Artificial Sequence
  Description of Artificial Sequence: Synthetic oligonucleotide
  Target: ATXN1; (-) strand; PAM type: YTN; PAM sequence: CTT
agttgtgcattgtacattag

SEQ ID NO: 167609 - DNA, 20 bp, Artificial Sequence
  Description of Artificial Sequence: Synthetic oligonucleotide
  Target: ATXN1; (-) strand; PAM type: YTN; PAM sequence: CTA
tcttagttgtgcattgtaca

SEQ ID NO: 167610 - DNA, 20 bp, Artificial Sequence
  Description of Artificial Sequence: Synthetic oligonucleotide
  Target: ATXN1; (-) strand; PAM type: YTN; PAM sequence: TTA
tatcagaaaaaagctatctt

SEQ ID NO: 167611 - DNA, 20 bp, Artificial Sequence
  Description of Artificial Sequence: Synthetic oligonucleotide
  Target: ATXN1; (-) strand; PAM type: YTN; PAM sequence: TTT
atatcagaaaaaagctatct

SEQ ID NO: 167612 - DNA, 20 bp, Artificial Sequence
  Description of Artificial Sequence: Synthetic oligonucleotide
  Target: ATXN1; (-) strand; PAM type: YTN; PAM sequence: TTT
tatatcagaaaaaagctatc

SEQ ID NO: 167613 - DNA, 20 bp, Artificial Sequence
  Description of Artificial Sequence: Synthetic oligonucleotide
  Target: ATXN1; (-) strand; PAM type: YTN; PAM sequence: TTT
ttatatcagaaaaaagctat

SEQ ID NO: 167614 - DNA, 20 bp, Artificial Sequence
  Description of Artificial Sequence: Synthetic oligonucleotide
  Target: ATXN1; (-) strand; PAM type: YTN; PAM sequence: TTA
tttttatatcagaaaaaagc

SEQ ID NO: 167615 - DNA, 20 bp, Artificial Sequence
  Description of Artificial Sequence: Synthetic oligonucleotide
  Target: ATXN1; (-) strand; PAM type: YTN; PAM sequence: TTT
atttttatatcagaaaaaag

SEQ ID NO: 167616 - DNA, 20 bp, Artificial Sequence
  Description of Artificial Sequence: Synthetic oligonucleotide
  Target: ATXN1; (-) strand; PAM type: YTN; PAM sequence: CTT
tatttttatatcagaaaaaa

SEQ ID NO: 167617 - DNA, 20 bp, Artificial Sequence
  Description of Artificial Sequence: Synthetic oligonucleotide
  Target: ATXN1; (-) strand; PAM type: YTN; PAM sequence: TTC
cacatatgatcacactttat

SEQ ID NO: 167618 - DNA, 20 bp, Artificial Sequence
  Description of Artificial Sequence: Synthetic oligonucleotide
  Target: ATXN1; (-) strand; PAM type: YTN; PAM sequence: TTT
ccacatatgatcacacttta

SEQ ID NO: 167619 - DNA, 20 bp, Artificial Sequence
  Description of Artificial Sequence: Synthetic oligonucleotide
  Target: ATXN1; (-) strand; PAM type: YTN; PAM sequence: CTG
tgtttccacatatgatcaca

SEQ ID NO: 167620 - DNA, 20 bp, Artificial Sequence
  Description of Artificial Sequence: Synthetic oligonucleotide
  Target: ATXN1; (-) strand; PAM type: YTN; PAM sequence: TTC
tgtgtttccacatatgatca

SEQ ID NO: 167621 - DNA, 20 bp, Artificial Sequence
  Description of Artificial Sequence: Synthetic oligonucleotide
  Target: ATXN1; (-) strand; PAM type: YTN; PAM sequence: TTT
ctgtgtttccacatatgatc

SEQ ID NO: 167622 - DNA, 20 bp, Artificial Sequence
  Description of Artificial Sequence: Synthetic oligonucleotide
  Target: ATXN1; (-) strand; PAM type: YTN; PAM sequence: TTT
tctgtgtttccacatatgat

SEQ ID NO: 167623 - DNA, 20 bp, Artificial Sequence
  Description of Artificial Sequence: Synthetic oligonucleotide
  Target: ATXN1; (-) strand; PAM type: YTN; PAM sequence: TTA
agttttctgtgtttccacat

SEQ ID NO: 167624 - DNA, 20 bp, Artificial Sequence
  Description of Artificial Sequence: Synthetic oligonucleotide
  Target: ATXN1; (-) strand; PAM type: YTN; PAM sequence: TTT
aagttttctgtgtttccaca

SEQ ID NO: 167625 - DNA, 20 bp, Artificial Sequence
  Description of Artificial Sequence: Synthetic oligonucleotide
  Target: ATXN1; (-) strand; PAM type: YTN; PAM sequence: TTT
taagttttctgtgtttccac

SEQ ID NO: 167626 - DNA, 20 bp, Artificial Sequence
  Description of Artificial Sequence: Synthetic oligonucleotide
  Target: ATXN1; (-) strand; PAM type: YTN; PAM sequence: TTT
ttaagttttctgtgtttcca

SEQ ID NO: 167627 - DNA, 20 bp, Artificial Sequence
  Description of Artificial Sequence: Synthetic oligonucleotide
  Target: ATXN1; (-) strand; PAM type: YTN; PAM sequence: TTT
tttaagttttctgtgtttcc

SEQ ID NO: 167628 - DNA, 20 bp, Artificial Sequence
  Description of Artificial Sequence: Synthetic oligonucleotide
  Target: ATXN1; (-) strand; PAM type: YTN; PAM sequence: TTA
tattttttaagttttctgtg

SEQ ID NO: 167629 - DNA, 20 bp, Artificial Sequence
  Description of Artificial Sequence: Synthetic oligonucleotide
  Target: ATXN1; (-) strand; PAM type: YTN; PAM sequence: TTT
atattttttaagttttctgt

SEQ ID NO: 167630 - DNA, 20 bp, Artificial Sequence
  Description of Artificial Sequence: Synthetic oligonucleotide
  Target: ATXN1; (-) strand; PAM type: YTN; PAM sequence: TTT
tatattttttaagttttctg

SEQ ID NO: 167631 - DNA, 20 bp, Artificial Sequence
  Description of Artificial Sequence: Synthetic oligonucleotide
  Target: ATXN1; (-) strand; PAM type: YTN; PAM sequence: TTA
ggagcagttttatatttttt

SEQ ID NO: 167632 - DNA, 20 bp, Artificial Sequence
  Description of Artificial Sequence: Synthetic oligonucleotide
  Target: ATXN1; (-) strand; PAM type: YTN; PAM sequence: TTG
gagatattaggagcagtttt

SEQ ID NO: 167633 - DNA, 20 bp, Artificial Sequence
  Description of Artificial Sequence: Synthetic oligonucleotide
  Target: ATXN1; (-) strand; PAM type: YTN; PAM sequence: TTA
tatatatatgccaaaataca

SEQ ID NO: 167634 - DNA, 20 bp, Artificial Sequence
  Description of Artificial Sequence: Synthetic oligonucleotide
  Target: ATXN1; (-) strand; PAM type: YTN; PAM sequence: TTA
aaaaagaaaattatatatat

SEQ ID NO: 167635 - DNA, 20 bp, Artificial Sequence
  Description of Artificial Sequence: Synthetic oligonucleotide
  Target: ATXN1; (-) strand; PAM type: YTN; PAM sequence: TTT
aaaaaagaaaattatatata

SEQ ID NO: 167636 - DNA, 20 bp, Artificial Sequence
  Description of Artificial Sequence: Synthetic oligonucleotide
  Target: ATXN1; (-) strand; PAM type: YTN; PAM sequence: CTT
taaaaaagaaaattatatat

SEQ ID NO: 167637 - DNA, 20 bp, Artificial Sequence
  Description of Artificial Sequence: Synthetic oligonucleotide
  Target: ATXN1; (-) strand; PAM type: YTN; PAM sequence: TTG
taaacatgcatagatatatg

SEQ ID NO: 167638 - DNA, 20 bp, Artificial Sequence
  Description of Artificial Sequence: Synthetic oligonucleotide
  Target: ATXN1; (-) strand; PAM type: YTN; PAM sequence: TTT
gtaaacatgcatagatatat

SEQ ID NO: 167639 - DNA, 20 bp, Artificial Sequence
  Description of Artificial Sequence: Synthetic oligonucleotide
  Target: ATXN1; (-) strand; PAM type: YTN; PAM sequence: CTT
tgtaaacatgcatagatata

SEQ ID NO: 167640 - DNA, 20 bp, Artificial Sequence
  Description of Artificial Sequence: Synthetic oligonucleotide
  Target: ATXN1; (-) strand; PAM type: YTN; PAM sequence: CTA
actttgtaaacatgcataga

SEQ ID NO: 167641 - DNA, 20 bp, Artificial Sequence
  Description of Artificial Sequence: Synthetic oligonucleotide
  Target: ATXN1; (-) strand; PAM type: YTN; PAM sequence: TTC
taactttgtaaacatgcata

SEQ ID NO: 167642 - DNA, 20 bp, Artificial Sequence
  Description of Artificial Sequence: Synthetic oligonucleotide
  Target: ATXN1; (-) strand; PAM type: YTN; PAM sequence: TTA
ttctaactttgtaaacatgc

SEQ ID NO: 167643 - DNA, 20 bp, Artificial Sequence
  Description of Artificial Sequence: Synthetic oligonucleotide
  Target: ATXN1; (-) strand; PAM type: YTN; PAM sequence: TTC
agaattattctaactttgta

SEQ ID NO: 167644 - DNA, 20 bp, Artificial Sequence
  Description of Artificial Sequence: Synthetic oligonucleotide
  Target: ATXN1; (-) strand; PAM type: YTN; PAM sequence: TTA
tatattcagaattattctaa

SEQ ID NO: 167645 - DNA, 20 bp, Artificial Sequence
  Description of Artificial Sequence: Synthetic oligonucleotide
  Target: ATXN1; (-) strand; PAM type: YTN; PAM sequence: TTC
aaaattatatattcagaatt

SEQ ID NO: 167646 - DNA, 20 bp, Artificial Sequence
  Description of Artificial Sequence: Synthetic oligonucleotide
  Target: ATXN1; (-) strand; PAM type: YTN; PAM sequence: CTG
attcaaaattatatattcag

SEQ ID NO: 167647 - DNA, 20 bp, Artificial Sequence
  Description of Artificial Sequence: Synthetic oligonucleotide
  Target: ATXN1; (-) strand; PAM type: YTN; PAM sequence: TTA
agtgaaagaactgattcaaa

SEQ ID NO: 167648 - DNA, 20 bp, Artificial Sequence
  Description of Artificial Sequence: Synthetic oligonucleotide
  Target: ATXN1; (-) strand; PAM type: YTN; PAM sequence: TTA
caatacaatgttaagtgaaa

SEQ ID NO: 167649 - DNA, 20 bp, Artificial Sequence
  Description of Artificial Sequence: Synthetic oligonucleotide
  Target: ATXN1; (-) strand; PAM type: YTN; PAM sequence: CTA
gttacaatacaatgttaagt

SEQ ID NO: 167650 - DNA, 20 bp, Artificial Sequence
  Description of Artificial Sequence: Synthetic oligonucleotide
  Target: ATXN1; (-) strand; PAM type: YTN; PAM sequence: TTC
tagttacaatacaatgttaa

SEQ ID NO: 167651 - DNA, 20 bp, Artificial Sequence
  Description of Artificial Sequence: Synthetic oligonucleotide
  Target: ATXN1; (-) strand; PAM type: YTN; PAM sequence: TTA
taattctagttacaatacaa

SEQ ID NO: 167652 - DNA, 20 bp, Artificial Sequence
  Description of Artificial Sequence: Synthetic oligonucleotide
  Target: ATXN1; (-) strand; PAM type: YTN; PAM sequence: TTT
ataattctagttacaataca

SEQ ID NO: 167653 - DNA, 20 bp, Artificial Sequence
  Description of Artificial Sequence: Synthetic oligonucleotide
  Target: ATXN1; (-) strand; PAM type: YTN; PAM sequence: CTA
gtttataattctagttacaa

SEQ ID NO: 167654 - DNA, 20 bp, Artificial Sequence
  Description of Artificial Sequence: Synthetic oligonucleotide
  Target: ATXN1; (-) strand; PAM type: YTN; PAM sequence: TTA
aaaaactagtttataattct

SEQ ID NO: 167655 - DNA, 20 bp, Artificial Sequence
  Description of Artificial Sequence: Synthetic oligonucleotide
  Target: ATXN1; (-) strand; PAM type: YTN; PAM sequence: TTT
aaaaaactagtttataattc

SEQ ID NO: 167656 - DNA, 20 bp, Artificial Sequence
  Description of Artificial Sequence: Synthetic oligonucleotide
  Target: ATXN1; (-) strand; PAM type: YTN; PAM sequence: CTT
taaaaaactagtttataatt

SEQ ID NO: 167657 - DNA, 20 bp, Artificial Sequence
  Description of Artificial Sequence: Synthetic oligonucleotide
  Target: ATXN1; (-) strand; PAM type: YTN; PAM sequence: CTA
gctttaaaaaactagtttat

SEQ ID NO: 167658 - DNA, 20 bp, Artificial Sequence
  Description of Artificial Sequence: Synthetic oligonucleotide
  Target: ATXN1; (-) strand; PAM type: YTN; PAM sequence: TTA
actagctttaaaaaactagt

SEQ ID NO: 167659 - DNA, 20 bp, Artificial Sequence
  Description of Artificial Sequence: Synthetic oligonucleotide
  Target: ATXN1; (-) strand; PAM type: YTN; PAM sequence: TTT
aactagctttaaaaaactag

SEQ ID NO: 167660 - DNA, 20 bp, Artificial Sequence
  Description of Artificial Sequence: Synthetic oligonucleotide
  Target: ATXN1; (-) strand; PAM type: YTN; PAM sequence: CTT
taactagctttaaaaaacta

SEQ ID NO: 167661 - DNA, 20 bp, Artificial Sequence
  Description of Artificial Sequence: Synthetic oligonucleotide
  Target: ATXN1; (-) strand; PAM type: YTN; PAM sequence: TTC
ctttaactagctttaaaaaa

SEQ ID NO: 167662 - DNA, 20 bp, Artificial Sequence
  Description of Artificial Sequence: Synthetic oligonucleotide
  Target: ATXN1; (-) strand; PAM type: YTN; PAM sequence: CTT
cctttaactagctttaaaaa

SEQ ID NO: 167663 - DNA, 20 bp, Artificial Sequence
  Description of Artificial Sequence: Synthetic oligonucleotide
  Target: ATXN1; (-) strand; PAM type: YTN; PAM sequence: TTC
ttcctttaactagctttaaa

SEQ ID NO: 167664 - DNA, 20 bp, Artificial Sequence
  Description of Artificial Sequence: Synthetic oligonucleotide
  Target: ATXN1; (-) strand; PAM type: YTN; PAM sequence: TTC
attcttcctttaactagctt

SEQ ID NO: 167665 - DNA, 20 bp, Artificial Sequence
  Description of Artificial Sequence: Synthetic oligonucleotide
  Target: ATXN1; (-) strand; PAM type: YTN; PAM sequence: CTT
cattcttcctttaactagct

SEQ ID NO: 167666 - DNA, 20 bp, Artificial Sequence
  Description of Artificial Sequence: Synthetic oligonucleotide
  Target: ATXN1; (-) strand; PAM type: YTN; PAM sequence: TTA
cttcattcttcctttaacta

SEQ ID NO: 167667 - DNA, 20 bp, Artificial Sequence
  Description of Artificial Sequence: Synthetic oligonucleotide
  Target: ATXN1; (-) strand; PAM type: YTN; PAM sequence: TTT
acttcattcttcctttaact

SEQ ID NO: 167668 - DNA, 20 bp, Artificial Sequence
  Description of Artificial Sequence: Synthetic oligonucleotide
  Target: ATXN1; (-) strand; PAM type: YTN; PAM sequence: CTT
tacttcattcttcctttaac

SEQ ID NO: 167669 - DNA, 20 bp, Artificial Sequence
  Description of Artificial Sequence: Synthetic oligonucleotide
  Target: ATXN1; (-) strand; PAM type: YTN; PAM sequence: CTG
gctttacttcattcttcctt

SEQ ID NO: 167670 - DNA, 20 bp, Artificial Sequence
  Description of Artificial Sequence: Synthetic oligonucleotide
  Target: ATXN1; (-) strand; PAM type: YTN; PAM sequence: TTC
tggctttacttcattcttcc

SEQ ID NO: 167671 - DNA, 20 bp, Artificial Sequence
  Description of Artificial Sequence: Synthetic oligonucleotide
  Target: ATXN1; (-) strand; PAM type: YTN; PAM sequence: TTT
ctggctttacttcattcttc

SEQ ID NO: 167672 - DNA, 20 bp, Artificial Sequence
  Description of Artificial Sequence: Synthetic oligonucleotide
  Target: ATXN1; (-) strand; PAM type: YTN; PAM sequence: TTT
tctggctttacttcattctt

SEQ ID NO: 167673 - DNA, 20 bp, Artificial Sequence
  Description of Artificial Sequence: Synthetic oligonucleotide
  Target: ATXN1; (-) strand; PAM type: YTN; PAM sequence: TTT
ttctggctttacttcattct

SEQ ID NO: 167674 - DNA, 20 bp, Artificial Sequence
  Description of Artificial Sequence: Synthetic oligonucleotide
  Target: ATXN1; (-) strand; PAM type: YTN; PAM sequence: TTA
aggtttttctggctttactt

SEQ ID NO: 167675 - DNA, 20 bp, Artificial Sequence
  Description of Artificial Sequence: Synthetic oligonucleotide
  Target: ATXN1; (-) strand; PAM type: YTN; PAM sequence: TTT
aaggtttttctggctttact

SEQ ID NO: 167676 - DNA, 20 bp, Artificial Sequence
  Description of Artificial Sequence: Synthetic oligonucleotide
  Target: ATXN1; (-) strand; PAM type: YTN; PAM sequence: CTG
tagtttaaggtttttctggc

SEQ ID NO: 167677 - DNA, 20 bp, Artificial Sequence
  Description of Artificial Sequence: Synthetic oligonucleotide
  Target: ATXN1; (-) strand; PAM type: YTN; PAM sequence: TTA
caaactgtagtttaaggttt

SEQ ID NO: 167678 - DNA, 20 bp, Artificial Sequence
  Description of Artificial Sequence: Synthetic oligonucleotide
  Target: ATXN1; (-) strand; PAM type: YTN; PAM sequence: TTA
gttacaaactgtagtttaag

SEQ ID NO: 167679 - DNA, 20 bp, Artificial Sequence
  Description of Artificial Sequence: Synthetic oligonucleotide
  Target: ATXN1; (-) strand; PAM type: YTN; PAM sequence: TTA
cagttagttacaaactgtag

SEQ ID NO: 167680 - DNA, 20 bp, Artificial Sequence
  Description of Artificial Sequence: Synthetic oligonucleotide
  Target: ATXN1; (-) strand; PAM type: YTN; PAM sequence: TTT
acagttagttacaaactgta

SEQ ID NO: 167681 - DNA, 20 bp, Artificial Sequence
  Description of Artificial Sequence: Synthetic oligonucleotide
  Target: ATXN1; (-) strand; PAM type: YTN; PAM sequence: TTT
tacagttagttacaaactgt

SEQ ID NO: 167682 - DNA, 20 bp, Artificial Sequence
  Description of Artificial Sequence: Synthetic oligonucleotide
  Target: ATXN1; (-) strand; PAM type: YTN; PAM sequence: TTG
gattttacagttagttacaa

SEQ ID NO: 167683 - DNA, 20 bp, Artificial Sequence
  Description of Artificial Sequence: Synthetic oligonucleotide
  Target: ATXN1; (-) strand; PAM type: YTN; PAM sequence: TTT
ggattttacagttagttaca

SEQ ID NO: 167684 - DNA, 20 bp, Artificial Sequence
  Description of Artificial Sequence: Synthetic oligonucleotide
  Target: ATXN1; (-) strand; PAM type: YTN; PAM sequence: TTT
tggattttacagttagttac

SEQ ID NO: 167685 - DNA, 20 bp, Artificial Sequence
  Description of Artificial Sequence: Synthetic oligonucleotide
  Target: ATXN1; (-) strand; PAM type: YTN; PAM sequence: CTT
ttggattttacagttagtta

SEQ ID NO: 167686 - DNA, 20 bp, Artificial Sequence
  Description of Artificial Sequence: Synthetic oligonucleotide
  Target: ATXN1; (-) strand; PAM type: YTN; PAM sequence: TTG
ccaagtgcttttggatttta

SEQ ID NO: 167687 - DNA, 20 bp, Artificial Sequence
  Description of Artificial Sequence: Synthetic oligonucleotide
  Target: ATXN1; (-) strand; PAM type: YTN; PAM sequence: TTT
gccaagtgcttttggatttt

SEQ ID NO: 167688 - DNA, 20 bp, Artificial Sequence
  Description of Artificial Sequence: Synthetic oligonucleotide
  Target: ATXN1; (-) strand; PAM type: YTN; PAM sequence: TTA
ccatttgccaagtgcttttg

SEQ ID NO: 167689 - DNA, 20 bp, Artificial Sequence
  Description of Artificial Sequence: Synthetic oligonucleotide
  Target: ATXN1; (-) strand; PAM type: YTN; PAM sequence: CTT
accatttgccaagtgctttt

SEQ ID NO: 167690 - DNA, 20 bp, Artificial Sequence
  Description of Artificial Sequence: Synthetic oligonucleotide
  Target: ATXN1; (-) strand; PAM type: YTN; PAM sequence: TTC
cttaccatttgccaagtgct

SEQ ID NO: 167691 - DNA, 20 bp, Artificial Sequence
  Description of Artificial Sequence: Synthetic oligonucleotide
  Target: ATXN1; (-) strand; PAM type: YTN; PAM sequence: TTA
tgtgtccaaattccttacca

SEQ ID NO: 167692 - DNA, 20 bp, Artificial Sequence
  Description of Artificial Sequence: Synthetic oligonucleotide
  Target: ATXN1; (-) strand; PAM type: YTN; PAM sequence: TTT
atgtgtccaaattccttacc

SEQ ID NO: 167693 - DNA, 20 bp, Artificial Sequence
  Description of Artificial Sequence: Synthetic oligonucleotide
  Target: ATXN1; (-) strand; PAM type: YTN; PAM sequence: TTA
atttatgtgtccaaattcct

SEQ ID NO: 167694 - DNA, 20 bp, Artificial Sequence
  Description of Artificial Sequence: Synthetic oligonucleotide
  Target: ATXN1; (-) strand; PAM type: YTN; PAM sequence: CTC
cattaatttatgtgtccaaa

SEQ ID NO: 167695 - DNA, 20 bp, Artificial Sequence
  Description of Artificial Sequence: Synthetic oligonucleotide
  Target: ATXN1; (-) strand; PAM type: YTN; PAM sequence: TTA
gctccattaatttatgtgtc

SEQ ID NO: 167696 - DNA, 20 bp, Artificial Sequence
  Description of Artificial Sequence: Synthetic oligonucleotide
  Target: ATXN1; (-) strand; PAM type: YTN; PAM sequence: TTT
agctccattaatttatgtgt

SEQ ID NO: 167697 - DNA, 20 bp, Artificial Sequence
  Description of Artificial Sequence: Synthetic oligonucleotide
  Target: ATXN1; (-) strand; PAM type: YTN; PAM sequence: TTA
atatttagctccattaattt

SEQ ID NO: 167698 - DNA, 20 bp, Artificial Sequence
  Description of Artificial Sequence: Synthetic oligonucleotide
  Target: ATXN1; (-) strand; PAM type: YTN; PAM sequence: CTG
attaatatttagctccatta

SEQ ID NO: 167699 - DNA, 20 bp, Artificial Sequence
  Description of Artificial Sequence: Synthetic oligonucleotide
  Target: ATXN1; (-) strand; PAM type: YTN; PAM sequence: CTC
actgattaatatttagctcc

SEQ ID NO: 167700 - DNA, 20 bp, Artificial Sequence
  Description of Artificial Sequence: Synthetic oligonucleotide
  Target: ATXN1; (-) strand; PAM type: YTN; PAM sequence: TTG
ctcactgattaatatttagc

SEQ ID NO: 167701 - DNA, 20 bp, Artificial Sequence
  Description of Artificial Sequence: Synthetic oligonucleotide
  Target: ATXN1; (-) strand; PAM type: YTN; PAM sequence: TTT
gctcactgattaatatttag

SEQ ID NO: 167702 - DNA, 20 bp, Artificial Sequence
  Description of Artificial Sequence: Synthetic oligonucleotide
  Target: ATXN1; (-) strand; PAM type: YTN; PAM sequence: TTA
atatttgctcactgattaat

SEQ ID NO: 167703 - DNA, 20 bp, Artificial Sequence
  Description of Artificial Sequence: Synthetic oligonucleotide
  Target: ATXN1; (-) strand; PAM type: YTN; PAM sequence: CTC
aattaatatttgctcactga

SEQ ID NO: 167704 - DNA, 20 bp, Artificial Sequence
  Description of Artificial Sequence: Synthetic oligonucleotide
  Target: ATXN1; (-) strand; PAM type: YTN; PAM sequence: TTA
agactcaattaatatttgct

SEQ ID NO: 167705 - DNA, 20 bp, Artificial Sequence
  Description of Artificial Sequence: Synthetic oligonucleotide
  Target: ATXN1; (-) strand; PAM type: YTN; PAM sequence: TTT
aagactcaattaatatttgc

SEQ ID NO: 167706 - DNA, 20 bp, Artificial Sequence
  Description of Artificial Sequence: Synthetic oligonucleotide
  Target: ATXN1; (-) strand; PAM type: YTN; PAM sequence: CTT
taagactcaattaatatttg

SEQ ID NO: 167707 - DNA, 20 bp, Artificial Sequence
  Description of Artificial Sequence: Synthetic oligonucleotide
  Target: ATXN1; (-) strand; PAM type: YTN; PAM sequence: CTC
tttaagactcaattaatatt

SEQ ID NO: 167708 - DNA, 20 bp, Artificial Sequence
  Description of Artificial Sequence: Synthetic oligonucleotide
  Target: ATXN1; (-) strand; PAM type: YTN; PAM sequence: TTC
agctctttaagactcaatta

SEQ ID NO: 167709 - DNA, 20 bp, Artificial Sequence
  Description of Artificial Sequence: Synthetic oligonucleotide
  Target: ATXN1; (-) strand; PAM type: YTN; PAM sequence: TTT
cagctctttaagactcaatt

SEQ ID NO: 167710 - DNA, 20 bp, Artificial Sequence
  Description of Artificial Sequence: Synthetic oligonucleotide
  Target: ATXN1; (-) strand; PAM type: YTN; PAM sequence: CTA
gaataatttcagctctttaa

SEQ ID NO: 167711 - DNA, 20 bp, Artificial Sequence
  Description of Artificial Sequence: Synthetic oligonucleotide
  Target: ATXN1; (-) strand; PAM type: YTN; PAM sequence: CTC
ctagaataatttcagctctt

SEQ ID NO: 167712 - DNA, 20 bp, Artificial Sequence
  Description of Artificial Sequence: Synthetic oligonucleotide
  Target: ATXN1; (-) strand; PAM type: YTN; PAM sequence: TTA
gccaccacgacatcccaggc

SEQ ID NO: 167713 - DNA, 20 bp, Artificial Sequence
  Description of Artificial Sequence: Synthetic oligonucleotide
  Target: ATXN1; (-) strand; PAM type: YTN; PAM sequence: CTT
agccaccacgacatcccagg

SEQ ID NO: 167714 - DNA, 20 bp, Artificial Sequence
  Description of Artificial Sequence: Synthetic oligonucleotide
  Target: ATXN1; (-) strand; PAM type: YTN; PAM sequence: CTC
catcttagccaccacgacat

SEQ ID NO: 167715 - DNA, 20 bp, Artificial Sequence
  Description of Artificial Sequence: Synthetic oligonucleotide
  Target: ATXN1; (-) strand; PAM type: YTN; PAM sequence: CTC
ccaatagtagggactccatc

SEQ ID NO: 167716 - DNA, 20 bp, Artificial Sequence
  Description of Artificial Sequence: Synthetic oligonucleotide
  Target: ATXN1; (-) strand; PAM type: YTN; PAM sequence: CTA
tgctcccaatagtagggact

SEQ ID NO: 167717 - DNA, 20 bp, Artificial Sequence
  Description of Artificial Sequence: Synthetic oligonucleotide
  Target: ATXN1; (-) strand; PAM type: YTN; PAM sequence: CTC
tatgctcccaatagtaggga

SEQ ID NO: 167718 - DNA, 20 bp, Artificial Sequence
  Description of Artificial Sequence: Synthetic oligonucleotide
  Target: ATXN1; (-) strand; PAM type: YTN; PAM sequence: CTG
acactctatgctcccaatag

SEQ ID NO: 167719 - DNA, 20 bp, Artificial Sequence
  Description of Artificial Sequence: Synthetic oligonucleotide
  Target: ATXN1; (-) strand; PAM type: YTN; PAM sequence: TTC
tgacactctatgctcccaat

SEQ ID NO: 167720 - DNA, 20 bp, Artificial Sequence
  Description of Artificial Sequence: Synthetic oligonucleotide
  Target: ATXN1; (-) strand; PAM type: YTN; PAM sequence: TTT
ctgacactctatgctcccaa

SEQ ID NO: 167721 - DNA, 20 bp, Artificial Sequence
  Description of Artificial Sequence: Synthetic oligonucleotide
  Target: ATXN1; (-) strand; PAM type: YTN; PAM sequence: TTA
atttctgacactctatgctc

SEQ ID NO: 167722 - DNA, 20 bp, Artificial Sequence
  Description of Artificial Sequence: Synthetic oligonucleotide
  Target: ATXN1; (-) strand; PAM type: YTN; PAM sequence: CTT
aatttctgacactctatgct

SEQ ID NO: 167723 - DNA, 20 bp, Artificial Sequence
  Description of Artificial Sequence: Synthetic oligonucleotide
  Target: ATXN1; (-) strand; PAM type: YTN; PAM sequence: CTC
ttaatttctgacactctatg

SEQ ID NO: 167724 - DNA, 20 bp, Artificial Sequence
  Description of Artificial Sequence: Synthetic oligonucleotide
  Target: ATXN1; (-) strand; PAM type: YTN; PAM sequence: TTC
tcttaatttctgacactcta

SEQ ID NO: 167725 - DNA, 20 bp, Artificial Sequence
  Description of Artificial Sequence: Synthetic oligonucleotide
  Target: ATXN1; (-) strand; PAM type: YTN; PAM sequence: TTG
cattctcttaatttctgaca

SEQ ID NO: 167726 - DNA, 20 bp, Artificial Sequence
  Description of Artificial Sequence: Synthetic oligonucleotide
  Target: ATXN1; (-) strand; PAM type: YTN; PAM sequence: TTA
ttgcattctcttaatttctg

SEQ ID NO: 167727 - DNA, 20 bp, Artificial Sequence
  Description of Artificial Sequence: Synthetic oligonucleotide
  Target: ATXN1; (-) strand; PAM type: YTN; PAM sequence: TTT
attgcattctcttaatttct

SEQ ID NO: 167728 - DNA, 20 bp, Artificial Sequence
  Description of Artificial Sequence: Synthetic oligonucleotide
  Target: ATXN1; (-) strand; PAM type: YTN; PAM sequence: CTG
gaatttattgcattctctta

SEQ ID NO: 167729 - DNA, 20 bp, Artificial Sequence
  Description of Artificial Sequence: Synthetic oligonucleotide
  Target: ATXN1; (-) strand; PAM type: YTN; PAM sequence: CTA
ctggaatttattgcattctc

SEQ ID NO: 167730 - DNA, 20 bp, Artificial Sequence
  Description of Artificial Sequence: Synthetic oligonucleotide
  Target: ATXN1; (-) strand; PAM type: YTN; PAM sequence: CTC
tactggaatttattgcattc

SEQ ID NO: 167731 - DNA, 20 bp, Artificial Sequence
  Description of Artificial Sequence: Synthetic oligonucleotide
  Target: ATXN1; (-) strand; PAM type: YTN; PAM sequence: TTG
agcccatctctactggaatt

SEQ ID NO: 167732 - DNA, 20 bp, Artificial Sequence
  Description of Artificial Sequence: Synthetic oligonucleotide
  Target: ATXN1; (-) strand; PAM type: YTN; PAM sequence: TTG
gtgtgaaagcaaattgagcc

SEQ ID NO: 167733 - DNA, 20 bp, Artificial Sequence
  Description of Artificial Sequence: Synthetic oligonucleotide
  Target: ATXN1; (-) strand; PAM type: YTN; PAM sequence: CTA
gttggtgtgaaagcaaattg

SEQ ID NO: 167734 - DNA, 20 bp, Artificial Sequence
  Description of Artificial Sequence: Synthetic oligonucleotide
  Target: ATXN1; (-) strand; PAM type: YTN; PAM sequence: TTC
tagttggtgtgaaagcaaat

SEQ ID NO: 167735 - DNA, 20 bp, Artificial Sequence
  Description of Artificial Sequence: Synthetic oligonucleotide
  Target: ATXN1; (-) strand; PAM type: YTN; PAM sequence: TTC
acaccattctagttggtgtg

SEQ ID NO: 167736 - DNA, 20 bp, Artificial Sequence
  Description of Artificial Sequence: Synthetic oligonucleotide
  Target: ATXN1; (-) strand; PAM type: YTN; PAM sequence: TTT
cacaccattctagttggtgt

SEQ ID NO: 167737 - DNA, 20 bp, Artificial Sequence
  Description of Artificial Sequence: Synthetic oligonucleotide
  Target: ATXN1; (-) strand; PAM type: YTN; PAM sequence: CTT
tcacaccattctagttggtg

SEQ ID NO: 167738 - DNA, 20 bp, Artificial Sequence
  Description of Artificial Sequence: Synthetic oligonucleotide
  Target: ATXN1; (-) strand; PAM type: YTN; PAM sequence: TTC
tttcacaccattctagttgg

SEQ ID NO: 167739 - DNA, 20 bp, Artificial Sequence
  Description of Artificial Sequence: Synthetic oligonucleotide
  Target: ATXN1; (-) strand; PAM type: YTN; PAM sequence: TTG
caaaccattctttcacacca

SEQ ID NO: 167740 - DNA, 20 bp, Artificial Sequence
  Description of Artificial Sequence: Synthetic oligonucleotide
  Target: ATXN1; (-) strand; PAM type: YTN; PAM sequence: TTT
gcaaaccattctttcacacc

SEQ ID NO: 167741 - DNA, 20 bp, Artificial Sequence
  Description of Artificial Sequence: Synthetic oligonucleotide
  Target: ATXN1; (-) strand; PAM type: YTN; PAM sequence: CTT
tgcaaaccattctttcacac

SEQ ID NO: 167742 - DNA, 20 bp, Artificial Sequence
  Description of Artificial Sequence: Synthetic oligonucleotide
  Target: ATXN1; (-) strand; PAM type: YTN; PAM sequence: TTG
ctttgcaaaccattctttca

SEQ ID NO: 167743 - DNA, 20 bp, Artificial Sequence
  Description of Artificial Sequence: Synthetic oligonucleotide
  Target: ATXN1; (-) strand; PAM type: YTN; PAM sequence: TTT
gctttgcaaaccattctttc

SEQ ID NO: 167744 - DNA, 20 bp, Artificial Sequence
  Description of Artificial Sequence: Synthetic oligonucleotide
  Target: ATXN1; (-) strand; PAM type: YTN; PAM sequence: TTC
atttgctttgcaaaccattc

SEQ ID NO: 167745 - DNA, 20 bp, Artificial Sequence
  Description of Artificial Sequence: Synthetic oligonucleotide
  Target: ATXN1; (-) strand; PAM type: YTN; PAM sequence: TTA
gacgatggtatgcatcattc

SEQ ID NO: 167746 - DNA, 20 bp, Artificial Sequence
  Description of Artificial Sequence: Synthetic oligonucleotide
  Target: ATXN1; (-) strand; PAM type: YTN; PAM sequence: CTT
agacgatggtatgcatcatt

SEQ ID NO: 167747 - DNA, 20 bp, Artificial Sequence
  Description of Artificial Sequence: Synthetic oligonucleotide
  Target: ATXN1; (-) strand; PAM type: YTN; PAM sequence: TTC
ttagacgatggtatgcatca

SEQ ID NO: 167748 - DNA, 20 bp, Artificial Sequence
  Description of Artificial Sequence: Synthetic oligonucleotide
  Target: ATXN1; (-) strand; PAM type: YTN; PAM sequence: CTA
ttcttagacgatggtatgca

SEQ ID NO: 167749 - DNA, 20 bp, Artificial Sequence
  Description of Artificial Sequence: Synthetic oligonucleotide
  Target: ATXN1; (-) strand; PAM type: YTN; PAM sequence: TTA
agtgctattcttagacgatg

SEQ ID NO: 167750 - DNA, 20 bp, Artificial Sequence
  Description of Artificial Sequence: Synthetic oligonucleotide
  Target: ATXN1; (-) strand; PAM type: YTN; PAM sequence: TTG
taagtaaattaagtgctatt

SEQ ID NO: 167751 - DNA, 20 bp, Artificial Sequence
  Description of Artificial Sequence: Synthetic oligonucleotide
  Target: ATXN1; (-) strand; PAM type: YTN; PAM sequence: CTT
gtaagtaaattaagtgctat

SEQ ID NO: 167752 - DNA, 20 bp, Artificial Sequence
  Description of Artificial Sequence: Synthetic oligonucleotide
  Target: ATXN1; (-) strand; PAM type: YTN; PAM sequence: TTC
ttgtaagtaaattaagtgct

SEQ ID NO: 167753 - DNA, 20 bp, Artificial Sequence
  Description of Artificial Sequence: Synthetic oligonucleotide
  Target: ATXN1; (-) strand; PAM type: YTN; PAM sequence: CTT
cttgtaagtaaattaagtgc

SEQ ID NO: 167754 - DNA, 20 bp, Artificial Sequence
  Description of Artificial Sequence: Synthetic oligonucleotide
  Target: ATXN1; (-) strand; PAM type: YTN; PAM sequence: TTC
cttcttgtaagtaaattaag

SEQ ID NO: 167755 - DNA, 20 bp, Artificial Sequence
  Description of Artificial Sequence: Synthetic oligonucleotide
  Target: ATXN1; (-) strand; PAM type: YTN; PAM sequence: TTA
aaacagttccttcttgtaag

SEQ ID NO: 167756 - DNA, 20 bp, Artificial Sequence
  Description of Artificial Sequence: Synthetic oligonucleotide
  Target: ATXN1; (-) strand; PAM type: YTN; PAM sequence: TTA
aaccaattaaaacagttcct

SEQ ID NO: 167757 - DNA, 20 bp, Artificial Sequence
  Description of Artificial Sequence: Synthetic oligonucleotide
  Target: ATXN1; (-) strand; PAM type: YTN; PAM sequence: TTT
aaaccaattaaaacagttcc

SEQ ID NO: 167758 - DNA, 20 bp, Artificial Sequence
  Description of Artificial Sequence: Synthetic oligonucleotide
  Target: ATXN1; (-) strand; PAM type: YTN; PAM sequence: TTT
taaaccaattaaaacagttc

SEQ ID NO: 167759 - DNA, 20 bp, Artificial Sequence
  Description of Artificial Sequence: Synthetic oligonucleotide
  Target: ATXN1; (-) strand; PAM type: YTN; PAM sequence: TTT
ttaaaccaattaaaacagtt

SEQ ID NO: 167760 - DNA, 20 bp, Artificial Sequence
  Description of Artificial Sequence: Synthetic oligonucleotide
  Target: ATXN1; (-) strand; PAM type: YTN; PAM sequence: TTG
tgtgtagtgagtatttttaa

SEQ ID NO: 167761 - DNA, 20 bp, Artificial Sequence
  Description of Artificial Sequence: Synthetic oligonucleotide
  Target: ATXN1; (-) strand; PAM type: YTN; PAM sequence: TTT
gtgtgtagtgagtattttta

SEQ ID NO: 167762 - DNA, 20 bp, Artificial Sequence
  Description of Artificial Sequence: Synthetic oligonucleotide
  Target: ATXN1; (-) strand; PAM type: YTN; PAM sequence: TTA
acaaaatatttgtgtgtagt

SEQ ID NO: 167763 - DNA, 20 bp, Artificial Sequence
  Description of Artificial Sequence: Synthetic oligonucleotide
  Target: ATXN1; (-) strand; PAM type: YTN; PAM sequence: TTA
attaacaaaatatttgtgtg

SEQ ID NO: 167764 - DNA, 20 bp, Artificial Sequence
  Description of Artificial Sequence: Synthetic oligonucleotide
  Target: ATXN1; (-) strand; PAM type: YTN; PAM sequence: TTT
aattaacaaaatatttgtgt

SEQ ID NO: 167765 - DNA, 20 bp, Artificial Sequence
  Description of Artificial Sequence: Synthetic oligonucleotide
  Target: ATXN1; (-) strand; PAM type: YTN; PAM sequence: TTT
taattaacaaaatatttgtg

SEQ ID NO: 167766 - DNA, 20 bp, Artificial Sequence
  Description of Artificial Sequence: Synthetic oligonucleotide
  Target: ATXN1; (-) strand; PAM type: YTN; PAM sequence: TTT
ttaattaacaaaatatttgt

SEQ ID NO: 167767 - DNA, 20 bp, Artificial Sequence
  Description of Artificial Sequence: Synthetic oligonucleotide
  Target: ATXN1; (-) strand; PAM type: YTN; PAM sequence: CTC
atttttaattaacaaaatat

SEQ ID NO: 167768 - DNA, 20 bp, Artificial Sequence
  Description of Artificial Sequence: Synthetic oligonucleotide
  Target: ATXN1; (-) strand; PAM type: YTN; PAM sequence: TTC
aaataggtactcatttttaa

SEQ ID NO: 167769 - DNA, 20 bp, Artificial Sequence
  Description of Artificial Sequence: Synthetic oligonucleotide
  Target: ATXN1; (-) strand; PAM type: YTN; PAM sequence: TTC
acataagtgttcaaataggt

SEQ ID NO: 167770 - DNA, 20 bp, Artificial Sequence
  Description of Artificial Sequence: Synthetic oligonucleotide
  Target: ATXN1; (-) strand; PAM type: YTN; PAM sequence: TTA
gttcacataagtgttcaaat

SEQ ID NO: 167771 - DNA, 20 bp, Artificial Sequence
  Description of Artificial Sequence: Synthetic oligonucleotide
  Target: ATXN1; (-) strand; PAM type: YTN; PAM sequence: TTT
agttcacataagtgttcaaa

SEQ ID NO: 167772 - DNA, 20 bp, Artificial Sequence
  Description of Artificial Sequence: Synthetic oligonucleotide
  Target: ATXN1; (-) strand; PAM type: YTN; PAM sequence: CTA
tttagttcacataagtgttc

SEQ ID NO: 167773 - DNA, 20 bp, Artificial Sequence
  Description of Artificial Sequence: Synthetic oligonucleotide
  Target: ATXN1; (-) strand; PAM type: YTN; PAM sequence: CTC
ctatttagttcacataagtg

SEQ ID NO: 167774 - DNA, 20 bp, Artificial Sequence
  Description of Artificial Sequence: Synthetic oligonucleotide
  Target: ATXN1; (-) strand; PAM type: YTN; PAM sequence: TTA
gctcctatttagttcacata

SEQ ID NO: 167775 - DNA, 20 bp, Artificial Sequence
  Description of Artificial Sequence: Synthetic oligonucleotide
  Target: ATXN1; (-) strand; PAM type: YTN; PAM sequence: CTC
atgtattagctcctatttag

SEQ ID NO: 167776 - DNA, 20 bp, Artificial Sequence
  Description of Artificial Sequence: Synthetic oligonucleotide
  Target: ATXN1; (-) strand; PAM type: YTN; PAM sequence: TTA
tctcatgtattagctcctat

SEQ ID NO: 167777 - DNA, 20 bp, Artificial Sequence
  Description of Artificial Sequence: Synthetic oligonucleotide
  Target: ATXN1; (-) strand; PAM type: YTN; PAM sequence: TTT
atctcatgtattagctccta

SEQ ID NO: 167778 - DNA, 20 bp, Artificial Sequence
  Description of Artificial Sequence: Synthetic oligonucleotide
  Target: ATXN1; (-) strand; PAM type: YTN; PAM sequence: TTT
tatctcatgtattagctcct

SEQ ID NO: 167779 - DNA, 20 bp, Artificial Sequence
  Description of Artificial Sequence: Synthetic oligonucleotide
  Target: ATXN1; (-) strand; PAM type: YTN; PAM sequence: TTT
ttatctcatgtattagctcc

SEQ ID NO: 167780 - DNA, 20 bp, Artificial Sequence
  Description of Artificial Sequence: Synthetic oligonucleotide
  Target: ATXN1; (-) strand; PAM type: YTN; PAM sequence: CTA
cataatttttatctcatgta

SEQ ID NO: 167781 - DNA, 20 bp, Artificial Sequence
  Description of Artificial Sequence: Synthetic oligonucleotide
  Target: ATXN1; (-) strand; PAM type: YTN; PAM sequence: TTG
taactacataatttttatct

SEQ ID NO: 167782 - DNA, 20 bp, Artificial Sequence
  Description of Artificial Sequence: Synthetic oligonucleotide
  Target: ATXN1; (-) strand; PAM type: YTN; PAM sequence: TTA
atgaaaagcaaaaaaaaaaa

SEQ ID NO: 167783 - DNA, 20 bp, Artificial Sequence
  Description of Artificial Sequence: Synthetic oligonucleotide
  Target: ATXN1; (-) strand; PAM type: YTN; PAM sequence: TTC
aattaatgaaaagcaaaaaa

SEQ ID NO: 167784 - DNA, 20 bp, Artificial Sequence
  Description of Artificial Sequence: Synthetic oligonucleotide
  Target: ATXN1; (-) strand; PAM type: YTN; PAM sequence: CTG
attcaattaatgaaaagcaa

SEQ ID NO: 167785 - DNA, 20 bp, Artificial Sequence
  Description of Artificial Sequence: Synthetic oligonucleotide
  Target: ATXN1; (-) strand; PAM type: YTN; PAM sequence: TTG
gagaaagtccagtctgattc

SEQ ID NO: 167786 - DNA, 20 bp, Artificial Sequence
  Description of Artificial Sequence: Synthetic oligonucleotide
  Target: ATXN1; (-) strand; PAM type: YTN; PAM sequence: CTT
ggagaaagtccagtctgatt

SEQ ID NO: 167787 - DNA, 20 bp, Artificial Sequence
  Description of Artificial Sequence: Synthetic oligonucleotide
  Target: ATXN1; (-) strand; PAM type: YTN; PAM sequence: TTC
acatgcttggagaaagtcca

SEQ ID NO: 167788 - DNA, 20 bp, Artificial Sequence
  Description of Artificial Sequence: Synthetic oligonucleotide
  Target: ATXN1; (-) strand; PAM type: YTN; PAM sequence: CTC
attcacatgcttggagaaag

SEQ ID NO: 167789 - DNA, 20 bp, Artificial Sequence
  Description of Artificial Sequence: Synthetic oligonucleotide
  Target: ATXN1; (-) strand; PAM type: YTN; PAM sequence: CTC
actcattcacatgcttggag

SEQ ID NO: 167790 - DNA, 20 bp, Artificial Sequence
  Description of Artificial Sequence: Synthetic oligonucleotide
  Target: ATXN1; (-) strand; PAM type: YTN; PAM sequence: TTG
catggtacaataaatcctca

SEQ ID NO: 167791 - DNA, 20 bp, Artificial Sequence
  Description of Artificial Sequence: Synthetic oligonucleotide
  Target: ATXN1; (-) strand; PAM type: YTN; PAM sequence: TTT
gcatggtacaataaatcctc

SEQ ID NO: 167792 - DNA, 20 bp, Artificial Sequence
  Description of Artificial Sequence: Synthetic oligonucleotide
  Target: ATXN1; (-) strand; PAM type: YTN; PAM sequence: TTT
tgcatggtacaataaatcct

SEQ ID NO: 167793 - DNA, 20 bp, Artificial Sequence
  Description of Artificial Sequence: Synthetic oligonucleotide
  Target: ATXN1; (-) strand; PAM type: YTN; PAM sequence: TTT
ttgcatggtacaataaatcc

SEQ ID NO: 167794 - DNA, 20 bp, Artificial Sequence
  Description of Artificial Sequence: Synthetic oligonucleotide
  Target: ATXN1; (-) strand; PAM type: YTN; PAM sequence: CTA
agtttttgcatggtacaata

SEQ ID NO: 167795 - DNA, 20 bp, Artificial Sequence
  Description of Artificial Sequence: Synthetic oligonucleotide
  Target: ATXN1; (-) strand; PAM type: YTN; PAM sequence: CTG
taaagatcctaagtttttgc

SEQ ID NO: 167796 - DNA, 20 bp, Artificial Sequence
  Description of Artificial Sequence: Synthetic oligonucleotide
  Target: ATXN1; (-) strand; PAM type: YTN; PAM sequence: TTA
aatacaaataataaaacctg

SEQ ID NO: 167797 - DNA, 20 bp, Artificial Sequence
  Description of Artificial Sequence: Synthetic oligonucleotide
  Target: ATXN1; (-) strand; PAM type: YTN; PAM sequence: CTA
gtgttaaatacaaataataa

SEQ ID NO: 167798 - DNA, 20 bp, Artificial Sequence
  Description of Artificial Sequence: Synthetic oligonucleotide
  Target: ATXN1; (-) strand; PAM type: YTN; PAM sequence: CTG
aaatggaactagtgttaaat

SEQ ID NO: 167799 - DNA, 20 bp, Artificial Sequence
  Description of Artificial Sequence: Synthetic oligonucleotide
  Target: ATXN1; (-) strand; PAM type: YTN; PAM sequence: CTG
accagctgaaatggaactag

SEQ ID NO: 167800 - DNA, 20 bp, Artificial Sequence
  Description of Artificial Sequence: Synthetic oligonucleotide
  Target: ATXN1; (-) strand; PAM type: YTN; PAM sequence: TTA
tctgaccagctgaaatggaa

SEQ ID NO: 167801 - DNA, 20 bp, Artificial Sequence
  Description of Artificial Sequence: Synthetic oligonucleotide
  Target: ATXN1; (-) strand; PAM type: YTN; PAM sequence: CTT
atctgaccagctgaaatgga

SEQ ID NO: 167802 - DNA, 20 bp, Artificial Sequence
  Description of Artificial Sequence: Synthetic oligonucleotide
  Target: ATXN1; (-) strand; PAM type: YTN; PAM sequence: TTC
ttatctgaccagctgaaatg

SEQ ID NO: 167803 - DNA, 20 bp, Artificial Sequence
  Description of Artificial Sequence: Synthetic oligonucleotide
  Target: ATXN1; (-) strand; PAM type: YTN; PAM sequence: CTT
cttatctgaccagctgaaat

SEQ ID NO: 167804 - DNA, 20 bp, Artificial Sequence
  Description of Artificial Sequence: Synthetic oligonucleotide
  Target: ATXN1; (-) strand; PAM type: YTN; PAM sequence: TTC
ttcttatctgaccagctgaa

SEQ ID NO: 167805 - DNA, 20 bp, Artificial Sequence
  Description of Artificial Sequence: Synthetic oligonucleotide
  Target: ATXN1; (-) strand; PAM type: YTN; PAM sequence: TTT
cttcttatctgaccagctga

SEQ ID NO: 167806 - DNA, 20 bp, Artificial Sequence
  Description of Artificial Sequence: Synthetic oligonucleotide
  Target: ATXN1; (-) strand; PAM type: YTN; PAM sequence: CTA
tcacatttcttcttatctga

SEQ ID NO: 167807 - DNA, 20 bp, Artificial Sequence
  Description of Artificial Sequence: Synthetic oligonucleotide
  Target: ATXN1; (-) strand; PAM type: YTN; PAM sequence: TTG
ctatcacatttcttcttatc

SEQ ID NO: 167808 - DNA, 20 bp, Artificial Sequence
  Description of Artificial Sequence: Synthetic oligonucleotide
  Target: ATXN1; (-) strand; PAM type: YTN; PAM sequence: TTT
gctatcacatttcttcttat

SEQ ID NO: 167809 - DNA, 20 bp, Artificial Sequence
  Description of Artificial Sequence: Synthetic oligonucleotide
  Target: ATXN1; (-) strand; PAM type: YTN; PAM sequence: TTT
tgctatcacatttcttctta

SEQ ID NO: 167810 - DNA, 20 bp, Artificial Sequence
  Description of Artificial Sequence: Synthetic oligonucleotide
  Target: ATXN1; (-) strand; PAM type: YTN; PAM sequence: CTT
ttgctatcacatttcttctt

SEQ ID NO: 167811 - DNA, 20 bp, Artificial Sequence
  Description of Artificial Sequence: Synthetic oligonucleotide
  Target: ATXN1; (-) strand; PAM type: YTN; PAM sequence: TTG
catatcttttgctatcacat

SEQ ID NO: 167812 - DNA, 20 bp, Artificial Sequence
  Description of Artificial Sequence: Synthetic oligonucleotide
  Target: ATXN1; (-) strand; PAM type: YTN; PAM sequence: CTT
gcatatcttttgctatcaca

SEQ ID NO: 167813 - DNA, 20 bp, Artificial Sequence
  Description of Artificial Sequence: Synthetic oligonucleotide
  Target: ATXN1; (-) strand; PAM type: YTN; PAM sequence: TTA
acatcttgcatatcttttgc

SEQ ID NO: 167814 - DNA, 20 bp, Artificial Sequence
  Description of Artificial Sequence: Synthetic oligonucleotide
  Target: ATXN1; (-) strand; PAM type: YTN; PAM sequence: TTA
agagcagattaacatcttgc

SEQ ID NO: 167815 - DNA, 20 bp, Artificial Sequence
  Description of Artificial Sequence: Synthetic oligonucleotide
  Target: ATXN1; (-) strand; PAM type: YTN; PAM sequence: TTT
aagagcagattaacatcttg

SEQ ID NO: 167816 - DNA, 20 bp, Artificial Sequence
  Description of Artificial Sequence: Synthetic oligonucleotide
  Target: ATXN1; (-) strand; PAM type: YTN; PAM sequence: TTT
taagagcagattaacatctt

SEQ ID NO: 167817 - DNA, 20 bp, Artificial Sequence
  Description of Artificial Sequence: Synthetic oligonucleotide
  Target: ATXN1; (-) strand; PAM type: YTN; PAM sequence: TTT
ttaagagcagattaacatct

SEQ ID NO: 167818 - DNA, 20 bp, Artificial Sequence
  Description of Artificial Sequence: Synthetic oligonucleotide
  Target: ATXN1; (-) strand; PAM type: YTN; PAM sequence: TTT
tttaagagcagattaacatc

SEQ ID NO: 167819 - DNA, 20 bp, Artificial Sequence
  Description of Artificial Sequence: Synthetic oligonucleotide
  Target: ATXN1; (-) strand; PAM type: YTN; PAM sequence: TTT
ttttaagagcagattaacat

SEQ ID NO: 167820 - DNA, 20 bp, Artificial Sequence
  Description of Artificial Sequence: Synthetic oligonucleotide
  Target: ATXN1; (-) strand; PAM type: YTN; PAM sequence: TTT
tttttaagagcagattaaca

SEQ ID NO: 167821 - DNA, 20 bp, Artificial Sequence
  Description of Artificial Sequence: Synthetic oligonucleotide
  Target: ATXN1; (-) strand; PAM type: YTN; PAM sequence: CTT
ttttttaagagcagattaac

SEQ ID NO: 167822 - DNA, 20 bp, Artificial Sequence
  Description of Artificial Sequence: Synthetic oligonucleotide
  Target: ATXN1; (-) strand; PAM type: YTN; PAM sequence: TTC
ttttttttaagagcagatta

SEQ ID NO: 167823 - DNA, 20 bp, Artificial Sequence
  Description of Artificial Sequence: Synthetic oligonucleotide
  Target: ATXN1; (-) strand; PAM type: YTN; PAM sequence: TTT
cttttttttaagagcagatt

SEQ ID NO: 167824 - DNA, 20 bp, Artificial Sequence
  Description of Artificial Sequence: Synthetic oligonucleotide
  Target: ATXN1; (-) strand; PAM type: YTN; PAM sequence: TTG
gtttcttttttttaagagca

SEQ ID NO: 167825 - DNA, 20 bp, Artificial Sequence
  Description of Artificial Sequence: Synthetic oligonucleotide
  Target: ATXN1; (-) strand; PAM type: YTN; PAM sequence: TTC
aggtcaaatattggtttctt

SEQ ID NO: 167826 - DNA, 20 bp, Artificial Sequence
  Description of Artificial Sequence: Synthetic oligonucleotide
  Target: ATXN1; (-) strand; PAM type: YTN; PAM sequence: TTG
tatcaattcaggtcaaatat

SEQ ID NO: 167827 - DNA, 20 bp, Artificial Sequence
  Description of Artificial Sequence: Synthetic oligonucleotide
  Target: ATXN1; (-) strand; PAM type: YTN; PAM sequence: CTT
gtatcaattcaggtcaaata

SEQ ID NO: 167828 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaagaaaacacttgt

SEQ ID NO: 167829 - DNA, 20 bp, Artificial Sequence
  Description of Artificial Sequence: Synthetic oligonucleotide
  Target: ATXN1; (-) strand; PAM type: YTN; PAM sequence: CTC
ggctcaaaaaaaagaaaaca

SEQ ID NO: 167830 - DNA, 20 bp, Artificial Sequence
  Description of Artificial Sequence: Synthetic oligonucleotide
  Target: ATXN1; (-) strand; PAM type: YTN; PAM sequence: CTG
tctcggctcaaaaaaaagaa

SEQ ID NO: 167831 - DNA, 20 bp, Artificial Sequence
  Description of Artificial Sequence: Synthetic oligonucleotide
  Target: ATXN1; (-) strand; PAM type: YTN; PAM sequence: CTA
gatgcaacagagcaagaccc

SEQ ID NO: 167832 - DNA, 20 bp, Artificial Sequence
  Description of Artificial Sequence: Synthetic oligonucleotide
  Target: ATXN1; (-) strand; PAM type: YTN; PAM sequence: CTC
tagatgcaacagagcaagac

SEQ ID NO: 167833 - DNA, 20 bp, Artificial Sequence
  Description of Artificial Sequence: Synthetic oligonucleotide
  Target: ATXN1; (-) strand; PAM type: YTN; PAM sequence: CTG
cactctagatgcaacagagc

SEQ ID NO: 167834 - DNA, 20 bp, Artificial Sequence
  Description of Artificial Sequence: Synthetic oligonucleotide
  Target: ATXN1; (-) strand; PAM type: YTN; PAM sequence: TTG
caccactgcactctagatgc

SEQ ID NO: 167835 - DNA, 20 bp, Artificial Sequence
  Description of Artificial Sequence: Synthetic oligonucleotide
  Target: ATXN1; (-) strand; PAM type: YTN; PAM sequence: CTA
tgattgcaccactgcactct

SEQ ID NO: 167836 - DNA, 20 bp, Artificial Sequence
  Description of Artificial Sequence: Synthetic oligonucleotide
  Target: ATXN1; (-) strand; PAM type: YTN; PAM sequence: CTG
cagtgagctatgattgcacc

SEQ ID NO: 167837 - DNA, 20 bp, Artificial Sequence
  Description of Artificial Sequence: Synthetic oligonucleotide
  Target: ATXN1; (-) strand; PAM type: YTN; PAM sequence: TTG
agactgcagtgagctatgat

SEQ ID NO: 167838 - DNA, 20 bp, Artificial Sequence
  Description of Artificial Sequence: Synthetic oligonucleotide
  Target: ATXN1; (-) strand; PAM type: YTN; PAM sequence: TTT
gagactgcagtgagctatga

SEQ ID NO: 167839 - DNA, 20 bp, Artificial Sequence
  Description of Artificial Sequence: Synthetic oligonucleotide
  Target: ATXN1; (-) strand; PAM type: YTN; PAM sequence: TTG
agccagcagtttgagactgc

SEQ ID NO: 167840 - DNA, 20 bp, Artificial Sequence
  Description of Artificial Sequence: Synthetic oligonucleotide
  Target: ATXN1; (-) strand; PAM type: YTN; PAM sequence: CTT
gagccagcagtttgagactg

SEQ ID NO: 167841 - DNA, 20 bp, Artificial Sequence
  Description of Artificial Sequence: Synthetic oligonucleotide
  Target: ATXN1; (-) strand; PAM type: YTN; PAM sequence: CTG
agatgggaggatcacttgag

SEQ ID NO: 167842 - DNA, 20 bp, Artificial Sequence
  Description of Artificial Sequence: Synthetic oligonucleotide
  Target: ATXN1; (-) strand; PAM type: YTN; PAM sequence: CTC
aggaagctgagatgggagga

SEQ ID NO: 167843 - DNA, 20 bp, Artificial Sequence
  Description of Artificial Sequence: Synthetic oligonucleotide
  Target: ATXN1; (-) strand; PAM type: YTN; PAM sequence: CTA
ctcaggaagctgagatggga

SEQ ID NO: 167844 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctactcaggaa

SEQ ID NO: 167845 - DNA, 20 bp, Artificial Sequence
  Description of Artificial Sequence: Synthetic oligonucleotide
  Target: ATXN1; (-) strand; PAM type: YTN; PAM sequence: CTG
aaaaaaataaaaataaaaat

SEQ ID NO: 167846 - DNA, 20 bp, Artificial Sequence
  Description of Artificial Sequence: Synthetic oligonucleotide
  Target: ATXN1; (-) strand; PAM type: YTN; PAM sequence: CTA
ctgaaaaaaataaaaataaa

SEQ ID NO: 167847 - DNA, 20 bp, Artificial Sequence
  Description of Artificial Sequence: Synthetic oligonucleotide
  Target: ATXN1; (-) strand; PAM type: YTN; PAM sequence: CTC
tactgaaaaaaataaaaata

SEQ ID NO: 167848 - DNA, 20 bp, Artificial Sequence
  Description of Artificial Sequence: Synthetic oligonucleotide
  Target: ATXN1; (-) strand; PAM type: YTN; PAM sequence: CTA
ggtaccatagcaagacccaa

SEQ ID NO: 167849 - DNA, 20 bp, Artificial Sequence
  Description of Artificial Sequence: Synthetic oligonucleotide
  Target: ATXN1; (-) strand; PAM type: YTN; PAM sequence: TTG
agaccagcctaggtaccata

SEQ ID NO: 167850 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctaggtaccat

SEQ ID NO: 167851 - DNA, 20 bp, Artificial Sequence
  Description of Artificial Sequence: Synthetic oligonucleotide
  Target: ATXN1; (-) strand; PAM type: YTN; PAM sequence: TTT
tgagaccagcctaggtacca

SEQ ID NO: 167852 - DNA, 20 bp, Artificial Sequence
  Description of Artificial Sequence: Synthetic oligonucleotide
  Target: ATXN1; (-) strand; PAM type: YTN; PAM sequence: TTG
agcccaggattttgagacca

SEQ ID NO: 167853 - DNA, 20 bp, Artificial Sequence
  Description of Artificial Sequence: Synthetic oligonucleotide
  Target: ATXN1; (-) strand; PAM type: YTN; PAM sequence: CTT
gagcccaggattttgagacc

SEQ ID NO: 167854 - DNA, 20 bp, Artificial Sequence
  Description of Artificial Sequence: Synthetic oligonucleotide
  Target: ATXN1; (-) strand; PAM type: YTN; PAM sequence: CTA
aggcaggaggatcacttgag

SEQ ID NO: 167855 - DNA, 20 bp, Artificial Sequence
  Description of Artificial Sequence: Synthetic oligonucleotide
  Target: ATXN1; (-) strand; PAM type: YTN; PAM sequence: TTG
ggaggctaaggcaggaggat

SEQ ID NO: 167856 - DNA, 20 bp, Artificial Sequence
  Description of Artificial Sequence: Synthetic oligonucleotide
  Target: ATXN1; (-) strand; PAM type: YTN; PAM sequence: TTT
gggaggctaaggcaggagga

SEQ ID NO: 167857 - DNA, 20 bp, Artificial Sequence
  Description of Artificial Sequence: Synthetic oligonucleotide
  Target: ATXN1; (-) strand; PAM type: YTN; PAM sequence: CTT
tgggaggctaaggcaggagg

SEQ ID NO: 167858 - DNA, 20 bp, Artificial Sequence
  Description of Artificial Sequence: Synthetic oligonucleotide
  Target: ATXN1; (-) strand; PAM type: YTN; PAM sequence: TTC
cagcactttgggaggctaag

SEQ ID NO: 167859 - DNA, 20 bp, Artificial Sequence
  Description of Artificial Sequence: Synthetic oligonucleotide
  Target: ATXN1; (-) strand; PAM type: YTN; PAM sequence: CTG
taattccagcactttgggag

SEQ ID NO: 167860 - DNA, 20 bp, Artificial Sequence
  Description of Artificial Sequence: Synthetic oligonucleotide
  Target: ATXN1; (-) strand; PAM type: YTN; PAM sequence: CTC
atgcctgtaattccagcact

SEQ ID NO: 167861 - DNA, 20 bp, Artificial Sequence
  Description of Artificial Sequence: Synthetic oligonucleotide
  Target: ATXN1; (-) strand; PAM type: YTN; PAM sequence: CTG
ggcatggtggctcatgcctg

SEQ ID NO: 167862 - DNA, 20 bp, Artificial Sequence
  Description of Artificial Sequence: Synthetic oligonucleotide
  Target: ATXN1; (-) strand; PAM type: YTN; PAM sequence: CTG
tatgggctgggcatggtggc

SEQ ID NO: 167863 - DNA, 20 bp, Artificial Sequence
  Description of Artificial Sequence: Synthetic oligonucleotide
  Target: ATXN1; (-) strand; PAM type: YTN; PAM sequence: TTA
aaacacctgtatgggctggg

SEQ ID NO: 167864 - DNA, 20 bp, Artificial Sequence
  Description of Artificial Sequence: Synthetic oligonucleotide
  Target: ATXN1; (-) strand; PAM type: YTN; PAM sequence: TTA
aaccaaattaaaacacctgt

SEQ ID NO: 167865 - DNA, 20 bp, Artificial Sequence
  Description of Artificial Sequence: Synthetic oligonucleotide
  Target: ATXN1; (-) strand; PAM type: YTN; PAM sequence: TTG
ggattaaaccaaattaaaac

SEQ ID NO: 167866 - DNA, 20 bp, Artificial Sequence
  Description of Artificial Sequence: Synthetic oligonucleotide
  Target: ATXN1; (-) strand; PAM type: YTN; PAM sequence: TTT
gggattaaaccaaattaaaa

SEQ ID NO: 167867 - DNA, 20 bp, Artificial Sequence
  Description of Artificial Sequence: Synthetic oligonucleotide
  Target: ATXN1; (-) strand; PAM type: YTN; PAM sequence: CTG
tagacatttgggattaaacc

SEQ ID NO: 167868 - DNA, 20 bp, Artificial Sequence
  Description of Artificial Sequence: Synthetic oligonucleotide
  Target: ATXN1; (-) strand; PAM type: YTN; PAM sequence: CTC
tgtagacatttgggattaaa

SEQ ID NO: 167869 - DNA, 20 bp, Artificial Sequence
  Description of Artificial Sequence: Synthetic oligonucleotide
  Target: ATXN1; (-) strand; PAM type: YTN; PAM sequence: CTG
tgacctctgtagacatttgg

SEQ ID NO: 167870 - DNA, 20 bp, Artificial Sequence
  Description of Artificial Sequence: Synthetic oligonucleotide
  Target: ATXN1; (-) strand; PAM type: YTN; PAM sequence: TTA
caataacacatgatccagta

SEQ ID NO: 167871 - DNA, 20 bp, Artificial Sequence
  Description of Artificial Sequence: Synthetic oligonucleotide
  Target: ATXN1; (-) strand; PAM type: YTN; PAM sequence: TTT
acaataacacatgatccagt

SEQ ID NO: 167872 - DNA, 20 bp, Artificial Sequence
  Description of Artificial Sequence: Synthetic oligonucleotide
  Target: ATXN1; (-) strand; PAM type: YTN; PAM sequence: TTT
tacaataacacatgatccag

SEQ ID NO: 167873 - DNA, 20 bp, Artificial Sequence
  Description of Artificial Sequence: Synthetic oligonucleotide
  Target: ATXN1; (-) strand; PAM type: YTN; PAM sequence: TTA
atcacacataaagaaatttt

SEQ ID NO: 167874 - DNA, 20 bp, Artificial Sequence
  Description of Artificial Sequence: Synthetic oligonucleotide
  Target: ATXN1; (-) strand; PAM type: YTN; PAM sequence: TTT
aatcacacataaagaaattt

SEQ ID NO: 167875 - DNA, 20 bp, Artificial Sequence
  Description of Artificial Sequence: Synthetic oligonucleotide
  Target: ATXN1; (-) strand; PAM type: YTN; PAM sequence: CTG
ggtttaatcacacataaaga

SEQ ID NO: 167876 - DNA, 20 bp, Artificial Sequence
  Description of Artificial Sequence: Synthetic oligonucleotide
  Target: ATXN1; (-) strand; PAM type: YTN; PAM sequence: TTG
ccctgggtttaatcacacat

SEQ ID NO: 167877 - DNA, 20 bp, Artificial Sequence
  Description of Artificial Sequence: Synthetic oligonucleotide
  Target: ATXN1; (-) strand; PAM type: YTN; PAM sequence: CTT
gccctgggtttaatcacaca

SEQ ID NO: 167878 - DNA, 20 bp, Artificial Sequence
  Description of Artificial Sequence: Synthetic oligonucleotide
  Target: ATXN1; (-) strand; PAM type: YTN; PAM sequence: CTG
gcttgccctgggtttaatca

SEQ ID NO: 167879 - DNA, 20 bp, Artificial Sequence
  Description of Artificial Sequence: Synthetic oligonucleotide
  Target: ATXN1; (-) strand; PAM type: YTN; PAM sequence: CTC
tggcttgccctgggtttaat

SEQ ID NO: 167880 - DNA, 20 bp, Artificial Sequence
  Description of Artificial Sequence: Synthetic oligonucleotide
  Target: ATXN1; (-) strand; PAM type: YTN; PAM sequence: TTG
actctggcttgccctgggtt

SEQ ID NO: 167881 - DNA, 20 bp, Artificial Sequence
  Description of Artificial Sequence: Synthetic oligonucleotide
  Target: ATXN1; (-) strand; PAM type: YTN; PAM sequence: TTA
ttgactctggcttgccctgg

SEQ ID NO: 167882 - DNA, 20 bp, Artificial Sequence
  Description of Artificial Sequence: Synthetic oligonucleotide
  Target: ATXN1; (-) strand; PAM type: YTN; PAM sequence: TTT
attgactctggcttgccctg

SEQ ID NO: 167883 - DNA, 20 bp, Artificial Sequence
  Description of Artificial Sequence: Synthetic oligonucleotide
  Target: ATXN1; (-) strand; PAM type: YTN; PAM sequence: CTG
atttattgactctggcttgc

SEQ ID NO: 167884 - DNA, 20 bp, Artificial Sequence
  Description of Artificial Sequence: Synthetic oligonucleotide
  Target: ATXN1; (-) strand; PAM type: YTN; PAM sequence: TTA
aaaatgtgtatcaacaatat

SEQ ID NO: 167885 - DNA, 20 bp, Artificial Sequence
  Description of Artificial Sequence: Synthetic oligonucleotide
  Target: ATXN1; (-) strand; PAM type: YTN; PAM sequence: TTT
aaaaatgtgtatcaacaata

SEQ ID NO: 167886 - DNA, 20 bp, Artificial Sequence
  Description of Artificial Sequence: Synthetic oligonucleotide
  Target: ATXN1; (-) strand; PAM type: YTN; PAM sequence: TTT
taaaaatgtgtatcaacaat

SEQ ID NO: 167887 - DNA, 20 bp, Artificial Sequence
  Description of Artificial Sequence: Synthetic oligonucleotide
  Target: ATXN1; (-) strand; PAM type: YTN; PAM sequence: CTA
aaaagcaattttaaaaatgt

SEQ ID NO: 167888 - DNA, 20 bp, Artificial Sequence
  Description of Artificial Sequence: Synthetic oligonucleotide
  Target: ATXN1; (-) strand; PAM type: YTN; PAM sequence: TTC
taaaaagcaattttaaaaat

SEQ ID NO: 167889 - DNA, 20 bp, Artificial Sequence
  Description of Artificial Sequence: Synthetic oligonucleotide
  Target: ATXN1; (-) strand; PAM type: YTN; PAM sequence: TTT
ctaaaaagcaattttaaaaa

SEQ ID NO: 167890 - DNA, 20 bp, Artificial Sequence
  Description of Artificial Sequence: Synthetic oligonucleotide
  Target: ATXN1; (-) strand; PAM type: YTN; PAM sequence: TTT
tctaaaaagcaattttaaaa

SEQ ID NO: 167891 - DNA, 20 bp, Artificial Sequence
  Description of Artificial Sequence: Synthetic oligonucleotide
  Target: ATXN1; (-) strand; PAM type: YTN; PAM sequence: TTG
attttctaaaaagcaatttt

SEQ ID NO: 167892 - DNA, 20 bp, Artificial Sequence
  Description of Artificial Sequence: Synthetic oligonucleotide
  Target: ATXN1; (-) strand; PAM type: YTN; PAM sequence: TTG
ttgattttctaaaaagcaat

SEQ ID NO: 167893 - DNA, 20 bp, Artificial Sequence
  Description of Artificial Sequence: Synthetic oligonucleotide
  Target: ATXN1; (-) strand; PAM type: YTN; PAM sequence: TTT
gttgattttctaaaaagcaa

SEQ ID NO: 167894 - DNA, 20 bp, Artificial Sequence
  Description of Artificial Sequence: Synthetic oligonucleotide
  Target: ATXN1; (-) strand; PAM type: YTN; PAM sequence: TTA
atttgttgattttctaaaaa

SEQ ID NO: 167895 - DNA, 20 bp, Artificial Sequence
  Description of Artificial Sequence: Synthetic oligonucleotide
  Target: ATXN1; (-) strand; PAM type: YTN; PAM sequence: CTT
aatttgttgattttctaaaa

SEQ ID NO: 167896 - DNA, 20 bp, Artificial Sequence
  Description of Artificial Sequence: Synthetic oligonucleotide
  Target: ATXN1; (-) strand; PAM type: YTN; PAM sequence: TTG
caaagtgccttaatttgttg

SEQ ID NO: 167897 - DNA, 20 bp, Artificial Sequence
  Description of Artificial Sequence: Synthetic oligonucleotide
  Target: ATXN1; (-) strand; PAM type: YTN; PAM sequence: TTT
gcaaagtgccttaatttgtt

SEQ ID NO: 167898 - DNA, 20 bp, Artificial Sequence
  Description of Artificial Sequence: Synthetic oligonucleotide
  Target: ATXN1; (-) strand; PAM type: YTN; PAM sequence: TTG
gatttgcaaagtgccttaat

SEQ ID NO: 167899 - DNA, 20 bp, Artificial Sequence
  Description of Artificial Sequence: Synthetic oligonucleotide
  Target: ATXN1; (-) strand; PAM type: YTN; PAM sequence: TTA
taaaagaaaaatagattgga

SEQ ID NO: 167900 - DNA, 20 bp, Artificial Sequence
  Description of Artificial Sequence: Synthetic oligonucleotide
  Target: ATXN1; (-) strand; PAM type: YTN; PAM sequence: TTT
ataaaagaaaaatagattgg

SEQ ID NO: 167901 - DNA, 20 bp, Artificial Sequence
  Description of Artificial Sequence: Synthetic oligonucleotide
  Target: ATXN1; (-) strand; PAM type: YTN; PAM sequence: TTT
tataaaagaaaaatagattg

SEQ ID NO: 167902 - DNA, 20 bp, Artificial Sequence
  Description of Artificial Sequence: Synthetic oligonucleotide
  Target: ATXN1; (-) strand; PAM type: YTN; PAM sequence: CTG
ttttataaaagaaaaataga

SEQ ID NO: 167903 - DNA, 20 bp, Artificial Sequence
  Description of Artificial Sequence: Synthetic oligonucleotide
  Target: ATXN1; (-) strand; PAM type: YTN; PAM sequence: TTC
ctgttttataaaagaaaaat

SEQ ID NO: 167904 - DNA, 20 bp, Artificial Sequence
  Description of Artificial Sequence: Synthetic oligonucleotide
  Target: ATXN1; (-) strand; PAM type: YTN; PAM sequence: CTT
cctgttttataaaagaaaaa

SEQ ID NO: 167905 - DNA, 20 bp, Artificial Sequence
  Description of Artificial Sequence: Synthetic oligonucleotide
  Target: ATXN1; (-) strand; PAM type: YTN; PAM sequence: TTC
cttcctgttttataaaagaa

SEQ ID NO: 167906 - DNA, 20 bp, Artificial Sequence
  Description of Artificial Sequence: Synthetic oligonucleotide
  Target: ATXN1; (-) strand; PAM type: YTN; PAM sequence: CTA
atattccttcctgttttata

SEQ ID NO: 167907 - DNA, 20 bp, Artificial Sequence
  Description of Artificial Sequence: Synthetic oligonucleotide
  Target: ATXN1; (-) strand; PAM type: YTN; PAM sequence: TTC
taatattccttcctgtttta

SEQ ID NO: 167908 - DNA, 20 bp, Artificial Sequence
  Description of Artificial Sequence: Synthetic oligonucleotide
  Target: ATXN1; (-) strand; PAM type: YTN; PAM sequence: TTT
ctaatattccttcctgtttt

SEQ ID NO: 167909 - DNA, 20 bp, Artificial Sequence
  Description of Artificial Sequence: Synthetic oligonucleotide
  Target: ATXN1; (-) strand; PAM type: YTN; PAM sequence: CTG
tgtttctaatattccttcct

SEQ ID NO: 167910 - DNA, 20 bp, Artificial Sequence
  Description of Artificial Sequence: Synthetic oligonucleotide
  Target: ATXN1; (-) strand; PAM type: YTN; PAM sequence: TTC
ctgtgtttctaatattcctt

SEQ ID NO: 167911 - DNA, 20 bp, Artificial Sequence
  Description of Artificial Sequence: Synthetic oligonucleotide
  Target: ATXN1; (-) strand; PAM type: YTN; PAM sequence: CTT
cctgtgtttctaatattcct

SEQ ID NO: 167912 - DNA, 20 bp, Artificial Sequence
  Description of Artificial Sequence: Synthetic oligonucleotide
  Target: ATXN1; (-) strand; PAM type: YTN; PAM sequence: TTC
aacttcctgtgtttctaata

SEQ ID NO: 167913 - DNA, 20 bp, Artificial Sequence
  Description of Artificial Sequence: Synthetic oligonucleotide
  Target: ATXN1; (-) strand; PAM type: YTN; PAM sequence: CTG
agatgttcaacttcctgtgt

SEQ ID NO: 167914 - DNA, 20 bp, Artificial Sequence
  Description of Artificial Sequence: Synthetic oligonucleotide
  Target: ATXN1; (-) strand; PAM type: YTN; PAM sequence: TTA
ctgagatgttcaacttcctg

SEQ ID NO: 167915 - DNA, 20 bp, Artificial Sequence
  Description of Artificial Sequence: Synthetic oligonucleotide
  Target: ATXN1; (-) strand; PAM type: YTN; PAM sequence: TTT
actgagatgttcaacttcct

SEQ ID NO: 167916 - DNA, 20 bp, Artificial Sequence
  Description of Artificial Sequence: Synthetic oligonucleotide
  Target: ATXN1; (-) strand; PAM type: YTN; PAM sequence: TTG
gcatttactgagatgttcaa

SEQ ID NO: 167917 - DNA, 20 bp, Artificial Sequence
  Description of Artificial Sequence: Synthetic oligonucleotide
  Target: ATXN1; (-) strand; PAM type: YTN; PAM sequence: CTT
ggcatttactgagatgttca

SEQ ID NO: 167918 - DNA, 20 bp, Artificial Sequence
  Description of Artificial Sequence: Synthetic oligonucleotide
  Target: ATXN1; (-) strand; PAM type: YTN; PAM sequence: TTC
ttggcatttactgagatgtt

SEQ ID NO: 167919 - DNA, 20 bp, Artificial Sequence
  Description of Artificial Sequence: Synthetic oligonucleotide
  Target: ATXN1; (-) strand; PAM type: YTN; PAM sequence: CTT
cttggcatttactgagatgt

SEQ ID NO: 167920 - DNA, 20 bp, Artificial Sequence
  Description of Artificial Sequence: Synthetic oligonucleotide
  Target: ATXN1; (-) strand; PAM type: YTN; PAM sequence: CTC
cttcttggcatttactgaga

SEQ ID NO: 167921 - DNA, 20 bp, Artificial Sequence
  Description of Artificial Sequence: Synthetic oligonucleotide
  Target: ATXN1; (-) strand; PAM type: YTN; PAM sequence: CTC
caaggcacaatctccttctt

SEQ ID NO: 167922 - DNA, 20 bp, Artificial Sequence
  Description of Artificial Sequence: Synthetic oligonucleotide
  Target: ATXN1; (-) strand; PAM type: YTN; PAM sequence: TTC
ctccaaggcacaatctcctt

SEQ ID NO: 167923 - DNA, 20 bp, Artificial Sequence
  Description of Artificial Sequence: Synthetic oligonucleotide
  Target: ATXN1; (-) strand; PAM type: YTN; PAM sequence: TTT
cctccaaggcacaatctcct

SEQ ID NO: 167924 - DNA, 20 bp, Artificial Sequence
  Description of Artificial Sequence: Synthetic oligonucleotide
  Target: ATXN1; (-) strand; PAM type: YTN; PAM sequence: CTT
tcctccaaggcacaatctcc

SEQ ID NO: 167925 - DNA, 20 bp, Artificial Sequence
  Description of Artificial Sequence: Synthetic oligonucleotide
  Target: ATXN1; (-) strand; PAM type: YTN; PAM sequence: CTC
catgccaacctttcctccaa

SEQ ID NO: 167926 - DNA, 20 bp, Artificial Sequence
  Description of Artificial Sequence: Synthetic oligonucleotide
  Target: ATXN1; (-) strand; PAM type: YTN; PAM sequence: CTG
gctccatgccaacctttcct

SEQ ID NO: 167927 - DNA, 20 bp, Artificial Sequence
  Description of Artificial Sequence: Synthetic oligonucleotide
  Target: ATXN1; (-) strand; PAM type: YTN; PAM sequence: CTG
gtgagaccaagggcacagaa

SEQ ID NO: 167928 - DNA, 20 bp, Artificial Sequence
  Description of Artificial Sequence: Synthetic oligonucleotide
  Target: ATXN1; (-) strand; PAM type: YTN; PAM sequence: CTG
ggtctggtgagaccaagggc

SEQ ID NO: 167929 - DNA, 20 bp, Artificial Sequence
  Description of Artificial Sequence: Synthetic oligonucleotide
  Target: ATXN1; (-) strand; PAM type: YTN; PAM sequence: CTG
gccctgggtctggtgagacc

SEQ ID NO: 167930 - DNA, 20 bp, Artificial Sequence
  Description of Artificial Sequence: Synthetic oligonucleotide
  Target: ATXN1; (-) strand; PAM type: YTN; PAM sequence: TTG
gtctggccctgggtctggtg

SEQ ID NO: 167931 - DNA, 20 bp, Artificial Sequence
  Description of Artificial Sequence: Synthetic oligonucleotide
  Target: ATXN1; (-) strand; PAM type: YTN; PAM sequence: TTA
ttggtctggccctgggtctg

SEQ ID NO: 167932 - DNA, 20 bp, Artificial Sequence
  Description of Artificial Sequence: Synthetic oligonucleotide
  Target: ATXN1; (-) strand; PAM type: YTN; PAM sequence: CTT
attggtctggccctgggtct

SEQ ID NO: 167933 - DNA, 20 bp, Artificial Sequence
  Description of Artificial Sequence: Synthetic oligonucleotide
  Target: ATXN1; (-) strand; PAM type: YTN; PAM sequence: TTC
ttattggtctggccctgggt

SEQ ID NO: 167934 - DNA, 20 bp, Artificial Sequence
  Description of Artificial Sequence: Synthetic oligonucleotide
  Target: ATXN1; (-) strand; PAM type: YTN; PAM sequence: TTT
cttattggtctggccctggg

SEQ ID NO: 167935 - DNA, 20 bp, Artificial Sequence
  Description of Artificial Sequence: Synthetic oligonucleotide
  Target: ATXN1; (-) strand; PAM type: YTN; PAM sequence: CTT
tcttattggtctggccctgg

SEQ ID NO: 167936 - DNA, 20 bp, Artificial Sequence
  Description of Artificial Sequence: Synthetic oligonucleotide
  Target: ATXN1; (-) strand; PAM type: YTN; PAM sequence: TTC
tttcttattggtctggccct

SEQ ID NO: 167937 - DNA, 20 bp, Artificial Sequence
  Description of Artificial Sequence: Synthetic oligonucleotide
  Target: ATXN1; (-) strand; PAM type: YTN; PAM sequence: CTT
ctttcttattggtctggccc

SEQ ID NO: 167938 - DNA, 20 bp, Artificial Sequence
  Description of Artificial Sequence: Synthetic oligonucleotide
  Target: ATXN1; (-) strand; PAM type: YTN; PAM sequence: TTC
ccttctttcttattggtctg

SEQ ID NO: 167939 - DNA, 20 bp, Artificial Sequence
  Description of Artificial Sequence: Synthetic oligonucleotide
  Target: ATXN1; (-) strand; PAM type: YTN; PAM sequence: TTT
cccttctttcttattggtct

SEQ ID NO: 167940 - DNA, 20 bp, Artificial Sequence
  Description of Artificial Sequence: Synthetic oligonucleotide
  Target: ATXN1; (-) strand; PAM type: YTN; PAM sequence: TTT
tcccttctttcttattggtc

SEQ ID NO: 167941 - DNA, 20 bp, Artificial Sequence
  Description of Artificial Sequence: Synthetic oligonucleotide
  Target: ATXN1; (-) strand; PAM type: YTN; PAM sequence: CTT
ttcccttctttcttattggt

SEQ ID NO: 167942 - DNA, 20 bp, Artificial Sequence
  Description of Artificial Sequence: Synthetic oligonucleotide
  Target: ATXN1; (-) strand; PAM type: YTN; PAM sequence: TTC
ccttttcccttctttcttat

SEQ ID NO: 167943 - DNA, 20 bp, Artificial Sequence
  Description of Artificial Sequence: Synthetic oligonucleotide
  Target: ATXN1; (-) strand; PAM type: YTN; PAM sequence: TTT
cccttttcccttctttctta

SEQ ID NO: 167944 - DNA, 20 bp, Artificial Sequence
  Description of Artificial Sequence: Synthetic oligonucleotide
  Target: ATXN1; (-) strand; PAM type: YTN; PAM sequence: TTA
atttcccttttcccttcttt

SEQ ID NO: 167945 - DNA, 20 bp, Artificial Sequence
  Description of Artificial Sequence: Synthetic oligonucleotide
  Target: ATXN1; (-) strand; PAM type: YTN; PAM sequence: TTT
aatttcccttttcccttctt

SEQ ID NO: 167946 - DNA, 20 bp, Artificial Sequence
  Description of Artificial Sequence: Synthetic oligonucleotide
  Target: ATXN1; (-) strand; PAM type: YTN; PAM sequence: TTT
taatttcccttttcccttct

SEQ ID NO: 167947 - DNA, 20 bp, Artificial Sequence
  Description of Artificial Sequence: Synthetic oligonucleotide
  Target: ATXN1; (-) strand; PAM type: YTN; PAM sequence: CTT
ttaatttcccttttcccttc

SEQ ID NO: 167948 - DNA, 20 bp, Artificial Sequence
  Description of Artificial Sequence: Synthetic oligonucleotide
  Target: ATXN1; (-) strand; PAM type: YTN; PAM sequence: TTC
ttttaatttcccttttccct

SEQ ID NO: 167949 - DNA, 20 bp, Artificial Sequence
  Description of Artificial Sequence: Synthetic oligonucleotide
  Target: ATXN1; (-) strand; PAM type: YTN; PAM sequence: CTT
cttttaatttcccttttccc

SEQ ID NO: 167950 - DNA, 20 bp, Artificial Sequence
  Description of Artificial Sequence: Synthetic oligonucleotide
  Target: ATXN1; (-) strand; PAM type: YTN; PAM sequence: CTG
gcttcttttaatttcccttt

SEQ ID NO: 167951 - DNA, 20 bp, Artificial Sequence
  Description of Artificial Sequence: Synthetic oligonucleotide
  Target: ATXN1; (-) strand; PAM type: YTN; PAM sequence: CTC
tggcttcttttaatttccct

SEQ ID NO: 167952 - DNA, 20 bp, Artificial Sequence
  Description of Artificial Sequence: Synthetic oligonucleotide
  Target: ATXN1; (-) strand; PAM type: YTN; PAM sequence: CTG
tccatatctctggcttcttt

SEQ ID NO: 167953 - DNA, 20 bp, Artificial Sequence
  Description of Artificial Sequence: Synthetic oligonucleotide
  Target: ATXN1; (-) strand; PAM type: YTN; PAM sequence: TTC
tgtccatatctctggcttct

SEQ ID NO: 167954 - DNA, 20 bp, Artificial Sequence
  Description of Artificial Sequence: Synthetic oligonucleotide
  Target: ATXN1; (-) strand; PAM type: YTN; PAM sequence: TTT
ctgtccatatctctggcttc

SEQ ID NO: 167955 - DNA, 20 bp, Artificial Sequence
  Description of Artificial Sequence: Synthetic oligonucleotide
  Target: ATXN1; (-) strand; PAM type: YTN; PAM sequence: TTG
tttctgtccatatctctggc

SEQ ID NO: 167956 - DNA, 20 bp, Artificial Sequence
  Description of Artificial Sequence: Synthetic oligonucleotide
  Target: ATXN1; (-) strand; PAM type: YTN; PAM sequence: CTT
gtttctgtccatatctctgg

SEQ ID NO: 167957 - DNA, 20 bp, Artificial Sequence
  Description of Artificial Sequence: Synthetic oligonucleotide
  Target: ATXN1; (-) strand; PAM type: YTN; PAM sequence: CTC
ttgtttctgtccatatctct

SEQ ID NO: 167958 - DNA, 20 bp, Artificial Sequence
  Description of Artificial Sequence: Synthetic oligonucleotide
  Target: ATXN1; (-) strand; PAM type: YTN; PAM sequence: TTC
ctcttgtttctgtccatatc

SEQ ID NO: 167959 - DNA, 20 bp, Artificial Sequence
  Description of Artificial Sequence: Synthetic oligonucleotide
  Target: ATXN1; (-) strand; PAM type: YTN; PAM sequence: CTT
cctcttgtttctgtccatat

SEQ ID NO: 167960 - DNA, 20 bp, Artificial Sequence
  Description of Artificial Sequence: Synthetic oligonucleotide
  Target: ATXN1; (-) strand; PAM type: YTN; PAM sequence: CTC
cttcctcttgtttctgtcca

SEQ ID NO: 167961 - DNA, 20 bp, Artificial Sequence
  Description of Artificial Sequence: Synthetic oligonucleotide
  Target: ATXN1; (-) strand; PAM type: YTN; PAM sequence: CTC
tccttcctcttgtttctgtc

SEQ ID NO: 167962 - DNA, 20 bp, Artificial Sequence
  Description of Artificial Sequence: Synthetic oligonucleotide
  Target: ATXN1; (-) strand; PAM type: YTN; PAM sequence: TTC
tctccttcctcttgtttctg

SEQ ID NO: 167963 - DNA, 20 bp, Artificial Sequence
  Description of Artificial Sequence: Synthetic oligonucleotide
  Target: ATXN1; (-) strand; PAM type: YTN; PAM sequence: TTC
cattctctccttcctcttgt

SEQ ID NO: 167964 - DNA, 20 bp, Artificial Sequence
  Description of Artificial Sequence: Synthetic oligonucleotide
  Target: ATXN1; (-) strand; PAM type: YTN; PAM sequence: TTT
ccattctctccttcctcttg

SEQ ID NO: 167965 - DNA, 20 bp, Artificial Sequence
  Description of Artificial Sequence: Synthetic oligonucleotide
  Target: ATXN1; (-) strand; PAM type: YTN; PAM sequence: TTT
tccattctctccttcctctt

SEQ ID NO: 167966 - DNA, 20 bp, Artificial Sequence
  Description of Artificial Sequence: Synthetic oligonucleotide
  Target: ATXN1; (-) strand; PAM type: YTN; PAM sequence: CTT
ttccattctctccttcctct

SEQ ID NO: 167967 - DNA, 20 bp, Artificial Sequence
  Description of Artificial Sequence: Synthetic oligonucleotide
  Target: ATXN1; (-) strand; PAM type: YTN; PAM sequence: TTC
ttttccattctctccttcct

SEQ ID NO: 167968 - DNA, 20 bp, Artificial Sequence
  Description of Artificial Sequence: Synthetic oligonucleotide
  Target: ATXN1; (-) strand; PAM type: YTN; PAM sequence: CTT
cttttccattctctccttcc

SEQ ID NO: 167969 - DNA, 20 bp, Artificial Sequence
  Description of Artificial Sequence: Synthetic oligonucleotide
  Target: ATXN1; (-) strand; PAM type: YTN; PAM sequence: CTC
aacttcttttccattctctc

SEQ ID NO: 167970 - DNA, 20 bp, Artificial Sequence
  Description of Artificial Sequence: Synthetic oligonucleotide
  Target: ATXN1; (-) strand; PAM type: YTN; PAM sequence: CTC
tcaacttcttttccattctc

SEQ ID NO: 167971 - DNA, 20 bp, Artificial Sequence
  Description of Artificial Sequence: Synthetic oligonucleotide
  Target: ATXN1; (-) strand; PAM type: YTN; PAM sequence: TTC
cctctcaacttcttttccat

SEQ ID NO: 167972 - DNA, 20 bp, Artificial Sequence
  Description of Artificial Sequence: Synthetic oligonucleotide
  Target: ATXN1; (-) strand; PAM type: YTN; PAM sequence: CTG
ttccctctcaacttcttttc

SEQ ID NO: 167973 - DNA, 20 bp, Artificial Sequence
  Description of Artificial Sequence: Synthetic oligonucleotide
  Target: ATXN1; (-) strand; PAM type: YTN; PAM sequence: TTC
tgttccctctcaacttcttt

SEQ ID NO: 167974 - DNA, 20 bp, Artificial Sequence
  Description of Artificial Sequence: Synthetic oligonucleotide
  Target: ATXN1; (-) strand; PAM type: YTN; PAM sequence: TTT
ctgttccctctcaacttctt

SEQ ID NO: 167975 - DNA, 20 bp, Artificial Sequence
  Description of Artificial Sequence: Synthetic oligonucleotide
  Target: ATXN1; (-) strand; PAM type: YTN; PAM sequence: TTT
tctgttccctctcaacttct

SEQ ID NO: 167976 - DNA, 20 bp, Artificial Sequence
  Description of Artificial Sequence: Synthetic oligonucleotide
  Target: ATXN1; (-) strand; PAM type: YTN; PAM sequence: CTT
ttctgttccctctcaacttc

SEQ ID NO: 167977 - DNA, 20 bp, Artificial Sequence
  Description of Artificial Sequence: Synthetic oligonucleotide
  Target: ATXN1; (-) strand; PAM type: YTN; PAM sequence: TTC
ttttctgttccctctcaact

SEQ ID NO: 167978 - DNA, 20 bp, Artificial Sequence
  Description of Artificial Sequence: Synthetic oligonucleotide
  Target: ATXN1; (-) strand; PAM type: YTN; PAM sequence: CTT
cttttctgttccctctcaac

SEQ ID NO: 167979 - DNA, 20 bp, Artificial Sequence
  Description of Artificial Sequence: Synthetic oligonucleotide
  Target: ATXN1; (-) strand; PAM type: YTN; PAM sequence: CTG
tgtacttcttttctgttccc

SEQ ID NO: 167980 - DNA, 20 bp, Artificial Sequence
  Description of Artificial Sequence: Synthetic oligonucleotide
  Target: ATXN1; (-) strand; PAM type: YTN; PAM sequence: CTA
cctgtgtacttcttttctgt

SEQ ID NO: 167981 - DNA, 20 bp, Artificial Sequence
  Description of Artificial Sequence: Synthetic oligonucleotide
  Target: ATXN1; (-) strand; PAM type: YTN; PAM sequence: TTC
tacctgtgtacttcttttct

SEQ ID NO: 167982 - DNA, 20 bp, Artificial Sequence
  Description of Artificial Sequence: Synthetic oligonucleotide
  Target: ATXN1; (-) strand; PAM type: YTN; PAM sequence: CTC
acccaccaattctacctgtg

SEQ ID NO: 167983 - DNA, 20 bp, Artificial Sequence
  Description of Artificial Sequence: Synthetic oligonucleotide
  Target: ATXN1; (-) strand; PAM type: YTN; PAM sequence: CTC
cacagctcacccaccaattc

SEQ ID NO: 167984 - DNA, 20 bp, Artificial Sequence
  Description of Artificial Sequence: Synthetic oligonucleotide
  Target: ATXN1; (-) strand; PAM type: YTN; PAM sequence: TTC
tccacagctcacccaccaat

SEQ ID NO: 167985 - DNA, 20 bp, Artificial Sequence
  Description of Artificial Sequence: Synthetic oligonucleotide
  Target: ATXN1; (-) strand; PAM type: YTN; PAM sequence: TTT
ctccacagctcacccaccaa

SEQ ID NO: 167986 - DNA, 20 bp, Artificial Sequence
  Description of Artificial Sequence: Synthetic oligonucleotide
  Target: ATXN1; (-) strand; PAM type: YTN; PAM sequence: TTG
cagtttctccacagctcacc

SEQ ID NO: 167987 - DNA, 20 bp, Artificial Sequence
  Description of Artificial Sequence: Synthetic oligonucleotide
  Target: ATXN1; (-) strand; PAM type: YTN; PAM sequence: TTT
gcagtttctccacagctcac

SEQ ID NO: 167988 - DNA, 20 bp, Artificial Sequence
  Description of Artificial Sequence: Synthetic oligonucleotide
  Target: ATXN1; (-) strand; PAM type: YTN; PAM sequence: CTC
ggtttgcagtttctccacag

SEQ ID NO: 167989 - DNA, 20 bp, Artificial Sequence
  Description of Artificial Sequence: Synthetic oligonucleotide
  Target: ATXN1; (-) strand; PAM type: YTN; PAM sequence: TTC
actcggtttgcagtttctcc

SEQ ID NO: 167990 - DNA, 20 bp, Artificial Sequence
  Description of Artificial Sequence: Synthetic oligonucleotide
  Target: ATXN1; (-) strand; PAM type: YTN; PAM sequence: TTT
cactcggtttgcagtttctc

SEQ ID NO: 167991 - DNA, 20 bp, Artificial Sequence
  Description of Artificial Sequence: Synthetic oligonucleotide
  Target: ATXN1; (-) strand; PAM type: YTN; PAM sequence: CTT
tcactcggtttgcagtttct

SEQ ID NO: 167992 - DNA, 20 bp, Artificial Sequence
  Description of Artificial Sequence: Synthetic oligonucleotide
  Target: ATXN1; (-) strand; PAM type: YTN; PAM sequence: TTA
gagggctttcactcggtttg

SEQ ID NO: 167993 - DNA, 20 bp, Artificial Sequence
  Description of Artificial Sequence: Synthetic oligonucleotide
  Target: ATXN1; (-) strand; PAM type: YTN; PAM sequence: TTC
agtgttagagggctttcact

SEQ ID NO: 167994 - DNA, 20 bp, Artificial Sequence
  Description of Artificial Sequence: Synthetic oligonucleotide
  Target: ATXN1; (-) strand; PAM type: YTN; PAM sequence: TTT
cagtgttagagggctttcac

SEQ ID NO: 167995 - DNA, 20 bp, Artificial Sequence
  Description of Artificial Sequence: Synthetic oligonucleotide
  Target: ATXN1; (-) strand; PAM type: YTN; PAM sequence: TTG
catttcagtgttagagggct

SEQ ID NO: 167996 - DNA, 20 bp, Artificial Sequence
  Description of Artificial Sequence: Synthetic oligonucleotide
  Target: ATXN1; (-) strand; PAM type: YTN; PAM sequence: TTA
ttgcatttcagtgttagagg

SEQ ID NO: 167997 - DNA, 20 bp, Artificial Sequence
  Description of Artificial Sequence: Synthetic oligonucleotide
  Target: ATXN1; (-) strand; PAM type: YTN; PAM sequence: CTT
attgcatttcagtgttagag

SEQ ID NO: 167998 - DNA, 20 bp, Artificial Sequence
  Description of Artificial Sequence: Synthetic oligonucleotide
  Target: ATXN1; (-) strand; PAM type: YTN; PAM sequence: CTG
agcatgggatggagtaatgc

SEQ ID NO: 167999 - DNA, 20 bp, Artificial Sequence
  Description of Artificial Sequence: Synthetic oligonucleotide
  Target: ATXN1; (-) strand; PAM type: YTN; PAM sequence: TTG
gggctgagcatgggatggag

SEQ ID NO: 168000 - DNA, 20 bp, Artificial Sequence
  Description of Artificial Sequence: Synthetic oligonucleotide
  Target: ATXN1; (-) strand; PAM type: YTN; PAM sequence: TTA
tccaaatgggcatggttggg

SEQ ID NO: 168001 - DNA, 20 bp, Artificial Sequence
  Description of Artificial Sequence: Synthetic oligonucleotide
  Target: ATXN1; (-) strand; PAM type: YTN; PAM sequence: TTT
atccaaatgggcatggttgg

SEQ ID NO: 168002 - DNA, 20 bp, Artificial Sequence
  Description of Artificial Sequence: Synthetic oligonucleotide
  Target: ATXN1; (-) strand; PAM type: YTN; PAM sequence: TTT
tatccaaatgggcatggttg

SEQ ID NO: 168003 - DNA, 20 bp, Artificial Sequence
  Description of Artificial Sequence: Synthetic oligonucleotide
  Target: ATXN1; (-) strand; PAM type: YTN; PAM sequence: TTA
ccaaatggaatccattttat

SEQ ID NO: 168004 - DNA, 20 bp, Artificial Sequence
  Description of Artificial Sequence: Synthetic oligonucleotide
  Target: ATXN1; (-) strand; PAM type: YTN; PAM sequence: TTG
ccaaccattaccaaatggaa

SEQ ID NO: 168005 - DNA, 20 bp, Artificial Sequence
  Description of Artificial Sequence: Synthetic oligonucleotide
  Target: ATXN1; (-) strand; PAM type: YTN; PAM sequence: TTA
ttgccaaccattaccaaatg

SEQ ID NO: 168006 - DNA, 20 bp, Artificial Sequence
  Description of Artificial Sequence: Synthetic oligonucleotide
  Target: ATXN1; (-) strand; PAM type: YTN; PAM sequence: TTC
agaaatgacagttattgcca

SEQ ID NO: 168007 - DNA, 20 bp, Artificial Sequence
  Description of Artificial Sequence: Synthetic oligonucleotide
  Target: ATXN1; (-) strand; PAM type: YTN; PAM sequence: TTT
cagaaatgacagttattgcc

SEQ ID NO: 168008 - DNA, 20 bp, Artificial Sequence
  Description of Artificial Sequence: Synthetic oligonucleotide
  Target: ATXN1; (-) strand; PAM type: YTN; PAM sequence: TTG
gcatttcagaaatgacagtt

SEQ ID NO: 168009 - DNA, 20 bp, Artificial Sequence
  Description of Artificial Sequence: Synthetic oligonucleotide
  Target: ATXN1; (-) strand; PAM type: YTN; PAM sequence: CTT
ggcatttcagaaatgacagt

SEQ ID NO: 168010 - DNA, 20 bp, Artificial Sequence
  Description of Artificial Sequence: Synthetic oligonucleotide
  Target: ATXN1; (-) strand; PAM type: YTN; PAM sequence: TTG
tatatgtgggcccttggcat

SEQ ID NO: 168011 - DNA, 20 bp, Artificial Sequence
  Description of Artificial Sequence: Synthetic oligonucleotide
  Target: ATXN1; (-) strand; PAM type: YTN; PAM sequence: CTG
gttgtatatgtgggcccttg

SEQ ID NO: 168012 - DNA, 20 bp, Artificial Sequence
  Description of Artificial Sequence: Synthetic oligonucleotide
  Target: ATXN1; (-) strand; PAM type: YTN; PAM sequence: CTA
taaaggtgtcaactggttgt

SEQ ID NO: 168013 - DNA, 20 bp, Artificial Sequence
  Description of Artificial Sequence: Synthetic oligonucleotide
  Target: ATXN1; (-) strand; PAM type: YTN; PAM sequence: CTA
ctataaaggtgtcaactggt

SEQ ID NO: 168014 - DNA, 20 bp, Artificial Sequence
  Description of Artificial Sequence: Synthetic oligonucleotide
  Target: ATXN1; (-) strand; PAM type: YTN; PAM sequence: CTA
taaatactactataaaggtg

SEQ ID NO: 168015 - DNA, 20 bp, Artificial Sequence
  Description of Artificial Sequence: Synthetic oligonucleotide
  Target: ATXN1; (-) strand; PAM type: YTN; PAM sequence: CTG
agctataaatactactataa

SEQ ID NO: 168016 - DNA, 20 bp, Artificial Sequence
  Description of Artificial Sequence: Synthetic oligonucleotide
  Target: ATXN1; (-) strand; PAM type: YTN; PAM sequence: TTA
aagtgtctgagctataaata

SEQ ID NO: 168017 - DNA, 20 bp, Artificial Sequence
  Description of Artificial Sequence: Synthetic oligonucleotide
  Target: ATXN1; (-) strand; PAM type: YTN; PAM sequence: TTT
aaagtgtctgagctataaat

SEQ ID NO: 168018 - DNA, 20 bp, Artificial Sequence
  Description of Artificial Sequence: Synthetic oligonucleotide
  Target: ATXN1; (-) strand; PAM type: YTN; PAM sequence: TTT
taaagtgtctgagctataaa

SEQ ID NO: 168019 - DNA, 20 bp, Artificial Sequence
  Description of Artificial Sequence: Synthetic oligonucleotide
  Target: ATXN1; (-) strand; PAM type: YTN; PAM sequence: CTG
tgcccagcccacagtcatgt

SEQ ID NO: 168020 - DNA, 20 bp, Artificial Sequence
  Description of Artificial Sequence: Synthetic oligonucleotide
  Target: ATXN1; (-) strand; PAM type: YTN; PAM sequence: TTA
cagacatgagccactgtgcc

SEQ ID NO: 168021 - DNA, 20 bp, Artificial Sequence
  Description of Artificial Sequence: Synthetic oligonucleotide
  Target: ATXN1; (-) strand; PAM type: YTN; PAM sequence: TTG
gattacagacatgagccact

SEQ ID NO: 168022 - DNA, 20 bp, Artificial Sequence
  Description of Artificial Sequence: Synthetic oligonucleotide
  Target: ATXN1; (-) strand; PAM type: YTN; PAM sequence: CTT
ggattacagacatgagccac

SEQ ID NO: 168023 - DNA, 20 bp, Artificial Sequence
  Description of Artificial Sequence: Synthetic oligonucleotide
  Target: ATXN1; (-) strand; PAM type: YTN; PAM sequence: CTC
ccaaagagcttggattacag

SEQ ID NO: 168024 - DNA, 20 bp, Artificial Sequence
  Description of Artificial Sequence: Synthetic oligonucleotide
  Target: ATXN1; (-) strand; PAM type: YTN; PAM sequence: CTC
agactcccaaagagcttgga

SEQ ID NO: 168025 - DNA, 20 bp, Artificial Sequence
  Description of Artificial Sequence: Synthetic oligonucleotide
  Target: ATXN1; (-) strand; PAM type: YTN; PAM sequence: CTG
cctcagactcccaaagagct

SEQ ID NO: 168026 - DNA, 20 bp, Artificial Sequence
  Description of Artificial Sequence: Synthetic oligonucleotide
  Target: ATXN1; (-) strand; PAM type: YTN; PAM sequence: TTC
tgcctcagactcccaaagag

SEQ ID NO: 168027 - DNA, 20 bp, Artificial Sequence
  Description of Artificial Sequence: Synthetic oligonucleotide
  Target: ATXN1; (-) strand; PAM type: YTN; PAM sequence: CTT
ctgcctcagactcccaaaga

SEQ ID NO: 168028 - DNA, 20 bp, Artificial Sequence
  Description of Artificial Sequence: Synthetic oligonucleotide
  Target: ATXN1; (-) strand; PAM type: YTN; PAM sequence: CTC
aagtgatccttctgcctcag

SEQ ID NO: 168029 - DNA, 20 bp, Artificial Sequence
  Description of Artificial Sequence: Synthetic oligonucleotide
  Target: ATXN1; (-) strand; PAM type: YTN; PAM sequence: CTG
ggctcaagtgatccttctgc

SEQ ID NO: 168030 - DNA, 20 bp, Artificial Sequence
  Description of Artificial Sequence: Synthetic oligonucleotide
  Target: ATXN1; (-) strand; PAM type: YTN; PAM sequence: CTC
ctgggctcaagtgatccttc

SEQ ID NO: 168031 - DNA, 20 bp, Artificial Sequence
  Description of Artificial Sequence: Synthetic oligonucleotide
  Target: ATXN1; (-) strand; PAM type: YTN; PAM sequence: CTC
aaactcctgggctcaagtga

SEQ ID NO: 168032 - DNA, 20 bp, Artificial Sequence
  Description of Artificial Sequence: Synthetic oligonucleotide
  Target: ATXN1; (-) strand; PAM type: YTN; PAM sequence: CTG
gtctcaaactcctgggctca

SEQ ID NO: 168033 - DNA, 20 bp, Artificial Sequence
  Description of Artificial Sequence: Synthetic oligonucleotide
  Target: ATXN1; (-) strand; PAM type: YTN; PAM sequence: TTG
cccaggctggtctcaaactc

SEQ ID NO: 168034 - DNA, 20 bp, Artificial Sequence
  Description of Artificial Sequence: Synthetic oligonucleotide
  Target: ATXN1; (-) strand; PAM type: YTN; PAM sequence: CTG
ggttgcccaggctggtctca

SEQ ID NO: 168035 - DNA, 20 bp, Artificial Sequence
  Description of Artificial Sequence: Synthetic oligonucleotide
  Target: ATXN1; (-) strand; PAM type: YTN; PAM sequence: CTC
actgggttgcccaggctggt

SEQ ID NO: 168036 - DNA, 20 bp, Artificial Sequence
  Description of Artificial Sequence: Synthetic oligonucleotide
  Target: ATXN1; (-) strand; PAM type: YTN; PAM sequence: TTC
tcactgggttgcccaggctg

SEQ ID NO: 168037 - DNA, 20 bp, Artificial Sequence
  Description of Artificial Sequence: Synthetic oligonucleotide
  Target: ATXN1; (-) strand; PAM type: YTN; PAM sequence: TTG
tagagatgagttctcactgg

SEQ ID NO: 168038 - DNA, 20 bp, Artificial Sequence
  Description of Artificial Sequence: Synthetic oligonucleotide
  Target: ATXN1; (-) strand; PAM type: YTN; PAM sequence: TTT
gtagagatgagttctcactg

SEQ ID NO: 168039 - DNA, 20 bp, Artificial Sequence
  Description of Artificial Sequence: Synthetic oligonucleotide
  Target: ATXN1; (-) strand; PAM type: YTN; PAM sequence: TTT
tgtagagatgagttctcact

SEQ ID NO: 168040 - DNA, 20 bp, Artificial Sequence
  Description of Artificial Sequence: Synthetic oligonucleotide
  Target: ATXN1; (-) strand; PAM type: YTN; PAM sequence: TTT
ttgtagagatgagttctcac

SEQ ID NO: 168041 - DNA, 20 bp, Artificial Sequence
  Description of Artificial Sequence: Synthetic oligonucleotide
  Target: ATXN1; (-) strand; PAM type: YTN; PAM sequence: TTT
tttgtagagatgagttctca

SEQ ID NO: 168042 - DNA, 20 bp, Artificial Sequence
  Description of Artificial Sequence: Synthetic oligonucleotide
  Target: ATXN1; (-) strand; PAM type: YTN; PAM sequence: TTT
ttttgtagagatgagttctc

SEQ ID NO: 168043 - DNA, 20 bp, Artificial Sequence
  Description of Artificial Sequence: Synthetic oligonucleotide
  Target: ATXN1; (-) strand; PAM type: YTN; PAM sequence: TTT
tttttgtagagatgagttct

SEQ ID NO: 168044 - DNA, 20 bp, Artificial Sequence
  Description of Artificial Sequence: Synthetic oligonucleotide
  Target: ATXN1; (-) strand; PAM type: YTN; PAM sequence: CTT
ttttttgtagagatgagttc

SEQ ID NO: 168045 - DNA, 20 bp, Artificial Sequence
  Description of Artificial Sequence: Synthetic oligonucleotide
  Target: ATXN1; (-) strand; PAM type: YTN; PAM sequence: TTA
ccttttttttgtagagatga

SEQ ID NO: 168046 - DNA, 20 bp, Artificial Sequence
  Description of Artificial Sequence: Synthetic oligonucleotide
  Target: ATXN1; (-) strand; PAM type: YTN; PAM sequence: TTT
accttttttttgtagagatg

SEQ ID NO: 168047 - DNA, 20 bp, Artificial Sequence
  Description of Artificial Sequence: Synthetic oligonucleotide
  Target: ATXN1; (-) strand; PAM type: YTN; PAM sequence: TTT
taccttttttttgtagagat

SEQ ID NO: 168048 - DNA, 20 bp, Artificial Sequence
  Description of Artificial Sequence: Synthetic oligonucleotide
  Target: ATXN1; (-) strand; PAM type: YTN; PAM sequence: TTT
ttaccttttttttgtagaga

SEQ ID NO: 168049 - DNA, 20 bp, Artificial Sequence
  Description of Artificial Sequence: Synthetic oligonucleotide
  Target: ATXN1; (-) strand; PAM type: YTN; PAM sequence: CTA
atttttaccttttttttgta

SEQ ID NO: 168050 - DNA, 20 bp, Artificial Sequence
  Description of Artificial Sequence: Synthetic oligonucleotide
  Target: ATXN1; (-) strand; PAM type: YTN; PAM sequence: CTA
tagacatgtgccaccacgcc

SEQ ID NO: 168051 - DNA, 20 bp, Artificial Sequence
  Description of Artificial Sequence: Synthetic oligonucleotide
  Target: ATXN1; (-) strand; PAM type: YTN; PAM sequence: CTA
gtagcaaggactatagacat

SEQ ID NO: 168052 - DNA, 20 bp, Artificial Sequence
  Description of Artificial Sequence: Synthetic oligonucleotide
  Target: ATXN1; (-) strand; PAM type: YTN; PAM sequence: CTC
cctagtagcaaggactatag

SEQ ID NO: 168053 - DNA, 20 bp, Artificial Sequence
  Description of Artificial Sequence: Synthetic oligonucleotide
  Target: ATXN1; (-) strand; PAM type: YTN; PAM sequence: CTC
agcctccctagtagcaagga

SEQ ID NO: 168054 - DNA, 20 bp, Artificial Sequence
  Description of Artificial Sequence: Synthetic oligonucleotide
  Target: ATXN1; (-) strand; PAM type: YTN; PAM sequence: CTG
cctcagcctccctagtagca

SEQ ID NO: 168055 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctccctagta

SEQ ID NO: 168056 - DNA, 20 bp, Artificial Sequence
  Description of Artificial Sequence: Synthetic oligonucleotide
  Target: ATXN1; (-) strand; PAM type: YTN; PAM sequence: CTC
aagtgatcctcctgcctcag

SEQ ID NO: 168057 - DNA, 20 bp, Artificial Sequence
  Description of Artificial Sequence: Synthetic oligonucleotide
  Target: ATXN1; (-) strand; PAM type: YTN; PAM sequence: CTC
ccaggctcaagtgatcctcc

SEQ ID NO: 168058 - DNA, 20 bp, Artificial Sequence
  Description of Artificial Sequence: Synthetic oligonucleotide
  Target: ATXN1; (-) strand; PAM type: YTN; PAM sequence: CTG
tctcccaggctcaagtgatc

SEQ ID NO: 168059 - DNA, 20 bp, Artificial Sequence
  Description of Artificial Sequence: Synthetic oligonucleotide
  Target: ATXN1; (-) strand; PAM type: YTN; PAM sequence: CTC
tgtctcccaggctcaagtga

SEQ ID NO: 168060 - DNA, 20 bp, Artificial Sequence
  Description of Artificial Sequence: Synthetic oligonucleotide
  Target: ATXN1; (-) strand; PAM type: YTN; PAM sequence: CTA
tagcctctgtctcccaggct

SEQ ID NO: 168061 - DNA, 20 bp, Artificial Sequence
  Description of Artificial Sequence: Synthetic oligonucleotide
  Target: ATXN1; (-) strand; PAM type: YTN; PAM sequence: CTC
cctatagcctctgtctccca

SEQ ID NO: 168062 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtgtgcaatcaca

SEQ ID NO: 168063 - DNA, 20 bp, Artificial Sequence
  Description of Artificial Sequence: Synthetic oligonucleotide
  Target: ATXN1; (-) strand; PAM type: YTN; PAM sequence: CTG
tccagctggagtgcagtgtg

SEQ ID NO: 168064 - DNA, 20 bp, Artificial Sequence
  Description of Artificial Sequence: Synthetic oligonucleotide
  Target: ATXN1; (-) strand; PAM type: YTN; PAM sequence: TTG
ctgtccagctggagtgcagt

SEQ ID NO: 168065 - DNA, 20 bp, Artificial Sequence
  Description of Artificial Sequence: Synthetic oligonucleotide
  Target: ATXN1; (-) strand; PAM type: YTN; PAM sequence: TTT
gctgtccagctggagtgcag

SEQ ID NO: 168066 - DNA, 20 bp, Artificial Sequence
  Description of Artificial Sequence: Synthetic oligonucleotide
  Target: ATXN1; (-) strand; PAM type: YTN; PAM sequence: CTT
tgctgtccagctggagtgca

SEQ ID NO: 168067 - DNA, 20 bp, Artificial Sequence
  Description of Artificial Sequence: Synthetic oligonucleotide
  Target: ATXN1; (-) strand; PAM type: YTN; PAM sequence: CTC
actttgctgtccagctggag

SEQ ID NO: 168068 - DNA, 20 bp, Artificial Sequence
  Description of Artificial Sequence: Synthetic oligonucleotide
  Target: ATXN1; (-) strand; PAM type: YTN; PAM sequence: TTG
atacagtgtctcactttgct

SEQ ID NO: 168069 - DNA, 20 bp, Artificial Sequence
  Description of Artificial Sequence: Synthetic oligonucleotide
  Target: ATXN1; (-) strand; PAM type: YTN; PAM sequence: TTT
gatacagtgtctcactttgc

SEQ ID NO: 168070 - DNA, 20 bp, Artificial Sequence
  Description of Artificial Sequence: Synthetic oligonucleotide
  Target: ATXN1; (-) strand; PAM type: YTN; PAM sequence: TTT
tgatacagtgtctcactttg

SEQ ID NO: 168071 - DNA, 20 bp, Artificial Sequence
  Description of Artificial Sequence: Synthetic oligonucleotide
  Target: ATXN1; (-) strand; PAM type: YTN; PAM sequence: TTA
ttttgatacagtgtctcact

SEQ ID NO: 168072 - DNA, 20 bp, Artificial Sequence
  Description of Artificial Sequence: Synthetic oligonucleotide
  Target: ATXN1; (-) strand; PAM type: YTN; PAM sequence: TTT
attttgatacagtgtctcac

SEQ ID NO: 168073 - DNA, 20 bp, Artificial Sequence
  Description of Artificial Sequence: Synthetic oligonucleotide
  Target: ATXN1; (-) strand; PAM type: YTN; PAM sequence: TTA
tttattttgatacagtgtct

SEQ ID NO: 168074 - DNA, 20 bp, Artificial Sequence
  Description of Artificial Sequence: Synthetic oligonucleotide
  Target: ATXN1; (-) strand; PAM type: YTN; PAM sequence: TTT
atttattttgatacagtgtc

SEQ ID NO: 168075 - DNA, 20 bp, Artificial Sequence
  Description of Artificial Sequence: Synthetic oligonucleotide
  Target: ATXN1; (-) strand; PAM type: YTN; PAM sequence: TTA
tttatttattttgatacagt

SEQ ID NO: 168076 - DNA, 20 bp, Artificial Sequence
  Description of Artificial Sequence: Synthetic oligonucleotide
  Target: ATXN1; (-) strand; PAM type: YTN; PAM sequence: TTT
atttatttattttgatacag

SEQ ID NO: 168077 - DNA, 20 bp, Artificial Sequence
  Description of Artificial Sequence: Synthetic oligonucleotide
  Target: ATXN1; (-) strand; PAM type: YTN; PAM sequence: TTA
tttatttatttattttgata

SEQ ID NO: 168078 - DNA, 20 bp, Artificial Sequence
  Description of Artificial Sequence: Synthetic oligonucleotide
  Target: ATXN1; (-) strand; PAM type: YTN; PAM sequence: TTT
atttatttatttattttgat

SEQ ID NO: 168079 - DNA, 20 bp, Artificial Sequence
  Description of Artificial Sequence: Synthetic oligonucleotide
  Target: ATXN1; (-) strand; PAM type: YTN; PAM sequence: TTA
tttatttatttatttatttt

SEQ ID NO: 168080 - DNA, 20 bp, Artificial Sequence
  Description of Artificial Sequence: Synthetic oligonucleotide
  Target: ATXN1; (-) strand; PAM type: YTN; PAM sequence: TTT
atttatttatttatttattt

SEQ ID NO: 168081 - DNA, 20 bp, Artificial Sequence
  Description of Artificial Sequence: Synthetic oligonucleotide
  Target: ATXN1; (-) strand; PAM type: YTN; PAM sequence: TTG
tttatttatttatttattta

SEQ ID NO: 168082 - DNA, 20 bp, Artificial Sequence
  Description of Artificial Sequence: Synthetic oligonucleotide
  Target: ATXN1; (-) strand; PAM type: YTN; PAM sequence: TTT
gtttatttatttatttattt

SEQ ID NO: 168083 - DNA, 20 bp, Artificial Sequence
  Description of Artificial Sequence: Synthetic oligonucleotide
  Target: ATXN1; (-) strand; PAM type: YTN; PAM sequence: TTG
tttgtttatttatttattta

SEQ ID NO: 168084 - DNA, 20 bp, Artificial Sequence
  Description of Artificial Sequence: Synthetic oligonucleotide
  Target: ATXN1; (-) strand; PAM type: YTN; PAM sequence: TTT
gtttgtttatttatttattt

SEQ ID NO: 168085 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttatttattta

SEQ ID NO: 168086 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttatttattt

SEQ ID NO: 168087 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgtttattta

SEQ ID NO: 168088 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgtttattt

SEQ ID NO: 168089 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgtttgttta

SEQ ID NO: 168090 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgtttgttt

SEQ ID NO: 168091 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgtttgtttg

SEQ ID NO: 168092 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgtttgttt

SEQ ID NO: 168093 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgtttgtttg

SEQ ID NO: 168094 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgtttgttt

SEQ ID NO: 168095 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgtttgtttg

SEQ ID NO: 168096 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgtttgttt

SEQ ID NO: 168097 - DNA, 20 bp, Artificial Sequence
  Description of Artificial Sequence: Synthetic oligonucleotide
  Target: ATXN1; (-) strand; PAM type: YTN; PAM sequence: TTA
tttgtttgtttgtttgtttg

SEQ ID NO: 168098 - DNA, 20 bp, Artificial Sequence
  Description of Artificial Sequence: Synthetic oligonucleotide
  Target: ATXN1; (-) strand; PAM type: YTN; PAM sequence: TTT
atttgtttgtttgtttgttt

SEQ ID NO: 168099 - DNA, 20 bp, Artificial Sequence
  Description of Artificial Sequence: Synthetic oligonucleotide
  Target: ATXN1; (-) strand; PAM type: YTN; PAM sequence: TTC
atttatttgtttgtttgttt

SEQ ID NO: 168100 - DNA, 20 bp, Artificial Sequence
  Description of Artificial Sequence: Synthetic oligonucleotide
  Target: ATXN1; (-) strand; PAM type: YTN; PAM sequence: CTA
ccacaggttcatttatttgt

SEQ ID NO: 168101 - DNA, 20 bp, Artificial Sequence
  Description of Artificial Sequence: Synthetic oligonucleotide
  Target: ATXN1; (-) strand; PAM type: YTN; PAM sequence: CTC
taccacaggttcatttattt

SEQ ID NO: 168102 - DNA, 20 bp, Artificial Sequence
  Description of Artificial Sequence: Synthetic oligonucleotide
  Target: ATXN1; (-) strand; PAM type: YTN; PAM sequence: CTA
ctctaccacaggttcattta

SEQ ID NO: 168103 - DNA, 20 bp, Artificial Sequence
  Description of Artificial Sequence: Synthetic oligonucleotide
  Target: ATXN1; (-) strand; PAM type: YTN; PAM sequence: CTC
tactctaccacaggttcatt

SEQ ID NO: 168104 - DNA, 20 bp, Artificial Sequence
  Description of Artificial Sequence: Synthetic oligonucleotide
  Target: ATXN1; (-) strand; PAM type: YTN; PAM sequence: TTC
tctactctaccacaggttca

SEQ ID NO: 168105 - DNA, 20 bp, Artificial Sequence
  Description of Artificial Sequence: Synthetic oligonucleotide
  Target: ATXN1; (-) strand; PAM type: YTN; PAM sequence: CTA
cattctctactctaccacag

SEQ ID NO: 168106 - DNA, 20 bp, Artificial Sequence
  Description of Artificial Sequence: Synthetic oligonucleotide
  Target: ATXN1; (-) strand; PAM type: YTN; PAM sequence: CTC
tacattctctactctaccac

SEQ ID NO: 168107 - DNA, 20 bp, Artificial Sequence
  Description of Artificial Sequence: Synthetic oligonucleotide
  Target: ATXN1; (-) strand; PAM type: YTN; PAM sequence: CTG
tctctacattctctactcta

SEQ ID NO: 168108 - DNA, 20 bp, Artificial Sequence
  Description of Artificial Sequence: Synthetic oligonucleotide
  Target: ATXN1; (-) strand; PAM type: YTN; PAM sequence: TTC
tgtctctacattctctactc

SEQ ID NO: 168109 - DNA, 20 bp, Artificial Sequence
  Description of Artificial Sequence: Synthetic oligonucleotide
  Target: ATXN1; (-) strand; PAM type: YTN; PAM sequence: CTT
ctgtctctacattctctact

SEQ ID NO: 168110 - DNA, 20 bp, Artificial Sequence
  Description of Artificial Sequence: Synthetic oligonucleotide
  Target: ATXN1; (-) strand; PAM type: YTN; PAM sequence: CTA
ccacataaacttctgtctct

SEQ ID NO: 168111 - DNA, 20 bp, Artificial Sequence
  Description of Artificial Sequence: Synthetic oligonucleotide
  Target: ATXN1; (-) strand; PAM type: YTN; PAM sequence: TTC
ctaccacataaacttctgtc

SEQ ID NO: 168112 - DNA, 20 bp, Artificial Sequence
  Description of Artificial Sequence: Synthetic oligonucleotide
  Target: ATXN1; (-) strand; PAM type: YTN; PAM sequence: CTT
cctaccacataaacttctgt

SEQ ID NO: 168113 - DNA, 20 bp, Artificial Sequence
  Description of Artificial Sequence: Synthetic oligonucleotide
  Target: ATXN1; (-) strand; PAM type: YTN; PAM sequence: CTC
gtatcacatgtccccttcct

SEQ ID NO: 168114 - DNA, 20 bp, Artificial Sequence
  Description of Artificial Sequence: Synthetic oligonucleotide
  Target: ATXN1; (-) strand; PAM type: YTN; PAM sequence: TTC
aacctcgtatcacatgtccc

SEQ ID NO: 168115 - DNA, 20 bp, Artificial Sequence
  Description of Artificial Sequence: Synthetic oligonucleotide
  Target: ATXN1; (-) strand; PAM type: YTN; PAM sequence: TTG
ttcaacctcgtatcacatgt

SEQ ID NO: 168116 - DNA, 20 bp, Artificial Sequence
  Description of Artificial Sequence: Synthetic oligonucleotide
  Target: ATXN1; (-) strand; PAM type: YTN; PAM sequence: CTT
gttcaacctcgtatcacatg

SEQ ID NO: 168117 - DNA, 20 bp, Artificial Sequence
  Description of Artificial Sequence: Synthetic oligonucleotide
  Target: ATXN1; (-) strand; PAM type: YTN; PAM sequence: CTC
ttgttcaacctcgtatcaca

SEQ ID NO: 168118 - DNA, 20 bp, Artificial Sequence
  Description of Artificial Sequence: Synthetic oligonucleotide
  Target: ATXN1; (-) strand; PAM type: YTN; PAM sequence: TTG
ggcctcttgttcaacctcgt

SEQ ID NO: 168119 - DNA, 20 bp, Artificial Sequence
  Description of Artificial Sequence: Synthetic oligonucleotide
  Target: ATXN1; (-) strand; PAM type: YTN; PAM sequence: CTT
gggcctcttgttcaacctcg

SEQ ID NO: 168120 - DNA, 20 bp, Artificial Sequence
  Description of Artificial Sequence: Synthetic oligonucleotide
  Target: ATXN1; (-) strand; PAM type: YTN; PAM sequence: CTC
cacttgggcctcttgttcaa

SEQ ID NO: 168121 - DNA, 20 bp, Artificial Sequence
  Description of Artificial Sequence: Synthetic oligonucleotide
  Target: ATXN1; (-) strand; PAM type: YTN; PAM sequence: CTA
tgtgtccctccacttgggcc

SEQ ID NO: 168122 - DNA, 20 bp, Artificial Sequence
  Description of Artificial Sequence: Synthetic oligonucleotide
  Target: ATXN1; (-) strand; PAM type: YTN; PAM sequence: CTA
catggccctatgtgtccctc

SEQ ID NO: 168123 - DNA, 20 bp, Artificial Sequence
  Description of Artificial Sequence: Synthetic oligonucleotide
  Target: ATXN1; (-) strand; PAM type: YTN; PAM sequence: TTA
acaggacacctacatggccc

SEQ ID NO: 168124 - DNA, 20 bp, Artificial Sequence
  Description of Artificial Sequence: Synthetic oligonucleotide
  Target: ATXN1; (-) strand; PAM type: YTN; PAM sequence: CTC
catggagttaacaggacacc

SEQ ID NO: 168125 - DNA, 20 bp, Artificial Sequence
  Description of Artificial Sequence: Synthetic oligonucleotide
  Target: ATXN1; (-) strand; PAM type: YTN; PAM sequence: CTC
ctccatggagttaacaggac

SEQ ID NO: 168126 - DNA, 20 bp, Artificial Sequence
  Description of Artificial Sequence: Synthetic oligonucleotide
  Target: ATXN1; (-) strand; PAM type: YTN; PAM sequence: CTG
ggacatccccagaaacctcc

SEQ ID NO: 168127 - DNA, 20 bp, Artificial Sequence
  Description of Artificial Sequence: Synthetic oligonucleotide
  Target: ATXN1; (-) strand; PAM type: YTN; PAM sequence: CTC
aggcaacatggcctgggaca

SEQ ID NO: 168128 - DNA, 20 bp, Artificial Sequence
  Description of Artificial Sequence: Synthetic oligonucleotide
  Target: ATXN1; (-) strand; PAM type: YTN; PAM sequence: TTC
tcaggcaacatggcctggga

SEQ ID NO: 168129 - DNA, 20 bp, Artificial Sequence
  Description of Artificial Sequence: Synthetic oligonucleotide
  Target: ATXN1; (-) strand; PAM type: YTN; PAM sequence: CTC
aggcagacatgttctcaggc

SEQ ID NO: 168130 - DNA, 20 bp, Artificial Sequence
  Description of Artificial Sequence: Synthetic oligonucleotide
  Target: ATXN1; (-) strand; PAM type: YTN; PAM sequence: TTC
aggaatagaatgagtctcag

SEQ ID NO: 168131 - DNA, 20 bp, Artificial Sequence
  Description of Artificial Sequence: Synthetic oligonucleotide
  Target: ATXN1; (-) strand; PAM type: YTN; PAM sequence: TTT
caggaatagaatgagtctca

SEQ ID NO: 168132 - DNA, 20 bp, Artificial Sequence
  Description of Artificial Sequence: Synthetic oligonucleotide
  Target: ATXN1; (-) strand; PAM type: YTN; PAM sequence: CTT
tcaggaatagaatgagtctc

SEQ ID NO: 168133 - DNA, 20 bp, Artificial Sequence
  Description of Artificial Sequence: Synthetic oligonucleotide
  Target: ATXN1; (-) strand; PAM type: YTN; PAM sequence: TTC
agactttcaggaatagaatg

SEQ ID NO: 168134 - DNA, 20 bp, Artificial Sequence
  Description of Artificial Sequence: Synthetic oligonucleotide
  Target: ATXN1; (-) strand; PAM type: YTN; PAM sequence: TTT
cagactttcaggaatagaat

SEQ ID NO: 168135 - DNA, 20 bp, Artificial Sequence
  Description of Artificial Sequence: Synthetic oligonucleotide
  Target: ATXN1; (-) strand; PAM type: YTN; PAM sequence: CTG
atggtttcagactttcagga

SEQ ID NO: 168136 - DNA, 20 bp, Artificial Sequence
  Description of Artificial Sequence: Synthetic oligonucleotide
  Target: ATXN1; (-) strand; PAM type: YTN; PAM sequence: TTG
aaccataatcaatgtaagaa

SEQ ID NO: 168137 - DNA, 20 bp, Artificial Sequence
  Description of Artificial Sequence: Synthetic oligonucleotide
  Target: ATXN1; (-) strand; PAM type: YTN; PAM sequence: TTA
tacggagaaaccataccatt

SEQ ID NO: 168138 - DNA, 20 bp, Artificial Sequence
  Description of Artificial Sequence: Synthetic oligonucleotide
  Target: ATXN1; (-) strand; PAM type: YTN; PAM sequence: TTT
atacggagaaaccataccat

SEQ ID NO: 168139 - DNA, 20 bp, Artificial Sequence
  Description of Artificial Sequence: Synthetic oligonucleotide
  Target: ATXN1; (-) strand; PAM type: YTN; PAM sequence: CTA
aatggtggccaggacgttta

SEQ ID NO: 168140 - DNA, 20 bp, Artificial Sequence
  Description of Artificial Sequence: Synthetic oligonucleotide
  Target: ATXN1; (-) strand; PAM type: YTN; PAM sequence: TTC
taaatggtggccaggacgtt

SEQ ID NO: 168141 - DNA, 20 bp, Artificial Sequence
  Description of Artificial Sequence: Synthetic oligonucleotide
  Target: ATXN1; (-) strand; PAM type: YTN; PAM sequence: TTT
ctaaatggtggccaggacgt

SEQ ID NO: 168142 - DNA, 20 bp, Artificial Sequence
  Description of Artificial Sequence: Synthetic oligonucleotide
  Target: ATXN1; (-) strand; PAM type: YTN; PAM sequence: TTA
tggatcatttctaaatggtg

SEQ ID NO: 168143 - DNA, 20 bp, Artificial Sequence
  Description of Artificial Sequence: Synthetic oligonucleotide
  Target: ATXN1; (-) strand; PAM type: YTN; PAM sequence: CTA
agacccaaacaagaaattat

SEQ ID NO: 168144 - DNA, 20 bp, Artificial Sequence
  Description of Artificial Sequence: Synthetic oligonucleotide
  Target: ATXN1; (-) strand; PAM type: YTN; PAM sequence: TTG
tataagtggaaaaactaaga

SEQ ID NO: 168145 - DNA, 20 bp, Artificial Sequence
  Description of Artificial Sequence: Synthetic oligonucleotide
  Target: ATXN1; (-) strand; PAM type: YTN; PAM sequence: TTA
atatgcccgtgaagcagata

SEQ ID NO: 168146 - DNA, 20 bp, Artificial Sequence
  Description of Artificial Sequence: Synthetic oligonucleotide
  Target: ATXN1; (-) strand; PAM type: YTN; PAM sequence: TTA
accatacacattaatatgcc

SEQ ID NO: 168147 - DNA, 20 bp, Artificial Sequence
  Description of Artificial Sequence: Synthetic oligonucleotide
  Target: ATXN1; (-) strand; PAM type: YTN; PAM sequence: TTG
ttaaccatacacattaatat

SEQ ID NO: 168148 - DNA, 20 bp, Artificial Sequence
  Description of Artificial Sequence: Synthetic oligonucleotide
  Target: ATXN1; (-) strand; PAM type: YTN; PAM sequence: CTT
gttaaccatacacattaata

SEQ ID NO: 168149 - DNA, 20 bp, Artificial Sequence
  Description of Artificial Sequence: Synthetic oligonucleotide
  Target: ATXN1; (-) strand; PAM type: YTN; PAM sequence: TTG
cttgttaaccatacacatta

SEQ ID NO: 168150 - DNA, 20 bp, Artificial Sequence
  Description of Artificial Sequence: Synthetic oligonucleotide
  Target: ATXN1; (-) strand; PAM type: YTN; PAM sequence: CTA
atgattgcttgttaaccata

SEQ ID NO: 168151 - DNA, 20 bp, Artificial Sequence
  Description of Artificial Sequence: Synthetic oligonucleotide
  Target: ATXN1; (-) strand; PAM type: YTN; PAM sequence: CTG
ctaatgattgcttgttaacc

SEQ ID NO: 168152 - DNA, 20 bp, Artificial Sequence
  Description of Artificial Sequence: Synthetic oligonucleotide
  Target: ATXN1; (-) strand; PAM type: YTN; PAM sequence: TTG
gtaactgctaatgattgctt

SEQ ID NO: 168153 - DNA, 20 bp, Artificial Sequence
  Description of Artificial Sequence: Synthetic oligonucleotide
  Target: ATXN1; (-) strand; PAM type: YTN; PAM sequence: CTT
ggtaactgctaatgattgct

SEQ ID NO: 168154 - DNA, 20 bp, Artificial Sequence
  Description of Artificial Sequence: Synthetic oligonucleotide
  Target: ATXN1; (-) strand; PAM type: YTN; PAM sequence: TTC
acttggtaactgctaatgat

SEQ ID NO: 168155 - DNA, 20 bp, Artificial Sequence
  Description of Artificial Sequence: Synthetic oligonucleotide
  Target: ATXN1; (-) strand; PAM type: YTN; PAM sequence: TTT
cacttggtaactgctaatga

SEQ ID NO: 168156 - DNA, 20 bp, Artificial Sequence
  Description of Artificial Sequence: Synthetic oligonucleotide
  Target: ATXN1; (-) strand; PAM type: YTN; PAM sequence: CTT
tcacttggtaactgctaatg

SEQ ID NO: 168157 - DNA, 20 bp, Artificial Sequence
  Description of Artificial Sequence: Synthetic oligonucleotide
  Target: ATXN1; (-) strand; PAM type: YTN; PAM sequence: TTG
tctttcacttggtaactgct

SEQ ID NO: 168158 - DNA, 20 bp, Artificial Sequence
  Description of Artificial Sequence: Synthetic oligonucleotide
  Target: ATXN1; (-) strand; PAM type: YTN; PAM sequence: TTT
gtctttcacttggtaactgc

SEQ ID NO: 168159 - DNA, 20 bp, Artificial Sequence
  Description of Artificial Sequence: Synthetic oligonucleotide
  Target: ATXN1; (-) strand; PAM type: YTN; PAM sequence: CTG
ccatttgtctttcacttggt

SEQ ID NO: 168160 - DNA, 20 bp, Artificial Sequence
  Description of Artificial Sequence: Synthetic oligonucleotide
  Target: ATXN1; (-) strand; PAM type: YTN; PAM sequence: TTC
catctgccatttgtctttca

SEQ ID NO: 168161 - DNA, 20 bp, Artificial Sequence
  Description of Artificial Sequence: Synthetic oligonucleotide
  Target: ATXN1; (-) strand; PAM type: YTN; PAM sequence: TTT
ccatctgccatttgtctttc

SEQ ID NO: 168162 - DNA, 20 bp, Artificial Sequence
  Description of Artificial Sequence: Synthetic oligonucleotide
  Target: ATXN1; (-) strand; PAM type: YTN; PAM sequence: TTC
accaagacacgtgtgtggga

SEQ ID NO: 168163 - DNA, 20 bp, Artificial Sequence
  Description of Artificial Sequence: Synthetic oligonucleotide
  Target: ATXN1; (-) strand; PAM type: YTN; PAM sequence: CTT
caccaagacacgtgtgtggg

SEQ ID NO: 168164 - DNA, 20 bp, Artificial Sequence
  Description of Artificial Sequence: Synthetic oligonucleotide
  Target: ATXN1; (-) strand; PAM type: YTN; PAM sequence: CTG
aataccttcaccaagacacg

SEQ ID NO: 168165 - DNA, 20 bp, Artificial Sequence
  Description of Artificial Sequence: Synthetic oligonucleotide
  Target: ATXN1; (-) strand; PAM type: YTN; PAM sequence: CTG
gagtggcctgaataccttca

SEQ ID NO: 168166 - DNA, 20 bp, Artificial Sequence
  Description of Artificial Sequence: Synthetic oligonucleotide
  Target: ATXN1; (-) strand; PAM type: YTN; PAM sequence: CTG
gcccctggagtggcctgaat

SEQ ID NO: 168167 - DNA, 20 bp, Artificial Sequence
  Description of Artificial Sequence: Synthetic oligonucleotide
  Target: ATXN1; (-) strand; PAM type: YTN; PAM sequence: TTC
cagactggcccctggagtgg

SEQ ID NO: 168168 - DNA, 20 bp, Artificial Sequence
  Description of Artificial Sequence: Synthetic oligonucleotide
  Target: ATXN1; (-) strand; PAM type: YTN; PAM sequence: CTT
ccagactggcccctggagtg

SEQ ID NO: 168169 - DNA, 20 bp, Artificial Sequence
  Description of Artificial Sequence: Synthetic oligonucleotide
  Target: ATXN1; (-) strand; PAM type: YTN; PAM sequence: CTG
atcagatatggcttccagac

SEQ ID NO: 168170 - DNA, 20 bp, Artificial Sequence
  Description of Artificial Sequence: Synthetic oligonucleotide
  Target: ATXN1; (-) strand; PAM type: YTN; PAM sequence: CTA
acctgatcagatatggcttc

SEQ ID NO: 168171 - DNA, 20 bp, Artificial Sequence
  Description of Artificial Sequence: Synthetic oligonucleotide
  Target: ATXN1; (-) strand; PAM type: YTN; PAM sequence: CTA
tatcatgccctaacctgatc

SEQ ID NO: 168172 - DNA, 20 bp, Artificial Sequence
  Description of Artificial Sequence: Synthetic oligonucleotide
  Target: ATXN1; (-) strand; PAM type: YTN; PAM sequence: TTG
ggtggggacacagccaaact

SEQ ID NO: 168173 - DNA, 20 bp, Artificial Sequence
  Description of Artificial Sequence: Synthetic oligonucleotide
  Target: ATXN1; (-) strand; PAM type: YTN; PAM sequence: CTT
gggtggggacacagccaaac

SEQ ID NO: 168174 - DNA, 20 bp, Artificial Sequence
  Description of Artificial Sequence: Synthetic oligonucleotide
  Target: ATXN1; (-) strand; PAM type: YTN; PAM sequence: TTC
aggatgacacttgggtgggg

SEQ ID NO: 168175 - DNA, 20 bp, Artificial Sequence
  Description of Artificial Sequence: Synthetic oligonucleotide
  Target: ATXN1; (-) strand; PAM type: YTN; PAM sequence: CTA
cgattcaggatgacacttgg

SEQ ID NO: 168176 - DNA, 20 bp, Artificial Sequence
  Description of Artificial Sequence: Synthetic oligonucleotide
  Target: ATXN1; (-) strand; PAM type: YTN; PAM sequence: TTG
tgggagctacgattcaggat

SEQ ID NO: 168177 - DNA, 20 bp, Artificial Sequence
  Description of Artificial Sequence: Synthetic oligonucleotide
  Target: ATXN1; (-) strand; PAM type: YTN; PAM sequence: CTA
caatatgtgggaattgtggg

SEQ ID NO: 168178 - DNA, 20 bp, Artificial Sequence
  Description of Artificial Sequence: Synthetic oligonucleotide
  Target: ATXN1; (-) strand; PAM type: YTN; PAM sequence: CTC
ctacaatatgtgggaattgt

SEQ ID NO: 168179 - DNA, 20 bp, Artificial Sequence
  Description of Artificial Sequence: Synthetic oligonucleotide
  Target: ATXN1; (-) strand; PAM type: YTN; PAM sequence: CTC
ccagcaggtccctcctacaa

SEQ ID NO: 168180 - DNA, 20 bp, Artificial Sequence
  Description of Artificial Sequence: Synthetic oligonucleotide
  Target: ATXN1; (-) strand; PAM type: YTN; PAM sequence: TTG
tctcccagcaggtccctcct

SEQ ID NO: 168181 - DNA, 20 bp, Artificial Sequence
  Description of Artificial Sequence: Synthetic oligonucleotide
  Target: ATXN1; (-) strand; PAM type: YTN; PAM sequence: TTC
agttgtctcccagcaggtcc

SEQ ID NO: 168182 - DNA, 20 bp, Artificial Sequence
  Description of Artificial Sequence: Synthetic oligonucleotide
  Target: ATXN1; (-) strand; PAM type: YTN; PAM sequence: TTA
ttcagttgtctcccagcagg

SEQ ID NO: 168183 - DNA, 20 bp, Artificial Sequence
  Description of Artificial Sequence: Synthetic oligonucleotide
  Target: ATXN1; (-) strand; PAM type: YTN; PAM sequence: CTG
cccccattattcagttgtct

SEQ ID NO: 168184 - DNA, 20 bp, Artificial Sequence
  Description of Artificial Sequence: Synthetic oligonucleotide
  Target: ATXN1; (-) strand; PAM type: YTN; PAM sequence: CTA
ccacgagaacagtatggggg

SEQ ID NO: 168185 - DNA, 20 bp, Artificial Sequence
  Description of Artificial Sequence: Synthetic oligonucleotide
  Target: ATXN1; (-) strand; PAM type: YTN; PAM sequence: TTC
actaccacgagaacagtatg

SEQ ID NO: 168186 - DNA, 20 bp, Artificial Sequence
  Description of Artificial Sequence: Synthetic oligonucleotide
  Target: ATXN1; (-) strand; PAM type: YTN; PAM sequence: TTA
ttcactaccacgagaacagt

SEQ ID NO: 168187 - DNA, 20 bp, Artificial Sequence
  Description of Artificial Sequence: Synthetic oligonucleotide
  Target: ATXN1; (-) strand; PAM type: YTN; PAM sequence: CTT
attcactaccacgagaacag

SEQ ID NO: 168188 - DNA, 20 bp, Artificial Sequence
  Description of Artificial Sequence: Synthetic oligonucleotide
  Target: ATXN1; (-) strand; PAM type: YTN; PAM sequence: CTC
gtgagacttattcactacca

SEQ ID NO: 168189 - DNA, 20 bp, Artificial Sequence
  Description of Artificial Sequence: Synthetic oligonucleotide
  Target: ATXN1; (-) strand; PAM type: YTN; PAM sequence: TTA
taaaacaatcagatctcgtg

SEQ ID NO: 168190 - DNA, 20 bp, Artificial Sequence
  Description of Artificial Sequence: Synthetic oligonucleotide
  Target: ATXN1; (-) strand; PAM type: YTN; PAM sequence: CTT
ataaaacaatcagatctcgt

SEQ ID NO: 168191 - DNA, 20 bp, Artificial Sequence
  Description of Artificial Sequence: Synthetic oligonucleotide
  Target: ATXN1; (-) strand; PAM type: YTN; PAM sequence: CTC
ttataaaacaatcagatctc

SEQ ID NO: 168192 - DNA, 20 bp, Artificial Sequence
  Description of Artificial Sequence: Synthetic oligonucleotide
  Target: ATXN1; (-) strand; PAM type: YTN; PAM sequence: TTA
catggcagcaggcaagagaa

SEQ ID NO: 168193 - DNA, 20 bp, Artificial Sequence
  Description of Artificial Sequence: Synthetic oligonucleotide
  Target: ATXN1; (-) strand; PAM type: YTN; PAM sequence: CTT
acatggcagcaggcaagaga

SEQ ID NO: 168194 - DNA, 20 bp, Artificial Sequence
  Description of Artificial Sequence: Synthetic oligonucleotide
  Target: ATXN1; (-) strand; PAM type: YTN; PAM sequence: TTC
acaatcatggtggaaggcaa

SEQ ID NO: 168195 - DNA, 20 bp, Artificial Sequence
  Description of Artificial Sequence: Synthetic oligonucleotide
  Target: ATXN1; (-) strand; PAM type: YTN; PAM sequence: CTT
cacaatcatggtggaaggca

SEQ ID NO: 168196 - DNA, 20 bp, Artificial Sequence
  Description of Artificial Sequence: Synthetic oligonucleotide
  Target: ATXN1; (-) strand; PAM type: YTN; PAM sequence: CTG
gggaggcttcacaatcatgg

SEQ ID NO: 168197 - DNA, 20 bp, Artificial Sequence
  Description of Artificial Sequence: Synthetic oligonucleotide
  Target: ATXN1; (-) strand; PAM type: YTN; PAM sequence: TTC
cacgtggctggggaggcttc

SEQ ID NO: 168198 - DNA, 20 bp, Artificial Sequence
  Description of Artificial Sequence: Synthetic oligonucleotide
  Target: ATXN1; (-) strand; PAM type: YTN; PAM sequence: CTC
acagttccacgtggctgggg

SEQ ID NO: 168199 - DNA, 20 bp, Artificial Sequence
  Description of Artificial Sequence: Synthetic oligonucleotide
  Target: ATXN1; (-) strand; PAM type: YTN; PAM sequence: TTA
atggactcacagttccacgt

SEQ ID NO: 168200 - DNA, 20 bp, Artificial Sequence
  Description of Artificial Sequence: Synthetic oligonucleotide
  Target: ATXN1; (-) strand; PAM type: YTN; PAM sequence: TTT
aatggactcacagttccacg

SEQ ID NO: 168201 - DNA, 20 bp, Artificial Sequence
  Description of Artificial Sequence: Synthetic oligonucleotide
  Target: ATXN1; (-) strand; PAM type: YTN; PAM sequence: TTA
taaagaaaaagaggtttaat

SEQ ID NO: 168202 - DNA, 20 bp, Artificial Sequence
  Description of Artificial Sequence: Synthetic oligonucleotide
  Target: ATXN1; (-) strand; PAM type: YTN; PAM sequence: TTT
ataaagaaaaagaggtttaa

SEQ ID NO: 168203 - DNA, 20 bp, Artificial Sequence
  Description of Artificial Sequence: Synthetic oligonucleotide
  Target: ATXN1; (-) strand; PAM type: YTN; PAM sequence: CTA
ggtaatttataaagaaaaag

SEQ ID NO: 168204 - DNA, 20 bp, Artificial Sequence
  Description of Artificial Sequence: Synthetic oligonucleotide
  Target: ATXN1; (-) strand; PAM type: YTN; PAM sequence: CTA
ataaagacatacccaagcct

SEQ ID NO: 168205 - DNA, 20 bp, Artificial Sequence
  Description of Artificial Sequence: Synthetic oligonucleotide
  Target: ATXN1; (-) strand; PAM type: YTN; PAM sequence: CTG
ctaataaagacatacccaag

SEQ ID NO: 168206 - DNA, 20 bp, Artificial Sequence
  Description of Artificial Sequence: Synthetic oligonucleotide
  Target: ATXN1; (-) strand; PAM type: YTN; PAM sequence: TTC
atgctgctaataaagacata

SEQ ID NO: 168207 - DNA, 20 bp, Artificial Sequence
  Description of Artificial Sequence: Synthetic oligonucleotide
  Target: ATXN1; (-) strand; PAM type: YTN; PAM sequence: TTT
catgctgctaataaagacat

SEQ ID NO: 168208 - DNA, 20 bp, Artificial Sequence
  Description of Artificial Sequence: Synthetic oligonucleotide
  Target: ATXN1; (-) strand; PAM type: YTN; PAM sequence: TTT
tcatgctgctaataaagaca

SEQ ID NO: 168209 - DNA, 20 bp, Artificial Sequence
  Description of Artificial Sequence: Synthetic oligonucleotide
  Target: ATXN1; (-) strand; PAM type: YTN; PAM sequence: CTG
ttttcatgctgctaataaag

SEQ ID NO: 168210 - DNA, 20 bp, Artificial Sequence
  Description of Artificial Sequence: Synthetic oligonucleotide
  Target: ATXN1; (-) strand; PAM type: YTN; PAM sequence: TTA
gtctgttttcatgctgctaa

SEQ ID NO: 168211 - DNA, 20 bp, Artificial Sequence
  Description of Artificial Sequence: Synthetic oligonucleotide
  Target: ATXN1; (-) strand; PAM type: YTN; PAM sequence: CTG
tattagtctgttttcatgct

SEQ ID NO: 168212 - DNA, 20 bp, Artificial Sequence
  Description of Artificial Sequence: Synthetic oligonucleotide
  Target: ATXN1; (-) strand; PAM type: YTN; PAM sequence: TTG
ggtgtgatgccctgtattag

SEQ ID NO: 168213 - DNA, 20 bp, Artificial Sequence
  Description of Artificial Sequence: Synthetic oligonucleotide
  Target: ATXN1; (-) strand; PAM type: YTN; PAM sequence: TTT
gggtgtgatgccctgtatta

SEQ ID NO: 168214 - DNA, 20 bp, Artificial Sequence
  Description of Artificial Sequence: Synthetic oligonucleotide
  Target: ATXN1; (-) strand; PAM type: YTN; PAM sequence: CTA
atttgggtgtgatgccctgt

SEQ ID NO: 168215 - DNA, 20 bp, Artificial Sequence
  Description of Artificial Sequence: Synthetic oligonucleotide
  Target: ATXN1; (-) strand; PAM type: YTN; PAM sequence: TTC
atatggaagtagaggagaaa

SEQ ID NO: 168216 - DNA, 20 bp, Artificial Sequence
  Description of Artificial Sequence: Synthetic oligonucleotide
  Target: ATXN1; (-) strand; PAM type: YTN; PAM sequence: TTA
cagagttcatatggaagtag

SEQ ID NO: 168217 - DNA, 20 bp, Artificial Sequence
  Description of Artificial Sequence: Synthetic oligonucleotide
  Target: ATXN1; (-) strand; PAM type: YTN; PAM sequence: TTA
tcagcaataggaaaagcatt

SEQ ID NO: 168218 - DNA, 20 bp, Artificial Sequence
  Description of Artificial Sequence: Synthetic oligonucleotide
  Target: ATXN1; (-) strand; PAM type: YTN; PAM sequence: TTG
ttatcagcaataggaaaagc

SEQ ID NO: 168219 - DNA, 20 bp, Artificial Sequence
  Description of Artificial Sequence: Synthetic oligonucleotide
  Target: ATXN1; (-) strand; PAM type: YTN; PAM sequence: CTG
caaccaggttgttatcagca

SEQ ID NO: 168220 - DNA, 20 bp, Artificial Sequence
  Description of Artificial Sequence: Synthetic oligonucleotide
  Target: ATXN1; (-) strand; PAM type: YTN; PAM sequence: TTG
gtctgcaaccaggttgttat

SEQ ID NO: 168221 - DNA, 20 bp, Artificial Sequence
  Description of Artificial Sequence: Synthetic oligonucleotide
  Target: ATXN1; (-) strand; PAM type: YTN; PAM sequence: TTG
atataacatgttggtctgca

SEQ ID NO: 168222 - DNA, 20 bp, Artificial Sequence
  Description of Artificial Sequence: Synthetic oligonucleotide
  Target: ATXN1; (-) strand; PAM type: YTN; PAM sequence: TTA
cagaacattgatataacatg

SEQ ID NO: 168223 - DNA, 20 bp, Artificial Sequence
  Description of Artificial Sequence: Synthetic oligonucleotide
  Target: ATXN1; (-) strand; PAM type: YTN; PAM sequence: TTT
acagaacattgatataacat

SEQ ID NO: 168224 - DNA, 20 bp, Artificial Sequence
  Description of Artificial Sequence: Synthetic oligonucleotide
  Target: ATXN1; (-) strand; PAM type: YTN; PAM sequence: CTA
tttacagaacattgatataa

SEQ ID NO: 168225 - DNA, 20 bp, Artificial Sequence
  Description of Artificial Sequence: Synthetic oligonucleotide
  Target: ATXN1; (-) strand; PAM type: YTN; PAM sequence: TTA
tgtaacatgtgcctatttac

SEQ ID NO: 168226 - DNA, 20 bp, Artificial Sequence
  Description of Artificial Sequence: Synthetic oligonucleotide
  Target: ATXN1; (-) strand; PAM type: YTN; PAM sequence: TTT
atgtaacatgtgcctattta

SEQ ID NO: 168227 - DNA, 20 bp, Artificial Sequence
  Description of Artificial Sequence: Synthetic oligonucleotide
  Target: ATXN1; (-) strand; PAM type: YTN; PAM sequence: CTT
tatgtaacatgtgcctattt

SEQ ID NO: 168228 - DNA, 20 bp, Artificial Sequence
  Description of Artificial Sequence: Synthetic oligonucleotide
  Target: ATXN1; (-) strand; PAM type: YTN; PAM sequence: TTA
tgccgtggtgctttatgtaa

SEQ ID NO: 168229 - DNA, 20 bp, Artificial Sequence
  Description of Artificial Sequence: Synthetic oligonucleotide
  Target: ATXN1; (-) strand; PAM type: YTN; PAM sequence: TTT
atgccgtggtgctttatgta

SEQ ID NO: 168230 - DNA, 20 bp, Artificial Sequence
  Description of Artificial Sequence: Synthetic oligonucleotide
  Target: ATXN1; (-) strand; PAM type: YTN; PAM sequence: CTG
gtttatgccgtggtgcttta

SEQ ID NO: 168231 - DNA, 20 bp, Artificial Sequence
  Description of Artificial Sequence: Synthetic oligonucleotide
  Target: ATXN1; (-) strand; PAM type: YTN; PAM sequence: TTA
tcacctggtttatgccgtgg

SEQ ID NO: 168232 - DNA, 20 bp, Artificial Sequence
  Description of Artificial Sequence: Synthetic oligonucleotide
  Target: ATXN1; (-) strand; PAM type: YTN; PAM sequence: TTA
caatgtattatcacctggtt

SEQ ID NO: 168233 - DNA, 20 bp, Artificial Sequence
  Description of Artificial Sequence: Synthetic oligonucleotide
  Target: ATXN1; (-) strand; PAM type: YTN; PAM sequence: TTA
gagtgtcattacaatgtatt

SEQ ID NO: 168234 - DNA, 20 bp, Artificial Sequence
  Description of Artificial Sequence: Synthetic oligonucleotide
  Target: ATXN1; (-) strand; PAM type: YTN; PAM sequence: TTT
agagtgtcattacaatgtat

SEQ ID NO: 168235 - DNA, 20 bp, Artificial Sequence
  Description of Artificial Sequence: Synthetic oligonucleotide
  Target: ATXN1; (-) strand; PAM type: YTN; PAM sequence: TTT
tagagtgtcattacaatgta

SEQ ID NO: 168236 - DNA, 20 bp, Artificial Sequence
  Description of Artificial Sequence: Synthetic oligonucleotide
  Target: ATXN1; (-) strand; PAM type: YTN; PAM sequence: TTT
ttagagtgtcattacaatgt

SEQ ID NO: 168237 - DNA, 20 bp, Artificial Sequence
  Description of Artificial Sequence: Synthetic oligonucleotide
  Target: ATXN1; (-) strand; PAM type: YTN; PAM sequence: CTA
catttttagagtgtcattac

SEQ ID NO: 168238 - DNA, 20 bp, Artificial Sequence
  Description of Artificial Sequence: Synthetic oligonucleotide
  Target: ATXN1; (-) strand; PAM type: YTN; PAM sequence: TTA
ctacatttttagagtgtcat

SEQ ID NO: 168239 - DNA, 20 bp, Artificial Sequence
  Description of Artificial Sequence: Synthetic oligonucleotide
  Target: ATXN1; (-) strand; PAM type: YTN; PAM sequence: TTG
agtgattactacatttttag

SEQ ID NO: 168240 - DNA, 20 bp, Artificial Sequence
  Description of Artificial Sequence: Synthetic oligonucleotide
  Target: ATXN1; (-) strand; PAM type: YTN; PAM sequence: TTA
ttgagtgattactacatttt

SEQ ID NO: 168241 - DNA, 20 bp, Artificial Sequence
  Description of Artificial Sequence: Synthetic oligonucleotide
  Target: ATXN1; (-) strand; PAM type: YTN; PAM sequence: TTT
attgagtgattactacattt

SEQ ID NO: 168242 - DNA, 20 bp, Artificial Sequence
  Description of Artificial Sequence: Synthetic oligonucleotide
  Target: ATXN1; (-) strand; PAM type: YTN; PAM sequence: TTT
tattgagtgattactacatt

SEQ ID NO: 168243 - DNA, 20 bp, Artificial Sequence
  Description of Artificial Sequence: Synthetic oligonucleotide
  Target: ATXN1; (-) strand; PAM type: YTN; PAM sequence: CTA
aggattttattgagtgatta

SEQ ID NO: 168244 - DNA, 20 bp, Artificial Sequence
  Description of Artificial Sequence: Synthetic oligonucleotide
  Target: ATXN1; (-) strand; PAM type: YTN; PAM sequence: TTC
gaggtatatagcagatgcta

SEQ ID NO: 168245 - DNA, 20 bp, Artificial Sequence
  Description of Artificial Sequence: Synthetic oligonucleotide
  Target: ATXN1; (-) strand; PAM type: YTN; PAM sequence: CTG
gtataattcgaggtatatag

SEQ ID NO: 168246 - DNA, 20 bp, Artificial Sequence
  Description of Artificial Sequence: Synthetic oligonucleotide
  Target: ATXN1; (-) strand; PAM type: YTN; PAM sequence: TTC
tggtataattcgaggtatat

SEQ ID NO: 168247 - DNA, 20 bp, Artificial Sequence
  Description of Artificial Sequence: Synthetic oligonucleotide
  Target: ATXN1; (-) strand; PAM type: YTN; PAM sequence: CTT
ctggtataattcgaggtata

SEQ ID NO: 168248 - DNA, 20 bp, Artificial Sequence
  Description of Artificial Sequence: Synthetic oligonucleotide
  Target: ATXN1; (-) strand; PAM type: YTN; PAM sequence: CTA
aaagcttctggtataattcg

SEQ ID NO: 168249 - DNA, 20 bp, Artificial Sequence
  Description of Artificial Sequence: Synthetic oligonucleotide
  Target: ATXN1; (-) strand; PAM type: YTN; PAM sequence: CTC
atatcctaaaagcttctggt

SEQ ID NO: 168250 - DNA, 20 bp, Artificial Sequence
  Description of Artificial Sequence: Synthetic oligonucleotide
  Target: ATXN1; (-) strand; PAM type: YTN; PAM sequence: TTG
ctcatatcctaaaagcttct

SEQ ID NO: 168251 - DNA, 20 bp, Artificial Sequence
  Description of Artificial Sequence: Synthetic oligonucleotide
  Target: ATXN1; (-) strand; PAM type: YTN; PAM sequence: TTT
gctcatatcctaaaagcttc

SEQ ID NO: 168252 - DNA, 20 bp, Artificial Sequence
  Description of Artificial Sequence: Synthetic oligonucleotide
  Target: ATXN1; (-) strand; PAM type: YTN; PAM sequence: TTT
tgctcatatcctaaaagctt

SEQ ID NO: 168253 - DNA, 20 bp, Artificial Sequence
  Description of Artificial Sequence: Synthetic oligonucleotide
  Target: ATXN1; (-) strand; PAM type: YTN; PAM sequence: TTT
ttgctcatatcctaaaagct

SEQ ID NO: 168254 - DNA, 20 bp, Artificial Sequence
  Description of Artificial Sequence: Synthetic oligonucleotide
  Target: ATXN1; (-) strand; PAM type: YTN; PAM sequence: TTT
tttgctcatatcctaaaagc

SEQ ID NO: 168255 - DNA, 20 bp, Artificial Sequence
  Description of Artificial Sequence: Synthetic oligonucleotide
  Target: ATXN1; (-) strand; PAM type: YTN; PAM sequence: TTT
ttttgctcatatcctaaaag

SEQ ID NO: 168256 - DNA, 20 bp, Artificial Sequence
  Description of Artificial Sequence: Synthetic oligonucleotide
  Target: ATXN1; (-) strand; PAM type: YTN; PAM sequence: TTT
tttttgctcatatcctaaaa

SEQ ID NO: 168257 - DNA, 20 bp, Artificial Sequence
  Description of Artificial Sequence: Synthetic oligonucleotide
  Target: ATXN1; (-) strand; PAM type: YTN; PAM sequence: TTT
ttttttgctcatatcctaaa

SEQ ID NO: 168258 - DNA, 20 bp, Artificial Sequence
  Description of Artificial Sequence: Synthetic oligonucleotide
  Target: ATXN1; (-) strand; PAM type: YTN; PAM sequence: TTT
tttttttgctcatatcctaa

SEQ ID NO: 168259 - DNA, 20 bp, Artificial Sequence
  Description of Artificial Sequence: Synthetic oligonucleotide
  Target: ATXN1; (-) strand; PAM type: YTN; PAM sequence: TTT
ttttttttgctcatatccta

SEQ ID NO: 168260 - DNA, 20 bp, Artificial Sequence
  Description of Artificial Sequence: Synthetic oligonucleotide
  Target: ATXN1; (-) strand; PAM type: YTN; PAM sequence: TTT
tttttttttgctcatatcct

SEQ ID NO: 168261 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgctcatatcc

SEQ ID NO: 168262 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgctcatatc

SEQ ID NO: 168263 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgctcatat

SEQ ID NO: 168264 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgctcata

SEQ ID NO: 168265 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgctcat

SEQ ID NO: 168266 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgctca

SEQ ID NO: 168267 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttttgctc

SEQ ID NO: 168268 - DNA, 20 bp, Artificial Sequence
  Description of Artificial Sequence: Synthetic oligonucleotide
  Target: ATXN1; (-) strand; PAM type: YTN; PAM sequence: CTA
tgtctttttttttttttttt

SEQ ID NO: 168269 - DNA, 20 bp, Artificial Sequence
  Description of Artificial Sequence: Synthetic oligonucleotide
  Target: ATXN1; (-) strand; PAM type: YTN; PAM sequence: TTA
gcagggtctatgtctttttt

SEQ ID NO: 168270 - DNA, 20 bp, Artificial Sequence
  Description of Artificial Sequence: Synthetic oligonucleotide
  Target: ATXN1; (-) strand; PAM type: YTN; PAM sequence: TTT
agcagggtctatgtcttttt

SEQ ID NO: 168271 - DNA, 20 bp, Artificial Sequence
  Description of Artificial Sequence: Synthetic oligonucleotide
  Target: ATXN1; (-) strand; PAM type: YTN; PAM sequence: TTT
tagcagggtctatgtctttt

SEQ ID NO: 168272 - DNA, 20 bp, Artificial Sequence
  Description of Artificial Sequence: Synthetic oligonucleotide
  Target: ATXN1; (-) strand; PAM type: YTN; PAM sequence: TTT
ttagcagggtctatgtcttt

SEQ ID NO: 168273 - DNA, 20 bp, Artificial Sequence
  Description of Artificial Sequence: Synthetic oligonucleotide
  Target: ATXN1; (-) strand; PAM type: YTN; PAM sequence: CTT
tttagcagggtctatgtctt

SEQ ID NO: 168274 - DNA, 20 bp, Artificial Sequence
  Description of Artificial Sequence: Synthetic oligonucleotide
  Target: ATXN1; (-) strand; PAM type: YTN; PAM sequence: TTC
ctttttagcagggtctatgt

SEQ ID NO: 168275 - DNA, 20 bp, Artificial Sequence
  Description of Artificial Sequence: Synthetic oligonucleotide
  Target: ATXN1; (-) strand; PAM type: YTN; PAM sequence: TTG
taagttcctttttagcaggg

SEQ ID NO: 168276 - DNA, 20 bp, Artificial Sequence
  Description of Artificial Sequence: Synthetic oligonucleotide
  Target: ATXN1; (-) strand; PAM type: YTN; PAM sequence: CTG
gattgtaagttcctttttag

SEQ ID NO: 168277 - DNA, 20 bp, Artificial Sequence
  Description of Artificial Sequence: Synthetic oligonucleotide
  Target: ATXN1; (-) strand; PAM type: YTN; PAM sequence: TTC
aagctggattgtaagttcct

SEQ ID NO: 168278 - DNA, 20 bp, Artificial Sequence
  Description of Artificial Sequence: Synthetic oligonucleotide
  Target: ATXN1; (-) strand; PAM type: YTN; PAM sequence: CTT
caagctggattgtaagttcc

SEQ ID NO: 168279 - DNA, 20 bp, Artificial Sequence
  Description of Artificial Sequence: Synthetic oligonucleotide
  Target: ATXN1; (-) strand; PAM type: YTN; PAM sequence: TTC
ttcaagctggattgtaagtt

SEQ ID NO: 168280 - DNA, 20 bp, Artificial Sequence
  Description of Artificial Sequence: Synthetic oligonucleotide
  Target: ATXN1; (-) strand; PAM type: YTN; PAM sequence: TTT
cttcaagctggattgtaagt

SEQ ID NO: 168281 - DNA, 20 bp, Artificial Sequence
  Description of Artificial Sequence: Synthetic oligonucleotide
  Target: ATXN1; (-) strand; PAM type: YTN; PAM sequence: TTA
tttcttcaagctggattgta

SEQ ID NO: 168282 - DNA, 20 bp, Artificial Sequence
  Description of Artificial Sequence: Synthetic oligonucleotide
  Target: ATXN1; (-) strand; PAM type: YTN; PAM sequence: TTT
atttcttcaagctggattgt

SEQ ID NO: 168283 - DNA, 20 bp, Artificial Sequence
  Description of Artificial Sequence: Synthetic oligonucleotide
  Target: ATXN1; (-) strand; PAM type: YTN; PAM sequence: CTT
tatttcttcaagctggattg

SEQ ID NO: 168284 - DNA, 20 bp, Artificial Sequence
  Description of Artificial Sequence: Synthetic oligonucleotide
  Target: ATXN1; (-) strand; PAM type: YTN; PAM sequence: TTA
tgtgtgggctttatttcttc

SEQ ID NO: 168285 - DNA, 20 bp, Artificial Sequence
  Description of Artificial Sequence: Synthetic oligonucleotide
  Target: ATXN1; (-) strand; PAM type: YTN; PAM sequence: TTT
atgtgtgggctttatttctt

SEQ ID NO: 168286 - DNA, 20 bp, Artificial Sequence
  Description of Artificial Sequence: Synthetic oligonucleotide
  Target: ATXN1; (-) strand; PAM type: YTN; PAM sequence: TTT
tatgtgtgggctttatttct

SEQ ID NO: 168287 - DNA, 20 bp, Artificial Sequence
  Description of Artificial Sequence: Synthetic oligonucleotide
  Target: ATXN1; (-) strand; PAM type: YTN; PAM sequence: TTT
ttatgtgtgggctttatttc

SEQ ID NO: 168288 - DNA, 20 bp, Artificial Sequence
  Description of Artificial Sequence: Synthetic oligonucleotide
  Target: ATXN1; (-) strand; PAM type: YTN; PAM sequence: TTT
tttatgtgtgggctttattt

SEQ ID NO: 168289 - DNA, 20 bp, Artificial Sequence
  Description of Artificial Sequence: Synthetic oligonucleotide
  Target: ATXN1; (-) strand; PAM type: YTN; PAM sequence: TTT
ttttatgtgtgggctttatt

SEQ ID NO: 168290 - DNA, 20 bp, Artificial Sequence
  Description of Artificial Sequence: Synthetic oligonucleotide
  Target: ATXN1; (-) strand; PAM type: YTN; PAM sequence: CTA
atttttttatgtgtgggctt

SEQ ID NO: 168291 - DNA, 20 bp, Artificial Sequence
  Description of Artificial Sequence: Synthetic oligonucleotide
  Target: ATXN1; (-) strand; PAM type: YTN; PAM sequence: TTC
cctaatttttttatgtgtgg

SEQ ID NO: 168292 - DNA, 20 bp, Artificial Sequence
  Description of Artificial Sequence: Synthetic oligonucleotide
  Target: ATXN1; (-) strand; PAM type: YTN; PAM sequence: TTG
ttccctaatttttttatgtg

SEQ ID NO: 168293 - DNA, 20 bp, Artificial Sequence
  Description of Artificial Sequence: Synthetic oligonucleotide
  Target: ATXN1; (-) strand; PAM type: YTN; PAM sequence: CTT
gttccctaatttttttatgt

SEQ ID NO: 168294 - DNA, 20 bp, Artificial Sequence
  Description of Artificial Sequence: Synthetic oligonucleotide
  Target: ATXN1; (-) strand; PAM type: YTN; PAM sequence: CTG
aatatggtcttgttccctaa

SEQ ID NO: 168295 - DNA, 20 bp, Artificial Sequence
  Description of Artificial Sequence: Synthetic oligonucleotide
  Target: ATXN1; (-) strand; PAM type: YTN; PAM sequence: TTA
actgaatatggtcttgttcc

SEQ ID NO: 168296 - DNA, 20 bp, Artificial Sequence
  Description of Artificial Sequence: Synthetic oligonucleotide
  Target: ATXN1; (-) strand; PAM type: YTN; PAM sequence: CTT
aactgaatatggtcttgttc

SEQ ID NO: 168297 - DNA, 20 bp, Artificial Sequence
  Description of Artificial Sequence: Synthetic oligonucleotide
  Target: ATXN1; (-) strand; PAM type: YTN; PAM sequence: TTG
cacttaactgaatatggtct

SEQ ID NO: 168298 - DNA, 20 bp, Artificial Sequence
  Description of Artificial Sequence: Synthetic oligonucleotide
  Target: ATXN1; (-) strand; PAM type: YTN; PAM sequence: TTT
gcacttaactgaatatggtc

SEQ ID NO: 168299 - DNA, 20 bp, Artificial Sequence
  Description of Artificial Sequence: Synthetic oligonucleotide
  Target: ATXN1; (-) strand; PAM type: YTN; PAM sequence: TTT
tgcacttaactgaatatggt

SEQ ID NO: 168300 - DNA, 20 bp, Artificial Sequence
  Description of Artificial Sequence: Synthetic oligonucleotide
  Target: ATXN1; (-) strand; PAM type: YTN; PAM sequence: TTT
ttgcacttaactgaatatgg

SEQ ID NO: 168301 - DNA, 20 bp, Artificial Sequence
  Description of Artificial Sequence: Synthetic oligonucleotide
  Target: ATXN1; (-) strand; PAM type: YTN; PAM sequence: TTC
aatttttgcacttaactgaa

SEQ ID NO: 168302 - DNA, 20 bp, Artificial Sequence
  Description of Artificial Sequence: Synthetic oligonucleotide
  Target: ATXN1; (-) strand; PAM type: YTN; PAM sequence: TTT
caatttttgcacttaactga

SEQ ID NO: 168303 - DNA, 20 bp, Artificial Sequence
  Description of Artificial Sequence: Synthetic oligonucleotide
  Target: ATXN1; (-) strand; PAM type: YTN; PAM sequence: TTT
tcaatttttgcacttaactg

SEQ ID NO: 168304 - DNA, 20 bp, Artificial Sequence
  Description of Artificial Sequence: Synthetic oligonucleotide
  Target: ATXN1; (-) strand; PAM type: YTN; PAM sequence: CTT
ttcaatttttgcacttaact

SEQ ID NO: 168305 - DNA, 20 bp, Artificial Sequence
  Description of Artificial Sequence: Synthetic oligonucleotide
  Target: ATXN1; (-) strand; PAM type: YTN; PAM sequence: CTA
atcgagcatacttttcaatt

SEQ ID NO: 168306 - DNA, 20 bp, Artificial Sequence
  Description of Artificial Sequence: Synthetic oligonucleotide
  Target: ATXN1; (-) strand; PAM type: YTN; PAM sequence: TTG
ctaatcgagcatacttttca

SEQ ID NO: 168307 - DNA, 20 bp, Artificial Sequence
  Description of Artificial Sequence: Synthetic oligonucleotide
  Target: ATXN1; (-) strand; PAM type: YTN; PAM sequence: CTT
gctaatcgagcatacttttc

SEQ ID NO: 168308 - DNA, 20 bp, Artificial Sequence
  Description of Artificial Sequence: Synthetic oligonucleotide
  Target: ATXN1; (-) strand; PAM type: YTN; PAM sequence: CTA
gcttgctaatcgagcatact

SEQ ID NO: 168309 - DNA, 20 bp, Artificial Sequence
  Description of Artificial Sequence: Synthetic oligonucleotide
  Target: ATXN1; (-) strand; PAM type: YTN; PAM sequence: CTC
tagcttgctaatcgagcata

SEQ ID NO: 168310 - DNA, 20 bp, Artificial Sequence
  Description of Artificial Sequence: Synthetic oligonucleotide
  Target: ATXN1; (-) strand; PAM type: YTN; PAM sequence: CTA
ataaaccctctagcttgcta

SEQ ID NO: 168311 - DNA, 20 bp, Artificial Sequence
  Description of Artificial Sequence: Synthetic oligonucleotide
  Target: ATXN1; (-) strand; PAM type: YTN; PAM sequence: TTC
taataaaccctctagcttgc

SEQ ID NO: 168312 - DNA, 20 bp, Artificial Sequence
  Description of Artificial Sequence: Synthetic oligonucleotide
  Target: ATXN1; (-) strand; PAM type: YTN; PAM sequence: TTT
ctaataaaccctctagcttg

SEQ ID NO: 168313 - DNA, 20 bp, Artificial Sequence
  Description of Artificial Sequence: Synthetic oligonucleotide
  Target: ATXN1; (-) strand; PAM type: YTN; PAM sequence: TTA
tttctaataaaccctctagc

SEQ ID NO: 168314 - DNA, 20 bp, Artificial Sequence
  Description of Artificial Sequence: Synthetic oligonucleotide
  Target: ATXN1; (-) strand; PAM type: YTN; PAM sequence: CTG
ttatttctaataaaccctct

SEQ ID NO: 168315 - DNA, 20 bp, Artificial Sequence
  Description of Artificial Sequence: Synthetic oligonucleotide
  Target: ATXN1; (-) strand; PAM type: YTN; PAM sequence: CTA
ctgttatttctaataaaccc

SEQ ID NO: 168316 - DNA, 20 bp, Artificial Sequence
  Description of Artificial Sequence: Synthetic oligonucleotide
  Target: ATXN1; (-) strand; PAM type: YTN; PAM sequence: TTA
agctactgttatttctaata

SEQ ID NO: 168317 - DNA, 20 bp, Artificial Sequence
  Description of Artificial Sequence: Synthetic oligonucleotide
  Target: ATXN1; (-) strand; PAM type: YTN; PAM sequence: TTT
aagctactgttatttctaat

SEQ ID NO: 168318 - DNA, 20 bp, Artificial Sequence
  Description of Artificial Sequence: Synthetic oligonucleotide
  Target: ATXN1; (-) strand; PAM type: YTN; PAM sequence: TTT
taagctactgttatttctaa

SEQ ID NO: 168319 - DNA, 20 bp, Artificial Sequence
  Description of Artificial Sequence: Synthetic oligonucleotide
  Target: ATXN1; (-) strand; PAM type: YTN; PAM sequence: TTT
ttaagctactgttatttcta

SEQ ID NO: 168320 - DNA, 20 bp, Artificial Sequence
  Description of Artificial Sequence: Synthetic oligonucleotide
  Target: ATXN1; (-) strand; PAM type: YTN; PAM sequence: TTA
tagtagggaagtttttaagc

SEQ ID NO: 168321 - DNA, 20 bp, Artificial Sequence
  Description of Artificial Sequence: Synthetic oligonucleotide
  Target: ATXN1; (-) strand; PAM type: YTN; PAM sequence: TTT
atagtagggaagtttttaag

SEQ ID NO: 168322 - DNA, 20 bp, Artificial Sequence
  Description of Artificial Sequence: Synthetic oligonucleotide
  Target: ATXN1; (-) strand; PAM type: YTN; PAM sequence: TTT
tatagtagggaagtttttaa

SEQ ID NO: 168323 - DNA, 20 bp, Artificial Sequence
  Description of Artificial Sequence: Synthetic oligonucleotide
  Target: ATXN1; (-) strand; PAM type: YTN; PAM sequence: TTT
ttatagtagggaagttttta

SEQ ID NO: 168324 - DNA, 20 bp, Artificial Sequence
  Description of Artificial Sequence: Synthetic oligonucleotide
  Target: ATXN1; (-) strand; PAM type: YTN; PAM sequence: CTA
tggtttttatagtagggaag

SEQ ID NO: 168325 - DNA, 20 bp, Artificial Sequence
  Description of Artificial Sequence: Synthetic oligonucleotide
  Target: ATXN1; (-) strand; PAM type: YTN; PAM sequence: TTA
aactatggtttttatagtag

SEQ ID NO: 168326 - DNA, 20 bp, Artificial Sequence
  Description of Artificial Sequence: Synthetic oligonucleotide
  Target: ATXN1; (-) strand; PAM type: YTN; PAM sequence: CTT
aaactatggtttttatagta

SEQ ID NO: 168327 - DNA, 20 bp, Artificial Sequence
  Description of Artificial Sequence: Synthetic oligonucleotide
  Target: ATXN1; (-) strand; PAM type: YTN; PAM sequence: TTA
aagcaggcttaaactatggt

SEQ ID NO: 168328 - DNA, 20 bp, Artificial Sequence
  Description of Artificial Sequence: Synthetic oligonucleotide
  Target: ATXN1; (-) strand; PAM type: YTN; PAM sequence: CTA
atgttaaagcaggcttaaac

SEQ ID NO: 168329 - DNA, 20 bp, Artificial Sequence
  Description of Artificial Sequence: Synthetic oligonucleotide
  Target: ATXN1; (-) strand; PAM type: YTN; PAM sequence: TTG
tgggaaaccagatctaatgt

SEQ ID NO: 168330 - DNA, 20 bp, Artificial Sequence
  Description of Artificial Sequence: Synthetic oligonucleotide
  Target: ATXN1; (-) strand; PAM type: YTN; PAM sequence: TTA
atcagttgtgggaaaccaga

SEQ ID NO: 168331 - DNA, 20 bp, Artificial Sequence
  Description of Artificial Sequence: Synthetic oligonucleotide
  Target: ATXN1; (-) strand; PAM type: YTN; PAM sequence: TTC
aggttaatcagttgtgggaa

SEQ ID NO: 168332 - DNA, 20 bp, Artificial Sequence
  Description of Artificial Sequence: Synthetic oligonucleotide
  Target: ATXN1; (-) strand; PAM type: YTN; PAM sequence: TTT
caggttaatcagttgtggga

SEQ ID NO: 168333 - DNA, 20 bp, Artificial Sequence
  Description of Artificial Sequence: Synthetic oligonucleotide
  Target: ATXN1; (-) strand; PAM type: YTN; PAM sequence: TTT
tcaggttaatcagttgtggg

SEQ ID NO: 168334 - DNA, 20 bp, Artificial Sequence
  Description of Artificial Sequence: Synthetic oligonucleotide
  Target: ATXN1; (-) strand; PAM type: YTN; PAM sequence: CTA
aaccattttcaggttaatca

SEQ ID NO: 168335 - DNA, 20 bp, Artificial Sequence
  Description of Artificial Sequence: Synthetic oligonucleotide
  Target: ATXN1; (-) strand; PAM type: YTN; PAM sequence: TTG
tgctaaaccattttcaggtt

SEQ ID NO: 168336 - DNA, 20 bp, Artificial Sequence
  Description of Artificial Sequence: Synthetic oligonucleotide
  Target: ATXN1; (-) strand; PAM type: YTN; PAM sequence: TTA
gtgttgtgctaaaccatttt

SEQ ID NO: 168337 - DNA, 20 bp, Artificial Sequence
  Description of Artificial Sequence: Synthetic oligonucleotide
  Target: ATXN1; (-) strand; PAM type: YTN; PAM sequence: TTA
aaggattagtgttgtgctaa

SEQ ID NO: 168338 - DNA, 20 bp, Artificial Sequence
  Description of Artificial Sequence: Synthetic oligonucleotide
  Target: ATXN1; (-) strand; PAM type: YTN; PAM sequence: TTA
aattaaaggattagtgttgt

SEQ ID NO: 168339 - DNA, 20 bp, Artificial Sequence
  Description of Artificial Sequence: Synthetic oligonucleotide
  Target: ATXN1; (-) strand; PAM type: YTN; PAM sequence: TTG
ttaaattaaaggattagtgt

SEQ ID NO: 168340 - DNA, 20 bp, Artificial Sequence
  Description of Artificial Sequence: Synthetic oligonucleotide
  Target: ATXN1; (-) strand; PAM type: YTN; PAM sequence: TTA
taggttgttaaattaaagga

SEQ ID NO: 168341 - DNA, 20 bp, Artificial Sequence
  Description of Artificial Sequence: Synthetic oligonucleotide
  Target: ATXN1; (-) strand; PAM type: YTN; PAM sequence: TTT
ataggttgttaaattaaagg

SEQ ID NO: 168342 - DNA, 20 bp, Artificial Sequence
  Description of Artificial Sequence: Synthetic oligonucleotide
  Target: ATXN1; (-) strand; PAM type: YTN; PAM sequence: TTA
tatacggcatttataggttg

SEQ ID NO: 168343 - DNA, 20 bp, Artificial Sequence
  Description of Artificial Sequence: Synthetic oligonucleotide
  Target: ATXN1; (-) strand; PAM type: YTN; PAM sequence: TTG
ttatatacggcatttatagg

SEQ ID NO: 168344 - DNA, 20 bp, Artificial Sequence
  Description of Artificial Sequence: Synthetic oligonucleotide
  Target: ATXN1; (-) strand; PAM type: YTN; PAM sequence: CTT
gttatatacggcatttatag

SEQ ID NO: 168345 - DNA, 20 bp, Artificial Sequence
  Description of Artificial Sequence: Synthetic oligonucleotide
  Target: ATXN1; (-) strand; PAM type: YTN; PAM sequence: CTG
tggaacttgttatatacggc

SEQ ID NO: 168346 - DNA, 20 bp, Artificial Sequence
  Description of Artificial Sequence: Synthetic oligonucleotide
  Target: ATXN1; (-) strand; PAM type: YTN; PAM sequence: CTC
tgtggaacttgttatatacg

SEQ ID NO: 168347 - DNA, 20 bp, Artificial Sequence
  Description of Artificial Sequence: Synthetic oligonucleotide
  Target: ATXN1; (-) strand; PAM type: YTN; PAM sequence: TTA
tgaatccaagaaagggctct

SEQ ID NO: 168348 - DNA, 20 bp, Artificial Sequence
  Description of Artificial Sequence: Synthetic oligonucleotide
  Target: ATXN1; (-) strand; PAM type: YTN; PAM sequence: TTA
tcattatgaatccaagaaag

SEQ ID NO: 168349 - DNA, 20 bp, Artificial Sequence
  Description of Artificial Sequence: Synthetic oligonucleotide
  Target: ATXN1; (-) strand; PAM type: YTN; PAM sequence: TTG
gatagtgtggtagatgcagg

SEQ ID NO: 168350 - DNA, 20 bp, Artificial Sequence
  Description of Artificial Sequence: Synthetic oligonucleotide
  Target: ATXN1; (-) strand; PAM type: YTN; PAM sequence: TTA
aaatgaacattggatagtgt

SEQ ID NO: 168351 - DNA, 20 bp, Artificial Sequence
  Description of Artificial Sequence: Synthetic oligonucleotide
  Target: ATXN1; (-) strand; PAM type: YTN; PAM sequence: CTC
attaaaatgaacattggata

SEQ ID NO: 168352 - DNA, 20 bp, Artificial Sequence
  Description of Artificial Sequence: Synthetic oligonucleotide
  Target: ATXN1; (-) strand; PAM type: YTN; PAM sequence: TTA
aagtccagaggtgctcatta

SEQ ID NO: 168353 - DNA, 20 bp, Artificial Sequence
  Description of Artificial Sequence: Synthetic oligonucleotide
  Target: ATXN1; (-) strand; PAM type: YTN; PAM sequence: TTC
attaaagtccagaggtgctc

SEQ ID NO: 168354 - DNA, 20 bp, Artificial Sequence
  Description of Artificial Sequence: Synthetic oligonucleotide
  Target: ATXN1; (-) strand; PAM type: YTN; PAM sequence: TTG
ttcattaaagtccagaggtg

SEQ ID NO: 168355 - DNA, 20 bp, Artificial Sequence
  Description of Artificial Sequence: Synthetic oligonucleotide
  Target: ATXN1; (-) strand; PAM type: YTN; PAM sequence: CTA
agattgttcattaaagtcca

SEQ ID NO: 168356 - DNA, 20 bp, Artificial Sequence
  Description of Artificial Sequence: Synthetic oligonucleotide
  Target: ATXN1; (-) strand; PAM type: YTN; PAM sequence: TTA
gacctaagattgttcattaa

SEQ ID NO: 168357 - DNA, 20 bp, Artificial Sequence
  Description of Artificial Sequence: Synthetic oligonucleotide
  Target: ATXN1; (-) strand; PAM type: YTN; PAM sequence: CTT
agacctaagattgttcatta

SEQ ID NO: 168358 - DNA, 20 bp, Artificial Sequence
  Description of Artificial Sequence: Synthetic oligonucleotide
  Target: ATXN1; (-) strand; PAM type: YTN; PAM sequence: CTC
acttagacctaagattgttc

SEQ ID NO: 168359 - DNA, 20 bp, Artificial Sequence
  Description of Artificial Sequence: Synthetic oligonucleotide
  Target: ATXN1; (-) strand; PAM type: YTN; PAM sequence: TTG
atgctcacttagacctaaga

SEQ ID NO: 168360 - DNA, 20 bp, Artificial Sequence
  Description of Artificial Sequence: Synthetic oligonucleotide
  Target: ATXN1; (-) strand; PAM type: YTN; PAM sequence: TTA
attgatgctcacttagacct

SEQ ID NO: 168361 - DNA, 20 bp, Artificial Sequence
  Description of Artificial Sequence: Synthetic oligonucleotide
  Target: ATXN1; (-) strand; PAM type: YTN; PAM sequence: TTT
aattgatgctcacttagacc

SEQ ID NO: 168362 - DNA, 20 bp, Artificial Sequence
  Description of Artificial Sequence: Synthetic oligonucleotide
  Target: ATXN1; (-) strand; PAM type: YTN; PAM sequence: CTT
taattgatgctcacttagac

SEQ ID NO: 168363 - DNA, 20 bp, Artificial Sequence
  Description of Artificial Sequence: Synthetic oligonucleotide
  Target: ATXN1; (-) strand; PAM type: YTN; PAM sequence: CTC
tttaattgatgctcacttag

SEQ ID NO: 168364 - DNA, 20 bp, Artificial Sequence
  Description of Artificial Sequence: Synthetic oligonucleotide
  Target: ATXN1; (-) strand; PAM type: YTN; PAM sequence: TTC
tctttaattgatgctcactt

SEQ ID NO: 168365 - DNA, 20 bp, Artificial Sequence
  Description of Artificial Sequence: Synthetic oligonucleotide
  Target: ATXN1; (-) strand; PAM type: YTN; PAM sequence: TTT
ctctttaattgatgctcact

SEQ ID NO: 168366 - DNA, 20 bp, Artificial Sequence
  Description of Artificial Sequence: Synthetic oligonucleotide
  Target: ATXN1; (-) strand; PAM type: YTN; PAM sequence: TTT
tctctttaattgatgctcac

SEQ ID NO: 168367 - DNA, 20 bp, Artificial Sequence
  Description of Artificial Sequence: Synthetic oligonucleotide
  Target: ATXN1; (-) strand; PAM type: YTN; PAM sequence: TTG
gaggcattttctctttaatt

SEQ ID NO: 168368 - DNA, 20 bp, Artificial Sequence
  Description of Artificial Sequence: Synthetic oligonucleotide
  Target: ATXN1; (-) strand; PAM type: YTN; PAM sequence: TTT
ggaggcattttctctttaat

SEQ ID NO: 168369 - DNA, 20 bp, Artificial Sequence
  Description of Artificial Sequence: Synthetic oligonucleotide
  Target: ATXN1; (-) strand; PAM type: YTN; PAM sequence: CTT
tggaggcattttctctttaa

SEQ ID NO: 168370 - DNA, 20 bp, Artificial Sequence
  Description of Artificial Sequence: Synthetic oligonucleotide
  Target: ATXN1; (-) strand; PAM type: YTN; PAM sequence: TTA
tacctttggaggcattttct

SEQ ID NO: 168371 - DNA, 20 bp, Artificial Sequence
  Description of Artificial Sequence: Synthetic oligonucleotide
  Target: ATXN1; (-) strand; PAM type: YTN; PAM sequence: TTT
atacctttggaggcattttc

SEQ ID NO: 168372 - DNA, 20 bp, Artificial Sequence
  Description of Artificial Sequence: Synthetic oligonucleotide
  Target: ATXN1; (-) strand; PAM type: YTN; PAM sequence: CTA
acccagatgatacatcacca

SEQ ID NO: 168373 - DNA, 20 bp, Artificial Sequence
  Description of Artificial Sequence: Synthetic oligonucleotide
  Target: ATXN1; (-) strand; PAM type: YTN; PAM sequence: CTG
ctaacccagatgatacatca

SEQ ID NO: 168374 - DNA, 20 bp, Artificial Sequence
  Description of Artificial Sequence: Synthetic oligonucleotide
  Target: ATXN1; (-) strand; PAM type: YTN; PAM sequence: TTC
aaccctgctaacccagatga

SEQ ID NO: 168375 - DNA, 20 bp, Artificial Sequence
  Description of Artificial Sequence: Synthetic oligonucleotide
  Target: ATXN1; (-) strand; PAM type: YTN; PAM sequence: TTT
caaccctgctaacccagatg

SEQ ID NO: 168376 - DNA, 20 bp, Artificial Sequence
  Description of Artificial Sequence: Synthetic oligonucleotide
  Target: ATXN1; (-) strand; PAM type: YTN; PAM sequence: CTT
tcaaccctgctaacccagat

SEQ ID NO: 168377 - DNA, 20 bp, Artificial Sequence
  Description of Artificial Sequence: Synthetic oligonucleotide
  Target: ATXN1; (-) strand; PAM type: YTN; PAM sequence: CTC
acaggtgtcctttcaaccct

SEQ ID NO: 168378 - DNA, 20 bp, Artificial Sequence
  Description of Artificial Sequence: Synthetic oligonucleotide
  Target: ATXN1; (-) strand; PAM type: YTN; PAM sequence: CTC
acgatgctcacaggtgtcct

SEQ ID NO: 168379 - DNA, 20 bp, Artificial Sequence
  Description of Artificial Sequence: Synthetic oligonucleotide
  Target: ATXN1; (-) strand; PAM type: YTN; PAM sequence: TTG
ccatccaaacctcacgatgc

SEQ ID NO: 168380 - DNA, 20 bp, Artificial Sequence
  Description of Artificial Sequence: Synthetic oligonucleotide
  Target: ATXN1; (-) strand; PAM type: YTN; PAM sequence: CTT
gccatccaaacctcacgatg

SEQ ID NO: 168381 - DNA, 20 bp, Artificial Sequence
  Description of Artificial Sequence: Synthetic oligonucleotide
  Target: ATXN1; (-) strand; PAM type: YTN; PAM sequence: CTG
atcaagggggcacacttgcc

SEQ ID NO: 168382 - DNA, 20 bp, Artificial Sequence
  Description of Artificial Sequence: Synthetic oligonucleotide
  Target: ATXN1; (-) strand; PAM type: YTN; PAM sequence: CTG
ctgatcaagggggcacactt

SEQ ID NO: 168383 - DNA, 20 bp, Artificial Sequence
  Description of Artificial Sequence: Synthetic oligonucleotide
  Target: ATXN1; (-) strand; PAM type: YTN; PAM sequence: CTA
tatcagacagaggtgggagc

SEQ ID NO: 168384 - DNA, 20 bp, Artificial Sequence
  Description of Artificial Sequence: Synthetic oligonucleotide
  Target: ATXN1; (-) strand; PAM type: YTN; PAM sequence: CTC
tatatcagacagaggtggga

SEQ ID NO: 168385 - DNA, 20 bp, Artificial Sequence
  Description of Artificial Sequence: Synthetic oligonucleotide
  Target: ATXN1; (-) strand; PAM type: YTN; PAM sequence: TTC
gctctatatcagacagaggt

SEQ ID NO: 168386 - DNA, 20 bp, Artificial Sequence
  Description of Artificial Sequence: Synthetic oligonucleotide
  Target: ATXN1; (-) strand; PAM type: YTN; PAM sequence: CTT
cgctctatatcagacagagg

SEQ ID NO: 168387 - DNA, 20 bp, Artificial Sequence
  Description of Artificial Sequence: Synthetic oligonucleotide
  Target: ATXN1; (-) strand; PAM type: YTN; PAM sequence: TTC
atcccaggccccagcttcgc

SEQ ID NO: 168388 - DNA, 20 bp, Artificial Sequence
  Description of Artificial Sequence: Synthetic oligonucleotide
  Target: ATXN1; (-) strand; PAM type: YTN; PAM sequence: TTT
catcccaggccccagcttcg

SEQ ID NO: 168389 - DNA, 20 bp, Artificial Sequence
  Description of Artificial Sequence: Synthetic oligonucleotide
  Target: ATXN1; (-) strand; PAM type: YTN; PAM sequence: CTT
tcatcccaggccccagcttc

SEQ ID NO: 168390 - DNA, 20 bp, Artificial Sequence
  Description of Artificial Sequence: Synthetic oligonucleotide
  Target: ATXN1; (-) strand; PAM type: YTN; PAM sequence: TTC
tttcatcccaggccccagct

SEQ ID NO: 168391 - DNA, 20 bp, Artificial Sequence
  Description of Artificial Sequence: Synthetic oligonucleotide
  Target: ATXN1; (-) strand; PAM type: YTN; PAM sequence: CTT
ctttcatcccaggccccagc

SEQ ID NO: 168392 - DNA, 20 bp, Artificial Sequence
  Description of Artificial Sequence: Synthetic oligonucleotide
  Target: ATXN1; (-) strand; PAM type: YTN; PAM sequence: TTC
ttctttcatcccaggcccca

SEQ ID NO: 168393 - DNA, 20 bp, Artificial Sequence
  Description of Artificial Sequence: Synthetic oligonucleotide
  Target: ATXN1; (-) strand; PAM type: YTN; PAM sequence: TTT
cttctttcatcccaggcccc

SEQ ID NO: 168394 - DNA, 20 bp, Artificial Sequence
  Description of Artificial Sequence: Synthetic oligonucleotide
  Target: ATXN1; (-) strand; PAM type: YTN; PAM sequence: CTT
tcttctttcatcccaggccc

SEQ ID NO: 168395 - DNA, 20 bp, Artificial Sequence
  Description of Artificial Sequence: Synthetic oligonucleotide
  Target: ATXN1; (-) strand; PAM type: YTN; PAM sequence: CTG
gggctttcttctttcatccc

SEQ ID NO: 168396 - DNA, 20 bp, Artificial Sequence
  Description of Artificial Sequence: Synthetic oligonucleotide
  Target: ATXN1; (-) strand; PAM type: YTN; PAM sequence: TTA
tgtgctggggctttcttctt

SEQ ID NO: 168397 - DNA, 20 bp, Artificial Sequence
  Description of Artificial Sequence: Synthetic oligonucleotide
  Target: ATXN1; (-) strand; PAM type: YTN; PAM sequence: TTT
atgtgctggggctttcttct

SEQ ID NO: 168398 - DNA, 20 bp, Artificial Sequence
  Description of Artificial Sequence: Synthetic oligonucleotide
  Target: ATXN1; (-) strand; PAM type: YTN; PAM sequence: CTA
atatttatgtgctggggctt

SEQ ID NO: 168399 - DNA, 20 bp, Artificial Sequence
  Description of Artificial Sequence: Synthetic oligonucleotide
  Target: ATXN1; (-) strand; PAM type: YTN; PAM sequence: TTC
ccctaatatttatgtgctgg

SEQ ID NO: 168400 - DNA, 20 bp, Artificial Sequence
  Description of Artificial Sequence: Synthetic oligonucleotide
  Target: ATXN1; (-) strand; PAM type: YTN; PAM sequence: CTA
tagcattcccctaatattta

SEQ ID NO: 168401 - DNA, 20 bp, Artificial Sequence
  Description of Artificial Sequence: Synthetic oligonucleotide
  Target: ATXN1; (-) strand; PAM type: YTN; PAM sequence: TTC
tatagcattcccctaatatt

SEQ ID NO: 168402 - DNA, 20 bp, Artificial Sequence
  Description of Artificial Sequence: Synthetic oligonucleotide
  Target: ATXN1; (-) strand; PAM type: YTN; PAM sequence: CTT
ctatagcattcccctaatat

SEQ ID NO: 168403 - DNA, 20 bp, Artificial Sequence
  Description of Artificial Sequence: Synthetic oligonucleotide
  Target: ATXN1; (-) strand; PAM type: YTN; PAM sequence: CTC
cttctatagcattcccctaa

SEQ ID NO: 168404 - DNA, 20 bp, Artificial Sequence
  Description of Artificial Sequence: Synthetic oligonucleotide
  Target: ATXN1; (-) strand; PAM type: YTN; PAM sequence: TTC
ctccttctatagcattcccc

SEQ ID NO: 168405 - DNA, 20 bp, Artificial Sequence
  Description of Artificial Sequence: Synthetic oligonucleotide
  Target: ATXN1; (-) strand; PAM type: YTN; PAM sequence: TTC
agaattcctccttctatagc

SEQ ID NO: 168406 - DNA, 20 bp, Artificial Sequence
  Description of Artificial Sequence: Synthetic oligonucleotide
  Target: ATXN1; (-) strand; PAM type: YTN; PAM sequence: TTT
cagaattcctccttctatag

SEQ ID NO: 168407 - DNA, 20 bp, Artificial Sequence
  Description of Artificial Sequence: Synthetic oligonucleotide
  Target: ATXN1; (-) strand; PAM type: YTN; PAM sequence: CTT
tcagaattcctccttctata

SEQ ID NO: 168408 - DNA, 20 bp, Artificial Sequence
  Description of Artificial Sequence: Synthetic oligonucleotide
  Target: ATXN1; (-) strand; PAM type: YTN; PAM sequence: TTC
tttcagaattcctccttcta

SEQ ID NO: 168409 - DNA, 20 bp, Artificial Sequence
  Description of Artificial Sequence: Synthetic oligonucleotide
  Target: ATXN1; (-) strand; PAM type: YTN; PAM sequence: CTT
ctttcagaattcctccttct

SEQ ID NO: 168410 - DNA, 20 bp, Artificial Sequence
  Description of Artificial Sequence: Synthetic oligonucleotide
  Target: ATXN1; (-) strand; PAM type: YTN; PAM sequence: CTC
ttctttcagaattcctcctt

SEQ ID NO: 168411 - DNA, 20 bp, Artificial Sequence
  Description of Artificial Sequence: Synthetic oligonucleotide
  Target: ATXN1; (-) strand; PAM type: YTN; PAM sequence: TTC
tcttctttcagaattcctcc

SEQ ID NO: 168412 - DNA, 20 bp, Artificial Sequence
  Description of Artificial Sequence: Synthetic oligonucleotide
  Target: ATXN1; (-) strand; PAM type: YTN; PAM sequence: TTT
ctcttctttcagaattcctc

SEQ ID NO: 168413 - DNA, 20 bp, Artificial Sequence
  Description of Artificial Sequence: Synthetic oligonucleotide
  Target: ATXN1; (-) strand; PAM type: YTN; PAM sequence: CTC
agatgtatttctcttctttc

SEQ ID NO: 168414 - DNA, 20 bp, Artificial Sequence
  Description of Artificial Sequence: Synthetic oligonucleotide
  Target: ATXN1; (-) strand; PAM type: YTN; PAM sequence: TTG
ctcagatgtatttctcttct

SEQ ID NO: 168415 - DNA, 20 bp, Artificial Sequence
  Description of Artificial Sequence: Synthetic oligonucleotide
  Target: ATXN1; (-) strand; PAM type: YTN; PAM sequence: CTG
tgttgctcagatgtatttct

SEQ ID NO: 168416 - DNA, 20 bp, Artificial Sequence
  Description of Artificial Sequence: Synthetic oligonucleotide
  Target: ATXN1; (-) strand; PAM type: YTN; PAM sequence: TTC
tgtgttgctcagatgtattt

SEQ ID NO: 168417 - DNA, 20 bp, Artificial Sequence
  Description of Artificial Sequence: Synthetic oligonucleotide
  Target: ATXN1; (-) strand; PAM type: YTN; PAM sequence: CTG
cagcaattctgtgttgctca

SEQ ID NO: 168418 - DNA, 20 bp, Artificial Sequence
  Description of Artificial Sequence: Synthetic oligonucleotide
  Target: ATXN1; (-) strand; PAM type: YTN; PAM sequence: CTC
tgcagcaattctgtgttgct

SEQ ID NO: 168419 - DNA, 20 bp, Artificial Sequence
  Description of Artificial Sequence: Synthetic oligonucleotide
  Target: ATXN1; (-) strand; PAM type: YTN; PAM sequence: CTG
taagaatgcgtgcaggtaac

SEQ ID NO: 168420 - DNA, 20 bp, Artificial Sequence
  Description of Artificial Sequence: Synthetic oligonucleotide
  Target: ATXN1; (-) strand; PAM type: YTN; PAM sequence: TTG
gaaaactgtaagaatgcgtg

SEQ ID NO: 168421 - DNA, 20 bp, Artificial Sequence
  Description of Artificial Sequence: Synthetic oligonucleotide
  Target: ATXN1; (-) strand; PAM type: YTN; PAM sequence: CTT
ggaaaactgtaagaatgcgt

SEQ ID NO: 168422 - DNA, 20 bp, Artificial Sequence
  Description of Artificial Sequence: Synthetic oligonucleotide
  Target: ATXN1; (-) strand; PAM type: YTN; PAM sequence: TTG
tccttggaaaactgtaagaa

SEQ ID NO: 168423 - DNA, 20 bp, Artificial Sequence
  Description of Artificial Sequence: Synthetic oligonucleotide
  Target: ATXN1; (-) strand; PAM type: YTN; PAM sequence: CTT
gtccttggaaaactgtaaga

SEQ ID NO: 168424 - DNA, 20 bp, Artificial Sequence
  Description of Artificial Sequence: Synthetic oligonucleotide
  Target: ATXN1; (-) strand; PAM type: YTN; PAM sequence: CTC
ttgtccttggaaaactgtaa

SEQ ID NO: 168425 - DNA, 20 bp, Artificial Sequence
  Description of Artificial Sequence: Synthetic oligonucleotide
  Target: ATXN1; (-) strand; PAM type: YTN; PAM sequence: CTC
ctcttgtccttggaaaactg

SEQ ID NO: 168426 - DNA, 20 bp, Artificial Sequence
  Description of Artificial Sequence: Synthetic oligonucleotide
  Target: ATXN1; (-) strand; PAM type: YTN; PAM sequence: TTA
atgccataccctcctcttgt

SEQ ID NO: 168427 - DNA, 20 bp, Artificial Sequence
  Description of Artificial Sequence: Synthetic oligonucleotide
  Target: ATXN1; (-) strand; PAM type: YTN; PAM sequence: CTC
gggttaatgccataccctcc

SEQ ID NO: 168428 - DNA, 20 bp, Artificial Sequence
  Description of Artificial Sequence: Synthetic oligonucleotide
  Target: ATXN1; (-) strand; PAM type: YTN; PAM sequence: TTC
aggggctcgggttaatgcca

SEQ ID NO: 168429 - DNA, 20 bp, Artificial Sequence
  Description of Artificial Sequence: Synthetic oligonucleotide
  Target: ATXN1; (-) strand; PAM type: YTN; PAM sequence: TTA
gacatattcaggggctcggg

SEQ ID NO: 168430 - DNA, 20 bp, Artificial Sequence
  Description of Artificial Sequence: Synthetic oligonucleotide
  Target: ATXN1; (-) strand; PAM type: YTN; PAM sequence: CTA
cagaattagacatattcagg

SEQ ID NO: 168431 - DNA, 20 bp, Artificial Sequence
  Description of Artificial Sequence: Synthetic oligonucleotide
  Target: ATXN1; (-) strand; PAM type: YTN; PAM sequence: TTG
catgcctacagaattagaca

SEQ ID NO: 168432 - DNA, 20 bp, Artificial Sequence
  Description of Artificial Sequence: Synthetic oligonucleotide
  Target: ATXN1; (-) strand; PAM type: YTN; PAM sequence: TTT
gcatgcctacagaattagac

SEQ ID NO: 168433 - DNA, 20 bp, Artificial Sequence
  Description of Artificial Sequence: Synthetic oligonucleotide
  Target: ATXN1; (-) strand; PAM type: YTN; PAM sequence: CTC
atttgcatgcctacagaatt

SEQ ID NO: 168434 - DNA, 20 bp, Artificial Sequence
  Description of Artificial Sequence: Synthetic oligonucleotide
  Target: ATXN1; (-) strand; PAM type: YTN; PAM sequence: TTC
tcatttgcatgcctacagaa

SEQ ID NO: 168435 - DNA, 20 bp, Artificial Sequence
  Description of Artificial Sequence: Synthetic oligonucleotide
  Target: ATXN1; (-) strand; PAM type: YTN; PAM sequence: CTG
ccgcaaagtcagtcagacca

SEQ ID NO: 168436 - DNA, 20 bp, Artificial Sequence
  Description of Artificial Sequence: Synthetic oligonucleotide
  Target: ATXN1; (-) strand; PAM type: YTN; PAM sequence: CTG
ctgccgcaaagtcagtcaga

SEQ ID NO: 168437 - DNA, 20 bp, Artificial Sequence
  Description of Artificial Sequence: Synthetic oligonucleotide
  Target: ATXN1; (-) strand; PAM type: YTN; PAM sequence: CTC
agctgctgccgcaaagtcag

SEQ ID NO: 168438 - DNA, 20 bp, Artificial Sequence
  Description of Artificial Sequence: Synthetic oligonucleotide
  Target: ATXN1; (-) strand; PAM type: YTN; PAM sequence: TTA
gcagggctcagctgctgccg

SEQ ID NO: 168439 - DNA, 20 bp, Artificial Sequence
  Description of Artificial Sequence: Synthetic oligonucleotide
  Target: ATXN1; (-) strand; PAM type: YTN; PAM sequence: CTG
aagggaagttagcagggctc

SEQ ID NO: 168440 - DNA, 20 bp, Artificial Sequence
  Description of Artificial Sequence: Synthetic oligonucleotide
  Target: ATXN1; (-) strand; PAM type: YTN; PAM sequence: TTC
tgaagggaagttagcagggc

SEQ ID NO: 168441 - DNA, 20 bp, Artificial Sequence
  Description of Artificial Sequence: Synthetic oligonucleotide
  Target: ATXN1; (-) strand; PAM type: YTN; PAM sequence: CTG
agttctgaagggaagttagc

SEQ ID NO: 168442 - DNA, 20 bp, Artificial Sequence
  Description of Artificial Sequence: Synthetic oligonucleotide
  Target: ATXN1; (-) strand; PAM type: YTN; PAM sequence: CTA
gcccaagctgagttctgaag

SEQ ID NO: 168443 - DNA, 20 bp, Artificial Sequence
  Description of Artificial Sequence: Synthetic oligonucleotide
  Target: ATXN1; (-) strand; PAM type: YTN; PAM sequence: TTG
ctagcccaagctgagttctg

SEQ ID NO: 168444 - DNA, 20 bp, Artificial Sequence
  Description of Artificial Sequence: Synthetic oligonucleotide
  Target: ATXN1; (-) strand; PAM type: YTN; PAM sequence: TTT
gctagcccaagctgagttct

SEQ ID NO: 168445 - DNA, 20 bp, Artificial Sequence
  Description of Artificial Sequence: Synthetic oligonucleotide
  Target: ATXN1; (-) strand; PAM type: YTN; PAM sequence: CTT
tgctagcccaagctgagttc

SEQ ID NO: 168446 - DNA, 20 bp, Artificial Sequence
  Description of Artificial Sequence: Synthetic oligonucleotide
  Target: ATXN1; (-) strand; PAM type: YTN; PAM sequence: TTC
tttgctagcccaagctgagt

SEQ ID NO: 168447 - DNA, 20 bp, Artificial Sequence
  Description of Artificial Sequence: Synthetic oligonucleotide
  Target: ATXN1; (-) strand; PAM type: YTN; PAM sequence: TTT
ctttgctagcccaagctgag

SEQ ID NO: 168448 - DNA, 20 bp, Artificial Sequence
  Description of Artificial Sequence: Synthetic oligonucleotide
  Target: ATXN1; (-) strand; PAM type: YTN; PAM sequence: TTT
tctttgctagcccaagctga

SEQ ID NO: 168449 - DNA, 20 bp, Artificial Sequence
  Description of Artificial Sequence: Synthetic oligonucleotide
  Target: ATXN1; (-) strand; PAM type: YTN; PAM sequence: CTT
ttctttgctagcccaagctg

SEQ ID NO: 168450 - DNA, 20 bp, Artificial Sequence
  Description of Artificial Sequence: Synthetic oligonucleotide
  Target: ATXN1; (-) strand; PAM type: YTN; PAM sequence: CTG
gggtaggtgggtgagtgggc

SEQ ID NO: 168451 - DNA, 20 bp, Artificial Sequence
  Description of Artificial Sequence: Synthetic oligonucleotide
  Target: ATXN1; (-) strand; PAM type: YTN; PAM sequence: CTG
ctggggtaggtgggtgagtg

SEQ ID NO: 168452 - DNA, 20 bp, Artificial Sequence
  Description of Artificial Sequence: Synthetic oligonucleotide
  Target: ATXN1; (-) strand; PAM type: YTN; PAM sequence: CTG
caaagctgctggggtaggtg

SEQ ID NO: 168453 - DNA, 20 bp, Artificial Sequence
  Description of Artificial Sequence: Synthetic oligonucleotide
  Target: ATXN1; (-) strand; PAM type: YTN; PAM sequence: TTC
tgcaaagctgctggggtagg

SEQ ID NO: 168454 - DNA, 20 bp, Artificial Sequence
  Description of Artificial Sequence: Synthetic oligonucleotide
  Target: ATXN1; (-) strand; PAM type: YTN; PAM sequence: CTT
ctgcaaagctgctggggtag

SEQ ID NO: 168455 - DNA, 20 bp, Artificial Sequence
  Description of Artificial Sequence: Synthetic oligonucleotide
  Target: ATXN1; (-) strand; PAM type: YTN; PAM sequence: CTG
cagcacttctgcaaagctgc

SEQ ID NO: 168456 - DNA, 20 bp, Artificial Sequence
  Description of Artificial Sequence: Synthetic oligonucleotide
  Target: ATXN1; (-) strand; PAM type: YTN; PAM sequence: TTC
accctgcagcacttctgcaa

SEQ ID NO: 168457 - DNA, 20 bp, Artificial Sequence
  Description of Artificial Sequence: Synthetic oligonucleotide
  Target: ATXN1; (-) strand; PAM type: YTN; PAM sequence: CTT
caccctgcagcacttctgca

SEQ ID NO: 168458 - DNA, 20 bp, Artificial Sequence
  Description of Artificial Sequence: Synthetic oligonucleotide
  Target: ATXN1; (-) strand; PAM type: YTN; PAM sequence: TTG
tcttcaccctgcagcacttc

SEQ ID NO: 168459 - DNA, 20 bp, Artificial Sequence
  Description of Artificial Sequence: Synthetic oligonucleotide
  Target: ATXN1; (-) strand; PAM type: YTN; PAM sequence: TTC
attgtcttcaccctgcagca

SEQ ID NO: 168460 - DNA, 20 bp, Artificial Sequence
  Description of Artificial Sequence: Synthetic oligonucleotide
  Target: ATXN1; (-) strand; PAM type: YTN; PAM sequence: CTT
cattgtcttcaccctgcagc

SEQ ID NO: 168461 - DNA, 20 bp, Artificial Sequence
  Description of Artificial Sequence: Synthetic oligonucleotide
  Target: ATXN1; (-) strand; PAM type: YTN; PAM sequence: TTC
ttcattgtcttcaccctgca

SEQ ID NO: 168462 - DNA, 20 bp, Artificial Sequence
  Description of Artificial Sequence: Synthetic oligonucleotide
  Target: ATXN1; (-) strand; PAM type: YTN; PAM sequence: TTT
cttcattgtcttcaccctgc

SEQ ID NO: 168463 - DNA, 20 bp, Artificial Sequence
  Description of Artificial Sequence: Synthetic oligonucleotide
  Target: ATXN1; (-) strand; PAM type: YTN; PAM sequence: CTT
tcttcattgtcttcaccctg

SEQ ID NO: 168464 - DNA, 20 bp, Artificial Sequence
  Description of Artificial Sequence: Synthetic oligonucleotide
  Target: ATXN1; (-) strand; PAM type: YTN; PAM sequence: TTG
cctttcttcattgtcttcac

SEQ ID NO: 168465 - DNA, 20 bp, Artificial Sequence
  Description of Artificial Sequence: Synthetic oligonucleotide
  Target: ATXN1; (-) strand; PAM type: YTN; PAM sequence: CTT
gcctttcttcattgtcttca

SEQ ID NO: 168466 - DNA, 20 bp, Artificial Sequence
  Description of Artificial Sequence: Synthetic oligonucleotide
  Target: ATXN1; (-) strand; PAM type: YTN; PAM sequence: TTC
agccttgcctttcttcattg

SEQ ID NO: 168467 - DNA, 20 bp, Artificial Sequence
  Description of Artificial Sequence: Synthetic oligonucleotide
  Target: ATXN1; (-) strand; PAM type: YTN; PAM sequence: CTT
cagccttgcctttcttcatt

SEQ ID NO: 168468 - DNA, 20 bp, Artificial Sequence
  Description of Artificial Sequence: Synthetic oligonucleotide
  Target: ATXN1; (-) strand; PAM type: YTN; PAM sequence: TTC
ttcagccttgcctttcttca

SEQ ID NO: 168469 - DNA, 20 bp, Artificial Sequence
  Description of Artificial Sequence: Synthetic oligonucleotide
  Target: ATXN1; (-) strand; PAM type: YTN; PAM sequence: TTT
cttcagccttgcctttcttc

SEQ ID NO: 168470 - DNA, 20 bp, Artificial Sequence
  Description of Artificial Sequence: Synthetic oligonucleotide
  Target: ATXN1; (-) strand; PAM type: YTN; PAM sequence: CTT
tcttcagccttgcctttctt

SEQ ID NO: 168471 - DNA, 20 bp, Artificial Sequence
  Description of Artificial Sequence: Synthetic oligonucleotide
  Target: ATXN1; (-) strand; PAM type: YTN; PAM sequence: CTC
ggctttcttcagccttgcct

SEQ ID NO: 168472 - DNA, 20 bp, Artificial Sequence
  Description of Artificial Sequence: Synthetic oligonucleotide
  Target: ATXN1; (-) strand; PAM type: YTN; PAM sequence: CTG
ggagagggcagaatgcctcg

SEQ ID NO: 168473 - DNA, 20 bp, Artificial Sequence
  Description of Artificial Sequence: Synthetic oligonucleotide
  Target: ATXN1; (-) strand; PAM type: YTN; PAM sequence: TTG
ctgggagagggcagaatgcc

SEQ ID NO: 168474 - DNA, 20 bp, Artificial Sequence
  Description of Artificial Sequence: Synthetic oligonucleotide
  Target: ATXN1; (-) strand; PAM type: YTN; PAM sequence: TTT
gctgggagagggcagaatgc

SEQ ID NO: 168475 - DNA, 20 bp, Artificial Sequence
  Description of Artificial Sequence: Synthetic oligonucleotide
  Target: ATXN1; (-) strand; PAM type: YTN; PAM sequence: CTT
tgctgggagagggcagaatg

SEQ ID NO: 168476 - DNA, 20 bp, Artificial Sequence
  Description of Artificial Sequence: Synthetic oligonucleotide
  Target: ATXN1; (-) strand; PAM type: YTN; PAM sequence: CTG
tctttgctgggagagggcag

SEQ ID NO: 168477 - DNA, 20 bp, Artificial Sequence
  Description of Artificial Sequence: Synthetic oligonucleotide
  Target: ATXN1; (-) strand; PAM type: YTN; PAM sequence: CTG
aacacgtccaggctgtcttt

SEQ ID NO: 168478 - DNA, 20 bp, Artificial Sequence
  Description of Artificial Sequence: Synthetic oligonucleotide
  Target: ATXN1; (-) strand; PAM type: YTN; PAM sequence: TTG
atgcggcgatagggtctgaa

SEQ ID NO: 168479 - DNA, 20 bp, Artificial Sequence
  Description of Artificial Sequence: Synthetic oligonucleotide
  Target: ATXN1; (-) strand; PAM type: YTN; PAM sequence: TTT
gatgcggcgatagggtctga

SEQ ID NO: 168480 - DNA, 20 bp, Artificial Sequence
  Description of Artificial Sequence: Synthetic oligonucleotide
  Target: ATXN1; (-) strand; PAM type: YTN; PAM sequence: TTT
tgatgcggcgatagggtctg

SEQ ID NO: 168481 - DNA, 20 bp, Artificial Sequence
  Description of Artificial Sequence: Synthetic oligonucleotide
  Target: ATXN1; (-) strand; PAM type: YTN; PAM sequence: CTT
ttgatgcggcgatagggtct

SEQ ID NO: 168482 - DNA, 20 bp, Artificial Sequence
  Description of Artificial Sequence: Synthetic oligonucleotide
  Target: ATXN1; (-) strand; PAM type: YTN; PAM sequence: TTC
ttttgatgcggcgatagggt

SEQ ID NO: 168483 - DNA, 20 bp, Artificial Sequence
  Description of Artificial Sequence: Synthetic oligonucleotide
  Target: ATXN1; (-) strand; PAM type: YTN; PAM sequence: CTT
cttttgatgcggcgataggg

SEQ ID NO: 168484 - DNA, 20 bp, Artificial Sequence
  Description of Artificial Sequence: Synthetic oligonucleotide
  Target: ATXN1; (-) strand; PAM type: YTN; PAM sequence: TTC
ttcttttgatgcggcgatag

SEQ ID NO: 168485 - DNA, 20 bp, Artificial Sequence
  Description of Artificial Sequence: Synthetic oligonucleotide
  Target: ATXN1; (-) strand; PAM type: YTN; PAM sequence: TTG
gtgttcttcttttgatgcgg

SEQ ID NO: 168486 - DNA, 20 bp, Artificial Sequence
  Description of Artificial Sequence: Synthetic oligonucleotide
  Target: ATXN1; (-) strand; PAM type: YTN; PAM sequence: CTT
ggtgttcttcttttgatgcg

SEQ ID NO: 168487 - DNA, 20 bp, Artificial Sequence
  Description of Artificial Sequence: Synthetic oligonucleotide
  Target: ATXN1; (-) strand; PAM type: YTN; PAM sequence: CTC
cttggtgttcttcttttgat

SEQ ID NO: 168488 - DNA, 20 bp, Artificial Sequence
  Description of Artificial Sequence: Synthetic oligonucleotide
  Target: ATXN1; (-) strand; PAM type: YTN; PAM sequence: TTC
tccttggtgttcttcttttg

SEQ ID NO: 168489 - DNA, 20 bp, Artificial Sequence
  Description of Artificial Sequence: Synthetic oligonucleotide
  Target: ATXN1; (-) strand; PAM type: YTN; PAM sequence: TTT
ctccttggtgttcttctttt

SEQ ID NO: 168490 - DNA, 20 bp, Artificial Sequence
  Description of Artificial Sequence: Synthetic oligonucleotide
  Target: ATXN1; (-) strand; PAM type: YTN; PAM sequence: CTT
tctccttggtgttcttcttt

SEQ ID NO: 168491 - DNA, 20 bp, Artificial Sequence
  Description of Artificial Sequence: Synthetic oligonucleotide
  Target: ATXN1; (-) strand; PAM type: YTN; PAM sequence: CTC
ctttctccttggtgttcttc

SEQ ID NO: 168492 - DNA, 20 bp, Artificial Sequence
  Description of Artificial Sequence: Synthetic oligonucleotide
  Target: ATXN1; (-) strand; PAM type: YTN; PAM sequence: TTG
tgactcctttctccttggtg

SEQ ID NO: 168493 - DNA, 20 bp, Artificial Sequence
  Description of Artificial Sequence: Synthetic oligonucleotide
  Target: ATXN1; (-) strand; PAM type: YTN; PAM sequence: TTT
gtgactcctttctccttggt

SEQ ID NO: 168494 - DNA, 20 bp, Artificial Sequence
  Description of Artificial Sequence: Synthetic oligonucleotide
  Target: ATXN1; (-) strand; PAM type: YTN; PAM sequence: TTT
tgtgactcctttctccttgg

SEQ ID NO: 168495 - DNA, 20 bp, Artificial Sequence
  Description of Artificial Sequence: Synthetic oligonucleotide
  Target: ATXN1; (-) strand; PAM type: YTN; PAM sequence: CTT
ttgtgactcctttctccttg

SEQ ID NO: 168496 - DNA, 20 bp, Artificial Sequence
  Description of Artificial Sequence: Synthetic oligonucleotide
  Target: ATXN1; (-) strand; PAM type: YTN; PAM sequence: CTG
atcatgccagagcttttgtg

SEQ ID NO: 168497 - DNA, 20 bp, Artificial Sequence
  Description of Artificial Sequence: Synthetic oligonucleotide
  Target: ATXN1; (-) strand; PAM type: YTN; PAM sequence: TTC
ctgatcatgccagagctttt

SEQ ID NO: 168498 - DNA, 20 bp, Artificial Sequence
  Description of Artificial Sequence: Synthetic oligonucleotide
  Target: ATXN1; (-) strand; PAM type: YTN; PAM sequence: CTT
cctgatcatgccagagcttt

SEQ ID NO: 168499 - DNA, 20 bp, Artificial Sequence
  Description of Artificial Sequence: Synthetic oligonucleotide
  Target: ATXN1; (-) strand; PAM type: YTN; PAM sequence: TTC
aaatccaggtgccttcctga

SEQ ID NO: 168500 - DNA, 20 bp, Artificial Sequence
  Description of Artificial Sequence: Synthetic oligonucleotide
  Target: ATXN1; (-) strand; PAM type: YTN; PAM sequence: TTT
caaatccaggtgccttcctg

SEQ ID NO: 168501 - DNA, 20 bp, Artificial Sequence
  Description of Artificial Sequence: Synthetic oligonucleotide
  Target: ATXN1; (-) strand; PAM type: YTN; PAM sequence: TTT
tcaaatccaggtgccttcct

SEQ ID NO: 168502 - DNA, 20 bp, Artificial Sequence
  Description of Artificial Sequence: Synthetic oligonucleotide
  Target: ATXN1; (-) strand; PAM type: YTN; PAM sequence: CTT
ttcaaatccaggtgccttcc

SEQ ID NO: 168503 - DNA, 20 bp, Artificial Sequence
  Description of Artificial Sequence: Synthetic oligonucleotide
  Target: ATXN1; (-) strand; PAM type: YTN; PAM sequence: TTG
ggcaataatatatccttttc

SEQ ID NO: 168504 - DNA, 20 bp, Artificial Sequence
  Description of Artificial Sequence: Synthetic oligonucleotide
  Target: ATXN1; (-) strand; PAM type: YTN; PAM sequence: CTT
gggcaataatatatcctttt

SEQ ID NO: 168505 - DNA, 20 bp, Artificial Sequence
  Description of Artificial Sequence: Synthetic oligonucleotide
  Target: ATXN1; (-) strand; PAM type: YTN; PAM sequence: TTA
agcttgggcaataatatatc

SEQ ID NO: 168506 - DNA, 20 bp, Artificial Sequence
  Description of Artificial Sequence: Synthetic oligonucleotide
  Target: ATXN1; (-) strand; PAM type: YTN; PAM sequence: TTA
gtcatggaaatcagtgaagt

SEQ ID NO: 168507 - DNA, 20 bp, Artificial Sequence
  Description of Artificial Sequence: Synthetic oligonucleotide
  Target: ATXN1; (-) strand; PAM type: YTN; PAM sequence: CTT
agtcatggaaatcagtgaag

SEQ ID NO: 168508 - DNA, 20 bp, Artificial Sequence
  Description of Artificial Sequence: Synthetic oligonucleotide
  Target: ATXN1; (-) strand; PAM type: YTN; PAM sequence: CTG
tcaagtggcttagtcatgga

SEQ ID NO: 168509 - DNA, 20 bp, Artificial Sequence
  Description of Artificial Sequence: Synthetic oligonucleotide
  Target: ATXN1; (-) strand; PAM type: YTN; PAM sequence: TTC
tgtcaagtggcttagtcatg

SEQ ID NO: 168510 - DNA, 20 bp, Artificial Sequence
  Description of Artificial Sequence: Synthetic oligonucleotide
  Target: ATXN1; (-) strand; PAM type: YTN; PAM sequence: TTT
ctgtcaagtggcttagtcat

SEQ ID NO: 168511 - DNA, 20 bp, Artificial Sequence
  Description of Artificial Sequence: Synthetic oligonucleotide
  Target: ATXN1; (-) strand; PAM type: YTN; PAM sequence: TTT
tctgtcaagtggcttagtca

SEQ ID NO: 168512 - DNA, 20 bp, Artificial Sequence
  Description of Artificial Sequence: Synthetic oligonucleotide
  Target: ATXN1; (-) strand; PAM type: YTN; PAM sequence: TTG
aaaaaaaggagttttctgtc

SEQ ID NO: 168513 - DNA, 20 bp, Artificial Sequence
  Description of Artificial Sequence: Synthetic oligonucleotide
  Target: ATXN1; (-) strand; PAM type: YTN; PAM sequence: TTA
aattgaaaaaaaggagtttt

SEQ ID NO: 168514 - DNA, 20 bp, Artificial Sequence
  Description of Artificial Sequence: Synthetic oligonucleotide
  Target: ATXN1; (-) strand; PAM type: YTN; PAM sequence: TTT
aaattgaaaaaaaggagttt

SEQ ID NO: 168515 - DNA, 20 bp, Artificial Sequence
  Description of Artificial Sequence: Synthetic oligonucleotide
  Target: ATXN1; (-) strand; PAM type: YTN; PAM sequence: TTA
aagtttaaattgaaaaaaag

SEQ ID NO: 168516 - DNA, 20 bp, Artificial Sequence
  Description of Artificial Sequence: Synthetic oligonucleotide
  Target: ATXN1; (-) strand; PAM type: YTN; PAM sequence: CTT
aaagtttaaattgaaaaaaa

SEQ ID NO: 168517 - DNA, 20 bp, Artificial Sequence
  Description of Artificial Sequence: Synthetic oligonucleotide
  Target: ATXN1; (-) strand; PAM type: YTN; PAM sequence: TTC
ttaaagtttaaattgaaaaa

SEQ ID NO: 168518 - DNA, 20 bp, Artificial Sequence
  Description of Artificial Sequence: Synthetic oligonucleotide
  Target: ATXN1; (-) strand; PAM type: YTN; PAM sequence: CTG
tagttcttaaagtttaaatt

SEQ ID NO: 168519 - DNA, 20 bp, Artificial Sequence
  Description of Artificial Sequence: Synthetic oligonucleotide
  Target: ATXN1; (-) strand; PAM type: YTN; PAM sequence: CTA
agtaacagagctgtagttct

SEQ ID NO: 168520 - DNA, 20 bp, Artificial Sequence
  Description of Artificial Sequence: Synthetic oligonucleotide
  Target: ATXN1; (-) strand; PAM type: YTN; PAM sequence: TTC
taagtaacagagctgtagtt

SEQ ID NO: 168521 - DNA, 20 bp, Artificial Sequence
  Description of Artificial Sequence: Synthetic oligonucleotide
  Target: ATXN1; (-) strand; PAM type: YTN; PAM sequence: TTG
gattctaagtaacagagctg

SEQ ID NO: 168522 - DNA, 20 bp, Artificial Sequence
  Description of Artificial Sequence: Synthetic oligonucleotide
  Target: ATXN1; (-) strand; PAM type: YTN; PAM sequence: TTT
ggattctaagtaacagagct

SEQ ID NO: 168523 - DNA, 20 bp, Artificial Sequence
  Description of Artificial Sequence: Synthetic oligonucleotide
  Target: ATXN1; (-) strand; PAM type: YTN; PAM sequence: CTT
tggattctaagtaacagagc

SEQ ID NO: 168524 - DNA, 20 bp, Artificial Sequence
  Description of Artificial Sequence: Synthetic oligonucleotide
  Target: ATXN1; (-) strand; PAM type: YTN; PAM sequence: TTG
ctttggattctaagtaacag

SEQ ID NO: 168525 - DNA, 20 bp, Artificial Sequence
  Description of Artificial Sequence: Synthetic oligonucleotide
  Target: ATXN1; (-) strand; PAM type: YTN; PAM sequence: TTT
gctttggattctaagtaaca

SEQ ID NO: 168526 - DNA, 20 bp, Artificial Sequence
  Description of Artificial Sequence: Synthetic oligonucleotide
  Target: ATXN1; (-) strand; PAM type: YTN; PAM sequence: CTG
atgatatttgctttggattc

SEQ ID NO: 168527 - DNA, 20 bp, Artificial Sequence
  Description of Artificial Sequence: Synthetic oligonucleotide
  Target: ATXN1; (-) strand; PAM type: YTN; PAM sequence: TTG
tcctgatgatatttgctttg

SEQ ID NO: 168528 - DNA, 20 bp, Artificial Sequence
  Description of Artificial Sequence: Synthetic oligonucleotide
  Target: ATXN1; (-) strand; PAM type: YTN; PAM sequence: CTT
gtcctgatgatatttgcttt

SEQ ID NO: 168529 - DNA, 20 bp, Artificial Sequence
  Description of Artificial Sequence: Synthetic oligonucleotide
  Target: ATXN1; (-) strand; PAM type: YTN; PAM sequence: CTC
agagacacttgtcctgatga

SEQ ID NO: 168530 - DNA, 20 bp, Artificial Sequence
  Description of Artificial Sequence: Synthetic oligonucleotide
  Target: ATXN1; (-) strand; PAM type: YTN; PAM sequence: TTC
ctcagagacacttgtcctga

SEQ ID NO: 168531 - DNA, 20 bp, Artificial Sequence
  Description of Artificial Sequence: Synthetic oligonucleotide
  Target: ATXN1; (-) strand; PAM type: YTN; PAM sequence: TTT
cctcagagacacttgtcctg

SEQ ID NO: 168532 - DNA, 20 bp, Artificial Sequence
  Description of Artificial Sequence: Synthetic oligonucleotide
  Target: ATXN1; (-) strand; PAM type: YTN; PAM sequence: CTG
tttcctcagagacacttgtc

SEQ ID NO: 168533 - DNA, 20 bp, Artificial Sequence
  Description of Artificial Sequence: Synthetic oligonucleotide
  Target: ATXN1; (-) strand; PAM type: YTN; PAM sequence: TTG
acagctgtttcctcagagac

SEQ ID NO: 168534 - DNA, 20 bp, Artificial Sequence
  Description of Artificial Sequence: Synthetic oligonucleotide
  Target: ATXN1; (-) strand; PAM type: YTN; PAM sequence: TTG
ttgacagctgtttcctcaga

SEQ ID NO: 168535 - DNA, 20 bp, Artificial Sequence
  Description of Artificial Sequence: Synthetic oligonucleotide
  Target: ATXN1; (-) strand; PAM type: YTN; PAM sequence: TTG
cagagttgttgacagctgtt

SEQ ID NO: 168536 - DNA, 20 bp, Artificial Sequence
  Description of Artificial Sequence: Synthetic oligonucleotide
  Target: ATXN1; (-) strand; PAM type: YTN; PAM sequence: TTA
gcatgtagtggataaaggaa

SEQ ID NO: 168537 - DNA, 20 bp, Artificial Sequence
  Description of Artificial Sequence: Synthetic oligonucleotide
  Target: ATXN1; (-) strand; PAM type: YTN; PAM sequence: CTC
aggatgggtgttagcatgta

SEQ ID NO: 168538 - DNA, 20 bp, Artificial Sequence
  Description of Artificial Sequence: Synthetic oligonucleotide
  Target: ATXN1; (-) strand; PAM type: YTN; PAM sequence: CTG
ggctcaggatgggtgttagc

SEQ ID NO: 168539 - DNA, 20 bp, Artificial Sequence
  Description of Artificial Sequence: Synthetic oligonucleotide
  Target: ATXN1; (-) strand; PAM type: YTN; PAM sequence: TTC
gctgggctcaggatgggtgt

SEQ ID NO: 168540 - DNA, 20 bp, Artificial Sequence
  Description of Artificial Sequence: Synthetic oligonucleotide
  Target: ATXN1; (-) strand; PAM type: YTN; PAM sequence: TTG
taaccaggcatagaaggaca

SEQ ID NO: 168541 - DNA, 20 bp, Artificial Sequence
  Description of Artificial Sequence: Synthetic oligonucleotide
  Target: ATXN1; (-) strand; PAM type: YTN; PAM sequence: TTT
gtaaccaggcatagaaggac

SEQ ID NO: 168542 - DNA, 20 bp, Artificial Sequence
  Description of Artificial Sequence: Synthetic oligonucleotide
  Target: ATXN1; (-) strand; PAM type: YTN; PAM sequence: CTT
tgtaaccaggcatagaagga

SEQ ID NO: 168543 - DNA, 20 bp, Artificial Sequence
  Description of Artificial Sequence: Synthetic oligonucleotide
  Target: ATXN1; (-) strand; PAM type: YTN; PAM sequence: TTG
taatgccccaatctttgtaa

SEQ ID NO: 168544 - DNA, 20 bp, Artificial Sequence
  Description of Artificial Sequence: Synthetic oligonucleotide
  Target: ATXN1; (-) strand; PAM type: YTN; PAM sequence: TTT
gtaatgccccaatctttgta

SEQ ID NO: 168545 - DNA, 20 bp, Artificial Sequence
  Description of Artificial Sequence: Synthetic oligonucleotide
  Target: ATXN1; (-) strand; PAM type: YTN; PAM sequence: TTT
tgtaatgccccaatctttgt

SEQ ID NO: 168546 - DNA, 20 bp, Artificial Sequence
  Description of Artificial Sequence: Synthetic oligonucleotide
  Target: ATXN1; (-) strand; PAM type: YTN; PAM sequence: TTT
ttgtaatgccccaatctttg

SEQ ID NO: 168547 - DNA, 20 bp, Artificial Sequence
  Description of Artificial Sequence: Synthetic oligonucleotide
  Target: ATXN1; (-) strand; PAM type: YTN; PAM sequence: TTA
tcagggtgagagaaggggga

SEQ ID NO: 168548 - DNA, 20 bp, Artificial Sequence
  Description of Artificial Sequence: Synthetic oligonucleotide
  Target: ATXN1; (-) strand; PAM type: YTN; PAM sequence: CTG
tgattatcagggtgagagaa

SEQ ID NO: 168549 - DNA, 20 bp, Artificial Sequence
  Description of Artificial Sequence: Synthetic oligonucleotide
  Target: ATXN1; (-) strand; PAM type: YTN; PAM sequence: CTA
ctgtgattatcagggtgaga

SEQ ID NO: 168550 - DNA, 20 bp, Artificial Sequence
  Description of Artificial Sequence: Synthetic oligonucleotide
  Target: ATXN1; (-) strand; PAM type: YTN; PAM sequence: CTA
ggtcccccagaaactactgt

SEQ ID NO: 168551 - DNA, 20 bp, Artificial Sequence
  Description of Artificial Sequence: Synthetic oligonucleotide
  Target: ATXN1; (-) strand; PAM type: YTN; PAM sequence: TTC
catctaggtcccccagaaac

SEQ ID NO: 168552 - DNA, 20 bp, Artificial Sequence
  Description of Artificial Sequence: Synthetic oligonucleotide
  Target: ATXN1; (-) strand; PAM type: YTN; PAM sequence: TTA
ataaagggttccatctaggt

SEQ ID NO: 168553 - DNA, 20 bp, Artificial Sequence
  Description of Artificial Sequence: Synthetic oligonucleotide
  Target: ATXN1; (-) strand; PAM type: YTN; PAM sequence: TTT
aataaagggttccatctagg

SEQ ID NO: 168554 - DNA, 20 bp, Artificial Sequence
  Description of Artificial Sequence: Synthetic oligonucleotide
  Target: ATXN1; (-) strand; PAM type: YTN; PAM sequence: TTC
caaaatttaataaagggttc

SEQ ID NO: 168555 - DNA, 20 bp, Artificial Sequence
  Description of Artificial Sequence: Synthetic oligonucleotide
  Target: ATXN1; (-) strand; PAM type: YTN; PAM sequence: CTC
atgttccaaaatttaataaa

SEQ ID NO: 168556 - DNA, 20 bp, Artificial Sequence
  Description of Artificial Sequence: Synthetic oligonucleotide
  Target: ATXN1; (-) strand; PAM type: YTN; PAM sequence: TTC
tcatgttccaaaatttaata

SEQ ID NO: 168557 - DNA, 20 bp, Artificial Sequence
  Description of Artificial Sequence: Synthetic oligonucleotide
  Target: ATXN1; (-) strand; PAM type: YTN; PAM sequence: TTT
ctcatgttccaaaatttaat

SEQ ID NO: 168558 - DNA, 20 bp, Artificial Sequence
  Description of Artificial Sequence: Synthetic oligonucleotide
  Target: ATXN1; (-) strand; PAM type: YTN; PAM sequence: CTT
tctcatgttccaaaatttaa

SEQ ID NO: 168559 - DNA, 20 bp, Artificial Sequence
  Description of Artificial Sequence: Synthetic oligonucleotide
  Target: ATXN1; (-) strand; PAM type: YTN; PAM sequence: TTA
caaatgacaagtgggtacca

SEQ ID NO: 168560 - DNA, 20 bp, Artificial Sequence
  Description of Artificial Sequence: Synthetic oligonucleotide
  Target: ATXN1; (-) strand; PAM type: YTN; PAM sequence: CTT
acaaatgacaagtgggtacc

SEQ ID NO: 168561 - DNA, 20 bp, Artificial Sequence
  Description of Artificial Sequence: Synthetic oligonucleotide
  Target: ATXN1; (-) strand; PAM type: YTN; PAM sequence: CTC
acttacaaatgacaagtggg

SEQ ID NO: 168562 - DNA, 20 bp, Artificial Sequence
  Description of Artificial Sequence: Synthetic oligonucleotide
  Target: ATXN1; (-) strand; PAM type: YTN; PAM sequence: TTA
tccagcactcacttacaaat

SEQ ID NO: 168563 - DNA, 20 bp, Artificial Sequence
  Description of Artificial Sequence: Synthetic oligonucleotide
  Target: ATXN1; (-) strand; PAM type: YTN; PAM sequence: CTG
atggaaattatccagcactc

SEQ ID NO: 168564 - DNA, 20 bp, Artificial Sequence
  Description of Artificial Sequence: Synthetic oligonucleotide
  Target: ATXN1; (-) strand; PAM type: YTN; PAM sequence: TTG
tggtctgatggaaattatcc

SEQ ID NO: 168565 - DNA, 20 bp, Artificial Sequence
  Description of Artificial Sequence: Synthetic oligonucleotide
  Target: ATXN1; (-) strand; PAM type: YTN; PAM sequence: TTA
gtatcataggaaggcaatga

SEQ ID NO: 168566 - DNA, 20 bp, Artificial Sequence
  Description of Artificial Sequence: Synthetic oligonucleotide
  Target: ATXN1; (-) strand; PAM type: YTN; PAM sequence: TTA
aattagtatcataggaaggc

SEQ ID NO: 168567 - DNA, 20 bp, Artificial Sequence
  Description of Artificial Sequence: Synthetic oligonucleotide
  Target: ATXN1; (-) strand; PAM type: YTN; PAM sequence: CTT
aaattagtatcataggaagg

SEQ ID NO: 168568 - DNA, 20 bp, Artificial Sequence
  Description of Artificial Sequence: Synthetic oligonucleotide
  Target: ATXN1; (-) strand; PAM type: YTN; PAM sequence: CTC
ttaaattagtatcataggaa

SEQ ID NO: 168569 - DNA, 20 bp, Artificial Sequence
  Description of Artificial Sequence: Synthetic oligonucleotide
  Target: ATXN1; (-) strand; PAM type: YTN; PAM sequence: TTG
aaagaactcttaaattagta

SEQ ID NO: 168570 - DNA, 20 bp, Artificial Sequence
  Description of Artificial Sequence: Synthetic oligonucleotide
  Target: ATXN1; (-) strand; PAM type: YTN; PAM sequence: TTT
gaaagaactcttaaattagt

SEQ ID NO: 168571 - DNA, 20 bp, Artificial Sequence
  Description of Artificial Sequence: Synthetic oligonucleotide
  Target: ATXN1; (-) strand; PAM type: YTN; PAM sequence: TTG
ggtttgaaagaactcttaaa

SEQ ID NO: 168572 - DNA, 20 bp, Artificial Sequence
  Description of Artificial Sequence: Synthetic oligonucleotide
  Target: ATXN1; (-) strand; PAM type: YTN; PAM sequence: TTT
gggtttgaaagaactcttaa

SEQ ID NO: 168573 - DNA, 20 bp, Artificial Sequence
  Description of Artificial Sequence: Synthetic oligonucleotide
  Target: ATXN1; (-) strand; PAM type: YTN; PAM sequence: CTA
aatttgggtttgaaagaact

SEQ ID NO: 168574 - DNA, 20 bp, Artificial Sequence
  Description of Artificial Sequence: Synthetic oligonucleotide
  Target: ATXN1; (-) strand; PAM type: YTN; PAM sequence: CTA
ggtgggcacacagagctaaa

SEQ ID NO: 168575 - DNA, 20 bp, Artificial Sequence
  Description of Artificial Sequence: Synthetic oligonucleotide
  Target: ATXN1; (-) strand; PAM type: YTN; PAM sequence: TTC
ccagagcaatctaggtgggc

SEQ ID NO: 168576 - DNA, 20 bp, Artificial Sequence
  Description of Artificial Sequence: Synthetic oligonucleotide
  Target: ATXN1; (-) strand; PAM type: YTN; PAM sequence: TTC
aattcccagagcaatctagg

SEQ ID NO: 168577 - DNA, 20 bp, Artificial Sequence
  Description of Artificial Sequence: Synthetic oligonucleotide
  Target: ATXN1; (-) strand; PAM type: YTN; PAM sequence: TTT
caattcccagagcaatctag

SEQ ID NO: 168578 - DNA, 20 bp, Artificial Sequence
  Description of Artificial Sequence: Synthetic oligonucleotide
  Target: ATXN1; (-) strand; PAM type: YTN; PAM sequence: CTA
tttcaattcccagagcaatc

SEQ ID NO: 168579 - DNA, 20 bp, Artificial Sequence
  Description of Artificial Sequence: Synthetic oligonucleotide
  Target: ATXN1; (-) strand; PAM type: YTN; PAM sequence: TTG
gactatttcaattcccagag

SEQ ID NO: 168580 - DNA, 20 bp, Artificial Sequence
  Description of Artificial Sequence: Synthetic oligonucleotide
  Target: ATXN1; (-) strand; PAM type: YTN; PAM sequence: CTT
ggactatttcaattcccaga

SEQ ID NO: 168581 - DNA, 20 bp, Artificial Sequence
  Description of Artificial Sequence: Synthetic oligonucleotide
  Target: ATXN1; (-) strand; PAM type: YTN; PAM sequence: TTC
caaagcaaatagcttggact

SEQ ID NO: 168582 - DNA, 20 bp, Artificial Sequence
  Description of Artificial Sequence: Synthetic oligonucleotide
  Target: ATXN1; (-) strand; PAM type: YTN; PAM sequence: TTT
ccaaagcaaatagcttggac

SEQ ID NO: 168583 - DNA, 20 bp, Artificial Sequence
  Description of Artificial Sequence: Synthetic oligonucleotide
  Target: ATXN1; (-) strand; PAM type: YTN; PAM sequence: TTT
tccaaagcaaatagcttgga

SEQ ID NO: 168584 - DNA, 20 bp, Artificial Sequence
  Description of Artificial Sequence: Synthetic oligonucleotide
  Target: ATXN1; (-) strand; PAM type: YTN; PAM sequence: TTC
acaatggagtatattttcca

SEQ ID NO: 168585 - DNA, 20 bp, Artificial Sequence
  Description of Artificial Sequence: Synthetic oligonucleotide
  Target: ATXN1; (-) strand; PAM type: YTN; PAM sequence: TTC
attcacaatggagtatattt

SEQ ID NO: 168586 - DNA, 20 bp, Artificial Sequence
  Description of Artificial Sequence: Synthetic oligonucleotide
  Target: ATXN1; (-) strand; PAM type: YTN; PAM sequence: TTT
cattcacaatggagtatatt

SEQ ID NO: 168587 - DNA, 20 bp, Artificial Sequence
  Description of Artificial Sequence: Synthetic oligonucleotide
  Target: ATXN1; (-) strand; PAM type: YTN; PAM sequence: CTT
tcattcacaatggagtatat

SEQ ID NO: 168588 - DNA, 20 bp, Artificial Sequence
  Description of Artificial Sequence: Synthetic oligonucleotide
  Target: ATXN1; (-) strand; PAM type: YTN; PAM sequence: TTG
gccataggcctttcattcac

SEQ ID NO: 168589 - DNA, 20 bp, Artificial Sequence
  Description of Artificial Sequence: Synthetic oligonucleotide
  Target: ATXN1; (-) strand; PAM type: YTN; PAM sequence: CTT
ggccataggcctttcattca

SEQ ID NO: 168590 - DNA, 20 bp, Artificial Sequence
  Description of Artificial Sequence: Synthetic oligonucleotide
  Target: ATXN1; (-) strand; PAM type: YTN; PAM sequence: TTG
tgccagaaggaaacaccttg

SEQ ID NO: 168591 - DNA, 20 bp, Artificial Sequence
  Description of Artificial Sequence: Synthetic oligonucleotide
  Target: ATXN1; (-) strand; PAM type: YTN; PAM sequence: CTT
gtgccagaaggaaacacctt

SEQ ID NO: 168592 - DNA, 20 bp, Artificial Sequence
  Description of Artificial Sequence: Synthetic oligonucleotide
  Target: ATXN1; (-) strand; PAM type: YTN; PAM sequence: TTC
ttgtgccagaaggaaacacc

SEQ ID NO: 168593 - DNA, 20 bp, Artificial Sequence
  Description of Artificial Sequence: Synthetic oligonucleotide
  Target: ATXN1; (-) strand; PAM type: YTN; PAM sequence: TTT
cttgtgccagaaggaaacac

SEQ ID NO: 168594 - DNA, 20 bp, Artificial Sequence
  Description of Artificial Sequence: Synthetic oligonucleotide
  Target: ATXN1; (-) strand; PAM type: YTN; PAM sequence: TTT
tcttgtgccagaaggaaaca

SEQ ID NO: 168595 - DNA, 20 bp, Artificial Sequence
  Description of Artificial Sequence: Synthetic oligonucleotide
  Target: ATXN1; (-) strand; PAM type: YTN; PAM sequence: CTT
ttcttgtgccagaaggaaac

SEQ ID NO: 168596 - DNA, 20 bp, Artificial Sequence
  Description of Artificial Sequence: Synthetic oligonucleotide
  Target: ATXN1; (-) strand; PAM type: YTN; PAM sequence: CTC
ttttcttgtgccagaaggaa

SEQ ID NO: 168597 - DNA, 20 bp, Artificial Sequence
  Description of Artificial Sequence: Synthetic oligonucleotide
  Target: ATXN1; (-) strand; PAM type: YTN; PAM sequence: TTC
tcttttcttgtgccagaagg

SEQ ID NO: 168598 - DNA, 20 bp, Artificial Sequence
  Description of Artificial Sequence: Synthetic oligonucleotide
  Target: ATXN1; (-) strand; PAM type: YTN; PAM sequence: TTT
ctcttttcttgtgccagaag

SEQ ID NO: 168599 - DNA, 20 bp, Artificial Sequence
  Description of Artificial Sequence: Synthetic oligonucleotide
  Target: ATXN1; (-) strand; PAM type: YTN; PAM sequence: TTT
tctcttttcttgtgccagaa

SEQ ID NO: 168600 - DNA, 20 bp, Artificial Sequence
  Description of Artificial Sequence: Synthetic oligonucleotide
  Target: ATXN1; (-) strand; PAM type: YTN; PAM sequence: CTT
ttctcttttcttgtgccaga

SEQ ID NO: 168601 - DNA, 20 bp, Artificial Sequence
  Description of Artificial Sequence: Synthetic oligonucleotide
  Target: ATXN1; (-) strand; PAM type: YTN; PAM sequence: CTG
tcttttctcttttcttgtgc

SEQ ID NO: 168602 - DNA, 20 bp, Artificial Sequence
  Description of Artificial Sequence: Synthetic oligonucleotide
  Target: ATXN1; (-) strand; PAM type: YTN; PAM sequence: TTC
tgtcttttctcttttcttgt

SEQ ID NO: 168603 - DNA, 20 bp, Artificial Sequence
  Description of Artificial Sequence: Synthetic oligonucleotide
  Target: ATXN1; (-) strand; PAM type: YTN; PAM sequence: CTG
ttctgtcttttctcttttct

SEQ ID NO: 168604 - DNA, 20 bp, Artificial Sequence
  Description of Artificial Sequence: Synthetic oligonucleotide
  Target: ATXN1; (-) strand; PAM type: YTN; PAM sequence: TTC
cctgttctgtcttttctctt

SEQ ID NO: 168605 - DNA, 20 bp, Artificial Sequence
  Description of Artificial Sequence: Synthetic oligonucleotide
  Target: ATXN1; (-) strand; PAM type: YTN; PAM sequence: CTT
ccctgttctgtcttttctct

SEQ ID NO: 168606 - DNA, 20 bp, Artificial Sequence
  Description of Artificial Sequence: Synthetic oligonucleotide
  Target: ATXN1; (-) strand; PAM type: YTN; PAM sequence: CTG
ccccttccctgttctgtctt

SEQ ID NO: 168607 - DNA, 20 bp, Artificial Sequence
  Description of Artificial Sequence: Synthetic oligonucleotide
  Target: ATXN1; (-) strand; PAM type: YTN; PAM sequence: TTC
cccctgccccttccctgttc

SEQ ID NO: 168608 - DNA, 20 bp, Artificial Sequence
  Description of Artificial Sequence: Synthetic oligonucleotide
  Target: ATXN1; (-) strand; PAM type: YTN; PAM sequence: CTT
ccccctgccccttccctgtt

SEQ ID NO: 168609 - DNA, 20 bp, Artificial Sequence
  Description of Artificial Sequence: Synthetic oligonucleotide
  Target: ATXN1; (-) strand; PAM type: YTN; PAM sequence: TTA
tcagacttccccctgcccct

SEQ ID NO: 168610 - DNA, 20 bp, Artificial Sequence
  Description of Artificial Sequence: Synthetic oligonucleotide
  Target: ATXN1; (-) strand; PAM type: YTN; PAM sequence: TTT
atcagacttccccctgcccc

SEQ ID NO: 168611 - DNA, 20 bp, Artificial Sequence
  Description of Artificial Sequence: Synthetic oligonucleotide
  Target: ATXN1; (-) strand; PAM type: YTN; PAM sequence: TTT
tatcagacttccccctgccc

SEQ ID NO: 168612 - DNA, 20 bp, Artificial Sequence
  Description of Artificial Sequence: Synthetic oligonucleotide
  Target: ATXN1; (-) strand; PAM type: YTN; PAM sequence: TTT
ttatcagacttccccctgcc

SEQ ID NO: 168613 - DNA, 20 bp, Artificial Sequence
  Description of Artificial Sequence: Synthetic oligonucleotide
  Target: ATXN1; (-) strand; PAM type: YTN; PAM sequence: TTG
aacagatagtccatttttat

SEQ ID NO: 168614 - DNA, 20 bp, Artificial Sequence
  Description of Artificial Sequence: Synthetic oligonucleotide
  Target: ATXN1; (-) strand; PAM type: YTN; PAM sequence: CTG
taggtaattgaacagatagt

SEQ ID NO: 168615 - DNA, 20 bp, Artificial Sequence
  Description of Artificial Sequence: Synthetic oligonucleotide
  Target: ATXN1; (-) strand; PAM type: YTN; PAM sequence: CTA
aagtaaagcccagtgggaaa

SEQ ID NO: 168616 - DNA, 20 bp, Artificial Sequence
  Description of Artificial Sequence: Synthetic oligonucleotide
  Target: ATXN1; (-) strand; PAM type: YTN; PAM sequence: TTC
taaagtaaagcccagtggga

SEQ ID NO: 168617 - DNA, 20 bp, Artificial Sequence
  Description of Artificial Sequence: Synthetic oligonucleotide
  Target: ATXN1; (-) strand; PAM type: YTN; PAM sequence: TTT
ctaaagtaaagcccagtggg

SEQ ID NO: 168618 - DNA, 20 bp, Artificial Sequence
  Description of Artificial Sequence: Synthetic oligonucleotide
  Target: ATXN1; (-) strand; PAM type: YTN; PAM sequence: CTT
tctaaagtaaagcccagtgg

SEQ ID NO: 168619 - DNA, 20 bp, Artificial Sequence
  Description of Artificial Sequence: Synthetic oligonucleotide
  Target: ATXN1; (-) strand; PAM type: YTN; PAM sequence: CTG
tacaactttctaaagtaaag

SEQ ID NO: 168620 - DNA, 20 bp, Artificial Sequence
  Description of Artificial Sequence: Synthetic oligonucleotide
  Target: ATXN1; (-) strand; PAM type: YTN; PAM sequence: TTA
acctgtacaactttctaaag

SEQ ID NO: 168621 - DNA, 20 bp, Artificial Sequence
  Description of Artificial Sequence: Synthetic oligonucleotide
  Target: ATXN1; (-) strand; PAM type: YTN; PAM sequence: TTG
tggatagcattaacctgtac

SEQ ID NO: 168622 - DNA, 20 bp, Artificial Sequence
  Description of Artificial Sequence: Synthetic oligonucleotide
  Target: ATXN1; (-) strand; PAM type: YTN; PAM sequence: CTT
gtggatagcattaacctgta

SEQ ID NO: 168623 - DNA, 20 bp, Artificial Sequence
  Description of Artificial Sequence: Synthetic oligonucleotide
  Target: ATXN1; (-) strand; PAM type: YTN; PAM sequence: CTG
tgccatggggcaccagtgcc

SEQ ID NO: 168624 - DNA, 20 bp, Artificial Sequence
  Description of Artificial Sequence: Synthetic oligonucleotide
  Target: ATXN1; (-) strand; PAM type: YTN; PAM sequence: TTA
gtgtaccatgtgccatcccg

SEQ ID NO: 168625 - DNA, 20 bp, Artificial Sequence
  Description of Artificial Sequence: Synthetic oligonucleotide
  Target: ATXN1; (-) strand; PAM type: YTN; PAM sequence: CTA
ttagtgtaccatgtgccatc

SEQ ID NO: 168626 - DNA, 20 bp, Artificial Sequence
  Description of Artificial Sequence: Synthetic oligonucleotide
  Target: ATXN1; (-) strand; PAM type: YTN; PAM sequence: CTA
ataataagtgtgctattagt

SEQ ID NO: 168627 - DNA, 20 bp, Artificial Sequence
  Description of Artificial Sequence: Synthetic oligonucleotide
  Target: ATXN1; (-) strand; PAM type: YTN; PAM sequence: TTA
tgtaaccatgcagaaaatct

SEQ ID NO: 168628 - DNA, 20 bp, Artificial Sequence
  Description of Artificial Sequence: Synthetic oligonucleotide
  Target: ATXN1; (-) strand; PAM type: YTN; PAM sequence: CTT
atgtaaccatgcagaaaatc

SEQ ID NO: 168629 - DNA, 20 bp, Artificial Sequence
  Description of Artificial Sequence: Synthetic oligonucleotide
  Target: ATXN1; (-) strand; PAM type: YTN; PAM sequence: TTG
taggcttatgtaaccatgca

SEQ ID NO: 168630 - DNA, 20 bp, Artificial Sequence
  Description of Artificial Sequence: Synthetic oligonucleotide
  Target: ATXN1; (-) strand; PAM type: YTN; PAM sequence: TTT
gtaggcttatgtaaccatgc

SEQ ID NO: 168631 - DNA, 20 bp, Artificial Sequence
  Description of Artificial Sequence: Synthetic oligonucleotide
  Target: ATXN1; (-) strand; PAM type: YTN; PAM sequence: TTT
tgtaggcttatgtaaccatg

SEQ ID NO: 168632 - DNA, 20 bp, Artificial Sequence
  Description of Artificial Sequence: Synthetic oligonucleotide
  Target: ATXN1; (-) strand; PAM type: YTN; PAM sequence: CTT
ttgtaggcttatgtaaccat

SEQ ID NO: 168633 - DNA, 20 bp, Artificial Sequence
  Description of Artificial Sequence: Synthetic oligonucleotide
  Target: ATXN1; (-) strand; PAM type: YTN; PAM sequence: TTC
ccttttgtaggcttatgtaa

SEQ ID NO: 168634 - DNA, 20 bp, Artificial Sequence
  Description of Artificial Sequence: Synthetic oligonucleotide
  Target: ATXN1; (-) strand; PAM type: YTN; PAM sequence: TTT
cccttttgtaggcttatgta

SEQ ID NO: 168635 - DNA, 20 bp, Artificial Sequence
  Description of Artificial Sequence: Synthetic oligonucleotide
  Target: ATXN1; (-) strand; PAM type: YTN; PAM sequence: TTT
tcccttttgtaggcttatgt

SEQ ID NO: 168636 - DNA, 20 bp, Artificial Sequence
  Description of Artificial Sequence: Synthetic oligonucleotide
  Target: ATXN1; (-) strand; PAM type: YTN; PAM sequence: TTT
ttcccttttgtaggcttatg

SEQ ID NO: 168637 - DNA, 20 bp, Artificial Sequence
  Description of Artificial Sequence: Synthetic oligonucleotide
  Target: ATXN1; (-) strand; PAM type: YTN; PAM sequence: TTA
catttttcccttttgtaggc

SEQ ID NO: 168638 - DNA, 20 bp, Artificial Sequence
  Description of Artificial Sequence: Synthetic oligonucleotide
  Target: ATXN1; (-) strand; PAM type: YTN; PAM sequence: TTT
acatttttcccttttgtagg

SEQ ID NO: 168639 - DNA, 20 bp, Artificial Sequence
  Description of Artificial Sequence: Synthetic oligonucleotide
  Target: ATXN1; (-) strand; PAM type: YTN; PAM sequence: TTG
aatcatttacatttttccct

SEQ ID NO: 168640 - DNA, 20 bp, Artificial Sequence
  Description of Artificial Sequence: Synthetic oligonucleotide
  Target: ATXN1; (-) strand; PAM type: YTN; PAM sequence: CTT
gaatcatttacatttttccc

SEQ ID NO: 168641 - DNA, 20 bp, Artificial Sequence
  Description of Artificial Sequence: Synthetic oligonucleotide
  Target: ATXN1; (-) strand; PAM type: YTN; PAM sequence: TTC
ttgaatcatttacatttttc

SEQ ID NO: 168642 - DNA, 20 bp, Artificial Sequence
  Description of Artificial Sequence: Synthetic oligonucleotide
  Target: ATXN1; (-) strand; PAM type: YTN; PAM sequence: CTT
cttgaatcatttacattttt

SEQ ID NO: 168643 - DNA, 20 bp, Artificial Sequence
  Description of Artificial Sequence: Synthetic oligonucleotide
  Target: ATXN1; (-) strand; PAM type: YTN; PAM sequence: TTC
atgagaaccgcatgaagaat

SEQ ID NO: 168644 - DNA, 20 bp, Artificial Sequence
  Description of Artificial Sequence: Synthetic oligonucleotide
  Target: ATXN1; (-) strand; PAM type: YTN; PAM sequence: TTT
catgagaaccgcatgaagaa

SEQ ID NO: 168645 - DNA, 20 bp, Artificial Sequence
  Description of Artificial Sequence: Synthetic oligonucleotide
  Target: ATXN1; (-) strand; PAM type: YTN; PAM sequence: TTA
aagatttcatgagaaccgca

SEQ ID NO: 168646 - DNA, 20 bp, Artificial Sequence
  Description of Artificial Sequence: Synthetic oligonucleotide
  Target: ATXN1; (-) strand; PAM type: YTN; PAM sequence: TTA
agatattaaagatttcatga

SEQ ID NO: 168647 - DNA, 20 bp, Artificial Sequence
  Description of Artificial Sequence: Synthetic oligonucleotide
  Target: ATXN1; (-) strand; PAM type: YTN; PAM sequence: CTT
aagatattaaagatttcatg

SEQ ID NO: 168648 - DNA, 20 bp, Artificial Sequence
  Description of Artificial Sequence: Synthetic oligonucleotide
  Target: ATXN1; (-) strand; PAM type: YTN; PAM sequence: CTA
agtcttaagatattaaagat

SEQ ID NO: 168649 - DNA, 20 bp, Artificial Sequence
  Description of Artificial Sequence: Synthetic oligonucleotide
  Target: ATXN1; (-) strand; PAM type: YTN; PAM sequence: TTC
ctaagtcttaagatattaaa

SEQ ID NO: 168650 - DNA, 20 bp, Artificial Sequence
  Description of Artificial Sequence: Synthetic oligonucleotide
  Target: ATXN1; (-) strand; PAM type: YTN; PAM sequence: CTT
cctaagtcttaagatattaa

SEQ ID NO: 168651 - DNA, 20 bp, Artificial Sequence
  Description of Artificial Sequence: Synthetic oligonucleotide
  Target: ATXN1; (-) strand; PAM type: YTN; PAM sequence: TTC
ttcctaagtcttaagatatt

SEQ ID NO: 168652 - DNA, 20 bp, Artificial Sequence
  Description of Artificial Sequence: Synthetic oligonucleotide
  Target: ATXN1; (-) strand; PAM type: YTN; PAM sequence: TTG
ccaggagagttcttcctaag

SEQ ID NO: 168653 - DNA, 20 bp, Artificial Sequence
  Description of Artificial Sequence: Synthetic oligonucleotide
  Target: ATXN1; (-) strand; PAM type: YTN; PAM sequence: CTT
gccaggagagttcttcctaa

SEQ ID NO: 168654 - DNA, 20 bp, Artificial Sequence
  Description of Artificial Sequence: Synthetic oligonucleotide
  Target: ATXN1; (-) strand; PAM type: YTN; PAM sequence: TTG
atcgtatcttgccaggagag

SEQ ID NO: 168655 - DNA, 20 bp, Artificial Sequence
  Description of Artificial Sequence: Synthetic oligonucleotide
  Target: ATXN1; (-) strand; PAM type: YTN; PAM sequence: CTA
atgaagcatgaaaattgatc

SEQ ID NO: 168656 - DNA, 20 bp, Artificial Sequence
  Description of Artificial Sequence: Synthetic oligonucleotide
  Target: ATXN1; (-) strand; PAM type: YTN; PAM sequence: TTC
ctaatgaagcatgaaaattg

SEQ ID NO: 168657 - DNA, 20 bp, Artificial Sequence
  Description of Artificial Sequence: Synthetic oligonucleotide
  Target: ATXN1; (-) strand; PAM type: YTN; PAM sequence: TTT
cctaatgaagcatgaaaatt

SEQ ID NO: 168658 - DNA, 20 bp, Artificial Sequence
  Description of Artificial Sequence: Synthetic oligonucleotide
  Target: ATXN1; (-) strand; PAM type: YTN; PAM sequence: TTT
tcctaatgaagcatgaaaat

SEQ ID NO: 168659 - DNA, 20 bp, Artificial Sequence
  Description of Artificial Sequence: Synthetic oligonucleotide
  Target: ATXN1; (-) strand; PAM type: YTN; PAM sequence: TTT
ttcctaatgaagcatgaaaa

SEQ ID NO: 168660 - DNA, 20 bp, Artificial Sequence
  Description of Artificial Sequence: Synthetic oligonucleotide
  Target: ATXN1; (-) strand; PAM type: YTN; PAM sequence: TTT
tttcctaatgaagcatgaaa

SEQ ID NO: 168661 - DNA, 20 bp, Artificial Sequence
  Description of Artificial Sequence: Synthetic oligonucleotide
  Target: ATXN1; (-) strand; PAM type: YTN; PAM sequence: CTT
ttttcctaatgaagcatgaa

SEQ ID NO: 168662 - DNA, 20 bp, Artificial Sequence
  Description of Artificial Sequence: Synthetic oligonucleotide
  Target: ATXN1; (-) strand; PAM type: YTN; PAM sequence: CTG
aaagggcttttttcctaatg

SEQ ID NO: 168663 - DNA, 20 bp, Artificial Sequence
  Description of Artificial Sequence: Synthetic oligonucleotide
  Target: ATXN1; (-) strand; PAM type: YTN; PAM sequence: TTA
ctgaaagggcttttttccta

SEQ ID NO: 168664 - DNA, 20 bp, Artificial Sequence
  Description of Artificial Sequence: Synthetic oligonucleotide
  Target: ATXN1; (-) strand; PAM type: YTN; PAM sequence: CTG
taacattactgaaagggctt

SEQ ID NO: 168665 - DNA, 20 bp, Artificial Sequence
  Description of Artificial Sequence: Synthetic oligonucleotide
  Target: ATXN1; (-) strand; PAM type: YTN; PAM sequence: TTC
tgtaacattactgaaagggc

SEQ ID NO: 168666 - DNA, 20 bp, Artificial Sequence
  Description of Artificial Sequence: Synthetic oligonucleotide
  Target: ATXN1; (-) strand; PAM type: YTN; PAM sequence: TTT
ctgtaacattactgaaaggg

SEQ ID NO: 168667 - DNA, 20 bp, Artificial Sequence
  Description of Artificial Sequence: Synthetic oligonucleotide
  Target: ATXN1; (-) strand; PAM type: YTN; PAM sequence: CTA
tagccatttctgtaacatta

SEQ ID NO: 168668 - DNA, 20 bp, Artificial Sequence
  Description of Artificial Sequence: Synthetic oligonucleotide
  Target: ATXN1; (-) strand; PAM type: YTN; PAM sequence: TTG
cctatagccatttctgtaac

SEQ ID NO: 168669 - DNA, 20 bp, Artificial Sequence
  Description of Artificial Sequence: Synthetic oligonucleotide
  Target: ATXN1; (-) strand; PAM type: YTN; PAM sequence: TTT
gcctatagccatttctgtaa

SEQ ID NO: 168670 - DNA, 20 bp, Artificial Sequence
  Description of Artificial Sequence: Synthetic oligonucleotide
  Target: ATXN1; (-) strand; PAM type: YTN; PAM sequence: TTT
tgcctatagccatttctgta

SEQ ID NO: 168671 - DNA, 20 bp, Artificial Sequence
  Description of Artificial Sequence: Synthetic oligonucleotide
  Target: ATXN1; (-) strand; PAM type: YTN; PAM sequence: CTT
ttgcctatagccatttctgt

SEQ ID NO: 168672 - DNA, 20 bp, Artificial Sequence
  Description of Artificial Sequence: Synthetic oligonucleotide
  Target: ATXN1; (-) strand; PAM type: YTN; PAM sequence: CTC
ttttgcctatagccatttct

SEQ ID NO: 168673 - DNA, 20 bp, Artificial Sequence
  Description of Artificial Sequence: Synthetic oligonucleotide
  Target: ATXN1; (-) strand; PAM type: YTN; PAM sequence: CTC
tcttttgcctatagccattt

SEQ ID NO: 168674 - DNA, 20 bp, Artificial Sequence
  Description of Artificial Sequence: Synthetic oligonucleotide
  Target: ATXN1; (-) strand; PAM type: YTN; PAM sequence: TTC
tctcttttgcctatagccat

SEQ ID NO: 168675 - DNA, 20 bp, Artificial Sequence
  Description of Artificial Sequence: Synthetic oligonucleotide
  Target: ATXN1; (-) strand; PAM type: YTN; PAM sequence: TTT
ctctcttttgcctatagcca

SEQ ID NO: 168676 - DNA, 20 bp, Artificial Sequence
  Description of Artificial Sequence: Synthetic oligonucleotide
  Target: ATXN1; (-) strand; PAM type: YTN; PAM sequence: TTT
tctctcttttgcctatagcc

SEQ ID NO: 168677 - DNA, 20 bp, Artificial Sequence
  Description of Artificial Sequence: Synthetic oligonucleotide
  Target: ATXN1; (-) strand; PAM type: YTN; PAM sequence: TTT
ttctctcttttgcctatagc

SEQ ID NO: 168678 - DNA, 20 bp, Artificial Sequence
  Description of Artificial Sequence: Synthetic oligonucleotide
  Target: ATXN1; (-) strand; PAM type: YTN; PAM sequence: TTT
tttctctcttttgcctatag

SEQ ID NO: 168679 - DNA, 20 bp, Artificial Sequence
  Description of Artificial Sequence: Synthetic oligonucleotide
  Target: ATXN1; (-) strand; PAM type: YTN; PAM sequence: TTT
ttttctctcttttgcctata

SEQ ID NO: 168680 - DNA, 20 bp, Artificial Sequence
  Description of Artificial Sequence: Synthetic oligonucleotide
  Target: ATXN1; (-) strand; PAM type: YTN; PAM sequence: TTC
agtccagagtgtaatttttt

SEQ ID NO: 168681 - DNA, 20 bp, Artificial Sequence
  Description of Artificial Sequence: Synthetic oligonucleotide
  Target: ATXN1; (-) strand; PAM type: YTN; PAM sequence: TTG
ttcagtccagagtgtaattt

SEQ ID NO: 168682 - DNA, 20 bp, Artificial Sequence
  Description of Artificial Sequence: Synthetic oligonucleotide
  Target: ATXN1; (-) strand; PAM type: YTN; PAM sequence: TTT
gttcagtccagagtgtaatt

SEQ ID NO: 168683 - DNA, 20 bp, Artificial Sequence
  Description of Artificial Sequence: Synthetic oligonucleotide
  Target: ATXN1; (-) strand; PAM type: YTN; PAM sequence: TTT
tgttcagtccagagtgtaat

SEQ ID NO: 168684 - DNA, 20 bp, Artificial Sequence
  Description of Artificial Sequence: Synthetic oligonucleotide
  Target: ATXN1; (-) strand; PAM type: YTN; PAM sequence: TTG
gggttttgttcagtccagag

SEQ ID NO: 168685 - DNA, 20 bp, Artificial Sequence
  Description of Artificial Sequence: Synthetic oligonucleotide
  Target: ATXN1; (-) strand; PAM type: YTN; PAM sequence: CTT
ggggttttgttcagtccaga

SEQ ID NO: 168686 - DNA, 20 bp, Artificial Sequence
  Description of Artificial Sequence: Synthetic oligonucleotide
  Target: ATXN1; (-) strand; PAM type: YTN; PAM sequence: TTA
gtccaaagtgccttggggtt

SEQ ID NO: 168687 - DNA, 20 bp, Artificial Sequence
  Description of Artificial Sequence: Synthetic oligonucleotide
  Target: ATXN1; (-) strand; PAM type: YTN; PAM sequence: TTT
agtccaaagtgccttggggt

SEQ ID NO: 168688 - DNA, 20 bp, Artificial Sequence
  Description of Artificial Sequence: Synthetic oligonucleotide
  Target: ATXN1; (-) strand; PAM type: YTN; PAM sequence: CTG
tgggtacaaagaaaggattt

SEQ ID NO: 168689 - DNA, 20 bp, Artificial Sequence
  Description of Artificial Sequence: Synthetic oligonucleotide
  Target: ATXN1; (-) strand; PAM type: YTN; PAM sequence: TTC
agatatgctgtgggtacaaa

SEQ ID NO: 168690 - DNA, 20 bp, Artificial Sequence
  Description of Artificial Sequence: Synthetic oligonucleotide
  Target: ATXN1; (-) strand; PAM type: YTN; PAM sequence: TTT
cagatatgctgtgggtacaa

SEQ ID NO: 168691 - DNA, 20 bp, Artificial Sequence
  Description of Artificial Sequence: Synthetic oligonucleotide
  Target: ATXN1; (-) strand; PAM type: YTN; PAM sequence: CTT
tcagatatgctgtgggtaca

SEQ ID NO: 168692 - DNA, 20 bp, Artificial Sequence
  Description of Artificial Sequence: Synthetic oligonucleotide
  Target: ATXN1; (-) strand; PAM type: YTN; PAM sequence: CTC
ctttcagatatgctgtgggt

SEQ ID NO: 168693 - DNA, 20 bp, Artificial Sequence
  Description of Artificial Sequence: Synthetic oligonucleotide
  Target: ATXN1; (-) strand; PAM type: YTN; PAM sequence: TTC
tcctttcagatatgctgtgg

SEQ ID NO: 168694 - DNA, 20 bp, Artificial Sequence
  Description of Artificial Sequence: Synthetic oligonucleotide
  Target: ATXN1; (-) strand; PAM type: YTN; PAM sequence: CTT
ctcctttcagatatgctgtg

SEQ ID NO: 168695 - DNA, 20 bp, Artificial Sequence
  Description of Artificial Sequence: Synthetic oligonucleotide
  Target: ATXN1; (-) strand; PAM type: YTN; PAM sequence: TTG
cttctcctttcagatatgct

SEQ ID NO: 168696 - DNA, 20 bp, Artificial Sequence
  Description of Artificial Sequence: Synthetic oligonucleotide
  Target: ATXN1; (-) strand; PAM type: YTN; PAM sequence: CTA
gtcaaaatacaatccccaca

SEQ ID NO: 168697 - DNA, 20 bp, Artificial Sequence
  Description of Artificial Sequence: Synthetic oligonucleotide
  Target: ATXN1; (-) strand; PAM type: YTN; PAM sequence: CTG
tgggtagacaggctagtcaa

SEQ ID NO: 168698 - DNA, 20 bp, Artificial Sequence
  Description of Artificial Sequence: Synthetic oligonucleotide
  Target: ATXN1; (-) strand; PAM type: YTN; PAM sequence: TTC
tgtgggtagacaggctagtc

SEQ ID NO: 168699 - DNA, 20 bp, Artificial Sequence
  Description of Artificial Sequence: Synthetic oligonucleotide
  Target: ATXN1; (-) strand; PAM type: YTN; PAM sequence: TTA
aatgaaattctgtgggtaga

SEQ ID NO: 168700 - DNA, 20 bp, Artificial Sequence
  Description of Artificial Sequence: Synthetic oligonucleotide
  Target: ATXN1; (-) strand; PAM type: YTN; PAM sequence: CTA
gattaaatgaaattctgtgg

SEQ ID NO: 168701 - DNA, 20 bp, Artificial Sequence
  Description of Artificial Sequence: Synthetic oligonucleotide
  Target: ATXN1; (-) strand; PAM type: YTN; PAM sequence: CTC
cacctagattaaatgaaatt

SEQ ID NO: 168702 - DNA, 20 bp, Artificial Sequence
  Description of Artificial Sequence: Synthetic oligonucleotide
  Target: ATXN1; (-) strand; PAM type: YTN; PAM sequence: TTG
ataacaactccacctagatt

SEQ ID NO: 168703 - DNA, 20 bp, Artificial Sequence
  Description of Artificial Sequence: Synthetic oligonucleotide
  Target: ATXN1; (-) strand; PAM type: YTN; PAM sequence: CTA
aacagattgataacaactcc

SEQ ID NO: 168704 - DNA, 20 bp, Artificial Sequence
  Description of Artificial Sequence: Synthetic oligonucleotide
  Target: ATXN1; (-) strand; PAM type: YTN; PAM sequence: TTG
tgaaagactaaacagattga

SEQ ID NO: 168705 - DNA, 20 bp, Artificial Sequence
  Description of Artificial Sequence: Synthetic oligonucleotide
  Target: ATXN1; (-) strand; PAM type: YTN; PAM sequence: TTT
gtgaaagactaaacagattg

SEQ ID NO: 168706 - DNA, 20 bp, Artificial Sequence
  Description of Artificial Sequence: Synthetic oligonucleotide
  Target: ATXN1; (-) strand; PAM type: YTN; PAM sequence: TTC
aaatttgtgaaagactaaac

SEQ ID NO: 168707 - DNA, 20 bp, Artificial Sequence
  Description of Artificial Sequence: Synthetic oligonucleotide
  Target: ATXN1; (-) strand; PAM type: YTN; PAM sequence: CTT
caaatttgtgaaagactaaa

SEQ ID NO: 168708 - DNA, 20 bp, Artificial Sequence
  Description of Artificial Sequence: Synthetic oligonucleotide
  Target: ATXN1; (-) strand; PAM type: YTN; PAM sequence: CTA
cagtcccttcaaatttgtga

SEQ ID NO: 168709 - DNA, 20 bp, Artificial Sequence
  Description of Artificial Sequence: Synthetic oligonucleotide
  Target: ATXN1; (-) strand; PAM type: YTN; PAM sequence: TTA
agctacagtcccttcaaatt

SEQ ID NO: 168710 - DNA, 20 bp, Artificial Sequence
  Description of Artificial Sequence: Synthetic oligonucleotide
  Target: ATXN1; (-) strand; PAM type: YTN; PAM sequence: TTT
aagctacagtcccttcaaat

SEQ ID NO: 168711 - DNA, 20 bp, Artificial Sequence
  Description of Artificial Sequence: Synthetic oligonucleotide
  Target: ATXN1; (-) strand; PAM type: YTN; PAM sequence: TTG
gtttaagctacagtcccttc

SEQ ID NO: 168712 - DNA, 20 bp, Artificial Sequence
  Description of Artificial Sequence: Synthetic oligonucleotide
  Target: ATXN1; (-) strand; PAM type: YTN; PAM sequence: TTG
ttggtttaagctacagtccc

SEQ ID NO: 168713 - DNA, 20 bp, Artificial Sequence
  Description of Artificial Sequence: Synthetic oligonucleotide
  Target: ATXN1; (-) strand; PAM type: YTN; PAM sequence: TTG
agggtgattgttggtttaag

SEQ ID NO: 168714 - DNA, 20 bp, Artificial Sequence
  Description of Artificial Sequence: Synthetic oligonucleotide
  Target: ATXN1; (-) strand; PAM type: YTN; PAM sequence: TTT
gagggtgattgttggtttaa

SEQ ID NO: 168715 - DNA, 20 bp, Artificial Sequence
  Description of Artificial Sequence: Synthetic oligonucleotide
  Target: ATXN1; (-) strand; PAM type: YTN; PAM sequence: CTT
tgagggtgattgttggttta

SEQ ID NO: 168716 - DNA, 20 bp, Artificial Sequence
  Description of Artificial Sequence: Synthetic oligonucleotide
  Target: ATXN1; (-) strand; PAM type: YTN; PAM sequence: TTG
caatgctttgagggtgattg

SEQ ID NO: 168717 - DNA, 20 bp, Artificial Sequence
  Description of Artificial Sequence: Synthetic oligonucleotide
  Target: ATXN1; (-) strand; PAM type: YTN; PAM sequence: TTC
atatcattgcaatgctttga

SEQ ID NO: 168718 - DNA, 20 bp, Artificial Sequence
  Description of Artificial Sequence: Synthetic oligonucleotide
  Target: ATXN1; (-) strand; PAM type: YTN; PAM sequence: CTT
catatcattgcaatgctttg

SEQ ID NO: 168719 - DNA, 20 bp, Artificial Sequence
  Description of Artificial Sequence: Synthetic oligonucleotide
  Target: ATXN1; (-) strand; PAM type: YTN; PAM sequence: TTC
cttcatatcattgcaatgct

SEQ ID NO: 168720 - DNA, 20 bp, Artificial Sequence
  Description of Artificial Sequence: Synthetic oligonucleotide
  Target: ATXN1; (-) strand; PAM type: YTN; PAM sequence: TTT
ccttcatatcattgcaatgc

SEQ ID NO: 168721 - DNA, 20 bp, Artificial Sequence
  Description of Artificial Sequence: Synthetic oligonucleotide
  Target: ATXN1; (-) strand; PAM type: YTN; PAM sequence: CTG
tttccttcatatcattgcaa

SEQ ID NO: 168722 - DNA, 20 bp, Artificial Sequence
  Description of Artificial Sequence: Synthetic oligonucleotide
  Target: ATXN1; (-) strand; PAM type: YTN; PAM sequence: CTC
cacaggccccatgtcagctg

SEQ ID NO: 168723 - DNA, 20 bp, Artificial Sequence
  Description of Artificial Sequence: Synthetic oligonucleotide
  Target: ATXN1; (-) strand; PAM type: YTN; PAM sequence: TTC
ccacctccacaggccccatg

SEQ ID NO: 168724 - DNA, 20 bp, Artificial Sequence
  Description of Artificial Sequence: Synthetic oligonucleotide
  Target: ATXN1; (-) strand; PAM type: YTN; PAM sequence: TTT
cccacctccacaggccccat

SEQ ID NO: 168725 - DNA, 20 bp, Artificial Sequence
  Description of Artificial Sequence: Synthetic oligonucleotide
  Target: ATXN1; (-) strand; PAM type: YTN; PAM sequence: TTT
tcccacctccacaggcccca

SEQ ID NO: 168726 - DNA, 20 bp, Artificial Sequence
  Description of Artificial Sequence: Synthetic oligonucleotide
  Target: ATXN1; (-) strand; PAM type: YTN; PAM sequence: CTC
caatccaccattttcccacc

SEQ ID NO: 168727 - DNA, 20 bp, Artificial Sequence
  Description of Artificial Sequence: Synthetic oligonucleotide
  Target: ATXN1; (-) strand; PAM type: YTN; PAM sequence: CTC
tccaatccaccattttccca

SEQ ID NO: 168728 - DNA, 20 bp, Artificial Sequence
  Description of Artificial Sequence: Synthetic oligonucleotide
  Target: ATXN1; (-) strand; PAM type: YTN; PAM sequence: CTC
tctccaatccaccattttcc

SEQ ID NO: 168729 - DNA, 20 bp, Artificial Sequence
  Description of Artificial Sequence: Synthetic oligonucleotide
  Target: ATXN1; (-) strand; PAM type: YTN; PAM sequence: TTC
aagtgtatatggcctctctc

SEQ ID NO: 168730 - DNA, 20 bp, Artificial Sequence
  Description of Artificial Sequence: Synthetic oligonucleotide
  Target: ATXN1; (-) strand; PAM type: YTN; PAM sequence: TTG
cagaaattcaagtgtatatg

SEQ ID NO: 168731 - DNA, 20 bp, Artificial Sequence
  Description of Artificial Sequence: Synthetic oligonucleotide
  Target: ATXN1; (-) strand; PAM type: YTN; PAM sequence: TTT
gcagaaattcaagtgtatat

SEQ ID NO: 168732 - DNA, 20 bp, Artificial Sequence
  Description of Artificial Sequence: Synthetic oligonucleotide
  Target: ATXN1; (-) strand; PAM type: YTN; PAM sequence: CTT
tgcagaaattcaagtgtata

SEQ ID NO: 168733 - DNA, 20 bp, Artificial Sequence
  Description of Artificial Sequence: Synthetic oligonucleotide
  Target: ATXN1; (-) strand; PAM type: YTN; PAM sequence: CTG
cctttgcagaaattcaagtg

SEQ ID NO: 168734 - DNA, 20 bp, Artificial Sequence
  Description of Artificial Sequence: Synthetic oligonucleotide
  Target: ATXN1; (-) strand; PAM type: YTN; PAM sequence: CTC
tgcctttgcagaaattcaag

SEQ ID NO: 168735 - DNA, 20 bp, Artificial Sequence
  Description of Artificial Sequence: Synthetic oligonucleotide
  Target: ATXN1; (-) strand; PAM type: YTN; PAM sequence: TTG
cctctgcctttgcagaaatt

SEQ ID NO: 168736 - DNA, 20 bp, Artificial Sequence
  Description of Artificial Sequence: Synthetic oligonucleotide
  Target: ATXN1; (-) strand; PAM type: YTN; PAM sequence: TTT
gcctctgcctttgcagaaat

SEQ ID NO: 168737 - DNA, 20 bp, Artificial Sequence
  Description of Artificial Sequence: Synthetic oligonucleotide
  Target: ATXN1; (-) strand; PAM type: YTN; PAM sequence: TTA
aatgaaaaggaaagcgggaa

SEQ ID NO: 168738 - DNA, 20 bp, Artificial Sequence
  Description of Artificial Sequence: Synthetic oligonucleotide
  Target: ATXN1; (-) strand; PAM type: YTN; PAM sequence: TTT
aaatgaaaaggaaagcggga

SEQ ID NO: 168739 - DNA, 20 bp, Artificial Sequence
  Description of Artificial Sequence: Synthetic oligonucleotide
  Target: ATXN1; (-) strand; PAM type: YTN; PAM sequence: TTT
taaatgaaaaggaaagcggg

SEQ ID NO: 168740 - DNA, 20 bp, Artificial Sequence
  Description of Artificial Sequence: Synthetic oligonucleotide
  Target: ATXN1; (-) strand; PAM type: YTN; PAM sequence: CTG
tagattttaaatgaaaagga

SEQ ID NO: 168741 - DNA, 20 bp, Artificial Sequence
  Description of Artificial Sequence: Synthetic oligonucleotide
  Target: ATXN1; (-) strand; PAM type: YTN; PAM sequence: TTG
aaaagctgtagattttaaat

SEQ ID NO: 168742 - DNA, 20 bp, Artificial Sequence
  Description of Artificial Sequence: Synthetic oligonucleotide
  Target: ATXN1; (-) strand; PAM type: YTN; PAM sequence: CTT
gaaaagctgtagattttaaa

SEQ ID NO: 168743 - DNA, 20 bp, Artificial Sequence
  Description of Artificial Sequence: Synthetic oligonucleotide
  Target: ATXN1; (-) strand; PAM type: YTN; PAM sequence: TTG
tcttgaaaagctgtagattt

SEQ ID NO: 168744 - DNA, 20 bp, Artificial Sequence
  Description of Artificial Sequence: Synthetic oligonucleotide
  Target: ATXN1; (-) strand; PAM type: YTN; PAM sequence: CTG
aaataaagggaaattgtctt

SEQ ID NO: 168745 - DNA, 20 bp, Artificial Sequence
  Description of Artificial Sequence: Synthetic oligonucleotide
  Target: ATXN1; (-) strand; PAM type: YTN; PAM sequence: CTC
ctgaaataaagggaaattgt

SEQ ID NO: 168746 - DNA, 20 bp, Artificial Sequence
  Description of Artificial Sequence: Synthetic oligonucleotide
  Target: ATXN1; (-) strand; PAM type: YTN; PAM sequence: TTC
tcctgaaataaagggaaatt

SEQ ID NO: 168747 - DNA, 20 bp, Artificial Sequence
  Description of Artificial Sequence: Synthetic oligonucleotide
  Target: ATXN1; (-) strand; PAM type: YTN; PAM sequence: CTC
gattctcctgaaataaaggg

SEQ ID NO: 168748 - DNA, 20 bp, Artificial Sequence
  Description of Artificial Sequence: Synthetic oligonucleotide
  Target: ATXN1; (-) strand; PAM type: YTN; PAM sequence: TTC
tcgattctcctgaaataaag

SEQ ID NO: 168749 - DNA, 20 bp, Artificial Sequence
  Description of Artificial Sequence: Synthetic oligonucleotide
  Target: ATXN1; (-) strand; PAM type: YTN; PAM sequence: TTG
tattctcgattctcctgaaa

SEQ ID NO: 168750 - DNA, 20 bp, Artificial Sequence
  Description of Artificial Sequence: Synthetic oligonucleotide
  Target: ATXN1; (-) strand; PAM type: YTN; PAM sequence: TTT
gtattctcgattctcctgaa

SEQ ID NO: 168751 - DNA, 20 bp, Artificial Sequence
  Description of Artificial Sequence: Synthetic oligonucleotide
  Target: ATXN1; (-) strand; PAM type: YTN; PAM sequence: TTT
tgtattctcgattctcctga

SEQ ID NO: 168752 - DNA, 20 bp, Artificial Sequence
  Description of Artificial Sequence: Synthetic oligonucleotide
  Target: ATXN1; (-) strand; PAM type: YTN; PAM sequence: TTT
ttgtattctcgattctcctg

SEQ ID NO: 168753 - DNA, 20 bp, Artificial Sequence
  Description of Artificial Sequence: Synthetic oligonucleotide
  Target: ATXN1; (-) strand; PAM type: YTN; PAM sequence: TTA
tttttgtattctcgattctc

SEQ ID NO: 168754 - DNA, 20 bp, Artificial Sequence
  Description of Artificial Sequence: Synthetic oligonucleotide
  Target: ATXN1; (-) strand; PAM type: YTN; PAM sequence: TTT
atttttgtattctcgattct

SEQ ID NO: 168755 - DNA, 20 bp, Artificial Sequence
  Description of Artificial Sequence: Synthetic oligonucleotide
  Target: ATXN1; (-) strand; PAM type: YTN; PAM sequence: TTA
agacatttatttttgtattc

SEQ ID NO: 168756 - DNA, 20 bp, Artificial Sequence
  Description of Artificial Sequence: Synthetic oligonucleotide
  Target: ATXN1; (-) strand; PAM type: YTN; PAM sequence: CTT
aagacatttatttttgtatt

SEQ ID NO: 168757 - DNA, 20 bp, Artificial Sequence
  Description of Artificial Sequence: Synthetic oligonucleotide
  Target: ATXN1; (-) strand; PAM type: YTN; PAM sequence: TTC
aagtgtcagaaaaaaataat

SEQ ID NO: 168758 - DNA, 20 bp, Artificial Sequence
  Description of Artificial Sequence: Synthetic oligonucleotide
  Target: ATXN1; (-) strand; PAM type: YTN; PAM sequence: CTA
ttcaagtgtcagaaaaaaat

SEQ ID NO: 168759 - DNA, 20 bp, Artificial Sequence
  Description of Artificial Sequence: Synthetic oligonucleotide
  Target: ATXN1; (-) strand; PAM type: YTN; PAM sequence: TTG
tcaactattcaagtgtcaga

SEQ ID NO: 168760 - DNA, 20 bp, Artificial Sequence
  Description of Artificial Sequence: Synthetic oligonucleotide
  Target: ATXN1; (-) strand; PAM type: YTN; PAM sequence: TTT
gtcaactattcaagtgtcag

SEQ ID NO: 168761 - DNA, 20 bp, Artificial Sequence
  Description of Artificial Sequence: Synthetic oligonucleotide
  Target: ATXN1; (-) strand; PAM type: YTN; PAM sequence: TTC
agagtttgtcaactattcaa

SEQ ID NO: 168762 - DNA, 20 bp, Artificial Sequence
  Description of Artificial Sequence: Synthetic oligonucleotide
  Target: ATXN1; (-) strand; PAM type: YTN; PAM sequence: TTT
cagagtttgtcaactattca

SEQ ID NO: 168763 - DNA, 20 bp, Artificial Sequence
  Description of Artificial Sequence: Synthetic oligonucleotide
  Target: ATXN1; (-) strand; PAM type: YTN; PAM sequence: TTA
aaagaagtgatttcagagtt

SEQ ID NO: 168764 - DNA, 20 bp, Artificial Sequence
  Description of Artificial Sequence: Synthetic oligonucleotide
  Target: ATXN1; (-) strand; PAM type: YTN; PAM sequence: TTT
aaaagaagtgatttcagagt

SEQ ID NO: 168765 - DNA, 20 bp, Artificial Sequence
  Description of Artificial Sequence: Synthetic oligonucleotide
  Target: ATXN1; (-) strand; PAM type: YTN; PAM sequence: TTA
ggtttaaaagaagtgatttc

SEQ ID NO: 168766 - DNA, 20 bp, Artificial Sequence
  Description of Artificial Sequence: Synthetic oligonucleotide
  Target: ATXN1; (-) strand; PAM type: YTN; PAM sequence: TTG
gtatcaacattaggtttaaa

SEQ ID NO: 168767 - DNA, 20 bp, Artificial Sequence
  Description of Artificial Sequence: Synthetic oligonucleotide
  Target: ATXN1; (-) strand; PAM type: YTN; PAM sequence: TTT
ggtatcaacattaggtttaa

SEQ ID NO: 168768 - DNA, 20 bp, Artificial Sequence
  Description of Artificial Sequence: Synthetic oligonucleotide
  Target: ATXN1; (-) strand; PAM type: YTN; PAM sequence: TTG
agtccaaaaagtagaatttg

SEQ ID NO: 168769 - DNA, 20 bp, Artificial Sequence
  Description of Artificial Sequence: Synthetic oligonucleotide
  Target: ATXN1; (-) strand; PAM type: YTN; PAM sequence: TTT
gagtccaaaaagtagaattt

SEQ ID NO: 168770 - DNA, 20 bp, Artificial Sequence
  Description of Artificial Sequence: Synthetic oligonucleotide
  Target: ATXN1; (-) strand; PAM type: YTN; PAM sequence: TTT
tgagtccaaaaagtagaatt

SEQ ID NO: 168771 - DNA, 20 bp, Artificial Sequence
  Description of Artificial Sequence: Synthetic oligonucleotide
  Target: ATXN1; (-) strand; PAM type: YTN; PAM sequence: TTT
ttgagtccaaaaagtagaat

SEQ ID NO: 168772 - DNA, 20 bp, Artificial Sequence
  Description of Artificial Sequence: Synthetic oligonucleotide
  Target: ATXN1; (-) strand; PAM type: YTN; PAM sequence: TTT
tttgagtccaaaaagtagaa

SEQ ID NO: 168773 - DNA, 20 bp, Artificial Sequence
  Description of Artificial Sequence: Synthetic oligonucleotide
  Target: ATXN1; (-) strand; PAM type: YTN; PAM sequence: TTT
ttttgagtccaaaaagtaga

SEQ ID NO: 168774 - DNA, 20 bp, Artificial Sequence
  Description of Artificial Sequence: Synthetic oligonucleotide
  Target: ATXN1; (-) strand; PAM type: YTN; PAM sequence: CTG
tttttttgagtccaaaaagt

SEQ ID NO: 168775 - DNA, 20 bp, Artificial Sequence
  Description of Artificial Sequence: Synthetic oligonucleotide
  Target: ATXN1; (-) strand; PAM type: YTN; PAM sequence: CTA
aagactgtttttttgagtcc

SEQ ID NO: 168776 - DNA, 20 bp, Artificial Sequence
  Description of Artificial Sequence: Synthetic oligonucleotide
  Target: ATXN1; (-) strand; PAM type: YTN; PAM sequence: TTC
taaagactgtttttttgagt

SEQ ID NO: 168777 - DNA, 20 bp, Artificial Sequence
  Description of Artificial Sequence: Synthetic oligonucleotide
  Target: ATXN1; (-) strand; PAM type: YTN; PAM sequence: TTG
aacaattctaaagactgttt

SEQ ID NO: 168778 - DNA, 20 bp, Artificial Sequence
  Description of Artificial Sequence: Synthetic oligonucleotide
  Target: ATXN1; (-) strand; PAM type: YTN; PAM sequence: TTA
aattgaacaattctaaagac

SEQ ID NO: 168779 - DNA, 20 bp, Artificial Sequence
  Description of Artificial Sequence: Synthetic oligonucleotide
  Target: ATXN1; (-) strand; PAM type: YTN; PAM sequence: TTT
aaattgaacaattctaaaga

SEQ ID NO: 168780 - DNA, 20 bp, Artificial Sequence
  Description of Artificial Sequence: Synthetic oligonucleotide
  Target: ATXN1; (-) strand; PAM type: YTN; PAM sequence: TTT
taaattgaacaattctaaag

SEQ ID NO: 168781 - DNA, 20 bp, Artificial Sequence
  Description of Artificial Sequence: Synthetic oligonucleotide
  Target: ATXN1; (-) strand; PAM type: YTN; PAM sequence: CTT
ttaaattgaacaattctaaa

SEQ ID NO: 168782 - DNA, 20 bp, Artificial Sequence
  Description of Artificial Sequence: Synthetic oligonucleotide
  Target: ATXN1; (-) strand; PAM type: YTN; PAM sequence: CTA
cagtatgacaaggcttttaa

SEQ ID NO: 168783 - DNA, 20 bp, Artificial Sequence
  Description of Artificial Sequence: Synthetic oligonucleotide
  Target: ATXN1; (-) strand; PAM type: YTN; PAM sequence: TTG
agtatatataactacagtat

SEQ ID NO: 168784 - DNA, 20 bp, Artificial Sequence
  Description of Artificial Sequence: Synthetic oligonucleotide
  Target: ATXN1; (-) strand; PAM type: YTN; PAM sequence: CTT
gagtatatataactacagta

SEQ ID NO: 168785 - DNA, 20 bp, Artificial Sequence
  Description of Artificial Sequence: Synthetic oligonucleotide
  Target: ATXN1; (-) strand; PAM type: YTN; PAM sequence: TTC
cttgagtatatataactaca

SEQ ID NO: 168786 - DNA, 20 bp, Artificial Sequence
  Description of Artificial Sequence: Synthetic oligonucleotide
  Target: ATXN1; (-) strand; PAM type: YTN; PAM sequence: CTT
ccttgagtatatataactac

SEQ ID NO: 168787 - DNA, 20 bp, Artificial Sequence
  Description of Artificial Sequence: Synthetic oligonucleotide
  Target: ATXN1; (-) strand; PAM type: YTN; PAM sequence: CTG
catacaataacttccttgag

SEQ ID NO: 168788 - DNA, 20 bp, Artificial Sequence
  Description of Artificial Sequence: Synthetic oligonucleotide
  Target: ATXN1; (-) strand; PAM type: YTN; PAM sequence: CTC
tgcatacaataacttccttg

SEQ ID NO: 168789 - DNA, 20 bp, Artificial Sequence
  Description of Artificial Sequence: Synthetic oligonucleotide
  Target: ATXN1; (-) strand; PAM type: YTN; PAM sequence: CTC
tctgcatacaataacttcct

SEQ ID NO: 168790 - DNA, 20 bp, Artificial Sequence
  Description of Artificial Sequence: Synthetic oligonucleotide
  Target: ATXN1; (-) strand; PAM type: YTN; PAM sequence: CTG
cagctctctgcatacaataa

SEQ ID NO: 168791 - DNA, 20 bp, Artificial Sequence
  Description of Artificial Sequence: Synthetic oligonucleotide
  Target: ATXN1; (-) strand; PAM type: YTN; PAM sequence: TTC
aagaatgtctgcagctctct

SEQ ID NO: 168792 - DNA, 20 bp, Artificial Sequence
  Description of Artificial Sequence: Synthetic oligonucleotide
  Target: ATXN1; (-) strand; PAM type: YTN; PAM sequence: TTT
caagaatgtctgcagctctc

SEQ ID NO: 168793 - DNA, 20 bp, Artificial Sequence
  Description of Artificial Sequence: Synthetic oligonucleotide
  Target: ATXN1; (-) strand; PAM type: YTN; PAM sequence: CTT
tcaagaatgtctgcagctct

SEQ ID NO: 168794 - DNA, 20 bp, Artificial Sequence
  Description of Artificial Sequence: Synthetic oligonucleotide
  Target: ATXN1; (-) strand; PAM type: YTN; PAM sequence: TTA
cctttcaagaatgtctgcag

SEQ ID NO: 168795 - DNA, 20 bp, Artificial Sequence
  Description of Artificial Sequence: Synthetic oligonucleotide
  Target: ATXN1; (-) strand; PAM type: YTN; PAM sequence: CTT
acctttcaagaatgtctgca

SEQ ID NO: 168796 - DNA, 20 bp, Artificial Sequence
  Description of Artificial Sequence: Synthetic oligonucleotide
  Target: ATXN1; (-) strand; PAM type: YTN; PAM sequence: CTC
cttacctttcaagaatgtct

SEQ ID NO: 168797 - DNA, 20 bp, Artificial Sequence
  Description of Artificial Sequence: Synthetic oligonucleotide
  Target: ATXN1; (-) strand; PAM type: YTN; PAM sequence: TTG
tatactccttacctttcaag

SEQ ID NO: 168798 - DNA, 20 bp, Artificial Sequence
  Description of Artificial Sequence: Synthetic oligonucleotide
  Target: ATXN1; (-) strand; PAM type: YTN; PAM sequence: TTT
gtatactccttacctttcaa

SEQ ID NO: 168799 - DNA, 20 bp, Artificial Sequence
  Description of Artificial Sequence: Synthetic oligonucleotide
  Target: ATXN1; (-) strand; PAM type: YTN; PAM sequence: CTT
tgtatactccttacctttca

SEQ ID NO: 168800 - DNA, 20 bp, Artificial Sequence
  Description of Artificial Sequence: Synthetic oligonucleotide
  Target: ATXN1; (-) strand; PAM type: YTN; PAM sequence: TTA
tatctttgtatactccttac

SEQ ID NO: 168801 - DNA, 20 bp, Artificial Sequence
  Description of Artificial Sequence: Synthetic oligonucleotide
  Target: ATXN1; (-) strand; PAM type: YTN; PAM sequence: CTG
caggttatatctttgtatac

SEQ ID NO: 168802 - DNA, 20 bp, Artificial Sequence
  Description of Artificial Sequence: Synthetic oligonucleotide
  Target: ATXN1; (-) strand; PAM type: YTN; PAM sequence: TTC
ctgcaggttatatctttgta

SEQ ID NO: 168803 - DNA, 20 bp, Artificial Sequence
  Description of Artificial Sequence: Synthetic oligonucleotide
  Target: ATXN1; (-) strand; PAM type: YTN; PAM sequence: CTA
ggttcctgcaggttatatct

SEQ ID NO: 168804 - DNA, 20 bp, Artificial Sequence
  Description of Artificial Sequence: Synthetic oligonucleotide
  Target: ATXN1; (-) strand; PAM type: YTN; PAM sequence: TTG
ctaggttcctgcaggttata

SEQ ID NO: 168805 - DNA, 20 bp, Artificial Sequence
  Description of Artificial Sequence: Synthetic oligonucleotide
  Target: ATXN1; (-) strand; PAM type: YTN; PAM sequence: CTA
gattgctaggttcctgcagg

SEQ ID NO: 168806 - DNA, 20 bp, Artificial Sequence
  Description of Artificial Sequence: Synthetic oligonucleotide
  Target: ATXN1; (-) strand; PAM type: YTN; PAM sequence: TTG
aagctagattgctaggttcc

SEQ ID NO: 168807 - DNA, 20 bp, Artificial Sequence
  Description of Artificial Sequence: Synthetic oligonucleotide
  Target: ATXN1; (-) strand; PAM type: YTN; PAM sequence: TTT
gaagctagattgctaggttc

SEQ ID NO: 168808 - DNA, 20 bp, Artificial Sequence
  Description of Artificial Sequence: Synthetic oligonucleotide
  Target: ATXN1; (-) strand; PAM type: YTN; PAM sequence: TTT
tgaagctagattgctaggtt

SEQ ID NO: 168809 - DNA, 20 bp, Artificial Sequence
  Description of Artificial Sequence: Synthetic oligonucleotide
  Target: ATXN1; (-) strand; PAM type: YTN; PAM sequence: CTC
gtgtgaatgaatgaatgaat

SEQ ID NO: 168810 - DNA, 20 bp, Artificial Sequence
  Description of Artificial Sequence: Synthetic oligonucleotide
  Target: ATXN1; (-) strand; PAM type: YTN; PAM sequence: TTG
atggaagtgctcgtgtgaat

SEQ ID NO: 168811 - DNA, 20 bp, Artificial Sequence
  Description of Artificial Sequence: Synthetic oligonucleotide
  Target: ATXN1; (-) strand; PAM type: YTN; PAM sequence: CTG
aaagtaaattgatggaagtg

SEQ ID NO: 168812 - DNA, 20 bp, Artificial Sequence
  Description of Artificial Sequence: Synthetic oligonucleotide
  Target: ATXN1; (-) strand; PAM type: YTN; PAM sequence: CTA
atcccatatatgagggatac

SEQ ID NO: 168813 - DNA, 20 bp, Artificial Sequence
  Description of Artificial Sequence: Synthetic oligonucleotide
  Target: ATXN1; (-) strand; PAM type: YTN; PAM sequence: TTA
tagatgggcactaatcccat

SEQ ID NO: 168814 - DNA, 20 bp, Artificial Sequence
  Description of Artificial Sequence: Synthetic oligonucleotide
  Target: ATXN1; (-) strand; PAM type: YTN; PAM sequence: CTT
atagatgggcactaatccca

SEQ ID NO: 168815 - DNA, 20 bp, Artificial Sequence
  Description of Artificial Sequence: Synthetic oligonucleotide
  Target: ATXN1; (-) strand; PAM type: YTN; PAM sequence: CTG
gggtcccttatagatgggca

SEQ ID NO: 168816 - DNA, 20 bp, Artificial Sequence
  Description of Artificial Sequence: Synthetic oligonucleotide
  Target: ATXN1; (-) strand; PAM type: YTN; PAM sequence: CTC
tggggtcccttatagatggg

SEQ ID NO: 168817 - DNA, 20 bp, Artificial Sequence
  Description of Artificial Sequence: Synthetic oligonucleotide
  Target: ATXN1; (-) strand; PAM type: YTN; PAM sequence: CTC
tctggggtcccttatagatg

SEQ ID NO: 168818 - DNA, 20 bp, Artificial Sequence
  Description of Artificial Sequence: Synthetic oligonucleotide
  Target: ATXN1; (-) strand; PAM type: YTN; PAM sequence: CTC
acatggtggaaggagcaagg

SEQ ID NO: 168819 - DNA, 20 bp, Artificial Sequence
  Description of Artificial Sequence: Synthetic oligonucleotide
  Target: ATXN1; (-) strand; PAM type: YTN; PAM sequence: TTG
gtgtgtcctcacatggtgga

SEQ ID NO: 168820 - DNA, 20 bp, Artificial Sequence
  Description of Artificial Sequence: Synthetic oligonucleotide
  Target: ATXN1; (-) strand; PAM type: YTN; PAM sequence: CTT
ggtgtgtcctcacatggtgg

SEQ ID NO: 168821 - DNA, 20 bp, Artificial Sequence
  Description of Artificial Sequence: Synthetic oligonucleotide
  Target: ATXN1; (-) strand; PAM type: YTN; PAM sequence: TTC
ttggtgtgtcctcacatggt

SEQ ID NO: 168822 - DNA, 20 bp, Artificial Sequence
  Description of Artificial Sequence: Synthetic oligonucleotide
  Target: ATXN1; (-) strand; PAM type: YTN; PAM sequence: CTT
cttggtgtgtcctcacatgg

SEQ ID NO: 168823 - DNA, 20 bp, Artificial Sequence
  Description of Artificial Sequence: Synthetic oligonucleotide
  Target: ATXN1; (-) strand; PAM type: YTN; PAM sequence: TTC
atagatgacaccttcttggt

SEQ ID NO: 168824 - DNA, 20 bp, Artificial Sequence
  Description of Artificial Sequence: Synthetic oligonucleotide
  Target: ATXN1; (-) strand; PAM type: YTN; PAM sequence: TTG
gttcatagatgacaccttct

SEQ ID NO: 168825 - DNA, 20 bp, Artificial Sequence
  Description of Artificial Sequence: Synthetic oligonucleotide
  Target: ATXN1; (-) strand; PAM type: YTN; PAM sequence: TTT
ggttcatagatgacaccttc

SEQ ID NO: 168826 - DNA, 20 bp, Artificial Sequence
  Description of Artificial Sequence: Synthetic oligonucleotide
  Target: ATXN1; (-) strand; PAM type: YTN; PAM sequence: TTT
tggttcatagatgacacctt

SEQ ID NO: 168827 - DNA, 20 bp, Artificial Sequence
  Description of Artificial Sequence: Synthetic oligonucleotide
  Target: ATXN1; (-) strand; PAM type: YTN; PAM sequence: TTT
ttggttcatagatgacacct

SEQ ID NO: 168828 - DNA, 20 bp, Artificial Sequence
  Description of Artificial Sequence: Synthetic oligonucleotide
  Target: ATXN1; (-) strand; PAM type: YTN; PAM sequence: TTT
tttggttcatagatgacacc

SEQ ID NO: 168829 - DNA, 20 bp, Artificial Sequence
  Description of Artificial Sequence: Synthetic oligonucleotide
  Target: ATXN1; (-) strand; PAM type: YTN; PAM sequence: TTT
ttttggttcatagatgacac

SEQ ID NO: 168830 - DNA, 20 bp, Artificial Sequence
  Description of Artificial Sequence: Synthetic oligonucleotide
  Target: ATXN1; (-) strand; PAM type: YTN; PAM sequence: TTG
atttttttggttcatagatg

SEQ ID NO: 168831 - DNA, 20 bp, Artificial Sequence
  Description of Artificial Sequence: Synthetic oligonucleotide
  Target: ATXN1; (-) strand; PAM type: YTN; PAM sequence: TTT
gatttttttggttcatagat

SEQ ID NO: 168832 - DNA, 20 bp, Artificial Sequence
  Description of Artificial Sequence: Synthetic oligonucleotide
  Target: ATXN1; (-) strand; PAM type: YTN; PAM sequence: TTG
gtgaggtttgatttttttgg

SEQ ID NO: 168833 - DNA, 20 bp, Artificial Sequence
  Description of Artificial Sequence: Synthetic oligonucleotide
  Target: ATXN1; (-) strand; PAM type: YTN; PAM sequence: TTT
ggtgaggtttgatttttttg

SEQ ID NO: 168834 - DNA, 20 bp, Artificial Sequence
  Description of Artificial Sequence: Synthetic oligonucleotide
  Target: ATXN1; (-) strand; PAM type: YTN; PAM sequence: TTC
aggatttggtgaggtttgat

SEQ ID NO: 168835 - DNA, 20 bp, Artificial Sequence
  Description of Artificial Sequence: Synthetic oligonucleotide
  Target: ATXN1; (-) strand; PAM type: YTN; PAM sequence: CTT
caggatttggtgaggtttga

SEQ ID NO: 168836 - DNA, 20 bp, Artificial Sequence
  Description of Artificial Sequence: Synthetic oligonucleotide
  Target: ATXN1; (-) strand; PAM type: YTN; PAM sequence: CTG
ggaagtccaagatcaaggtg

SEQ ID NO: 168837 - DNA, 20 bp, Artificial Sequence
  Description of Artificial Sequence: Synthetic oligonucleotide
  Target: ATXN1; (-) strand; PAM type: YTN; PAM sequence: CTG
gtggctgggaagtccaagat

SEQ ID NO: 168838 - DNA, 20 bp, Artificial Sequence
  Description of Artificial Sequence: Synthetic oligonucleotide
  Target: ATXN1; (-) strand; PAM type: YTN; PAM sequence: CTC
acagtgctggtggctgggaa

SEQ ID NO: 168839 - DNA, 20 bp, Artificial Sequence
  Description of Artificial Sequence: Synthetic oligonucleotide
  Target: ATXN1; (-) strand; PAM type: YTN; PAM sequence: TTC
tcacagtgctggtggctggg

SEQ ID NO: 168840 - DNA, 20 bp, Artificial Sequence
  Description of Artificial Sequence: Synthetic oligonucleotide
  Target: ATXN1; (-) strand; PAM type: YTN; PAM sequence: TTT
ctcacagtgctggtggctgg

SEQ ID NO: 168841 - DNA, 20 bp, Artificial Sequence
  Description of Artificial Sequence: Synthetic oligonucleotide
  Target: ATXN1; (-) strand; PAM type: YTN; PAM sequence: TTA
taaacaacagaaatacattt

SEQ ID NO: 168842 - DNA, 20 bp, Artificial Sequence
  Description of Artificial Sequence: Synthetic oligonucleotide
  Target: ATXN1; (-) strand; PAM type: YTN; PAM sequence: CTT
ataaacaacagaaatacatt

SEQ ID NO: 168843 - DNA, 20 bp, Artificial Sequence
  Description of Artificial Sequence: Synthetic oligonucleotide
  Target: ATXN1; (-) strand; PAM type: YTN; PAM sequence: CTA
agcaaaataccgtaaactta

SEQ ID NO: 168844 - DNA, 20 bp, Artificial Sequence
  Description of Artificial Sequence: Synthetic oligonucleotide
  Target: ATXN1; (-) strand; PAM type: YTN; PAM sequence: CTG
ctaagcaaaataccgtaaac

SEQ ID NO: 168845 - DNA, 20 bp, Artificial Sequence
  Description of Artificial Sequence: Synthetic oligonucleotide
  Target: ATXN1; (-) strand; PAM type: YTN; PAM sequence: TTG
gactgctaagcaaaataccg

SEQ ID NO: 168846 - DNA, 20 bp, Artificial Sequence
  Description of Artificial Sequence: Synthetic oligonucleotide
  Target: ATXN1; (-) strand; PAM type: YTN; PAM sequence: TTT
ggactgctaagcaaaatacc

SEQ ID NO: 168847 - DNA, 20 bp, Artificial Sequence
  Description of Artificial Sequence: Synthetic oligonucleotide
  Target: ATXN1; (-) strand; PAM type: YTN; PAM sequence: TTA
gtccatttggactgctaagc

SEQ ID NO: 168848 - DNA, 20 bp, Artificial Sequence
  Description of Artificial Sequence: Synthetic oligonucleotide
  Target: ATXN1; (-) strand; PAM type: YTN; PAM sequence: CTT
agtccatttggactgctaag

SEQ ID NO: 168849 - DNA, 20 bp, Artificial Sequence
  Description of Artificial Sequence: Synthetic oligonucleotide
  Target: ATXN1; (-) strand; PAM type: YTN; PAM sequence: TTG
gcagtgtcttagtccatttg

SEQ ID NO: 168850 - DNA, 20 bp, Artificial Sequence
  Description of Artificial Sequence: Synthetic oligonucleotide
  Target: ATXN1; (-) strand; PAM type: YTN; PAM sequence: TTT
ggcagtgtcttagtccattt

SEQ ID NO: 168851 - DNA, 20 bp, Artificial Sequence
  Description of Artificial Sequence: Synthetic oligonucleotide
  Target: ATXN1; (-) strand; PAM type: YTN; PAM sequence: TTT
tggcagtgtcttagtccatt

SEQ ID NO: 168852 - DNA, 20 bp, Artificial Sequence
  Description of Artificial Sequence: Synthetic oligonucleotide
  Target: ATXN1; (-) strand; PAM type: YTN; PAM sequence: CTT
ttggcagtgtcttagtccat

SEQ ID NO: 168853 - DNA, 20 bp, Artificial Sequence
  Description of Artificial Sequence: Synthetic oligonucleotide
  Target: ATXN1; (-) strand; PAM type: YTN; PAM sequence: TTG
gcttttggcagtgtcttagt

SEQ ID NO: 168854 - DNA, 20 bp, Artificial Sequence
  Description of Artificial Sequence: Synthetic oligonucleotide
  Target: ATXN1; (-) strand; PAM type: YTN; PAM sequence: TTT
ggcttttggcagtgtcttag

SEQ ID NO: 168855 - DNA, 20 bp, Artificial Sequence
  Description of Artificial Sequence: Synthetic oligonucleotide
  Target: ATXN1; (-) strand; PAM type: YTN; PAM sequence: TTT
tggcttttggcagtgtctta

SEQ ID NO: 168856 - DNA, 20 bp, Artificial Sequence
  Description of Artificial Sequence: Synthetic oligonucleotide
  Target: ATXN1; (-) strand; PAM type: YTN; PAM sequence: TTT
ttggcttttggcagtgtctt

SEQ ID NO: 168857 - DNA, 20 bp, Artificial Sequence
  Description of Artificial Sequence: Synthetic oligonucleotide
  Target: ATXN1; (-) strand; PAM type: YTN; PAM sequence: TTG
aggtggatgtatttttggct

SEQ ID NO: 168858 - DNA, 20 bp, Artificial Sequence
  Description of Artificial Sequence: Synthetic oligonucleotide
  Target: ATXN1; (-) strand; PAM type: YTN; PAM sequence: TTT
gaggtggatgtatttttggc

SEQ ID NO: 168859 - DNA, 20 bp, Artificial Sequence
  Description of Artificial Sequence: Synthetic oligonucleotide
  Target: ATXN1; (-) strand; PAM type: YTN; PAM sequence: CTT
tgaggtggatgtatttttgg

SEQ ID NO: 168860 - DNA, 20 bp, Artificial Sequence
  Description of Artificial Sequence: Synthetic oligonucleotide
  Target: ATXN1; (-) strand; PAM type: YTN; PAM sequence: TTC
ctttgaggtggatgtatttt

SEQ ID NO: 168861 - DNA, 20 bp, Artificial Sequence
  Description of Artificial Sequence: Synthetic oligonucleotide
  Target: ATXN1; (-) strand; PAM type: YTN; PAM sequence: CTT
cctttgaggtggatgtattt

SEQ ID NO: 168862 - DNA, 20 bp, Artificial Sequence
  Description of Artificial Sequence: Synthetic oligonucleotide
  Target: ATXN1; (-) strand; PAM type: YTN; PAM sequence: TTC
ttcctttgaggtggatgtat

SEQ ID NO: 168863 - DNA, 20 bp, Artificial Sequence
  Description of Artificial Sequence: Synthetic oligonucleotide
  Target: ATXN1; (-) strand; PAM type: YTN; PAM sequence: TTT
cttcctttgaggtggatgta

SEQ ID NO: 168864 - DNA, 20 bp, Artificial Sequence
  Description of Artificial Sequence: Synthetic oligonucleotide
  Target: ATXN1; (-) strand; PAM type: YTN; PAM sequence: TTT
tcttcctttgaggtggatgt

SEQ ID NO: 168865 - DNA, 20 bp, Artificial Sequence
  Description of Artificial Sequence: Synthetic oligonucleotide
  Target: ATXN1; (-) strand; PAM type: YTN; PAM sequence: CTT
ttcttcctttgaggtggatg

SEQ ID NO: 168866 - DNA, 20 bp, Artificial Sequence
  Description of Artificial Sequence: Synthetic oligonucleotide
  Target: ATXN1; (-) strand; PAM type: YTN; PAM sequence: TTC
aaacttttcttcctttgagg

SEQ ID NO: 168867 - DNA, 20 bp, Artificial Sequence
  Description of Artificial Sequence: Synthetic oligonucleotide
  Target: ATXN1; (-) strand; PAM type: YTN; PAM sequence: TTT
caaacttttcttcctttgag

SEQ ID NO: 168868 - DNA, 20 bp, Artificial Sequence
  Description of Artificial Sequence: Synthetic oligonucleotide
  Target: ATXN1; (-) strand; PAM type: YTN; PAM sequence: TTG
aatggtttcaaacttttctt

SEQ ID NO: 168869 - DNA, 20 bp, Artificial Sequence
  Description of Artificial Sequence: Synthetic oligonucleotide
  Target: ATXN1; (-) strand; PAM type: YTN; PAM sequence: CTC
cagttgaatggtttcaaact

SEQ ID NO: 168870 - DNA, 20 bp, Artificial Sequence
  Description of Artificial Sequence: Synthetic oligonucleotide
  Target: ATXN1; (-) strand; PAM type: YTN; PAM sequence: TTC
actccagttgaatggtttca

SEQ ID NO: 168871 - DNA, 20 bp, Artificial Sequence
  Description of Artificial Sequence: Synthetic oligonucleotide
  Target: ATXN1; (-) strand; PAM type: YTN; PAM sequence: CTC
ccaggcagagaacaagagtg

SEQ ID NO: 168872 - DNA, 20 bp, Artificial Sequence
  Description of Artificial Sequence: Synthetic oligonucleotide
  Target: ATXN1; (-) strand; PAM type: YTN; PAM sequence: TTC
tcccaggcagagaacaagag

SEQ ID NO: 168873 - DNA, 20 bp, Artificial Sequence
  Description of Artificial Sequence: Synthetic oligonucleotide
  Target: ATXN1; (-) strand; PAM type: YTN; PAM sequence: TTG
ttctcccaggcagagaacaa

SEQ ID NO: 168874 - DNA, 20 bp, Artificial Sequence
  Description of Artificial Sequence: Synthetic oligonucleotide
  Target: ATXN1; (-) strand; PAM type: YTN; PAM sequence: CTT
gttctcccaggcagagaaca

SEQ ID NO: 168875 - DNA, 20 bp, Artificial Sequence
  Description of Artificial Sequence: Synthetic oligonucleotide
  Target: ATXN1; (-) strand; PAM type: YTN; PAM sequence: CTG
acttgttctcccaggcagag

SEQ ID NO: 168876 - DNA, 20 bp, Artificial Sequence
  Description of Artificial Sequence: Synthetic oligonucleotide
  Target: ATXN1; (-) strand; PAM type: YTN; PAM sequence: CTC
atatcagctgacttgttctc

SEQ ID NO: 168877 - DNA, 20 bp, Artificial Sequence
  Description of Artificial Sequence: Synthetic oligonucleotide
  Target: ATXN1; (-) strand; PAM type: YTN; PAM sequence: TTC
acacagaaaagcaggctcat

SEQ ID NO: 168878 - DNA, 20 bp, Artificial Sequence
  Description of Artificial Sequence: Synthetic oligonucleotide
  Target: ATXN1; (-) strand; PAM type: YTN; PAM sequence: CTT
cacacagaaaagcaggctca

SEQ ID NO: 168879 - DNA, 20 bp, Artificial Sequence
  Description of Artificial Sequence: Synthetic oligonucleotide
  Target: ATXN1; (-) strand; PAM type: YTN; PAM sequence: TTC
ttcacacagaaaagcaggct

SEQ ID NO: 168880 - DNA, 20 bp, Artificial Sequence
  Description of Artificial Sequence: Synthetic oligonucleotide
  Target: ATXN1; (-) strand; PAM type: YTN; PAM sequence: CTG
tacattcttcacacagaaaa

SEQ ID NO: 168881 - DNA, 20 bp, Artificial Sequence
  Description of Artificial Sequence: Synthetic oligonucleotide
  Target: ATXN1; (-) strand; PAM type: YTN; PAM sequence: CTC
tgtacattcttcacacagaa

SEQ ID NO: 168882 - DNA, 20 bp, Artificial Sequence
  Description of Artificial Sequence: Synthetic oligonucleotide
  Target: ATXN1; (-) strand; PAM type: YTN; PAM sequence: TTC
aaactctgtacattcttcac

SEQ ID NO: 168883 - DNA, 20 bp, Artificial Sequence
  Description of Artificial Sequence: Synthetic oligonucleotide
  Target: ATXN1; (-) strand; PAM type: YTN; PAM sequence: TTT
caaactctgtacattcttca

SEQ ID NO: 168884 - DNA, 20 bp, Artificial Sequence
  Description of Artificial Sequence: Synthetic oligonucleotide
  Target: ATXN1; (-) strand; PAM type: YTN; PAM sequence: TTT
tcaaactctgtacattcttc

SEQ ID NO: 168885 - DNA, 20 bp, Artificial Sequence
  Description of Artificial Sequence: Synthetic oligonucleotide
  Target: ATXN1; (-) strand; PAM type: YTN; PAM sequence: CTT
ttcaaactctgtacattctt

SEQ ID NO: 168886 - DNA, 20 bp, Artificial Sequence
  Description of Artificial Sequence: Synthetic oligonucleotide
  Target: ATXN1; (-) strand; PAM type: YTN; PAM sequence: CTG
tatgacccatgaaggtgcac

SEQ ID NO: 168887 - DNA, 20 bp, Artificial Sequence
  Description of Artificial Sequence: Synthetic oligonucleotide
  Target: ATXN1; (-) strand; PAM type: YTN; PAM sequence: CTC
atataacctgtatgacccat

SEQ ID NO: 168888 - DNA, 20 bp, Artificial Sequence
  Description of Artificial Sequence: Synthetic oligonucleotide
  Target: ATXN1; (-) strand; PAM type: YTN; PAM sequence: CTC
cggaccctcatataacctgt

SEQ ID NO: 168889 - DNA, 20 bp, Artificial Sequence
  Description of Artificial Sequence: Synthetic oligonucleotide
  Target: ATXN1; (-) strand; PAM type: YTN; PAM sequence: CTG
accctccggaccctcatata

SEQ ID NO: 168890 - DNA, 20 bp, Artificial Sequence
  Description of Artificial Sequence: Synthetic oligonucleotide
  Target: ATXN1; (-) strand; PAM type: YTN; PAM sequence: CTC
tgaccctccggaccctcata

SEQ ID NO: 168891 - DNA, 20 bp, Artificial Sequence
  Description of Artificial Sequence: Synthetic oligonucleotide
  Target: ATXN1; (-) strand; PAM type: YTN; PAM sequence: TTC
agctctgaccctccggaccc

SEQ ID NO: 168892 - DNA, 20 bp, Artificial Sequence
  Description of Artificial Sequence: Synthetic oligonucleotide
  Target: ATXN1; (-) strand; PAM type: YTN; PAM sequence: CTG
ttcagctctgaccctccgga

SEQ ID NO: 168893 - DNA, 20 bp, Artificial Sequence
  Description of Artificial Sequence: Synthetic oligonucleotide
  Target: ATXN1; (-) strand; PAM type: YTN; PAM sequence: CTG
tagcctgttcagctctgacc

SEQ ID NO: 168894 - DNA, 20 bp, Artificial Sequence
  Description of Artificial Sequence: Synthetic oligonucleotide
  Target: ATXN1; (-) strand; PAM type: YTN; PAM sequence: TTG
gtgaacagcggctgtagcct

SEQ ID NO: 168895 - DNA, 20 bp, Artificial Sequence
  Description of Artificial Sequence: Synthetic oligonucleotide
  Target: ATXN1; (-) strand; PAM type: YTN; PAM sequence: CTT
ggtgaacagcggctgtagcc

SEQ ID NO: 168896 - DNA, 20 bp, Artificial Sequence
  Description of Artificial Sequence: Synthetic oligonucleotide
  Target: ATXN1; (-) strand; PAM type: YTN; PAM sequence: CTC
ttggtgaacagcggctgtag

SEQ ID NO: 168897 - DNA, 20 bp, Artificial Sequence
  Description of Artificial Sequence: Synthetic oligonucleotide
  Target: ATXN1; (-) strand; PAM type: YTN; PAM sequence: CTC
cccgcgagaccatgggctct

SEQ ID NO: 168898 - DNA, 20 bp, Artificial Sequence
  Description of Artificial Sequence: Synthetic oligonucleotide
  Target: ATXN1; (-) strand; PAM type: YTN; PAM sequence: CTG
tctccccgcgagaccatggg

SEQ ID NO: 168899 - DNA, 20 bp, Artificial Sequence
  Description of Artificial Sequence: Synthetic oligonucleotide
  Target: ATXN1; (-) strand; PAM type: YTN; PAM sequence: TTG
gtgtctgtctccccgcgaga

SEQ ID NO: 168900 - DNA, 20 bp, Artificial Sequence
  Description of Artificial Sequence: Synthetic oligonucleotide
  Target: ATXN1; (-) strand; PAM type: YTN; PAM sequence: CTT
ggtgtctgtctccccgcgag

SEQ ID NO: 168901 - DNA, 20 bp, Artificial Sequence
  Description of Artificial Sequence: Synthetic oligonucleotide
  Target: ATXN1; (-) strand; PAM type: YTN; PAM sequence: TTC
ttggtgtctgtctccccgcg

SEQ ID NO: 168902 - DNA, 20 bp, Artificial Sequence
  Description of Artificial Sequence: Synthetic oligonucleotide
  Target: ATXN1; (-) strand; PAM type: YTN; PAM sequence: TTT
cttggtgtctgtctccccgc

SEQ ID NO: 168903 - DNA, 20 bp, Artificial Sequence
  Description of Artificial Sequence: Synthetic oligonucleotide
  Target: ATXN1; (-) strand; PAM type: YTN; PAM sequence: CTG
tgatggtttcttggtgtctg

SEQ ID NO: 168904 - DNA, 20 bp, Artificial Sequence
  Description of Artificial Sequence: Synthetic oligonucleotide
  Target: ATXN1; (-) strand; PAM type: YTN; PAM sequence: CTA
atcccagtgagctgtgatgg

SEQ ID NO: 168905 - DNA, 20 bp, Artificial Sequence
  Description of Artificial Sequence: Synthetic oligonucleotide
  Target: ATXN1; (-) strand; PAM type: YTN; PAM sequence: CTA
cccccagtggagcactaatc

SEQ ID NO: 168906 - DNA, 20 bp, Artificial Sequence
  Description of Artificial Sequence: Synthetic oligonucleotide
  Target: ATXN1; (-) strand; PAM type: YTN; PAM sequence: TTC
agctacccccagtggagcac

SEQ ID NO: 168907 - DNA, 20 bp, Artificial Sequence
  Description of Artificial Sequence: Synthetic oligonucleotide
  Target: ATXN1; (-) strand; PAM type: YTN; PAM sequence: TTA
gagcaccattcagctacccc

SEQ ID NO: 168908 - DNA, 20 bp, Artificial Sequence
  Description of Artificial Sequence: Synthetic oligonucleotide
  Target: ATXN1; (-) strand; PAM type: YTN; PAM sequence: CTT
agagcaccattcagctaccc

SEQ ID NO: 168909 - DNA, 20 bp, Artificial Sequence
  Description of Artificial Sequence: Synthetic oligonucleotide
  Target: ATXN1; (-) strand; PAM type: YTN; PAM sequence: CTC
ttagagcaccattcagctac

SEQ ID NO: 168910 - DNA, 20 bp, Artificial Sequence
  Description of Artificial Sequence: Synthetic oligonucleotide
  Target: ATXN1; (-) strand; PAM type: YTN; PAM sequence: CTG
ctcttagagcaccattcagc

SEQ ID NO: 168911 - DNA, 20 bp, Artificial Sequence
  Description of Artificial Sequence: Synthetic oligonucleotide
  Target: ATXN1; (-) strand; PAM type: YTN; PAM sequence: CTC
tgctcttagagcaccattca

SEQ ID NO: 168912 - DNA, 20 bp, Artificial Sequence
  Description of Artificial Sequence: Synthetic oligonucleotide
  Target: ATXN1; (-) strand; PAM type: YTN; PAM sequence: CTC
tctgctcttagagcaccatt

SEQ ID NO: 168913 - DNA, 20 bp, Artificial Sequence
  Description of Artificial Sequence: Synthetic oligonucleotide
  Target: ATXN1; (-) strand; PAM type: YTN; PAM sequence: TTC
ctctctgctcttagagcacc

SEQ ID NO: 168914 - DNA, 20 bp, Artificial Sequence
  Description of Artificial Sequence: Synthetic oligonucleotide
  Target: ATXN1; (-) strand; PAM type: YTN; PAM sequence: TTG
ttcctctctgctcttagagc

SEQ ID NO: 168915 - DNA, 20 bp, Artificial Sequence
  Description of Artificial Sequence: Synthetic oligonucleotide
  Target: ATXN1; (-) strand; PAM type: YTN; PAM sequence: CTT
gttcctctctgctcttagag

SEQ ID NO: 168916 - DNA, 20 bp, Artificial Sequence
  Description of Artificial Sequence: Synthetic oligonucleotide
  Target: ATXN1; (-) strand; PAM type: YTN; PAM sequence: CTG
tgcacacaggcgtacagaga

SEQ ID NO: 168917 - DNA, 20 bp, Artificial Sequence
  Description of Artificial Sequence: Synthetic oligonucleotide
  Target: ATXN1; (-) strand; PAM type: YTN; PAM sequence: CTC
ctgtgcacacaggcgtacag

SEQ ID NO: 168918 - DNA, 20 bp, Artificial Sequence
  Description of Artificial Sequence: Synthetic oligonucleotide
  Target: ATXN1; (-) strand; PAM type: YTN; PAM sequence: CTC
acaccacccgctcctgtgca

SEQ ID NO: 168919 - DNA, 20 bp, Artificial Sequence
  Description of Artificial Sequence: Synthetic oligonucleotide
  Target: ATXN1; (-) strand; PAM type: YTN; PAM sequence: CTG
tcagcagccacctcacacca

SEQ ID NO: 168920 - DNA, 20 bp, Artificial Sequence
  Description of Artificial Sequence: Synthetic oligonucleotide
  Target: ATXN1; (-) strand; PAM type: YTN; PAM sequence: TTC
ctgtcagcagccacctcaca

SEQ ID NO: 168921 - DNA, 20 bp, Artificial Sequence
  Description of Artificial Sequence: Synthetic oligonucleotide
  Target: ATXN1; (-) strand; PAM type: YTN; PAM sequence: CTG
tgccacattcctgtcagcag

SEQ ID NO: 168922 - DNA, 20 bp, Artificial Sequence
  Description of Artificial Sequence: Synthetic oligonucleotide
  Target: ATXN1; (-) strand; PAM type: YTN; PAM sequence: CTC
tgtgccacattcctgtcagc

SEQ ID NO: 168923 - DNA, 20 bp, Artificial Sequence
  Description of Artificial Sequence: Synthetic oligonucleotide
  Target: ATXN1; (-) strand; PAM type: YTN; PAM sequence: TTC
tctgtgccacattcctgtca

SEQ ID NO: 168924 - DNA, 20 bp, Artificial Sequence
  Description of Artificial Sequence: Synthetic oligonucleotide
  Target: ATXN1; (-) strand; PAM type: YTN; PAM sequence: CTT
ctctgtgccacattcctgtc

SEQ ID NO: 168925 - DNA, 20 bp, Artificial Sequence
  Description of Artificial Sequence: Synthetic oligonucleotide
  Target: ATXN1; (-) strand; PAM type: YTN; PAM sequence: TTG
tcttctctgtgccacattcc

SEQ ID NO: 168926 - DNA, 20 bp, Artificial Sequence
  Description of Artificial Sequence: Synthetic oligonucleotide
  Target: ATXN1; (-) strand; PAM type: YTN; PAM sequence: CTT
gtcttctctgtgccacattc

SEQ ID NO: 168927 - DNA, 20 bp, Artificial Sequence
  Description of Artificial Sequence: Synthetic oligonucleotide
  Target: ATXN1; (-) strand; PAM type: YTN; PAM sequence: TTA
catcttgtcttctctgtgcc

SEQ ID NO: 168928 - DNA, 20 bp, Artificial Sequence
  Description of Artificial Sequence: Synthetic oligonucleotide
  Target: ATXN1; (-) strand; PAM type: YTN; PAM sequence: CTT
acatcttgtcttctctgtgc

SEQ ID NO: 168929 - DNA, 20 bp, Artificial Sequence
  Description of Artificial Sequence: Synthetic oligonucleotide
  Target: ATXN1; (-) strand; PAM type: YTN; PAM sequence: TTC
agcttacatcttgtcttctc

SEQ ID NO: 168930 - DNA, 20 bp, Artificial Sequence
  Description of Artificial Sequence: Synthetic oligonucleotide
  Target: ATXN1; (-) strand; PAM type: YTN; PAM sequence: TTC
aggattcagcttacatcttg

SEQ ID NO: 168931 - DNA, 20 bp, Artificial Sequence
  Description of Artificial Sequence: Synthetic oligonucleotide
  Target: ATXN1; (-) strand; PAM type: YTN; PAM sequence: TTT
caggattcagcttacatctt

SEQ ID NO: 168932 - DNA, 20 bp, Artificial Sequence
  Description of Artificial Sequence: Synthetic oligonucleotide
  Target: ATXN1; (-) strand; PAM type: YTN; PAM sequence: CTT
tcaggattcagcttacatct

SEQ ID NO: 168933 - DNA, 20 bp, Artificial Sequence
  Description of Artificial Sequence: Synthetic oligonucleotide
  Target: ATXN1; (-) strand; PAM type: YTN; PAM sequence: CTC
atctttcaggattcagctta

SEQ ID NO: 168934 - DNA, 20 bp, Artificial Sequence
  Description of Artificial Sequence: Synthetic oligonucleotide
  Target: ATXN1; (-) strand; PAM type: YTN; PAM sequence: TTG
ctcatctttcaggattcagc

SEQ ID NO: 168935 - DNA, 20 bp, Artificial Sequence
  Description of Artificial Sequence: Synthetic oligonucleotide
  Target: ATXN1; (-) strand; PAM type: YTN; PAM sequence: TTT
gctcatctttcaggattcag

SEQ ID NO: 168936 - DNA, 20 bp, Artificial Sequence
  Description of Artificial Sequence: Synthetic oligonucleotide
  Target: ATXN1; (-) strand; PAM type: YTN; PAM sequence: CTT
tgctcatctttcaggattca

SEQ ID NO: 168937 - DNA, 20 bp, Artificial Sequence
  Description of Artificial Sequence: Synthetic oligonucleotide
  Target: ATXN1; (-) strand; PAM type: YTN; PAM sequence: CTG
ctttgctcatctttcaggat

SEQ ID NO: 168938 - DNA, 20 bp, Artificial Sequence
  Description of Artificial Sequence: Synthetic oligonucleotide
  Target: ATXN1; (-) strand; PAM type: YTN; PAM sequence: TTG
gtaactgctttgctcatctt

SEQ ID NO: 168939 - DNA, 20 bp, Artificial Sequence
  Description of Artificial Sequence: Synthetic oligonucleotide
  Target: ATXN1; (-) strand; PAM type: YTN; PAM sequence: TTT
ggtaactgctttgctcatct

SEQ ID NO: 168940 - DNA, 20 bp, Artificial Sequence
  Description of Artificial Sequence: Synthetic oligonucleotide
  Target: ATXN1; (-) strand; PAM type: YTN; PAM sequence: CTT
tggtaactgctttgctcatc

SEQ ID NO: 168941 - DNA, 20 bp, Artificial Sequence
  Description of Artificial Sequence: Synthetic oligonucleotide
  Target: ATXN1; (-) strand; PAM type: YTN; PAM sequence: CTG
tctttggtaactgctttgct

SEQ ID NO: 168942 - DNA, 20 bp, Artificial Sequence
  Description of Artificial Sequence: Synthetic oligonucleotide
  Target: ATXN1; (-) strand; PAM type: YTN; PAM sequence: TTC
tgtctttggtaactgctttg

SEQ ID NO: 168943 - DNA, 20 bp, Artificial Sequence
  Description of Artificial Sequence: Synthetic oligonucleotide
  Target: ATXN1; (-) strand; PAM type: YTN; PAM sequence: CTT
ctgtctttggtaactgcttt

SEQ ID NO: 168944 - DNA, 20 bp, Artificial Sequence
  Description of Artificial Sequence: Synthetic oligonucleotide
  Target: ATXN1; (-) strand; PAM type: YTN; PAM sequence: CTG
cccttctgtctttggtaact

SEQ ID NO: 168945 - DNA, 20 bp, Artificial Sequence
  Description of Artificial Sequence: Synthetic oligonucleotide
  Target: ATXN1; (-) strand; PAM type: YTN; PAM sequence: TTA
tgcaaatgctgcccttctgt

SEQ ID NO: 168946 - DNA, 20 bp, Artificial Sequence
  Description of Artificial Sequence: Synthetic oligonucleotide
  Target: ATXN1; (-) strand; PAM type: YTN; PAM sequence: TTT
atgcaaatgctgcccttctg

SEQ ID NO: 168947 - DNA, 20 bp, Artificial Sequence
  Description of Artificial Sequence: Synthetic oligonucleotide
  Target: ATXN1; (-) strand; PAM type: YTN; PAM sequence: TTC
agcgtttatgcaaatgctgc

SEQ ID NO: 168948 - DNA, 20 bp, Artificial Sequence
  Description of Artificial Sequence: Synthetic oligonucleotide
  Target: ATXN1; (-) strand; PAM type: YTN; PAM sequence: TTT
cagcgtttatgcaaatgctg

SEQ ID NO: 168949 - DNA, 20 bp, Artificial Sequence
  Description of Artificial Sequence: Synthetic oligonucleotide
  Target: ATXN1; (-) strand; PAM type: YTN; PAM sequence: TTT
tcagcgtttatgcaaatgct

SEQ ID NO: 168950 - DNA, 20 bp, Artificial Sequence
  Description of Artificial Sequence: Synthetic oligonucleotide
  Target: ATXN1; (-) strand; PAM type: YTN; PAM sequence: TTT
ttcagcgtttatgcaaatgc

SEQ ID NO: 168951 - DNA, 20 bp, Artificial Sequence
  Description of Artificial Sequence: Synthetic oligonucleotide
  Target: ATXN1; (-) strand; PAM type: YTN; PAM sequence: TTA
caagcatttttcagcgttta

SEQ ID NO: 168952 - DNA, 20 bp, Artificial Sequence
  Description of Artificial Sequence: Synthetic oligonucleotide
  Target: ATXN1; (-) strand; PAM type: YTN; PAM sequence: TTT
acaagcatttttcagcgttt

SEQ ID NO: 168953 - DNA, 20 bp, Artificial Sequence
  Description of Artificial Sequence: Synthetic oligonucleotide
  Target: ATXN1; (-) strand; PAM type: YTN; PAM sequence: TTT
tacaagcatttttcagcgtt

SEQ ID NO: 168954 - DNA, 20 bp, Artificial Sequence
  Description of Artificial Sequence: Synthetic oligonucleotide
  Target: ATXN1; (-) strand; PAM type: YTN; PAM sequence: CTA
tgccgccatagttttacaag

SEQ ID NO: 168955 - DNA, 20 bp, Artificial Sequence
  Description of Artificial Sequence: Synthetic oligonucleotide
  Target: ATXN1; (-) strand; PAM type: YTN; PAM sequence: TTA
tgctatgccgccatagtttt

SEQ ID NO: 168956 - DNA, 20 bp, Artificial Sequence
  Description of Artificial Sequence: Synthetic oligonucleotide
  Target: ATXN1; (-) strand; PAM type: YTN; PAM sequence: CTT
atgctatgccgccatagttt

SEQ ID NO: 168957 - DNA, 20 bp, Artificial Sequence
  Description of Artificial Sequence: Synthetic oligonucleotide
  Target: ATXN1; (-) strand; PAM type: YTN; PAM sequence: CTG
cgtgtgcttatgctatgccg

SEQ ID NO: 168958 - DNA, 20 bp, Artificial Sequence
  Description of Artificial Sequence: Synthetic oligonucleotide
  Target: ATXN1; (-) strand; PAM type: YTN; PAM sequence: CTC
ccaaacactgcgtgtgctta

SEQ ID NO: 168959 - DNA, 20 bp, Artificial Sequence
  Description of Artificial Sequence: Synthetic oligonucleotide
  Target: ATXN1; (-) strand; PAM type: YTN; PAM sequence: TTC
tcccaaacactgcgtgtgct

SEQ ID NO: 168960 - DNA, 20 bp, Artificial Sequence
  Description of Artificial Sequence: Synthetic oligonucleotide
  Target: ATXN1; (-) strand; PAM type: YTN; PAM sequence: CTG
gccattctcccaaacactgc

SEQ ID NO: 168961 - DNA, 20 bp, Artificial Sequence
  Description of Artificial Sequence: Synthetic oligonucleotide
  Target: ATXN1; (-) strand; PAM type: YTN; PAM sequence: TTA
gcaaatcactggccattctc

SEQ ID NO: 168962 - DNA, 20 bp, Artificial Sequence
  Description of Artificial Sequence: Synthetic oligonucleotide
  Target: ATXN1; (-) strand; PAM type: YTN; PAM sequence: CTT
agcaaatcactggccattct

SEQ ID NO: 168963 - DNA, 20 bp, Artificial Sequence
  Description of Artificial Sequence: Synthetic oligonucleotide
  Target: ATXN1; (-) strand; PAM type: YTN; PAM sequence: CTG
gtggagccttagcaaatcac

SEQ ID NO: 168964 - DNA, 20 bp, Artificial Sequence
  Description of Artificial Sequence: Synthetic oligonucleotide
  Target: ATXN1; (-) strand; PAM type: YTN; PAM sequence: CTG
aaagacctggtggagcctta

SEQ ID NO: 168965 - DNA, 20 bp, Artificial Sequence
  Description of Artificial Sequence: Synthetic oligonucleotide
  Target: ATXN1; (-) strand; PAM type: YTN; PAM sequence: CTA
accctgaaagacctggtgga

SEQ ID NO: 168966 - DNA, 20 bp, Artificial Sequence
  Description of Artificial Sequence: Synthetic oligonucleotide
  Target: ATXN1; (-) strand; PAM type: YTN; PAM sequence: TTC
taaccctgaaagacctggtg

SEQ ID NO: 168967 - DNA, 20 bp, Artificial Sequence
  Description of Artificial Sequence: Synthetic oligonucleotide
  Target: ATXN1; (-) strand; PAM type: YTN; PAM sequence: CTG
ttctaaccctgaaagacctg

SEQ ID NO: 168968 - DNA, 20 bp, Artificial Sequence
  Description of Artificial Sequence: Synthetic oligonucleotide
  Target: ATXN1; (-) strand; PAM type: YTN; PAM sequence: CTC
tgttctaaccctgaaagacc

SEQ ID NO: 168969 - DNA, 20 bp, Artificial Sequence
  Description of Artificial Sequence: Synthetic oligonucleotide
  Target: ATXN1; (-) strand; PAM type: YTN; PAM sequence: TTA
tgtgtgatgatgctctgttc

SEQ ID NO: 168970 - DNA, 20 bp, Artificial Sequence
  Description of Artificial Sequence: Synthetic oligonucleotide
  Target: ATXN1; (-) strand; PAM type: YTN; PAM sequence: CTG
ttatgtgtgatgatgctctg

SEQ ID NO: 168971 - DNA, 20 bp, Artificial Sequence
  Description of Artificial Sequence: Synthetic oligonucleotide
  Target: ATXN1; (-) strand; PAM type: YTN; PAM sequence: TTA
catacacgtgctgttatgtg

SEQ ID NO: 168972 - DNA, 20 bp, Artificial Sequence
  Description of Artificial Sequence: Synthetic oligonucleotide
  Target: ATXN1; (-) strand; PAM type: YTN; PAM sequence: TTG
tcatattacatacacgtgct

SEQ ID NO: 168973 - DNA, 20 bp, Artificial Sequence
  Description of Artificial Sequence: Synthetic oligonucleotide
  Target: ATXN1; (-) strand; PAM type: YTN; PAM sequence: CTT
gtcatattacatacacgtgc

SEQ ID NO: 168974 - DNA, 20 bp, Artificial Sequence
  Description of Artificial Sequence: Synthetic oligonucleotide
  Target: ATXN1; (-) strand; PAM type: YTN; PAM sequence: TTG
cttgtcatattacatacacg

SEQ ID NO: 168975 - DNA, 20 bp, Artificial Sequence
  Description of Artificial Sequence: Synthetic oligonucleotide
  Target: ATXN1; (-) strand; PAM type: YTN; PAM sequence: CTC
aattgcttgtcatattacat

SEQ ID NO: 168976 - DNA, 20 bp, Artificial Sequence
  Description of Artificial Sequence: Synthetic oligonucleotide
  Target: ATXN1; (-) strand; PAM type: YTN; PAM sequence: TTC
ccaaatggagctcaattgct

SEQ ID NO: 168977 - DNA, 20 bp, Artificial Sequence
  Description of Artificial Sequence: Synthetic oligonucleotide
  Target: ATXN1; (-) strand; PAM type: YTN; PAM sequence: TTT
cccaaatggagctcaattgc

SEQ ID NO: 168978 - DNA, 20 bp, Artificial Sequence
  Description of Artificial Sequence: Synthetic oligonucleotide
  Target: ATXN1; (-) strand; PAM type: YTN; PAM sequence: CTA
gtttcccaaatggagctcaa

SEQ ID NO: 168979 - DNA, 20 bp, Artificial Sequence
  Description of Artificial Sequence: Synthetic oligonucleotide
  Target: ATXN1; (-) strand; PAM type: YTN; PAM sequence: CTC
tagtttcccaaatggagctc

SEQ ID NO: 168980 - DNA, 20 bp, Artificial Sequence
  Description of Artificial Sequence: Synthetic oligonucleotide
  Target: ATXN1; (-) strand; PAM type: YTN; PAM sequence: TTA
gagctctagtttcccaaatg

SEQ ID NO: 168981 - DNA, 20 bp, Artificial Sequence
  Description of Artificial Sequence: Synthetic oligonucleotide
  Target: ATXN1; (-) strand; PAM type: YTN; PAM sequence: CTT
agagctctagtttcccaaat

SEQ ID NO: 168982 - DNA, 20 bp, Artificial Sequence
  Description of Artificial Sequence: Synthetic oligonucleotide
  Target: ATXN1; (-) strand; PAM type: YTN; PAM sequence: TTG
ccatgaagtaggcagaaggc

SEQ ID NO: 168983 - DNA, 20 bp, Artificial Sequence
  Description of Artificial Sequence: Synthetic oligonucleotide
  Target: ATXN1; (-) strand; PAM type: YTN; PAM sequence: CTT
gccatgaagtaggcagaagg

SEQ ID NO: 168984 - DNA, 20 bp, Artificial Sequence
  Description of Artificial Sequence: Synthetic oligonucleotide
  Target: ATXN1; (-) strand; PAM type: YTN; PAM sequence: CTC
cttgccatgaagtaggcaga

SEQ ID NO: 168985 - DNA, 20 bp, Artificial Sequence
  Description of Artificial Sequence: Synthetic oligonucleotide
  Target: ATXN1; (-) strand; PAM type: YTN; PAM sequence: CTG
gtggtgcccgagatggccct

SEQ ID NO: 168986 - DNA, 20 bp, Artificial Sequence
  Description of Artificial Sequence: Synthetic oligonucleotide
  Target: ATXN1; (-) strand; PAM type: YTN; PAM sequence: CTG
ccatagagggctggtggtgc

SEQ ID NO: 168987 - DNA, 20 bp, Artificial Sequence
  Description of Artificial Sequence: Synthetic oligonucleotide
  Target: ATXN1; (-) strand; PAM type: YTN; PAM sequence: TTG
tggtgggccaggaggatatg

SEQ ID NO: 168988 - DNA, 20 bp, Artificial Sequence
  Description of Artificial Sequence: Synthetic oligonucleotide
  Target: ATXN1; (-) strand; PAM type: YTN; PAM sequence: CTG
cacacaggttgtggtgggcc

SEQ ID NO: 168989 - DNA, 20 bp, Artificial Sequence
  Description of Artificial Sequence: Synthetic oligonucleotide
  Target: ATXN1; (-) strand; PAM type: YTN; PAM sequence: CTG
agtacctgcacacaggttgt

SEQ ID NO: 168990 - DNA, 20 bp, Artificial Sequence
  Description of Artificial Sequence: Synthetic oligonucleotide
  Target: ATXN1; (-) strand; PAM type: YTN; PAM sequence: CTG
gcatagacaaagggaagcag

SEQ ID NO: 168991 - DNA, 20 bp, Artificial Sequence
  Description of Artificial Sequence: Synthetic oligonucleotide
  Target: ATXN1; (-) strand; PAM type: YTN; PAM sequence: TTG
aagaataaggccacctggca

SEQ ID NO: 168992 - DNA, 20 bp, Artificial Sequence
  Description of Artificial Sequence: Synthetic oligonucleotide
  Target: ATXN1; (-) strand; PAM type: YTN; PAM sequence: TTT
gaagaataaggccacctggc

SEQ ID NO: 168993 - DNA, 20 bp, Artificial Sequence
  Description of Artificial Sequence: Synthetic oligonucleotide
  Target: ATXN1; (-) strand; PAM type: YTN; PAM sequence: CTT
tgaagaataaggccacctgg

SEQ ID NO: 168994 - DNA, 20 bp, Artificial Sequence
  Description of Artificial Sequence: Synthetic oligonucleotide
  Target: ATXN1; (-) strand; PAM type: YTN; PAM sequence: TTG
gccagagctttgaagaataa

SEQ ID NO: 168995 - DNA, 20 bp, Artificial Sequence
  Description of Artificial Sequence: Synthetic oligonucleotide
  Target: ATXN1; (-) strand; PAM type: YTN; PAM sequence: CTT
ggccagagctttgaagaata

SEQ ID NO: 168996 - DNA, 20 bp, Artificial Sequence
  Description of Artificial Sequence: Synthetic oligonucleotide
  Target: ATXN1; (-) strand; PAM type: YTN; PAM sequence: TTA
gaacttggccagagctttga

SEQ ID NO: 168997 - DNA, 20 bp, Artificial Sequence
  Description of Artificial Sequence: Synthetic oligonucleotide
  Target: ATXN1; (-) strand; PAM type: YTN; PAM sequence: TTA
gcaagtaaggcacgtgcaag

SEQ ID NO: 168998 - DNA, 20 bp, Artificial Sequence
  Description of Artificial Sequence: Synthetic oligonucleotide
  Target: ATXN1; (-) strand; PAM type: YTN; PAM sequence: CTG
ggtaggagttagcaagtaag

SEQ ID NO: 168999 - DNA, 20 bp, Artificial Sequence
  Description of Artificial Sequence: Synthetic oligonucleotide
  Target: ATXN1; (-) strand; PAM type: YTN; PAM sequence: TTG
ctgggtaggagttagcaagt

SEQ ID NO: 169000 - DNA, 20 bp, Artificial Sequence
  Description of Artificial Sequence: Synthetic oligonucleotide
  Target: ATXN1; (-) strand; PAM type: YTN; PAM sequence: CTG
agttgctgggtaggagttag

SEQ ID NO: 169001 - DNA, 20 bp, Artificial Sequence
  Description of Artificial Sequence: Synthetic oligonucleotide
  Target: ATXN1; (-) strand; PAM type: YTN; PAM sequence: TTC
tgagttgctgggtaggagtt

SEQ ID NO: 169002 - DNA, 20 bp, Artificial Sequence
  Description of Artificial Sequence: Synthetic oligonucleotide
  Target: ATXN1; (-) strand; PAM type: YTN; PAM sequence: TTA
atgttctgagttgctgggta

SEQ ID NO: 169003 - DNA, 20 bp, Artificial Sequence
  Description of Artificial Sequence: Synthetic oligonucleotide
  Target: ATXN1; (-) strand; PAM type: YTN; PAM sequence: TTA
ggacagaccaggggagtggt

SEQ ID NO: 169004 - DNA, 20 bp, Artificial Sequence
  Description of Artificial Sequence: Synthetic oligonucleotide
  Target: ATXN1; (-) strand; PAM type: YTN; PAM sequence: CTG
agttaggacagaccagggga

SEQ ID NO: 169005 - DNA, 20 bp, Artificial Sequence
  Description of Artificial Sequence: Synthetic oligonucleotide
  Target: ATXN1; (-) strand; PAM type: YTN; PAM sequence: TTA
tgacacaaggcagtatctga

SEQ ID NO: 169006 - DNA, 20 bp, Artificial Sequence
  Description of Artificial Sequence: Synthetic oligonucleotide
  Target: ATXN1; (-) strand; PAM type: YTN; PAM sequence: TTT
atgacacaaggcagtatctg

SEQ ID NO: 169007 - DNA, 20 bp, Artificial Sequence
  Description of Artificial Sequence: Synthetic oligonucleotide
  Target: ATXN1; (-) strand; PAM type: YTN; PAM sequence: TTT
tatgacacaaggcagtatct

SEQ ID NO: 169008 - DNA, 20 bp, Artificial Sequence
  Description of Artificial Sequence: Synthetic oligonucleotide
  Target: ATXN1; (-) strand; PAM type: YTN; PAM sequence: CTT
ttatgacacaaggcagtatc

SEQ ID NO: 169009 - DNA, 20 bp, Artificial Sequence
  Description of Artificial Sequence: Synthetic oligonucleotide
  Target: ATXN1; (-) strand; PAM type: YTN; PAM sequence: TTG
cttttatgacacaaggcagt

SEQ ID NO: 169010 - DNA, 20 bp, Artificial Sequence
  Description of Artificial Sequence: Synthetic oligonucleotide
  Target: ATXN1; (-) strand; PAM type: YTN; PAM sequence: CTA
aggtatgttgcttttatgac

SEQ ID NO: 169011 - DNA, 20 bp, Artificial Sequence
  Description of Artificial Sequence: Synthetic oligonucleotide
  Target: ATXN1; (-) strand; PAM type: YTN; PAM sequence: CTA
aatctaaggtatgttgcttt

SEQ ID NO: 169012 - DNA, 20 bp, Artificial Sequence
  Description of Artificial Sequence: Synthetic oligonucleotide
  Target: ATXN1; (-) strand; PAM type: YTN; PAM sequence: TTG
gtaagtcatagcatggtatc

SEQ ID NO: 169013 - DNA, 20 bp, Artificial Sequence
  Description of Artificial Sequence: Synthetic oligonucleotide
  Target: ATXN1; (-) strand; PAM type: YTN; PAM sequence: CTT
ggtaagtcatagcatggtat

SEQ ID NO: 169014 - DNA, 20 bp, Artificial Sequence
  Description of Artificial Sequence: Synthetic oligonucleotide
  Target: ATXN1; (-) strand; PAM type: YTN; PAM sequence: TTA
taaagtgcttggtaagtcat

SEQ ID NO: 169015 - DNA, 20 bp, Artificial Sequence
  Description of Artificial Sequence: Synthetic oligonucleotide
  Target: ATXN1; (-) strand; PAM type: YTN; PAM sequence: TTA
agggtataatgtatattata

SEQ ID NO: 169016 - DNA, 20 bp, Artificial Sequence
  Description of Artificial Sequence: Synthetic oligonucleotide
  Target: ATXN1; (-) strand; PAM type: YTN; PAM sequence: CTG
gggatattaagggtataatg

SEQ ID NO: 169017 - DNA, 20 bp, Artificial Sequence
  Description of Artificial Sequence: Synthetic oligonucleotide
  Target: ATXN1; (-) strand; PAM type: YTN; PAM sequence: TTA
ctggggatattaagggtata

SEQ ID NO: 169018 - DNA, 20 bp, Artificial Sequence
  Description of Artificial Sequence: Synthetic oligonucleotide
  Target: ATXN1; (-) strand; PAM type: YTN; PAM sequence: CTG
aaagaattactggggatatt

SEQ ID NO: 169019 - DNA, 20 bp, Artificial Sequence
  Description of Artificial Sequence: Synthetic oligonucleotide
  Target: ATXN1; (-) strand; PAM type: YTN; PAM sequence: CTA
tctgaaagaattactgggga

SEQ ID NO: 169020 - DNA, 20 bp, Artificial Sequence
  Description of Artificial Sequence: Synthetic oligonucleotide
  Target: ATXN1; (-) strand; PAM type: YTN; PAM sequence: CTA
acgcctatctgaaagaatta

SEQ ID NO: 169021 - DNA, 20 bp, Artificial Sequence
  Description of Artificial Sequence: Synthetic oligonucleotide
  Target: ATXN1; (-) strand; PAM type: YTN; PAM sequence: CTA
aaaagtgggcctaacgccta

SEQ ID NO: 169022 - DNA, 20 bp, Artificial Sequence
  Description of Artificial Sequence: Synthetic oligonucleotide
  Target: ATXN1; (-) strand; PAM type: YTN; PAM sequence: CTG
atctaaaaagtgggcctaac

SEQ ID NO: 169023 - DNA, 20 bp, Artificial Sequence
  Description of Artificial Sequence: Synthetic oligonucleotide
  Target: ATXN1; (-) strand; PAM type: YTN; PAM sequence: TTA
ctgatctaaaaagtgggcct

SEQ ID NO: 169024 - DNA, 20 bp, Artificial Sequence
  Description of Artificial Sequence: Synthetic oligonucleotide
  Target: ATXN1; (-) strand; PAM type: YTN; PAM sequence: TTT
actgatctaaaaagtgggcc

SEQ ID NO: 169025 - DNA, 20 bp, Artificial Sequence
  Description of Artificial Sequence: Synthetic oligonucleotide
  Target: ATXN1; (-) strand; PAM type: YTN; PAM sequence: CTG
agtttactgatctaaaaagt

SEQ ID NO: 169026 - DNA, 20 bp, Artificial Sequence
  Description of Artificial Sequence: Synthetic oligonucleotide
  Target: ATXN1; (-) strand; PAM type: YTN; PAM sequence: CTA
catgagcctgagtttactga

SEQ ID NO: 169027 - DNA, 20 bp, Artificial Sequence
  Description of Artificial Sequence: Synthetic oligonucleotide
  Target: ATXN1; (-) strand; PAM type: YTN; PAM sequence: TTA
acctacatgagcctgagttt

SEQ ID NO: 169028 - DNA, 20 bp, Artificial Sequence
  Description of Artificial Sequence: Synthetic oligonucleotide
  Target: ATXN1; (-) strand; PAM type: YTN; PAM sequence: CTT
aacctacatgagcctgagtt

SEQ ID NO: 169029 - DNA, 20 bp, Artificial Sequence
  Description of Artificial Sequence: Synthetic oligonucleotide
  Target: ATXN1; (-) strand; PAM type: YTN; PAM sequence: TTC
ccttaacctacatgagcctg

SEQ ID NO: 169030 - DNA, 20 bp, Artificial Sequence
  Description of Artificial Sequence: Synthetic oligonucleotide
  Target: ATXN1; (-) strand; PAM type: YTN; PAM sequence: CTT
cccttaacctacatgagcct

SEQ ID NO: 169031 - DNA, 20 bp, Artificial Sequence
  Description of Artificial Sequence: Synthetic oligonucleotide
  Target: ATXN1; (-) strand; PAM type: YTN; PAM sequence: CTG
ggaacttcccttaacctaca

SEQ ID NO: 169032 - DNA, 20 bp, Artificial Sequence
  Description of Artificial Sequence: Synthetic oligonucleotide
  Target: ATXN1; (-) strand; PAM type: YTN; PAM sequence: CTC
ctgggaacttcccttaacct

SEQ ID NO: 169033 - DNA, 20 bp, Artificial Sequence
  Description of Artificial Sequence: Synthetic oligonucleotide
  Target: ATXN1; (-) strand; PAM type: YTN; PAM sequence: CTG
tgctcctgggaacttccctt

SEQ ID NO: 169034 - DNA, 20 bp, Artificial Sequence
  Description of Artificial Sequence: Synthetic oligonucleotide
  Target: ATXN1; (-) strand; PAM type: YTN; PAM sequence: TTC
tgtgctcctgggaacttccc

SEQ ID NO: 169035 - DNA, 20 bp, Artificial Sequence
  Description of Artificial Sequence: Synthetic oligonucleotide
  Target: ATXN1; (-) strand; PAM type: YTN; PAM sequence: TTA
catattctgtgctcctggga

SEQ ID NO: 169036 - DNA, 20 bp, Artificial Sequence
  Description of Artificial Sequence: Synthetic oligonucleotide
  Target: ATXN1; (-) strand; PAM type: YTN; PAM sequence: CTC
cacaagttacatattctgtg

SEQ ID NO: 169037 - DNA, 20 bp, Artificial Sequence
  Description of Artificial Sequence: Synthetic oligonucleotide
  Target: ATXN1; (-) strand; PAM type: YTN; PAM sequence: CTG
gctccacaagttacatattc

SEQ ID NO: 169038 - DNA, 20 bp, Artificial Sequence
  Description of Artificial Sequence: Synthetic oligonucleotide
  Target: ATXN1; (-) strand; PAM type: YTN; PAM sequence: CTA
gtcctggctccacaagttac

SEQ ID NO: 169039 - DNA, 20 bp, Artificial Sequence
  Description of Artificial Sequence: Synthetic oligonucleotide
  Target: ATXN1; (-) strand; PAM type: YTN; PAM sequence: TTC
tagtcctggctccacaagtt

SEQ ID NO: 169040 - DNA, 20 bp, Artificial Sequence
  Description of Artificial Sequence: Synthetic oligonucleotide
  Target: ATXN1; (-) strand; PAM type: YTN; PAM sequence: TTT
ctagtcctggctccacaagt

SEQ ID NO: 169041 - DNA, 20 bp, Artificial Sequence
  Description of Artificial Sequence: Synthetic oligonucleotide
  Target: ATXN1; (-) strand; PAM type: YTN; PAM sequence: TTT
tctagtcctggctccacaag

SEQ ID NO: 169042 - DNA, 20 bp, Artificial Sequence
  Description of Artificial Sequence: Synthetic oligonucleotide
  Target: ATXN1; (-) strand; PAM type: YTN; PAM sequence: TTG
ttttctagtcctggctccac

SEQ ID NO: 169043 - DNA, 20 bp, Artificial Sequence
  Description of Artificial Sequence: Synthetic oligonucleotide
  Target: ATXN1; (-) strand; PAM type: YTN; PAM sequence: TTT
gttttctagtcctggctcca

SEQ ID NO: 169044 - DNA, 20 bp, Artificial Sequence
  Description of Artificial Sequence: Synthetic oligonucleotide
  Target: ATXN1; (-) strand; PAM type: YTN; PAM sequence: CTG
tagatttgttttctagtcct

SEQ ID NO: 169045 - DNA, 20 bp, Artificial Sequence
  Description of Artificial Sequence: Synthetic oligonucleotide
  Target: ATXN1; (-) strand; PAM type: YTN; PAM sequence: TTC
atagaatctgtagatttgtt

SEQ ID NO: 169046 - DNA, 20 bp, Artificial Sequence
  Description of Artificial Sequence: Synthetic oligonucleotide
  Target: ATXN1; (-) strand; PAM type: YTN; PAM sequence: CTG
ttcatagaatctgtagattt

SEQ ID NO: 169047 - DNA, 20 bp, Artificial Sequence
  Description of Artificial Sequence: Synthetic oligonucleotide
  Target: ATXN1; (-) strand; PAM type: YTN; PAM sequence: CTA
aataaataaataaataaata

SEQ ID NO: 169048 - DNA, 20 bp, Artificial Sequence
  Description of Artificial Sequence: Synthetic oligonucleotide
  Target: ATXN1; (-) strand; PAM type: YTN; PAM sequence: CTC
taaataaataaataaataaa

SEQ ID NO: 169049 - DNA, 20 bp, Artificial Sequence
  Description of Artificial Sequence: Synthetic oligonucleotide
  Target: ATXN1; (-) strand; PAM type: YTN; PAM sequence: CTG
tctctaaataaataaataaa

SEQ ID NO: 169050 - DNA, 20 bp, Artificial Sequence
  Description of Artificial Sequence: Synthetic oligonucleotide
  Target: ATXN1; (-) strand; PAM type: YTN; PAM sequence: CTC
ggtgacagagtgagaccctg

SEQ ID NO: 169051 - DNA, 20 bp, Artificial Sequence
  Description of Artificial Sequence: Synthetic oligonucleotide
  Target: ATXN1; (-) strand; PAM type: YTN; PAM sequence: CTC
cagcctcggtgacagagtga

SEQ ID NO: 169052 - DNA, 20 bp, Artificial Sequence
  Description of Artificial Sequence: Synthetic oligonucleotide
  Target: ATXN1; (-) strand; PAM type: YTN; PAM sequence: CTG
cactccagcctcggtgacag

SEQ ID NO: 169053 - DNA, 20 bp, Artificial Sequence
  Description of Artificial Sequence: Synthetic oligonucleotide
  Target: ATXN1; (-) strand; PAM type: YTN; PAM sequence: TTG
caccactgcactccagcctc

SEQ ID NO: 169054 - DNA, 20 bp, Artificial Sequence
  Description of Artificial Sequence: Synthetic oligonucleotide
  Target: ATXN1; (-) strand; PAM type: YTN; PAM sequence: CTG
cggtgagccgtgattgcacc

SEQ ID NO: 169055 - DNA, 20 bp, Artificial Sequence
  Description of Artificial Sequence: Synthetic oligonucleotide
  Target: ATXN1; (-) strand; PAM type: YTN; PAM sequence: TTC
agccagggcagtcaaggctg

SEQ ID NO: 169056 - DNA, 20 bp, Artificial Sequence
  Description of Artificial Sequence: Synthetic oligonucleotide
  Target: ATXN1; (-) strand; PAM type: YTN; PAM sequence: TTT
cagccagggcagtcaaggct

SEQ ID NO: 169057 - DNA, 20 bp, Artificial Sequence
  Description of Artificial Sequence: Synthetic oligonucleotide
  Target: ATXN1; (-) strand; PAM type: YTN; PAM sequence: CTG
aggtgggaggatatttcagc

SEQ ID NO: 169058 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggtgggagga

SEQ ID NO: 169059 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgaggtggga

SEQ ID NO: 169060 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctactcaggag

SEQ ID NO: 169061 - DNA, 20 bp, Artificial Sequence
  Description of Artificial Sequence: Synthetic oligonucleotide
  Target: ATXN1; (-) strand; PAM type: YTN; PAM sequence: TTA
gccaggggtggtggtgtgca

SEQ ID NO: 169062 - DNA, 20 bp, Artificial Sequence
  Description of Artificial Sequence: Synthetic oligonucleotide
  Target: ATXN1; (-) strand; PAM type: YTN; PAM sequence: TTA
aaaaattagccaggggtggt

SEQ ID NO: 169063 - DNA, 20 bp, Artificial Sequence
  Description of Artificial Sequence: Synthetic oligonucleotide
  Target: ATXN1; (-) strand; PAM type: YTN; PAM sequence: TTA
caaaaaagttaaaaaattag

SEQ ID NO: 169064 - DNA, 20 bp, Artificial Sequence
  Description of Artificial Sequence: Synthetic oligonucleotide
  Target: ATXN1; (-) strand; PAM type: YTN; PAM sequence: TTT
acaaaaaagttaaaaaatta

SEQ ID NO: 169065 - DNA, 20 bp, Artificial Sequence
  Description of Artificial Sequence: Synthetic oligonucleotide
  Target: ATXN1; (-) strand; PAM type: YTN; PAM sequence: CTT
tacaaaaaagttaaaaaatt

SEQ ID NO: 169066 - DNA, 20 bp, Artificial Sequence
  Description of Artificial Sequence: Synthetic oligonucleotide
  Target: ATXN1; (-) strand; PAM type: YTN; PAM sequence: TTG
tctttacaaaaaagttaaaa

SEQ ID NO: 169067 - DNA, 20 bp, Artificial Sequence
  Description of Artificial Sequence: Synthetic oligonucleotide
  Target: ATXN1; (-) strand; PAM type: YTN; PAM sequence: TTT
gtctttacaaaaaagttaaa

SEQ ID NO: 169068 - DNA, 20 bp, Artificial Sequence
  Description of Artificial Sequence: Synthetic oligonucleotide
  Target: ATXN1; (-) strand; PAM type: YTN; PAM sequence: CTT
tgtctttacaaaaaagttaa

SEQ ID NO: 169069 - DNA, 20 bp, Artificial Sequence
  Description of Artificial Sequence: Synthetic oligonucleotide
  Target: ATXN1; (-) strand; PAM type: YTN; PAM sequence: CTG
ggaaatatagtgagactttg

SEQ ID NO: 169070 - DNA, 20 bp, Artificial Sequence
  Description of Artificial Sequence: Synthetic oligonucleotide
  Target: ATXN1; (-) strand; PAM type: YTN; PAM sequence: TTG
agaccagcctgggaaatata

SEQ ID NO: 169071 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctgggaaatat

SEQ ID NO: 169072 - DNA, 20 bp, Artificial Sequence
  Description of Artificial Sequence: Synthetic oligonucleotide
  Target: ATXN1; (-) strand; PAM type: YTN; PAM sequence: TTG
aacccaggagtttgagacca

SEQ ID NO: 169073 - DNA, 20 bp, Artificial Sequence
  Description of Artificial Sequence: Synthetic oligonucleotide
  Target: ATXN1; (-) strand; PAM type: YTN; PAM sequence: CTT
gaacccaggagtttgagacc

SEQ ID NO: 169074 - DNA, 20 bp, Artificial Sequence
  Description of Artificial Sequence: Synthetic oligonucleotide
  Target: ATXN1; (-) strand; PAM type: YTN; PAM sequence: CTG
cttgaacccaggagtttgag

SEQ ID NO: 169075 - DNA, 20 bp, Artificial Sequence
  Description of Artificial Sequence: Synthetic oligonucleotide
  Target: ATXN1; (-) strand; PAM type: YTN; PAM sequence: CTG
aggtgggaggactgcttgaa

SEQ ID NO: 169076 - DNA, 20 bp, Artificial Sequence
  Description of Artificial Sequence: Synthetic oligonucleotide
  Target: ATXN1; (-) strand; PAM type: YTN; PAM sequence: TTG
ggaagctgaggtgggaggac

SEQ ID NO: 169077 - DNA, 20 bp, Artificial Sequence
  Description of Artificial Sequence: Synthetic oligonucleotide
  Target: ATXN1; (-) strand; PAM type: YTN; PAM sequence: TTT
gggaagctgaggtgggagga

SEQ ID NO: 169078 - DNA, 20 bp, Artificial Sequence
  Description of Artificial Sequence: Synthetic oligonucleotide
  Target: ATXN1; (-) strand; PAM type: YTN; PAM sequence: TTT
tgggaagctgaggtgggagg

SEQ ID NO: 169079 - DNA, 20 bp, Artificial Sequence
  Description of Artificial Sequence: Synthetic oligonucleotide
  Target: ATXN1; (-) strand; PAM type: YTN; PAM sequence: CTC
ccagcattttgggaagctga

SEQ ID NO: 169080 - DNA, 20 bp, Artificial Sequence
  Description of Artificial Sequence: Synthetic oligonucleotide
  Target: ATXN1; (-) strand; PAM type: YTN; PAM sequence: CTA
tactcccagcattttgggaa

SEQ ID NO: 169081 - DNA, 20 bp, Artificial Sequence
  Description of Artificial Sequence: Synthetic oligonucleotide
  Target: ATXN1; (-) strand; PAM type: YTN; PAM sequence: CTC
atgcctatactcccagcatt

SEQ ID NO: 169082 - DNA, 20 bp, Artificial Sequence
  Description of Artificial Sequence: Synthetic oligonucleotide
  Target: ATXN1; (-) strand; PAM type: YTN; PAM sequence: CTG
tgctcatgcctatactccca

SEQ ID NO: 169083 - DNA, 20 bp, Artificial Sequence
  Description of Artificial Sequence: Synthetic oligonucleotide
  Target: ATXN1; (-) strand; PAM type: YTN; PAM sequence: CTG
ggcactgtgctcatgcctat

SEQ ID NO: 169084 - DNA, 20 bp, Artificial Sequence
  Description of Artificial Sequence: Synthetic oligonucleotide
  Target: ATXN1; (-) strand; PAM type: YTN; PAM sequence: TTA
ataagtcaagaggaggtctg

SEQ ID NO: 169085 - DNA, 20 bp, Artificial Sequence
  Description of Artificial Sequence: Synthetic oligonucleotide
  Target: ATXN1; (-) strand; PAM type: YTN; PAM sequence: CTT
aataagtcaagaggaggtct

SEQ ID NO: 169086 - DNA, 20 bp, Artificial Sequence
  Description of Artificial Sequence: Synthetic oligonucleotide
  Target: ATXN1; (-) strand; PAM type: YTN; PAM sequence: CTG
aatcggcatcataataactt

SEQ ID NO: 169087 - DNA, 20 bp, Artificial Sequence
  Description of Artificial Sequence: Synthetic oligonucleotide
  Target: ATXN1; (-) strand; PAM type: YTN; PAM sequence: TTG
ctgaatcggcatcataataa

SEQ ID NO: 169088 - DNA, 20 bp, Artificial Sequence
  Description of Artificial Sequence: Synthetic oligonucleotide
  Target: ATXN1; (-) strand; PAM type: YTN; PAM sequence: CTT
gctgaatcggcatcataata

SEQ ID NO: 169089 - DNA, 20 bp, Artificial Sequence
  Description of Artificial Sequence: Synthetic oligonucleotide
  Target: ATXN1; (-) strand; PAM type: YTN; PAM sequence: CTG
ggtagatacccagtagtggg

SEQ ID NO: 169090 - DNA, 20 bp, Artificial Sequence
  Description of Artificial Sequence: Synthetic oligonucleotide
  Target: ATXN1; (-) strand; PAM type: YTN; PAM sequence: CTC
tgggtagatacccagtagtg

SEQ ID NO: 169091 - DNA, 20 bp, Artificial Sequence
  Description of Artificial Sequence: Synthetic oligonucleotide
  Target: ATXN1; (-) strand; PAM type: YTN; PAM sequence: TTC
ctctgggtagatacccagta

SEQ ID NO: 169092 - DNA, 20 bp, Artificial Sequence
  Description of Artificial Sequence: Synthetic oligonucleotide
  Target: ATXN1; (-) strand; PAM type: YTN; PAM sequence: TTT
cctctgggtagatacccagt

SEQ ID NO: 169093 - DNA, 20 bp, Artificial Sequence
  Description of Artificial Sequence: Synthetic oligonucleotide
  Target: ATXN1; (-) strand; PAM type: YTN; PAM sequence: TTT
tcctctgggtagatacccag

SEQ ID NO: 169094 - DNA, 20 bp, Artificial Sequence
  Description of Artificial Sequence: Synthetic oligonucleotide
  Target: ATXN1; (-) strand; PAM type: YTN; PAM sequence: TTA
ttttcctctgggtagatacc

SEQ ID NO: 169095 - DNA, 20 bp, Artificial Sequence
  Description of Artificial Sequence: Synthetic oligonucleotide
  Target: ATXN1; (-) strand; PAM type: YTN; PAM sequence: CTT
attttcctctgggtagatac

SEQ ID NO: 169096 - DNA, 20 bp, Artificial Sequence
  Description of Artificial Sequence: Synthetic oligonucleotide
  Target: ATXN1; (-) strand; PAM type: YTN; PAM sequence: TTC
gaataatgacttattttcct

SEQ ID NO: 169097 - DNA, 20 bp, Artificial Sequence
  Description of Artificial Sequence: Synthetic oligonucleotide
  Target: ATXN1; (-) strand; PAM type: YTN; PAM sequence: TTT
cgaataatgacttattttcc

SEQ ID NO: 169098 - DNA, 20 bp, Artificial Sequence
  Description of Artificial Sequence: Synthetic oligonucleotide
  Target: ATXN1; (-) strand; PAM type: YTN; PAM sequence: TTT
tcgaataatgacttattttc

SEQ ID NO: 169099 - DNA, 20 bp, Artificial Sequence
  Description of Artificial Sequence: Synthetic oligonucleotide
  Target: ATXN1; (-) strand; PAM type: YTN; PAM sequence: TTT
ttcgaataatgacttatttt

SEQ ID NO: 169100 - DNA, 20 bp, Artificial Sequence
  Description of Artificial Sequence: Synthetic oligonucleotide
  Target: ATXN1; (-) strand; PAM type: YTN; PAM sequence: CTT
tttcgaataatgacttattt

SEQ ID NO: 169101 - DNA, 20 bp, Artificial Sequence
  Description of Artificial Sequence: Synthetic oligonucleotide
  Target: ATXN1; (-) strand; PAM type: YTN; PAM sequence: CTA
taaacatgcgtgtgcaagta

SEQ ID NO: 169102 - DNA, 20 bp, Artificial Sequence
  Description of Artificial Sequence: Synthetic oligonucleotide
  Target: ATXN1; (-) strand; PAM type: YTN; PAM sequence: CTG
ctataaacatgcgtgtgcaa

SEQ ID NO: 169103 - DNA, 20 bp, Artificial Sequence
  Description of Artificial Sequence: Synthetic oligonucleotide
  Target: ATXN1; (-) strand; PAM type: YTN; PAM sequence: TTG
tgctgctataaacatgcgtg

SEQ ID NO: 169104 - DNA, 20 bp, Artificial Sequence
  Description of Artificial Sequence: Synthetic oligonucleotide
  Target: ATXN1; (-) strand; PAM type: YTN; PAM sequence: TTG
tgaattgtgctgctataaac

SEQ ID NO: 169105 - DNA, 20 bp, Artificial Sequence
  Description of Artificial Sequence: Synthetic oligonucleotide
  Target: ATXN1; (-) strand; PAM type: YTN; PAM sequence: TTG
caattgtgaattgtgctgct

SEQ ID NO: 169106 - DNA, 20 bp, Artificial Sequence
  Description of Artificial Sequence: Synthetic oligonucleotide
  Target: ATXN1; (-) strand; PAM type: YTN; PAM sequence: TTT
gcaattgtgaattgtgctgc

SEQ ID NO: 169107 - DNA, 20 bp, Artificial Sequence
  Description of Artificial Sequence: Synthetic oligonucleotide
  Target: ATXN1; (-) strand; PAM type: YTN; PAM sequence: TTT
tgcaattgtgaattgtgctg

SEQ ID NO: 169108 - DNA, 20 bp, Artificial Sequence
  Description of Artificial Sequence: Synthetic oligonucleotide
  Target: ATXN1; (-) strand; PAM type: YTN; PAM sequence: TTC
catgattttgcaattgtgaa

SEQ ID NO: 169109 - DNA, 20 bp, Artificial Sequence
  Description of Artificial Sequence: Synthetic oligonucleotide
  Target: ATXN1; (-) strand; PAM type: YTN; PAM sequence: TTG
gttccatgattttgcaattg

SEQ ID NO: 169110 - DNA, 20 bp, Artificial Sequence
  Description of Artificial Sequence: Synthetic oligonucleotide
  Target: ATXN1; (-) strand; PAM type: YTN; PAM sequence: TTG
ggttggttccatgattttgc

SEQ ID NO: 169111 - DNA, 20 bp, Artificial Sequence
  Description of Artificial Sequence: Synthetic oligonucleotide
  Target: ATXN1; (-) strand; PAM type: YTN; PAM sequence: TTT
gggttggttccatgattttg

SEQ ID NO: 169112 - DNA, 20 bp, Artificial Sequence
  Description of Artificial Sequence: Synthetic oligonucleotide
  Target: ATXN1; (-) strand; PAM type: YTN; PAM sequence: TTG
atgggcatttgggttggttc

SEQ ID NO: 169113 - DNA, 20 bp, Artificial Sequence
  Description of Artificial Sequence: Synthetic oligonucleotide
  Target: ATXN1; (-) strand; PAM type: YTN; PAM sequence: CTC
aattgatgggcatttgggtt

SEQ ID NO: 169114 - DNA, 20 bp, Artificial Sequence
  Description of Artificial Sequence: Synthetic oligonucleotide
  Target: ATXN1; (-) strand; PAM type: YTN; PAM sequence: TTA
tccactcaattgatgggcat

SEQ ID NO: 169115 - DNA, 20 bp, Artificial Sequence
  Description of Artificial Sequence: Synthetic oligonucleotide
  Target: ATXN1; (-) strand; PAM type: YTN; PAM sequence: TTT
atccactcaattgatgggca

SEQ ID NO: 169116 - DNA, 20 bp, Artificial Sequence
  Description of Artificial Sequence: Synthetic oligonucleotide
  Target: ATXN1; (-) strand; PAM type: YTN; PAM sequence: CTT
tatccactcaattgatgggc

SEQ ID NO: 169117 - DNA, 20 bp, Artificial Sequence
  Description of Artificial Sequence: Synthetic oligonucleotide
  Target: ATXN1; (-) strand; PAM type: YTN; PAM sequence: TTC
ctttatccactcaattgatg

SEQ ID NO: 169118 - DNA, 20 bp, Artificial Sequence
  Description of Artificial Sequence: Synthetic oligonucleotide
  Target: ATXN1; (-) strand; PAM type: YTN; PAM sequence: TTC
catcatatatatgtaccaca

SEQ ID NO: 169119 - DNA, 20 bp, Artificial Sequence
  Description of Artificial Sequence: Synthetic oligonucleotide
  Target: ATXN1; (-) strand; PAM type: YTN; PAM sequence: CTG
agtagtattccatcatatat

SEQ ID NO: 169120 - DNA, 20 bp, Artificial Sequence
  Description of Artificial Sequence: Synthetic oligonucleotide
  Target: ATXN1; (-) strand; PAM type: YTN; PAM sequence: TTA
tggctgagtagtattccatc

SEQ ID NO: 169121 - DNA, 20 bp, Artificial Sequence
  Description of Artificial Sequence: Synthetic oligonucleotide
  Target: ATXN1; (-) strand; PAM type: YTN; PAM sequence: TTT
atggctgagtagtattccat

SEQ ID NO: 169122 - DNA, 20 bp, Artificial Sequence
  Description of Artificial Sequence: Synthetic oligonucleotide
  Target: ATXN1; (-) strand; PAM type: YTN; PAM sequence: TTT
tatggctgagtagtattcca

SEQ ID NO: 169123 - DNA, 20 bp, Artificial Sequence
  Description of Artificial Sequence: Synthetic oligonucleotide
  Target: ATXN1; (-) strand; PAM type: YTN; PAM sequence: TTT
ttatggctgagtagtattcc

SEQ ID NO: 169124 - DNA, 20 bp, Artificial Sequence
  Description of Artificial Sequence: Synthetic oligonucleotide
  Target: ATXN1; (-) strand; PAM type: YTN; PAM sequence: CTT
tttatggctgagtagtattc

SEQ ID NO: 169125 - DNA, 20 bp, Artificial Sequence
  Description of Artificial Sequence: Synthetic oligonucleotide
  Target: ATXN1; (-) strand; PAM type: YTN; PAM sequence: TTC
ctttttatggctgagtagta

SEQ ID NO: 169126 - DNA, 20 bp, Artificial Sequence
  Description of Artificial Sequence: Synthetic oligonucleotide
  Target: ATXN1; (-) strand; PAM type: YTN; PAM sequence: TTC
attcctttttatggctgagt

SEQ ID NO: 169127 - DNA, 20 bp, Artificial Sequence
  Description of Artificial Sequence: Synthetic oligonucleotide
  Target: ATXN1; (-) strand; PAM type: YTN; PAM sequence: TTA
attcattcctttttatggct

SEQ ID NO: 169128 - DNA, 20 bp, Artificial Sequence
  Description of Artificial Sequence: Synthetic oligonucleotide
  Target: ATXN1; (-) strand; PAM type: YTN; PAM sequence: CTG
ttaattcattcctttttatg

SEQ ID NO: 169129 - DNA, 20 bp, Artificial Sequence
  Description of Artificial Sequence: Synthetic oligonucleotide
  Target: ATXN1; (-) strand; PAM type: YTN; PAM sequence: CTG
caaatgctgttaattcattc

SEQ ID NO: 169130 - DNA, 20 bp, Artificial Sequence
  Description of Artificial Sequence: Synthetic oligonucleotide
  Target: ATXN1; (-) strand; PAM type: YTN; PAM sequence: CTC
atccaggtcactgcaaatgc

SEQ ID NO: 169131 - DNA, 20 bp, Artificial Sequence
  Description of Artificial Sequence: Synthetic oligonucleotide
  Target: ATXN1; (-) strand; PAM type: YTN; PAM sequence: CTC
caatctcatccaggtcactg

SEQ ID NO: 169132 - DNA, 20 bp, Artificial Sequence
  Description of Artificial Sequence: Synthetic oligonucleotide
  Target: ATXN1; (-) strand; PAM type: YTN; PAM sequence: TTA
gaataatagtctccaatctc

SEQ ID NO: 169133 - DNA, 20 bp, Artificial Sequence
  Description of Artificial Sequence: Synthetic oligonucleotide
  Target: ATXN1; (-) strand; PAM type: YTN; PAM sequence: CTT
agaataatagtctccaatct

SEQ ID NO: 169134 - DNA, 20 bp, Artificial Sequence
  Description of Artificial Sequence: Synthetic oligonucleotide
  Target: ATXN1; (-) strand; PAM type: YTN; PAM sequence: TTC
acttagaataatagtctcca

SEQ ID NO: 169135 - DNA, 20 bp, Artificial Sequence
  Description of Artificial Sequence: Synthetic oligonucleotide
  Target: ATXN1; (-) strand; PAM type: YTN; PAM sequence: CTT
cacttagaataatagtctcc

SEQ ID NO: 169136 - DNA, 20 bp, Artificial Sequence
  Description of Artificial Sequence: Synthetic oligonucleotide
  Target: ATXN1; (-) strand; PAM type: YTN; PAM sequence: TTA
cttcacttagaataatagtc

SEQ ID NO: 169137 - DNA, 20 bp, Artificial Sequence
  Description of Artificial Sequence: Synthetic oligonucleotide
  Target: ATXN1; (-) strand; PAM type: YTN; PAM sequence: TTG
agttacttcacttagaataa

SEQ ID NO: 169138 - DNA, 20 bp, Artificial Sequence
  Description of Artificial Sequence: Synthetic oligonucleotide
  Target: ATXN1; (-) strand; PAM type: YTN; PAM sequence: CTT
gagttacttcacttagaata

SEQ ID NO: 169139 - DNA, 20 bp, Artificial Sequence
  Description of Artificial Sequence: Synthetic oligonucleotide
  Target: ATXN1; (-) strand; PAM type: YTN; PAM sequence: TTC
ttgagttacttcacttagaa

SEQ ID NO: 169140 - DNA, 20 bp, Artificial Sequence
  Description of Artificial Sequence: Synthetic oligonucleotide
  Target: ATXN1; (-) strand; PAM type: YTN; PAM sequence: TTC
cattcttgagttacttcact

SEQ ID NO: 169141 - DNA, 20 bp, Artificial Sequence
  Description of Artificial Sequence: Synthetic oligonucleotide
  Target: ATXN1; (-) strand; PAM type: YTN; PAM sequence: TTT
ccattcttgagttacttcac

SEQ ID NO: 169142 - DNA, 20 bp, Artificial Sequence
  Description of Artificial Sequence: Synthetic oligonucleotide
  Target: ATXN1; (-) strand; PAM type: YTN; PAM sequence: TTT
tccattcttgagttacttca

SEQ ID NO: 169143 - DNA, 20 bp, Artificial Sequence
  Description of Artificial Sequence: Synthetic oligonucleotide
  Target: ATXN1; (-) strand; PAM type: YTN; PAM sequence: TTG
gttttccattcttgagttac

SEQ ID NO: 169144 - DNA, 20 bp, Artificial Sequence
  Description of Artificial Sequence: Synthetic oligonucleotide
  Target: ATXN1; (-) strand; PAM type: YTN; PAM sequence: TTT
ggttttccattcttgagtta

SEQ ID NO: 169145 - DNA, 20 bp, Artificial Sequence
  Description of Artificial Sequence: Synthetic oligonucleotide
  Target: ATXN1; (-) strand; PAM type: YTN; PAM sequence: CTC
acatatcagtgagaacatat

SEQ ID NO: 169146 - DNA, 20 bp, Artificial Sequence
  Description of Artificial Sequence: Synthetic oligonucleotide
  Target: ATXN1; (-) strand; PAM type: YTN; PAM sequence: CTC
tcacatatcagtgagaacat

SEQ ID NO: 169147 - DNA, 20 bp, Artificial Sequence
  Description of Artificial Sequence: Synthetic oligonucleotide
  Target: ATXN1; (-) strand; PAM type: YTN; PAM sequence: TTA
gctctcacatatcagtgaga

SEQ ID NO: 169148 - DNA, 20 bp, Artificial Sequence
  Description of Artificial Sequence: Synthetic oligonucleotide
  Target: ATXN1; (-) strand; PAM type: YTN; PAM sequence: CTT
agctctcacatatcagtgag

SEQ ID NO: 169149 - DNA, 20 bp, Artificial Sequence
  Description of Artificial Sequence: Synthetic oligonucleotide
  Target: ATXN1; (-) strand; PAM type: YTN; PAM sequence: CTC
atagcttagctctcacatat

SEQ ID NO: 169150 - DNA, 20 bp, Artificial Sequence
  Description of Artificial Sequence: Synthetic oligonucleotide
  Target: ATXN1; (-) strand; PAM type: YTN; PAM sequence: TTG
catcctcatagcttagctct

SEQ ID NO: 169151 - DNA, 20 bp, Artificial Sequence
  Description of Artificial Sequence: Synthetic oligonucleotide
  Target: ATXN1; (-) strand; PAM type: YTN; PAM sequence: TTT
gcatcctcatagcttagctc

SEQ ID NO: 169152 - DNA, 20 bp, Artificial Sequence
  Description of Artificial Sequence: Synthetic oligonucleotide
  Target: ATXN1; (-) strand; PAM type: YTN; PAM sequence: CTT
tgcatcctcatagcttagct

SEQ ID NO: 169153 - DNA, 20 bp, Artificial Sequence
  Description of Artificial Sequence: Synthetic oligonucleotide
  Target: ATXN1; (-) strand; PAM type: YTN; PAM sequence: TTA
tgcctttgcatcctcatagc

SEQ ID NO: 169154 - DNA, 20 bp, Artificial Sequence
  Description of Artificial Sequence: Synthetic oligonucleotide
  Target: ATXN1; (-) strand; PAM type: YTN; PAM sequence: CTT
atgcctttgcatcctcatag

SEQ ID NO: 169155 - DNA, 20 bp, Artificial Sequence
  Description of Artificial Sequence: Synthetic oligonucleotide
  Target: ATXN1; (-) strand; PAM type: YTN; PAM sequence: TTC
ttatgcctttgcatcctcat

SEQ ID NO: 169156 - DNA, 20 bp, Artificial Sequence
  Description of Artificial Sequence: Synthetic oligonucleotide
  Target: ATXN1; (-) strand; PAM type: YTN; PAM sequence: CTG
tatcattcttatgcctttgc

SEQ ID NO: 169157 - DNA, 20 bp, Artificial Sequence
  Description of Artificial Sequence: Synthetic oligonucleotide
  Target: ATXN1; (-) strand; PAM type: YTN; PAM sequence: CTA
agtgcccaaagtccgctgta

SEQ ID NO: 169158 - DNA, 20 bp, Artificial Sequence
  Description of Artificial Sequence: Synthetic oligonucleotide
  Target: ATXN1; (-) strand; PAM type: YTN; PAM sequence: TTC
cccctaagtgcccaaagtcc

SEQ ID NO: 169159 - DNA, 20 bp, Artificial Sequence
  Description of Artificial Sequence: Synthetic oligonucleotide
  Target: ATXN1; (-) strand; PAM type: YTN; PAM sequence: CTT
ccccctaagtgcccaaagtc

SEQ ID NO: 169160 - DNA, 20 bp, Artificial Sequence
  Description of Artificial Sequence: Synthetic oligonucleotide
  Target: ATXN1; (-) strand; PAM type: YTN; PAM sequence: CTC
ttccccctaagtgcccaaag

SEQ ID NO: 169161 - DNA, 20 bp, Artificial Sequence
  Description of Artificial Sequence: Synthetic oligonucleotide
  Target: ATXN1; (-) strand; PAM type: YTN; PAM sequence: CTC
ccactcttccccctaagtgc

SEQ ID NO: 169162 - DNA, 20 bp, Artificial Sequence
  Description of Artificial Sequence: Synthetic oligonucleotide
  Target: ATXN1; (-) strand; PAM type: YTN; PAM sequence: CTC
cccactcccactcttccccc

SEQ ID NO: 169163 - DNA, 20 bp, Artificial Sequence
  Description of Artificial Sequence: Synthetic oligonucleotide
  Target: ATXN1; (-) strand; PAM type: YTN; PAM sequence: CTC
tccccactcccactcttccc

SEQ ID NO: 169164 - DNA, 20 bp, Artificial Sequence
  Description of Artificial Sequence: Synthetic oligonucleotide
  Target: ATXN1; (-) strand; PAM type: YTN; PAM sequence: TTA
tccctctccccactcccact

SEQ ID NO: 169165 - DNA, 20 bp, Artificial Sequence
  Description of Artificial Sequence: Synthetic oligonucleotide
  Target: ATXN1; (-) strand; PAM type: YTN; PAM sequence: TTT
atccctctccccactcccac

SEQ ID NO: 169166 - DNA, 20 bp, Artificial Sequence
  Description of Artificial Sequence: Synthetic oligonucleotide
  Target: ATXN1; (-) strand; PAM type: YTN; PAM sequence: TTT
tatccctctccccactccca

SEQ ID NO: 169167 - DNA, 20 bp, Artificial Sequence
  Description of Artificial Sequence: Synthetic oligonucleotide
  Target: ATXN1; (-) strand; PAM type: YTN; PAM sequence: CTT
ttatccctctccccactccc

SEQ ID NO: 169168 - DNA, 20 bp, Artificial Sequence
  Description of Artificial Sequence: Synthetic oligonucleotide
  Target: ATXN1; (-) strand; PAM type: YTN; PAM sequence: TTG
cagtcttttatccctctccc

SEQ ID NO: 169169 - DNA, 20 bp, Artificial Sequence
  Description of Artificial Sequence: Synthetic oligonucleotide
  Target: ATXN1; (-) strand; PAM type: YTN; PAM sequence: TTT
gcagtcttttatccctctcc

SEQ ID NO: 169170 - DNA, 20 bp, Artificial Sequence
  Description of Artificial Sequence: Synthetic oligonucleotide
  Target: ATXN1; (-) strand; PAM type: YTN; PAM sequence: CTG
caccatatttgcagtctttt

SEQ ID NO: 169171 - DNA, 20 bp, Artificial Sequence
  Description of Artificial Sequence: Synthetic oligonucleotide
  Target: ATXN1; (-) strand; PAM type: YTN; PAM sequence: CTG
agcagtatacactgcaccat

SEQ ID NO: 169172 - DNA, 20 bp, Artificial Sequence
  Description of Artificial Sequence: Synthetic oligonucleotide
  Target: ATXN1; (-) strand; PAM type: YTN; PAM sequence: TTG
gtgcacccatcacctgagca

SEQ ID NO: 169173 - DNA, 20 bp, Artificial Sequence
  Description of Artificial Sequence: Synthetic oligonucleotide
  Target: ATXN1; (-) strand; PAM type: YTN; PAM sequence: TTT
ggtgcacccatcacctgagc

SEQ ID NO: 169174 - DNA, 20 bp, Artificial Sequence
  Description of Artificial Sequence: Synthetic oligonucleotide
  Target: ATXN1; (-) strand; PAM type: YTN; PAM sequence: TTT
tggtgcacccatcacctgag

SEQ ID NO: 169175 - DNA, 20 bp, Artificial Sequence
  Description of Artificial Sequence: Synthetic oligonucleotide
  Target: ATXN1; (-) strand; PAM type: YTN; PAM sequence: TTG
tgagattttggtgcacccat

SEQ ID NO: 169176 - DNA, 20 bp, Artificial Sequence
  Description of Artificial Sequence: Synthetic oligonucleotide
  Target: ATXN1; (-) strand; PAM type: YTN; PAM sequence: TTT
gtgagattttggtgcaccca

SEQ ID NO: 169177 - DNA, 20 bp, Artificial Sequence
  Description of Artificial Sequence: Synthetic oligonucleotide
  Target: ATXN1; (-) strand; PAM type: YTN; PAM sequence: TTA
gtggcgatttgtgagatttt

SEQ ID NO: 169178 - DNA, 20 bp, Artificial Sequence
  Description of Artificial Sequence: Synthetic oligonucleotide
  Target: ATXN1; (-) strand; PAM type: YTN; PAM sequence: TTT
agtggcgatttgtgagattt

SEQ ID NO: 169179 - DNA, 20 bp, Artificial Sequence
  Description of Artificial Sequence: Synthetic oligonucleotide
  Target: ATXN1; (-) strand; PAM type: YTN; PAM sequence: CTT
tagtggcgatttgtgagatt

SEQ ID NO: 169180 - DNA, 20 bp, Artificial Sequence
  Description of Artificial Sequence: Synthetic oligonucleotide
  Target: ATXN1; (-) strand; PAM type: YTN; PAM sequence: TTC
tttagtggcgatttgtgaga

SEQ ID NO: 169181 - DNA, 20 bp, Artificial Sequence
  Description of Artificial Sequence: Synthetic oligonucleotide
  Target: ATXN1; (-) strand; PAM type: YTN; PAM sequence: TTA
cataagttctttagtggcga

SEQ ID NO: 169182 - DNA, 20 bp, Artificial Sequence
  Description of Artificial Sequence: Synthetic oligonucleotide
  Target: ATXN1; (-) strand; PAM type: YTN; PAM sequence: TTG
gttacataagttctttagtg

SEQ ID NO: 169183 - DNA, 20 bp, Artificial Sequence
  Description of Artificial Sequence: Synthetic oligonucleotide
  Target: ATXN1; (-) strand; PAM type: YTN; PAM sequence: TTT
ggttacataagttctttagt

SEQ ID NO: 169184 - DNA, 20 bp, Artificial Sequence
  Description of Artificial Sequence: Synthetic oligonucleotide
  Target: ATXN1; (-) strand; PAM type: YTN; PAM sequence: TTG
ggatacaggtggtatttggt

SEQ ID NO: 169185 - DNA, 20 bp, Artificial Sequence
  Description of Artificial Sequence: Synthetic oligonucleotide
  Target: ATXN1; (-) strand; PAM type: YTN; PAM sequence: TTA
ttgggatacaggtggtattt

SEQ ID NO: 169186 - DNA, 20 bp, Artificial Sequence
  Description of Artificial Sequence: Synthetic oligonucleotide
  Target: ATXN1; (-) strand; PAM type: YTN; PAM sequence: TTC
cgtaagttattgggatacag

SEQ ID NO: 169187 - DNA, 20 bp, Artificial Sequence
  Description of Artificial Sequence: Synthetic oligonucleotide
  Target: ATXN1; (-) strand; PAM type: YTN; PAM sequence: TTT
ccgtaagttattgggataca

SEQ ID NO: 169188 - DNA, 20 bp, Artificial Sequence
  Description of Artificial Sequence: Synthetic oligonucleotide
  Target: ATXN1; (-) strand; PAM type: YTN; PAM sequence: TTT
tccgtaagttattgggatac

SEQ ID NO: 169189 - DNA, 20 bp, Artificial Sequence
  Description of Artificial Sequence: Synthetic oligonucleotide
  Target: ATXN1; (-) strand; PAM type: YTN; PAM sequence: TTT
ttccgtaagttattgggata

SEQ ID NO: 169190 - DNA, 20 bp, Artificial Sequence
  Description of Artificial Sequence: Synthetic oligonucleotide
  Target: ATXN1; (-) strand; PAM type: YTN; PAM sequence: TTA
tttttccgtaagttattggg

SEQ ID NO: 169191 - DNA, 20 bp, Artificial Sequence
  Description of Artificial Sequence: Synthetic oligonucleotide
  Target: ATXN1; (-) strand; PAM type: YTN; PAM sequence: TTT
atttttccgtaagttattgg

SEQ ID NO: 169192 - DNA, 20 bp, Artificial Sequence
  Description of Artificial Sequence: Synthetic oligonucleotide
  Target: ATXN1; (-) strand; PAM type: YTN; PAM sequence: TTT
tatttttccgtaagttattg

SEQ ID NO: 169193 - DNA, 20 bp, Artificial Sequence
  Description of Artificial Sequence: Synthetic oligonucleotide
  Target: ATXN1; (-) strand; PAM type: YTN; PAM sequence: TTA
ttttatttttccgtaagtta

SEQ ID NO: 169194 - DNA, 20 bp, Artificial Sequence
  Description of Artificial Sequence: Synthetic oligonucleotide
  Target: ATXN1; (-) strand; PAM type: YTN; PAM sequence: TTT
attttatttttccgtaagtt

SEQ ID NO: 169195 - DNA, 20 bp, Artificial Sequence
  Description of Artificial Sequence: Synthetic oligonucleotide
  Target: ATXN1; (-) strand; PAM type: YTN; PAM sequence: TTT
tattttatttttccgtaagt

SEQ ID NO: 169196 - DNA, 20 bp, Artificial Sequence
  Description of Artificial Sequence: Synthetic oligonucleotide
  Target: ATXN1; (-) strand; PAM type: YTN; PAM sequence: TTT
ttattttatttttccgtaag

SEQ ID NO: 169197 - DNA, 20 bp, Artificial Sequence
  Description of Artificial Sequence: Synthetic oligonucleotide
  Target: ATXN1; (-) strand; PAM type: YTN; PAM sequence: TTA
aaatttttattttatttttc

SEQ ID NO: 169198 - DNA, 20 bp, Artificial Sequence
  Description of Artificial Sequence: Synthetic oligonucleotide
  Target: ATXN1; (-) strand; PAM type: YTN; PAM sequence: CTT
aaaatttttattttattttt

SEQ ID NO: 169199 - DNA, 20 bp, Artificial Sequence
  Description of Artificial Sequence: Synthetic oligonucleotide
  Target: ATXN1; (-) strand; PAM type: YTN; PAM sequence: TTC
ttaaaatttttattttattt

SEQ ID NO: 169200 - DNA, 20 bp, Artificial Sequence
  Description of Artificial Sequence: Synthetic oligonucleotide
  Target: ATXN1; (-) strand; PAM type: YTN; PAM sequence: CTT
cttaaaatttttattttatt

SEQ ID NO: 169201 - DNA, 20 bp, Artificial Sequence
  Description of Artificial Sequence: Synthetic oligonucleotide
  Target: ATXN1; (-) strand; PAM type: YTN; PAM sequence: TTC
aaaataagtggcataataat

SEQ ID NO: 169202 - DNA, 20 bp, Artificial Sequence
  Description of Artificial Sequence: Synthetic oligonucleotide
  Target: ATXN1; (-) strand; PAM type: YTN; PAM sequence: TTA
ttcaaaataagtggcataat

SEQ ID NO: 169203 - DNA, 20 bp, Artificial Sequence
  Description of Artificial Sequence: Synthetic oligonucleotide
  Target: ATXN1; (-) strand; PAM type: YTN; PAM sequence: CTT
attcaaaataagtggcataa

SEQ ID NO: 169204 - DNA, 20 bp, Artificial Sequence
  Description of Artificial Sequence: Synthetic oligonucleotide
  Target: ATXN1; (-) strand; PAM type: YTN; PAM sequence: TTG
catcacaagggtaaaacgtg

SEQ ID NO: 169205 - DNA, 20 bp, Artificial Sequence
  Description of Artificial Sequence: Synthetic oligonucleotide
  Target: ATXN1; (-) strand; PAM type: YTN; PAM sequence: TTG
cgttgcatcacaagggtaaa

SEQ ID NO: 169206 - DNA, 20 bp, Artificial Sequence
  Description of Artificial Sequence: Synthetic oligonucleotide
  Target: ATXN1; (-) strand; PAM type: YTN; PAM sequence: TTC
agttgcgttgcatcacaagg

SEQ ID NO: 169207 - DNA, 20 bp, Artificial Sequence
  Description of Artificial Sequence: Synthetic oligonucleotide
  Target: ATXN1; (-) strand; PAM type: YTN; PAM sequence: CTT
cagttgcgttgcatcacaag

SEQ ID NO: 169208 - DNA, 20 bp, Artificial Sequence
  Description of Artificial Sequence: Synthetic oligonucleotide
  Target: ATXN1; (-) strand; PAM type: YTN; PAM sequence: TTC
ttcagttgcgttgcatcaca

SEQ ID NO: 169209 - DNA, 20 bp, Artificial Sequence
  Description of Artificial Sequence: Synthetic oligonucleotide
  Target: ATXN1; (-) strand; PAM type: YTN; PAM sequence: TTG
atagtaggtcattcttcagt

SEQ ID NO: 169210 - DNA, 20 bp, Artificial Sequence
  Description of Artificial Sequence: Synthetic oligonucleotide
  Target: ATXN1; (-) strand; PAM type: YTN; PAM sequence: CTA
gagtgtcatggaggacacaa

SEQ ID NO: 169211 - DNA, 20 bp, Artificial Sequence
  Description of Artificial Sequence: Synthetic oligonucleotide
  Target: ATXN1; (-) strand; PAM type: YTN; PAM sequence: TTC
tagagtgtcatggaggacac

SEQ ID NO: 169212 - DNA, 20 bp, Artificial Sequence
  Description of Artificial Sequence: Synthetic oligonucleotide
  Target: ATXN1; (-) strand; PAM type: YTN; PAM sequence: CTG
ttctagagtgtcatggagga

SEQ ID NO: 169213 - DNA, 20 bp, Artificial Sequence
  Description of Artificial Sequence: Synthetic oligonucleotide
  Target: ATXN1; (-) strand; PAM type: YTN; PAM sequence: TTG
catagcactgttctagagtg

SEQ ID NO: 169214 - DNA, 20 bp, Artificial Sequence
  Description of Artificial Sequence: Synthetic oligonucleotide
  Target: ATXN1; (-) strand; PAM type: YTN; PAM sequence: CTT
gcatagcactgttctagagt

SEQ ID NO: 169215 - DNA, 20 bp, Artificial Sequence
  Description of Artificial Sequence: Synthetic oligonucleotide
  Target: ATXN1; (-) strand; PAM type: YTN; PAM sequence: CTG
cttgcatagcactgttctag

SEQ ID NO: 169216 - DNA, 20 bp, Artificial Sequence
  Description of Artificial Sequence: Synthetic oligonucleotide
  Target: ATXN1; (-) strand; PAM type: YTN; PAM sequence: TTC
tgcttgcatagcactgttct

SEQ ID NO: 169217 - DNA, 20 bp, Artificial Sequence
  Description of Artificial Sequence: Synthetic oligonucleotide
  Target: ATXN1; (-) strand; PAM type: YTN; PAM sequence: TTT
ctgcttgcatagcactgttc

SEQ ID NO: 169218 - DNA, 20 bp, Artificial Sequence
  Description of Artificial Sequence: Synthetic oligonucleotide
  Target: ATXN1; (-) strand; PAM type: YTN; PAM sequence: CTT
tctgcttgcatagcactgtt

SEQ ID NO: 169219 - DNA, 20 bp, Artificial Sequence
  Description of Artificial Sequence: Synthetic oligonucleotide
  Target: ATXN1; (-) strand; PAM type: YTN; PAM sequence: TTA
ctttctgcttgcatagcact

SEQ ID NO: 169220 - DNA, 20 bp, Artificial Sequence
  Description of Artificial Sequence: Synthetic oligonucleotide
  Target: ATXN1; (-) strand; PAM type: YTN; PAM sequence: CTG
ttactttctgcttgcatagc

SEQ ID NO: 169221 - DNA, 20 bp, Artificial Sequence
  Description of Artificial Sequence: Synthetic oligonucleotide
  Target: ATXN1; (-) strand; PAM type: YTN; PAM sequence: TTG
aatgaatgaatgaataagct

SEQ ID NO: 169222 - DNA, 20 bp, Artificial Sequence
  Description of Artificial Sequence: Synthetic oligonucleotide
  Target: ATXN1; (-) strand; PAM type: YTN; PAM sequence: TTA
ttgaatgaatgaatgaataa

SEQ ID NO: 169223 - DNA, 20 bp, Artificial Sequence
  Description of Artificial Sequence: Synthetic oligonucleotide
  Target: ATXN1; (-) strand; PAM type: YTN; PAM sequence: TTC
agtgtatggttattgaatga

SEQ ID NO: 169224 - DNA, 20 bp, Artificial Sequence
  Description of Artificial Sequence: Synthetic oligonucleotide
  Target: ATXN1; (-) strand; PAM type: YTN; PAM sequence: CTG
gatgttcagtgtatggttat

SEQ ID NO: 169225 - DNA, 20 bp, Artificial Sequence
  Description of Artificial Sequence: Synthetic oligonucleotide
  Target: ATXN1; (-) strand; PAM type: YTN; PAM sequence: TTC
ctggatgttcagtgtatggt

SEQ ID NO: 169226 - DNA, 20 bp, Artificial Sequence
  Description of Artificial Sequence: Synthetic oligonucleotide
  Target: ATXN1; (-) strand; PAM type: YTN; PAM sequence: CTT
cctggatgttcagtgtatgg

SEQ ID NO: 169227 - DNA, 20 bp, Artificial Sequence
  Description of Artificial Sequence: Synthetic oligonucleotide
  Target: ATXN1; (-) strand; PAM type: YTN; PAM sequence: TTA
gcacttcctggatgttcagt

SEQ ID NO: 169228 - DNA, 20 bp, Artificial Sequence
  Description of Artificial Sequence: Synthetic oligonucleotide
  Target: ATXN1; (-) strand; PAM type: YTN; PAM sequence: CTG
gttagcacttcctggatgtt

SEQ ID NO: 169229 - DNA, 20 bp, Artificial Sequence
  Description of Artificial Sequence: Synthetic oligonucleotide
  Target: ATXN1; (-) strand; PAM type: YTN; PAM sequence: CTA
gtgcagtacctggttagcac

SEQ ID NO: 169230 - DNA, 20 bp, Artificial Sequence
  Description of Artificial Sequence: Synthetic oligonucleotide
  Target: ATXN1; (-) strand; PAM type: YTN; PAM sequence: CTA
atacctagtgcagtacctgg

SEQ ID NO: 169231 - DNA, 20 bp, Artificial Sequence
  Description of Artificial Sequence: Synthetic oligonucleotide
  Target: ATXN1; (-) strand; PAM type: YTN; PAM sequence: TTC
cctaatacctagtgcagtac

SEQ ID NO: 169232 - DNA, 20 bp, Artificial Sequence
  Description of Artificial Sequence: Synthetic oligonucleotide
  Target: ATXN1; (-) strand; PAM type: YTN; PAM sequence: TTT
ccctaatacctagtgcagta

SEQ ID NO: 169233 - DNA, 20 bp, Artificial Sequence
  Description of Artificial Sequence: Synthetic oligonucleotide
  Target: ATXN1; (-) strand; PAM type: YTN; PAM sequence: CTG
tttccctaatacctagtgca

SEQ ID NO: 169234 - DNA, 20 bp, Artificial Sequence
  Description of Artificial Sequence: Synthetic oligonucleotide
  Target: ATXN1; (-) strand; PAM type: YTN; PAM sequence: CTC
tgtttccctaatacctagtg

SEQ ID NO: 169235 - DNA, 20 bp, Artificial Sequence
  Description of Artificial Sequence: Synthetic oligonucleotide
  Target: ATXN1; (-) strand; PAM type: YTN; PAM sequence: CTC
atctctgtttccctaatacc

SEQ ID NO: 169236 - DNA, 20 bp, Artificial Sequence
  Description of Artificial Sequence: Synthetic oligonucleotide
  Target: ATXN1; (-) strand; PAM type: YTN; PAM sequence: TTA
ctcatctctgtttccctaat

SEQ ID NO: 169237 - DNA, 20 bp, Artificial Sequence
  Description of Artificial Sequence: Synthetic oligonucleotide
  Target: ATXN1; (-) strand; PAM type: YTN; PAM sequence: TTT
actcatctctgtttccctaa

SEQ ID NO: 169238 - DNA, 20 bp, Artificial Sequence
  Description of Artificial Sequence: Synthetic oligonucleotide
  Target: ATXN1; (-) strand; PAM type: YTN; PAM sequence: TTT
tactcatctctgtttcccta

SEQ ID NO: 169239 - DNA, 20 bp, Artificial Sequence
  Description of Artificial Sequence: Synthetic oligonucleotide
  Target: ATXN1; (-) strand; PAM type: YTN; PAM sequence: CTG
aattttactcatctctgttt

SEQ ID NO: 169240 - DNA, 20 bp, Artificial Sequence
  Description of Artificial Sequence: Synthetic oligonucleotide
  Target: ATXN1; (-) strand; PAM type: YTN; PAM sequence: CTC
aactgaattttactcatctc

SEQ ID NO: 169241 - DNA, 20 bp, Artificial Sequence
  Description of Artificial Sequence: Synthetic oligonucleotide
  Target: ATXN1; (-) strand; PAM type: YTN; PAM sequence: TTC
ccaacaagacatggagtctc

SEQ ID NO: 169242 - DNA, 20 bp, Artificial Sequence
  Description of Artificial Sequence: Synthetic oligonucleotide
  Target: ATXN1; (-) strand; PAM type: YTN; PAM sequence: CTG
gttcccaacaagacatggag

SEQ ID NO: 169243 - DNA, 20 bp, Artificial Sequence
  Description of Artificial Sequence: Synthetic oligonucleotide
  Target: ATXN1; (-) strand; PAM type: YTN; PAM sequence: CTA
cacgtgcctggttcccaaca

SEQ ID NO: 169244 - DNA, 20 bp, Artificial Sequence
  Description of Artificial Sequence: Synthetic oligonucleotide
  Target: ATXN1; (-) strand; PAM type: YTN; PAM sequence: CTC
tacacgtgcctggttcccaa

SEQ ID NO: 169245 - DNA, 20 bp, Artificial Sequence
  Description of Artificial Sequence: Synthetic oligonucleotide
  Target: ATXN1; (-) strand; PAM type: YTN; PAM sequence: CTG
cgtaagagtgacctctacac

SEQ ID NO: 169246 - DNA, 20 bp, Artificial Sequence
  Description of Artificial Sequence: Synthetic oligonucleotide
  Target: ATXN1; (-) strand; PAM type: YTN; PAM sequence: TTA
cctgcgtaagagtgacctct

SEQ ID NO: 169247 - DNA, 20 bp, Artificial Sequence
  Description of Artificial Sequence: Synthetic oligonucleotide
  Target: ATXN1; (-) strand; PAM type: YTN; PAM sequence: TTA
ttacctgcgtaagagtgacc

SEQ ID NO: 169248 - DNA, 20 bp, Artificial Sequence
  Description of Artificial Sequence: Synthetic oligonucleotide
  Target: ATXN1; (-) strand; PAM type: YTN; PAM sequence: TTT
attacctgcgtaagagtgac

SEQ ID NO: 169249 - DNA, 20 bp, Artificial Sequence
  Description of Artificial Sequence: Synthetic oligonucleotide
  Target: ATXN1; (-) strand; PAM type: YTN; PAM sequence: CTG
tagagtcatttattacctgc

SEQ ID NO: 169250 - DNA, 20 bp, Artificial Sequence
  Description of Artificial Sequence: Synthetic oligonucleotide
  Target: ATXN1; (-) strand; PAM type: YTN; PAM sequence: CTC
tgtagagtcatttattacct

SEQ ID NO: 169251 - DNA, 20 bp, Artificial Sequence
  Description of Artificial Sequence: Synthetic oligonucleotide
  Target: ATXN1; (-) strand; PAM type: YTN; PAM sequence: CTG
atgcctctgtagagtcattt

SEQ ID NO: 169252 - DNA, 20 bp, Artificial Sequence
  Description of Artificial Sequence: Synthetic oligonucleotide
  Target: ATXN1; (-) strand; PAM type: YTN; PAM sequence: TTG
ctgatgcctctgtagagtca

SEQ ID NO: 169253 - DNA, 20 bp, Artificial Sequence
  Description of Artificial Sequence: Synthetic oligonucleotide
  Target: ATXN1; (-) strand; PAM type: YTN; PAM sequence: CTT
gctgatgcctctgtagagtc

SEQ ID NO: 169254 - DNA, 20 bp, Artificial Sequence
  Description of Artificial Sequence: Synthetic oligonucleotide
  Target: ATXN1; (-) strand; PAM type: YTN; PAM sequence: TTC
cagcgtcttgctgatgcctc

SEQ ID NO: 169255 - DNA, 20 bp, Artificial Sequence
  Description of Artificial Sequence: Synthetic oligonucleotide
  Target: ATXN1; (-) strand; PAM type: YTN; PAM sequence: CTT
ccagcgtcttgctgatgcct

SEQ ID NO: 169256 - DNA, 20 bp, Artificial Sequence
  Description of Artificial Sequence: Synthetic oligonucleotide
  Target: ATXN1; (-) strand; PAM type: YTN; PAM sequence: CTC
cttccagcgtcttgctgatg

SEQ ID NO: 169257 - DNA, 20 bp, Artificial Sequence
  Description of Artificial Sequence: Synthetic oligonucleotide
  Target: ATXN1; (-) strand; PAM type: YTN; PAM sequence: TTC
tccttccagcgtcttgctga

SEQ ID NO: 169258 - DNA, 20 bp, Artificial Sequence
  Description of Artificial Sequence: Synthetic oligonucleotide
  Target: ATXN1; (-) strand; PAM type: YTN; PAM sequence: TTT
ctccttccagcgtcttgctg

SEQ ID NO: 169259 - DNA, 20 bp, Artificial Sequence
  Description of Artificial Sequence: Synthetic oligonucleotide
  Target: ATXN1; (-) strand; PAM type: YTN; PAM sequence: TTA
tttctccttccagcgtcttg

SEQ ID NO: 169260 - DNA, 20 bp, Artificial Sequence
  Description of Artificial Sequence: Synthetic oligonucleotide
  Target: ATXN1; (-) strand; PAM type: YTN; PAM sequence: CTT
atttctccttccagcgtctt

SEQ ID NO: 169261 - DNA, 20 bp, Artificial Sequence
  Description of Artificial Sequence: Synthetic oligonucleotide
  Target: ATXN1; (-) strand; PAM type: YTN; PAM sequence: CTG
acttatttctccttccagcg

SEQ ID NO: 169262 - DNA, 20 bp, Artificial Sequence
  Description of Artificial Sequence: Synthetic oligonucleotide
  Target: ATXN1; (-) strand; PAM type: YTN; PAM sequence: CTG
ctgacttatttctccttcca

SEQ ID NO: 169263 - DNA, 20 bp, Artificial Sequence
  Description of Artificial Sequence: Synthetic oligonucleotide
  Target: ATXN1; (-) strand; PAM type: YTN; PAM sequence: TTG
ctgctgacttatttctcctt

SEQ ID NO: 169264 - DNA, 20 bp, Artificial Sequence
  Description of Artificial Sequence: Synthetic oligonucleotide
  Target: ATXN1; (-) strand; PAM type: YTN; PAM sequence: TTG
cagagtgagttgctgctgac

SEQ ID NO: 169265 - DNA, 20 bp, Artificial Sequence
  Description of Artificial Sequence: Synthetic oligonucleotide
  Target: ATXN1; (-) strand; PAM type: YTN; PAM sequence: TTT
gcagagtgagttgctgctga

SEQ ID NO: 169266 - DNA, 20 bp, Artificial Sequence
  Description of Artificial Sequence: Synthetic oligonucleotide
  Target: ATXN1; (-) strand; PAM type: YTN; PAM sequence: CTT
tgcagagtgagttgctgctg

SEQ ID NO: 169267 - DNA, 20 bp, Artificial Sequence
  Description of Artificial Sequence: Synthetic oligonucleotide
  Target: ATXN1; (-) strand; PAM type: YTN; PAM sequence: TTC
tttgcagagtgagttgctgc

SEQ ID NO: 169268 - DNA, 20 bp, Artificial Sequence
  Description of Artificial Sequence: Synthetic oligonucleotide
  Target: ATXN1; (-) strand; PAM type: YTN; PAM sequence: CTT
ctttgcagagtgagttgctg

SEQ ID NO: 169269 - DNA, 20 bp, Artificial Sequence
  Description of Artificial Sequence: Synthetic oligonucleotide
  Target: ATXN1; (-) strand; PAM type: YTN; PAM sequence: CTG
tacacttctttgcagagtga

SEQ ID NO: 169270 - DNA, 20 bp, Artificial Sequence
  Description of Artificial Sequence: Synthetic oligonucleotide
  Target: ATXN1; (-) strand; PAM type: YTN; PAM sequence: TTC
ctgtacacttctttgcagag

SEQ ID NO: 169271 - DNA, 20 bp, Artificial Sequence
  Description of Artificial Sequence: Synthetic oligonucleotide
  Target: ATXN1; (-) strand; PAM type: YTN; PAM sequence: CTT
cctgtacacttctttgcaga

SEQ ID NO: 169272 - DNA, 20 bp, Artificial Sequence
  Description of Artificial Sequence: Synthetic oligonucleotide
  Target: ATXN1; (-) strand; PAM type: YTN; PAM sequence: CTA
gagcttcctgtacacttctt

SEQ ID NO: 169273 - DNA, 20 bp, Artificial Sequence
  Description of Artificial Sequence: Synthetic oligonucleotide
  Target: ATXN1; (-) strand; PAM type: YTN; PAM sequence: TTC
aaaaatgacccatctagagc

SEQ ID NO: 169274 - DNA, 20 bp, Artificial Sequence
  Description of Artificial Sequence: Synthetic oligonucleotide
  Target: ATXN1; (-) strand; PAM type: YTN; PAM sequence: TTG
aggatatgttcaaaaatgac

SEQ ID NO: 169275 - DNA, 20 bp, Artificial Sequence
  Description of Artificial Sequence: Synthetic oligonucleotide
  Target: ATXN1; (-) strand; PAM type: YTN; PAM sequence: CTT
gaggatatgttcaaaaatga

SEQ ID NO: 169276 - DNA, 20 bp, Artificial Sequence
  Description of Artificial Sequence: Synthetic oligonucleotide
  Target: ATXN1; (-) strand; PAM type: YTN; PAM sequence: CTC
atcttgaggatatgttcaaa

SEQ ID NO: 169277 - DNA, 20 bp, Artificial Sequence
  Description of Artificial Sequence: Synthetic oligonucleotide
  Target: ATXN1; (-) strand; PAM type: YTN; PAM sequence: TTC
aaaactcatcttgaggatat

SEQ ID NO: 169278 - DNA, 20 bp, Artificial Sequence
  Description of Artificial Sequence: Synthetic oligonucleotide
  Target: ATXN1; (-) strand; PAM type: YTN; PAM sequence: TTT
caaaactcatcttgaggata

SEQ ID NO: 169279 - DNA, 20 bp, Artificial Sequence
  Description of Artificial Sequence: Synthetic oligonucleotide
  Target: ATXN1; (-) strand; PAM type: YTN; PAM sequence: CTT
tcaaaactcatcttgaggat

SEQ ID NO: 169280 - DNA, 20 bp, Artificial Sequence
  Description of Artificial Sequence: Synthetic oligonucleotide
  Target: ATXN1; (-) strand; PAM type: YTN; PAM sequence: TTA
tcctttcaaaactcatcttg

SEQ ID NO: 169281 - DNA, 20 bp, Artificial Sequence
  Description of Artificial Sequence: Synthetic oligonucleotide
  Target: ATXN1; (-) strand; PAM type: YTN; PAM sequence: TTT
atcctttcaaaactcatctt

SEQ ID NO: 169282 - DNA, 20 bp, Artificial Sequence
  Description of Artificial Sequence: Synthetic oligonucleotide
  Target: ATXN1; (-) strand; PAM type: YTN; PAM sequence: TTG
agtttatcctttcaaaactc

SEQ ID NO: 169283 - DNA, 20 bp, Artificial Sequence
  Description of Artificial Sequence: Synthetic oligonucleotide
  Target: ATXN1; (-) strand; PAM type: YTN; PAM sequence: TTA
ttgagtttatcctttcaaaa

SEQ ID NO: 169284 - DNA, 20 bp, Artificial Sequence
  Description of Artificial Sequence: Synthetic oligonucleotide
  Target: ATXN1; (-) strand; PAM type: YTN; PAM sequence: CTT
attgagtttatcctttcaaa

SEQ ID NO: 169285 - DNA, 20 bp, Artificial Sequence
  Description of Artificial Sequence: Synthetic oligonucleotide
  Target: ATXN1; (-) strand; PAM type: YTN; PAM sequence: TTA
agccacttattgagtttatc

SEQ ID NO: 169286 - DNA, 20 bp, Artificial Sequence
  Description of Artificial Sequence: Synthetic oligonucleotide
  Target: ATXN1; (-) strand; PAM type: YTN; PAM sequence: TTT
aagccacttattgagtttat

SEQ ID NO: 169287 - DNA, 20 bp, Artificial Sequence
  Description of Artificial Sequence: Synthetic oligonucleotide
  Target: ATXN1; (-) strand; PAM type: YTN; PAM sequence: TTT
taagccacttattgagttta

SEQ ID NO: 169288 - DNA, 20 bp, Artificial Sequence
  Description of Artificial Sequence: Synthetic oligonucleotide
  Target: ATXN1; (-) strand; PAM type: YTN; PAM sequence: TTT
ttaagccacttattgagttt

SEQ ID NO: 169289 - DNA, 20 bp, Artificial Sequence
  Description of Artificial Sequence: Synthetic oligonucleotide
  Target: ATXN1; (-) strand; PAM type: YTN; PAM sequence: CTT
tttaagccacttattgagtt

SEQ ID NO: 169290 - DNA, 20 bp, Artificial Sequence
  Description of Artificial Sequence: Synthetic oligonucleotide
  Target: ATXN1; (-) strand; PAM type: YTN; PAM sequence: TTA
ctttttaagccacttattga

SEQ ID NO: 169291 - DNA, 20 bp, Artificial Sequence
  Description of Artificial Sequence: Synthetic oligonucleotide
  Target: ATXN1; (-) strand; PAM type: YTN; PAM sequence: CTT
actttttaagccacttattg

SEQ ID NO: 169292 - DNA, 20 bp, Artificial Sequence
  Description of Artificial Sequence: Synthetic oligonucleotide
  Target: ATXN1; (-) strand; PAM type: YTN; PAM sequence: TTC
ttactttttaagccacttat

SEQ ID NO: 169293 - DNA, 20 bp, Artificial Sequence
  Description of Artificial Sequence: Synthetic oligonucleotide
  Target: ATXN1; (-) strand; PAM type: YTN; PAM sequence: TTT
cttactttttaagccactta

SEQ ID NO: 169294 - DNA, 20 bp, Artificial Sequence
  Description of Artificial Sequence: Synthetic oligonucleotide
  Target: ATXN1; (-) strand; PAM type: YTN; PAM sequence: TTT
tcttactttttaagccactt

SEQ ID NO: 169295 - DNA, 20 bp, Artificial Sequence
  Description of Artificial Sequence: Synthetic oligonucleotide
  Target: ATXN1; (-) strand; PAM type: YTN; PAM sequence: CTT
ttcttactttttaagccact

SEQ ID NO: 169296 - DNA, 20 bp, Artificial Sequence
  Description of Artificial Sequence: Synthetic oligonucleotide
  Target: ATXN1; (-) strand; PAM type: YTN; PAM sequence: CTC
ttttcttactttttaagcca

SEQ ID NO: 169297 - DNA, 20 bp, Artificial Sequence
  Description of Artificial Sequence: Synthetic oligonucleotide
  Target: ATXN1; (-) strand; PAM type: YTN; PAM sequence: TTC
ctcttttcttactttttaag

SEQ ID NO: 169298 - DNA, 20 bp, Artificial Sequence
  Description of Artificial Sequence: Synthetic oligonucleotide
  Target: ATXN1; (-) strand; PAM type: YTN; PAM sequence: CTT
cctcttttcttactttttaa

SEQ ID NO: 169299 - DNA, 20 bp, Artificial Sequence
  Description of Artificial Sequence: Synthetic oligonucleotide
  Target: ATXN1; (-) strand; PAM type: YTN; PAM sequence: TTC
cttcctcttttcttactttt

SEQ ID NO: 169300 - DNA, 20 bp, Artificial Sequence
  Description of Artificial Sequence: Synthetic oligonucleotide
  Target: ATXN1; (-) strand; PAM type: YTN; PAM sequence: TTT
ccttcctcttttcttacttt

SEQ ID NO: 169301 - DNA, 20 bp, Artificial Sequence
  Description of Artificial Sequence: Synthetic oligonucleotide
  Target: ATXN1; (-) strand; PAM type: YTN; PAM sequence: CTT
tccttcctcttttcttactt

SEQ ID NO: 169302 - DNA, 20 bp, Artificial Sequence
  Description of Artificial Sequence: Synthetic oligonucleotide
  Target: ATXN1; (-) strand; PAM type: YTN; PAM sequence: TTC
ctttccttcctcttttctta

SEQ ID NO: 169303 - DNA, 20 bp, Artificial Sequence
  Description of Artificial Sequence: Synthetic oligonucleotide
  Target: ATXN1; (-) strand; PAM type: YTN; PAM sequence: TTT
cctttccttcctcttttctt

SEQ ID NO: 169304 - DNA, 20 bp, Artificial Sequence
  Description of Artificial Sequence: Synthetic oligonucleotide
  Target: ATXN1; (-) strand; PAM type: YTN; PAM sequence: TTT
tcctttccttcctcttttct

SEQ ID NO: 169305 - DNA, 20 bp, Artificial Sequence
  Description of Artificial Sequence: Synthetic oligonucleotide
  Target: ATXN1; (-) strand; PAM type: YTN; PAM sequence: TTG
ttttcctttccttcctcttt

SEQ ID NO: 169306 - DNA, 20 bp, Artificial Sequence
  Description of Artificial Sequence: Synthetic oligonucleotide
  Target: ATXN1; (-) strand; PAM type: YTN; PAM sequence: CTT
gttttcctttccttcctctt

SEQ ID NO: 169307 - DNA, 20 bp, Artificial Sequence
  Description of Artificial Sequence: Synthetic oligonucleotide
  Target: ATXN1; (-) strand; PAM type: YTN; PAM sequence: TTC
ttgttttcctttccttcctc

SEQ ID NO: 169308 - DNA, 20 bp, Artificial Sequence
  Description of Artificial Sequence: Synthetic oligonucleotide
  Target: ATXN1; (-) strand; PAM type: YTN; PAM sequence: TTT
cttgttttcctttccttcct

SEQ ID NO: 169309 - DNA, 20 bp, Artificial Sequence
  Description of Artificial Sequence: Synthetic oligonucleotide
  Target: ATXN1; (-) strand; PAM type: YTN; PAM sequence: CTT
tcttgttttcctttccttcc

SEQ ID NO: 169310 - DNA, 20 bp, Artificial Sequence
  Description of Artificial Sequence: Synthetic oligonucleotide
  Target: ATXN1; (-) strand; PAM type: YTN; PAM sequence: TTC
tttcttgttttcctttcctt

SEQ ID NO: 169311 - DNA, 20 bp, Artificial Sequence
  Description of Artificial Sequence: Synthetic oligonucleotide
  Target: ATXN1; (-) strand; PAM type: YTN; PAM sequence: CTT
ctttcttgttttcctttcct

SEQ ID NO: 169312 - DNA, 20 bp, Artificial Sequence
  Description of Artificial Sequence: Synthetic oligonucleotide
  Target: ATXN1; (-) strand; PAM type: YTN; PAM sequence: TTC
cttctttcttgttttccttt

SEQ ID NO: 169313 - DNA, 20 bp, Artificial Sequence
  Description of Artificial Sequence: Synthetic oligonucleotide
  Target: ATXN1; (-) strand; PAM type: YTN; PAM sequence: TTG
ttccttctttcttgttttcc

SEQ ID NO: 169314 - DNA, 20 bp, Artificial Sequence
  Description of Artificial Sequence: Synthetic oligonucleotide
  Target: ATXN1; (-) strand; PAM type: YTN; PAM sequence: TTT
gttccttctttcttgttttc

SEQ ID NO: 169315 - DNA, 20 bp, Artificial Sequence
  Description of Artificial Sequence: Synthetic oligonucleotide
  Target: ATXN1; (-) strand; PAM type: YTN; PAM sequence: TTT
tgttccttctttcttgtttt

SEQ ID NO: 169316 - DNA, 20 bp, Artificial Sequence
  Description of Artificial Sequence: Synthetic oligonucleotide
  Target: ATXN1; (-) strand; PAM type: YTN; PAM sequence: CTA
ttttgttccttctttcttgt

SEQ ID NO: 169317 - DNA, 20 bp, Artificial Sequence
  Description of Artificial Sequence: Synthetic oligonucleotide
  Target: ATXN1; (-) strand; PAM type: YTN; PAM sequence: TTC
ctattttgttccttctttct

SEQ ID NO: 169318 - DNA, 20 bp, Artificial Sequence
  Description of Artificial Sequence: Synthetic oligonucleotide
  Target: ATXN1; (-) strand; PAM type: YTN; PAM sequence: TTT
cctattttgttccttctttc

SEQ ID NO: 169319 - DNA, 20 bp, Artificial Sequence
  Description of Artificial Sequence: Synthetic oligonucleotide
  Target: ATXN1; (-) strand; PAM type: YTN; PAM sequence: CTA
agtttcctattttgttcctt

SEQ ID NO: 169320 - DNA, 20 bp, Artificial Sequence
  Description of Artificial Sequence: Synthetic oligonucleotide
  Target: ATXN1; (-) strand; PAM type: YTN; PAM sequence: CTG
ggtggatgtgtacagtccat

SEQ ID NO: 169321 - DNA, 20 bp, Artificial Sequence
  Description of Artificial Sequence: Synthetic oligonucleotide
  Target: ATXN1; (-) strand; PAM type: YTN; PAM sequence: CTG
ctgggtggatgtgtacagtc

SEQ ID NO: 169322 - DNA, 20 bp, Artificial Sequence
  Description of Artificial Sequence: Synthetic oligonucleotide
  Target: ATXN1; (-) strand; PAM type: YTN; PAM sequence: CTA
tagcctgctgggtggatgtg

SEQ ID NO: 169323 - DNA, 20 bp, Artificial Sequence
  Description of Artificial Sequence: Synthetic oligonucleotide
  Target: ATXN1; (-) strand; PAM type: YTN; PAM sequence: TTC
tatagcctgctgggtggatg

SEQ ID NO: 169324 - DNA, 20 bp, Artificial Sequence
  Description of Artificial Sequence: Synthetic oligonucleotide
  Target: ATXN1; (-) strand; PAM type: YTN; PAM sequence: TTG
ggagagaaacattctatagc

SEQ ID NO: 169325 - DNA, 20 bp, Artificial Sequence
  Description of Artificial Sequence: Synthetic oligonucleotide
  Target: ATXN1; (-) strand; PAM type: YTN; PAM sequence: CTT
gggagagaaacattctatag

SEQ ID NO: 169326 - DNA, 20 bp, Artificial Sequence
  Description of Artificial Sequence: Synthetic oligonucleotide
  Target: ATXN1; (-) strand; PAM type: YTN; PAM sequence: TTG
cccttgggagagaaacattc

SEQ ID NO: 169327 - DNA, 20 bp, Artificial Sequence
  Description of Artificial Sequence: Synthetic oligonucleotide
  Target: ATXN1; (-) strand; PAM type: YTN; PAM sequence: TTC
attgcccttgggagagaaac

SEQ ID NO: 169328 - DNA, 20 bp, Artificial Sequence
  Description of Artificial Sequence: Synthetic oligonucleotide
  Target: ATXN1; (-) strand; PAM type: YTN; PAM sequence: CTA
aaccaattcattgcccttgg

SEQ ID NO: 169329 - DNA, 20 bp, Artificial Sequence
  Description of Artificial Sequence: Synthetic oligonucleotide
  Target: ATXN1; (-) strand; PAM type: YTN; PAM sequence: CTG
tggctaaaccaattcattgc

SEQ ID NO: 169330 - DNA, 20 bp, Artificial Sequence
  Description of Artificial Sequence: Synthetic oligonucleotide
  Target: ATXN1; (-) strand; PAM type: YTN; PAM sequence: TTG
aagaaaatcctgtggctaaa

SEQ ID NO: 169331 - DNA, 20 bp, Artificial Sequence
  Description of Artificial Sequence: Synthetic oligonucleotide
  Target: ATXN1; (-) strand; PAM type: YTN; PAM sequence: TTT
gaagaaaatcctgtggctaa

SEQ ID NO: 169332 - DNA, 20 bp, Artificial Sequence
  Description of Artificial Sequence: Synthetic oligonucleotide
  Target: ATXN1; (-) strand; PAM type: YTN; PAM sequence: CTT
tgaagaaaatcctgtggcta

SEQ ID NO: 169333 - DNA, 20 bp, Artificial Sequence
  Description of Artificial Sequence: Synthetic oligonucleotide
  Target: ATXN1; (-) strand; PAM type: YTN; PAM sequence: CTC
ctttgaagaaaatcctgtgg

SEQ ID NO: 169334 - DNA, 20 bp, Artificial Sequence
  Description of Artificial Sequence: Synthetic oligonucleotide
  Target: ATXN1; (-) strand; PAM type: YTN; PAM sequence: TTG
aggacctcctttgaagaaaa

SEQ ID NO: 169335 - DNA, 20 bp, Artificial Sequence
  Description of Artificial Sequence: Synthetic oligonucleotide
  Target: ATXN1; (-) strand; PAM type: YTN; PAM sequence: CTG
gcatgttgaggacctccttt

SEQ ID NO: 169336 - DNA, 20 bp, Artificial Sequence
  Description of Artificial Sequence: Synthetic oligonucleotide
  Target: ATXN1; (-) strand; PAM type: YTN; PAM sequence: CTG
accaaaatcagggaagtacc

SEQ ID NO: 169337 - DNA, 20 bp, Artificial Sequence
  Description of Artificial Sequence: Synthetic oligonucleotide
  Target: ATXN1; (-) strand; PAM type: YTN; PAM sequence: TTG
catcctgaccaaaatcaggg

SEQ ID NO: 169338 - DNA, 20 bp, Artificial Sequence
  Description of Artificial Sequence: Synthetic oligonucleotide
  Target: ATXN1; (-) strand; PAM type: YTN; PAM sequence: CTG
gattgcatcctgaccaaaat

SEQ ID NO: 169339 - DNA, 20 bp, Artificial Sequence
  Description of Artificial Sequence: Synthetic oligonucleotide
  Target: ATXN1; (-) strand; PAM type: YTN; PAM sequence: TTA
cagatgtcacaagccagtga

SEQ ID NO: 169340 - DNA, 20 bp, Artificial Sequence
  Description of Artificial Sequence: Synthetic oligonucleotide
  Target: ATXN1; (-) strand; PAM type: YTN; PAM sequence: CTG
ggcagattacagatgtcaca

SEQ ID NO: 169341 - DNA, 20 bp, Artificial Sequence
  Description of Artificial Sequence: Synthetic oligonucleotide
  Target: ATXN1; (-) strand; PAM type: YTN; PAM sequence: CTG
tgatctgggcagattacaga

SEQ ID NO: 169342 - DNA, 20 bp, Artificial Sequence
  Description of Artificial Sequence: Synthetic oligonucleotide
  Target: ATXN1; (-) strand; PAM type: YTN; PAM sequence: CTG
cgcatctgtgatctgggcag

SEQ ID NO: 169343 - DNA, 20 bp, Artificial Sequence
  Description of Artificial Sequence: Synthetic oligonucleotide
  Target: ATXN1; (-) strand; PAM type: YTN; PAM sequence: TTC
tgcgcatctgtgatctgggc

SEQ ID NO: 169344 - DNA, 20 bp, Artificial Sequence
  Description of Artificial Sequence: Synthetic oligonucleotide
  Target: ATXN1; (-) strand; PAM type: YTN; PAM sequence: TTT
ctgcgcatctgtgatctggg

SEQ ID NO: 169345 - DNA, 20 bp, Artificial Sequence
  Description of Artificial Sequence: Synthetic oligonucleotide
  Target: ATXN1; (-) strand; PAM type: YTN; PAM sequence: TTG
tttctgcgcatctgtgatct

SEQ ID NO: 169346 - DNA, 20 bp, Artificial Sequence
  Description of Artificial Sequence: Synthetic oligonucleotide
  Target: ATXN1; (-) strand; PAM type: YTN; PAM sequence: CTT
gtttctgcgcatctgtgatc

SEQ ID NO: 169347 - DNA, 20 bp, Artificial Sequence
  Description of Artificial Sequence: Synthetic oligonucleotide
  Target: ATXN1; (-) strand; PAM type: YTN; PAM sequence: CTG
atgccttgtttctgcgcatc

SEQ ID NO: 169348 - DNA, 20 bp, Artificial Sequence
  Description of Artificial Sequence: Synthetic oligonucleotide
  Target: ATXN1; (-) strand; PAM type: YTN; PAM sequence: CTA
agcagagggaatctgatgcc

SEQ ID NO: 169349 - DNA, 20 bp, Artificial Sequence
  Description of Artificial Sequence: Synthetic oligonucleotide
  Target: ATXN1; (-) strand; PAM type: YTN; PAM sequence: TTC
taagcagagggaatctgatg

SEQ ID NO: 169350 - DNA, 20 bp, Artificial Sequence
  Description of Artificial Sequence: Synthetic oligonucleotide
  Target: ATXN1; (-) strand; PAM type: YTN; PAM sequence: CTG
ttctaagcagagggaatctg

SEQ ID NO: 169351 - DNA, 20 bp, Artificial Sequence
  Description of Artificial Sequence: Synthetic oligonucleotide
  Target: ATXN1; (-) strand; PAM type: YTN; PAM sequence: TTC
tgttctaagcagagggaatc

SEQ ID NO: 169352 - DNA, 20 bp, Artificial Sequence
  Description of Artificial Sequence: Synthetic oligonucleotide
  Target: ATXN1; (-) strand; PAM type: YTN; PAM sequence: CTT
ctgttctaagcagagggaat

SEQ ID NO: 169353 - DNA, 20 bp, Artificial Sequence
  Description of Artificial Sequence: Synthetic oligonucleotide
  Target: ATXN1; (-) strand; PAM type: YTN; PAM sequence: CTG
gcttctgttctaagcagagg

SEQ ID NO: 169354 - DNA, 20 bp, Artificial Sequence
  Description of Artificial Sequence: Synthetic oligonucleotide
  Target: ATXN1; (-) strand; PAM type: YTN; PAM sequence: CTC
ctggcttctgttctaagcag

SEQ ID NO: 169355 - DNA, 20 bp, Artificial Sequence
  Description of Artificial Sequence: Synthetic oligonucleotide
  Target: ATXN1; (-) strand; PAM type: YTN; PAM sequence: TTC
tcctggcttctgttctaagc

SEQ ID NO: 169356 - DNA, 20 bp, Artificial Sequence
  Description of Artificial Sequence: Synthetic oligonucleotide
  Target: ATXN1; (-) strand; PAM type: YTN; PAM sequence: CTT
ctcctggcttctgttctaag

SEQ ID NO: 169357 - DNA, 20 bp, Artificial Sequence
  Description of Artificial Sequence: Synthetic oligonucleotide
  Target: ATXN1; (-) strand; PAM type: YTN; PAM sequence: TTC
agccccttctcctggcttct

SEQ ID NO: 169358 - DNA, 20 bp, Artificial Sequence
  Description of Artificial Sequence: Synthetic oligonucleotide
  Target: ATXN1; (-) strand; PAM type: YTN; PAM sequence: TTA
aagatgcatgtattcagccc

SEQ ID NO: 169359 - DNA, 20 bp, Artificial Sequence
  Description of Artificial Sequence: Synthetic oligonucleotide
  Target: ATXN1; (-) strand; PAM type: YTN; PAM sequence: CTT
aaagatgcatgtattcagcc

SEQ ID NO: 169360 - DNA, 20 bp, Artificial Sequence
  Description of Artificial Sequence: Synthetic oligonucleotide
  Target: ATXN1; (-) strand; PAM type: YTN; PAM sequence: TTC
cgtgggtatgaatcttaaag

SEQ ID NO: 169361 - DNA, 20 bp, Artificial Sequence
  Description of Artificial Sequence: Synthetic oligonucleotide
  Target: ATXN1; (-) strand; PAM type: YTN; PAM sequence: CTG
ttccgtgggtatgaatctta

SEQ ID NO: 169362 - DNA, 20 bp, Artificial Sequence
  Description of Artificial Sequence: Synthetic oligonucleotide
  Target: ATXN1; (-) strand; PAM type: YTN; PAM sequence: CTC
tgttccgtgggtatgaatct

SEQ ID NO: 169363 - DNA, 20 bp, Artificial Sequence
  Description of Artificial Sequence: Synthetic oligonucleotide
  Target: ATXN1; (-) strand; PAM type: YTN; PAM sequence: CTA
ggagagtctctgttccgtgg

SEQ ID NO: 169364 - DNA, 20 bp, Artificial Sequence
  Description of Artificial Sequence: Synthetic oligonucleotide
  Target: ATXN1; (-) strand; PAM type: YTN; PAM sequence: TTG
tgaacagatgactaggagag

SEQ ID NO: 169365 - DNA, 20 bp, Artificial Sequence
  Description of Artificial Sequence: Synthetic oligonucleotide
  Target: ATXN1; (-) strand; PAM type: YTN; PAM sequence: TTT
gtgaacagatgactaggaga

SEQ ID NO: 169366 - DNA, 20 bp, Artificial Sequence
  Description of Artificial Sequence: Synthetic oligonucleotide
  Target: ATXN1; (-) strand; PAM type: YTN; PAM sequence: CTG
aaagtttgtgaacagatgac

SEQ ID NO: 169367 - DNA, 20 bp, Artificial Sequence
  Description of Artificial Sequence: Synthetic oligonucleotide
  Target: ATXN1; (-) strand; PAM type: YTN; PAM sequence: CTC
actgaaagtttgtgaacaga

SEQ ID NO: 169368 - DNA, 20 bp, Artificial Sequence
  Description of Artificial Sequence: Synthetic oligonucleotide
  Target: ATXN1; (-) strand; PAM type: YTN; PAM sequence: CTG
gcatatagtagacactcact

SEQ ID NO: 169369 - DNA, 20 bp, Artificial Sequence
  Description of Artificial Sequence: Synthetic oligonucleotide
  Target: ATXN1; (-) strand; PAM type: YTN; PAM sequence: CTG
cctggcatatagtagacact

SEQ ID NO: 169370 - DNA, 20 bp, Artificial Sequence
  Description of Artificial Sequence: Synthetic oligonucleotide
  Target: ATXN1; (-) strand; PAM type: YTN; PAM sequence: CTG
tggtctgcctggcatatagt

SEQ ID NO: 169371 - DNA, 20 bp, Artificial Sequence
  Description of Artificial Sequence: Synthetic oligonucleotide
  Target: ATXN1; (-) strand; PAM type: YTN; PAM sequence: TTG
cactgtggtctgcctggcat

SEQ ID NO: 169372 - DNA, 20 bp, Artificial Sequence
  Description of Artificial Sequence: Synthetic oligonucleotide
  Target: ATXN1; (-) strand; PAM type: YTN; PAM sequence: TTT
gcactgtggtctgcctggca

SEQ ID NO: 169373 - DNA, 20 bp, Artificial Sequence
  Description of Artificial Sequence: Synthetic oligonucleotide
  Target: ATXN1; (-) strand; PAM type: YTN; PAM sequence: TTT
tgcactgtggtctgcctggc

SEQ ID NO: 169374 - DNA, 20 bp, Artificial Sequence
  Description of Artificial Sequence: Synthetic oligonucleotide
  Target: ATXN1; (-) strand; PAM type: YTN; PAM sequence: TTT
ttgcactgtggtctgcctgg

SEQ ID NO: 169375 - DNA, 20 bp, Artificial Sequence
  Description of Artificial Sequence: Synthetic oligonucleotide
  Target: ATXN1; (-) strand; PAM type: YTN; PAM sequence: TTT
tttgcactgtggtctgcctg

SEQ ID NO: 169376 - DNA, 20 bp, Artificial Sequence
  Description of Artificial Sequence: Synthetic oligonucleotide
  Target: ATXN1; (-) strand; PAM type: YTN; PAM sequence: TTA
attttttgcactgtggtctg

SEQ ID NO: 169377 - DNA, 20 bp, Artificial Sequence
  Description of Artificial Sequence: Synthetic oligonucleotide
  Target: ATXN1; (-) strand; PAM type: YTN; PAM sequence: CTT
aattttttgcactgtggtct

SEQ ID NO: 169378 - DNA, 20 bp, Artificial Sequence
  Description of Artificial Sequence: Synthetic oligonucleotide
  Target: ATXN1; (-) strand; PAM type: YTN; PAM sequence: TTA
agcttaattttttgcactgt

SEQ ID NO: 169379 - DNA, 20 bp, Artificial Sequence
  Description of Artificial Sequence: Synthetic oligonucleotide
  Target: ATXN1; (-) strand; PAM type: YTN; PAM sequence: TTA
ttaagcttaattttttgcac

SEQ ID NO: 169380 - DNA, 20 bp, Artificial Sequence
  Description of Artificial Sequence: Synthetic oligonucleotide
  Target: ATXN1; (-) strand; PAM type: YTN; PAM sequence: TTA
agggttattaagcttaattt

SEQ ID NO: 169381 - DNA, 20 bp, Artificial Sequence
  Description of Artificial Sequence: Synthetic oligonucleotide
  Target: ATXN1; (-) strand; PAM type: YTN; PAM sequence: TTT
aagggttattaagcttaatt

SEQ ID NO: 169382 - DNA, 20 bp, Artificial Sequence
  Description of Artificial Sequence: Synthetic oligonucleotide
  Target: ATXN1; (-) strand; PAM type: YTN; PAM sequence: CTG
gaaccagagaatgatattta

SEQ ID NO: 169383 - DNA, 20 bp, Artificial Sequence
  Description of Artificial Sequence: Synthetic oligonucleotide
  Target: ATXN1; (-) strand; PAM type: YTN; PAM sequence: CTG
aagaggcctggaaccagaga

SEQ ID NO: 169384 - DNA, 20 bp, Artificial Sequence
  Description of Artificial Sequence: Synthetic oligonucleotide
  Target: ATXN1; (-) strand; PAM type: YTN; PAM sequence: TTC
tgaagaggcctggaaccaga

SEQ ID NO: 169385 - DNA, 20 bp, Artificial Sequence
  Description of Artificial Sequence: Synthetic oligonucleotide
  Target: ATXN1; (-) strand; PAM type: YTN; PAM sequence: CTT
ctgaagaggcctggaaccag

SEQ ID NO: 169386 - DNA, 20 bp, Artificial Sequence
  Description of Artificial Sequence: Synthetic oligonucleotide
  Target: ATXN1; (-) strand; PAM type: YTN; PAM sequence: TTA
gataataaatagccaagctt

SEQ ID NO: 169387 - DNA, 20 bp, Artificial Sequence
  Description of Artificial Sequence: Synthetic oligonucleotide
  Target: ATXN1; (-) strand; PAM type: YTN; PAM sequence: CTC
acaagaatattagataataa

SEQ ID NO: 169388 - DNA, 20 bp, Artificial Sequence
  Description of Artificial Sequence: Synthetic oligonucleotide
  Target: ATXN1; (-) strand; PAM type: YTN; PAM sequence: CTA
aacacagaaatccagacaca

SEQ ID NO: 169389 - DNA, 20 bp, Artificial Sequence
  Description of Artificial Sequence: Synthetic oligonucleotide
  Target: ATXN1; (-) strand; PAM type: YTN; PAM sequence: CTA
aaagagcctaaacacagaaa

SEQ ID NO: 169390 - DNA, 20 bp, Artificial Sequence
  Description of Artificial Sequence: Synthetic oligonucleotide
  Target: ATXN1; (-) strand; PAM type: YTN; PAM sequence: CTC
cctaaaagagcctaaacaca

SEQ ID NO: 169391 - DNA, 20 bp, Artificial Sequence
  Description of Artificial Sequence: Synthetic oligonucleotide
  Target: ATXN1; (-) strand; PAM type: YTN; PAM sequence: CTA
tctccctaaaagagcctaaa

SEQ ID NO: 169392 - DNA, 20 bp, Artificial Sequence
  Description of Artificial Sequence: Synthetic oligonucleotide
  Target: ATXN1; (-) strand; PAM type: YTN; PAM sequence: TTA
ctatctccctaaaagagcct

SEQ ID NO: 169393 - DNA, 20 bp, Artificial Sequence
  Description of Artificial Sequence: Synthetic oligonucleotide
  Target: ATXN1; (-) strand; PAM type: YTN; PAM sequence: CTT
actatctccctaaaagagcc

SEQ ID NO: 169394 - DNA, 20 bp, Artificial Sequence
  Description of Artificial Sequence: Synthetic oligonucleotide
  Target: ATXN1; (-) strand; PAM type: YTN; PAM sequence: TTC
cttactatctccctaaaaga

SEQ ID NO: 169395 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaaaaaagtcacat

SEQ ID NO: 169396 - DNA, 20 bp, Artificial Sequence
  Description of Artificial Sequence: Synthetic oligonucleotide
  Target: ATXN1; (-) strand; PAM type: YTN; PAM sequence: TTT
aaaaaaaaaaaaaagtcaca

SEQ ID NO: 169397 - DNA, 20 bp, Artificial Sequence
  Description of Artificial Sequence: Synthetic oligonucleotide
  Target: ATXN1; (-) strand; PAM type: YTN; PAM sequence: TTT
taaaaaaaaaaaaaagtcac

SEQ ID NO: 169398 - DNA, 20 bp, Artificial Sequence
  Description of Artificial Sequence: Synthetic oligonucleotide
  Target: ATXN1; (-) strand; PAM type: YTN; PAM sequence: CTT
ttaaaaaaaaaaaaaagtca

SEQ ID NO: 169399 - DNA, 20 bp, Artificial Sequence
  Description of Artificial Sequence: Synthetic oligonucleotide
  Target: ATXN1; (-) strand; PAM type: YTN; PAM sequence: TTC
aggcagagaaggcttttaaa

SEQ ID NO: 169400 - DNA, 20 bp, Artificial Sequence
  Description of Artificial Sequence: Synthetic oligonucleotide
  Target: ATXN1; (-) strand; PAM type: YTN; PAM sequence: TTT
caggcagagaaggcttttaa

SEQ ID NO: 169401 - DNA, 20 bp, Artificial Sequence
  Description of Artificial Sequence: Synthetic oligonucleotide
  Target: ATXN1; (-) strand; PAM type: YTN; PAM sequence: TTT
tcaggcagagaaggctttta

SEQ ID NO: 169402 - DNA, 20 bp, Artificial Sequence
  Description of Artificial Sequence: Synthetic oligonucleotide
  Target: ATXN1; (-) strand; PAM type: YTN; PAM sequence: CTG
gcattttcaggcagagaagg

SEQ ID NO: 169403 - DNA, 20 bp, Artificial Sequence
  Description of Artificial Sequence: Synthetic oligonucleotide
  Target: ATXN1; (-) strand; PAM type: YTN; PAM sequence: CTG
aaatgtgtctggcattttca

SEQ ID NO: 169404 - DNA, 20 bp, Artificial Sequence
  Description of Artificial Sequence: Synthetic oligonucleotide
  Target: ATXN1; (-) strand; PAM type: YTN; PAM sequence: TTG
acatctgaaatgtgtctggc

SEQ ID NO: 169405 - DNA, 20 bp, Artificial Sequence
  Description of Artificial Sequence: Synthetic oligonucleotide
  Target: ATXN1; (-) strand; PAM type: YTN; PAM sequence: TTT
gacatctgaaatgtgtctgg

SEQ ID NO: 169406 - DNA, 20 bp, Artificial Sequence
  Description of Artificial Sequence: Synthetic oligonucleotide
  Target: ATXN1; (-) strand; PAM type: YTN; PAM sequence: TTT
tgacatctgaaatgtgtctg

SEQ ID NO: 169407 - DNA, 20 bp, Artificial Sequence
  Description of Artificial Sequence: Synthetic oligonucleotide
  Target: ATXN1; (-) strand; PAM type: YTN; PAM sequence: TTA
gttttgacatctgaaatgtg

SEQ ID NO: 169408 - DNA, 20 bp, Artificial Sequence
  Description of Artificial Sequence: Synthetic oligonucleotide
  Target: ATXN1; (-) strand; PAM type: YTN; PAM sequence: CTG
aatgccacgttagttttgac

SEQ ID NO: 169409 - DNA, 20 bp, Artificial Sequence
  Description of Artificial Sequence: Synthetic oligonucleotide
  Target: ATXN1; (-) strand; PAM type: YTN; PAM sequence: CTC
acatggatcagtcacccacc

SEQ ID NO: 169410 - DNA, 20 bp, Artificial Sequence
  Description of Artificial Sequence: Synthetic oligonucleotide
  Target: ATXN1; (-) strand; PAM type: YTN; PAM sequence: TTA
agagcactcacatggatcag

SEQ ID NO: 169411 - DNA, 20 bp, Artificial Sequence
  Description of Artificial Sequence: Synthetic oligonucleotide
  Target: ATXN1; (-) strand; PAM type: YTN; PAM sequence: CTT
aagagcactcacatggatca

SEQ ID NO: 169412 - DNA, 20 bp, Artificial Sequence
  Description of Artificial Sequence: Synthetic oligonucleotide
  Target: ATXN1; (-) strand; PAM type: YTN; PAM sequence: CTA
cacccacttaagagcactca

SEQ ID NO: 169413 - DNA, 20 bp, Artificial Sequence
  Description of Artificial Sequence: Synthetic oligonucleotide
  Target: ATXN1; (-) strand; PAM type: YTN; PAM sequence: TTC
tacacccacttaagagcact

SEQ ID NO: 169414 - DNA, 20 bp, Artificial Sequence
  Description of Artificial Sequence: Synthetic oligonucleotide
  Target: ATXN1; (-) strand; PAM type: YTN; PAM sequence: CTT
ctacacccacttaagagcac

SEQ ID NO: 169415 - DNA, 20 bp, Artificial Sequence
  Description of Artificial Sequence: Synthetic oligonucleotide
  Target: ATXN1; (-) strand; PAM type: YTN; PAM sequence: TTG
aatgcgcgtgtgcagaaaag

SEQ ID NO: 169416 - DNA, 20 bp, Artificial Sequence
  Description of Artificial Sequence: Synthetic oligonucleotide
  Target: ATXN1; (-) strand; PAM type: YTN; PAM sequence: TTT
gaatgcgcgtgtgcagaaaa

SEQ ID NO: 169417 - DNA, 20 bp, Artificial Sequence
  Description of Artificial Sequence: Synthetic oligonucleotide
  Target: ATXN1; (-) strand; PAM type: YTN; PAM sequence: CTG
tgcacatttgaatgcgcgtg

SEQ ID NO: 169418 - DNA, 20 bp, Artificial Sequence
  Description of Artificial Sequence: Synthetic oligonucleotide
  Target: ATXN1; (-) strand; PAM type: YTN; PAM sequence: CTA
caagcctgtgcacatttgaa

SEQ ID NO: 169419 - DNA, 20 bp, Artificial Sequence
  Description of Artificial Sequence: Synthetic oligonucleotide
  Target: ATXN1; (-) strand; PAM type: YTN; PAM sequence: TTA
tggcctacaagcctgtgcac

SEQ ID NO: 169420 - DNA, 20 bp, Artificial Sequence
  Description of Artificial Sequence: Synthetic oligonucleotide
  Target: ATXN1; (-) strand; PAM type: YTN; PAM sequence: TTT
atggcctacaagcctgtgca

SEQ ID NO: 169421 - DNA, 20 bp, Artificial Sequence
  Description of Artificial Sequence: Synthetic oligonucleotide
  Target: ATXN1; (-) strand; PAM type: YTN; PAM sequence: CTA
tttatggcctacaagcctgt

SEQ ID NO: 169422 - DNA, 20 bp, Artificial Sequence
  Description of Artificial Sequence: Synthetic oligonucleotide
  Target: ATXN1; (-) strand; PAM type: YTN; PAM sequence: CTA
agagctatttatggcctaca

SEQ ID NO: 169423 - DNA, 20 bp, Artificial Sequence
  Description of Artificial Sequence: Synthetic oligonucleotide
  Target: ATXN1; (-) strand; PAM type: YTN; PAM sequence: CTC
ccctaagagctatttatggc

SEQ ID NO: 169424 - DNA, 20 bp, Artificial Sequence
  Description of Artificial Sequence: Synthetic oligonucleotide
  Target: ATXN1; (-) strand; PAM type: YTN; PAM sequence: CTC
acactcccctaagagctatt

SEQ ID NO: 169425 - DNA, 20 bp, Artificial Sequence
  Description of Artificial Sequence: Synthetic oligonucleotide
  Target: ATXN1; (-) strand; PAM type: YTN; PAM sequence: CTG
tgatgtaatctcacactccc

SEQ ID NO: 169426 - DNA, 20 bp, Artificial Sequence
  Description of Artificial Sequence: Synthetic oligonucleotide
  Target: ATXN1; (-) strand; PAM type: YTN; PAM sequence: TTG
agtctgtgatgtaatctcac

SEQ ID NO: 169427 - DNA, 20 bp, Artificial Sequence
  Description of Artificial Sequence: Synthetic oligonucleotide
  Target: ATXN1; (-) strand; PAM type: YTN; PAM sequence: CTT
gagtctgtgatgtaatctca

SEQ ID NO: 169428 - DNA, 20 bp, Artificial Sequence
  Description of Artificial Sequence: Synthetic oligonucleotide
  Target: ATXN1; (-) strand; PAM type: YTN; PAM sequence: CTC
ttgagtctgtgatgtaatct

SEQ ID NO: 169429 - DNA, 20 bp, Artificial Sequence
  Description of Artificial Sequence: Synthetic oligonucleotide
  Target: ATXN1; (-) strand; PAM type: YTN; PAM sequence: TTG
aggtaacggggccctcttga

SEQ ID NO: 169430 - DNA, 20 bp, Artificial Sequence
  Description of Artificial Sequence: Synthetic oligonucleotide
  Target: ATXN1; (-) strand; PAM type: YTN; PAM sequence: TTT
gaggtaacggggccctcttg

SEQ ID NO: 169431 - DNA, 20 bp, Artificial Sequence
  Description of Artificial Sequence: Synthetic oligonucleotide
  Target: ATXN1; (-) strand; PAM type: YTN; PAM sequence: CTG
atttgaggtaacggggccct

SEQ ID NO: 169432 - DNA, 20 bp, Artificial Sequence
  Description of Artificial Sequence: Synthetic oligonucleotide
  Target: ATXN1; (-) strand; PAM type: YTN; PAM sequence: TTC
actgatttgaggtaacgggg

SEQ ID NO: 169433 - DNA, 20 bp, Artificial Sequence
  Description of Artificial Sequence: Synthetic oligonucleotide
  Target: ATXN1; (-) strand; PAM type: YTN; PAM sequence: TTG
gggagatgagtgtcaagcat

SEQ ID NO: 169434 - DNA, 20 bp, Artificial Sequence
  Description of Artificial Sequence: Synthetic oligonucleotide
  Target: ATXN1; (-) strand; PAM type: YTN; PAM sequence: TTT
ggggagatgagtgtcaagca

SEQ ID NO: 169435 - DNA, 20 bp, Artificial Sequence
  Description of Artificial Sequence: Synthetic oligonucleotide
  Target: ATXN1; (-) strand; PAM type: YTN; PAM sequence: TTT
tggggagatgagtgtcaagc

SEQ ID NO: 169436 - DNA, 20 bp, Artificial Sequence
  Description of Artificial Sequence: Synthetic oligonucleotide
  Target: ATXN1; (-) strand; PAM type: YTN; PAM sequence: TTT
ttggggagatgagtgtcaag

SEQ ID NO: 169437 - DNA, 20 bp, Artificial Sequence
  Description of Artificial Sequence: Synthetic oligonucleotide
  Target: ATXN1; (-) strand; PAM type: YTN; PAM sequence: CTT
tttggggagatgagtgtcaa

SEQ ID NO: 169438 - DNA, 20 bp, Artificial Sequence
  Description of Artificial Sequence: Synthetic oligonucleotide
  Target: ATXN1; (-) strand; PAM type: YTN; PAM sequence: TTC
aacagcatgcctttttgggg

SEQ ID NO: 169439 - DNA, 20 bp, Artificial Sequence
  Description of Artificial Sequence: Synthetic oligonucleotide
  Target: ATXN1; (-) strand; PAM type: YTN; PAM sequence: TTT
caacagcatgcctttttggg

SEQ ID NO: 169440 - DNA, 20 bp, Artificial Sequence
  Description of Artificial Sequence: Synthetic oligonucleotide
  Target: ATXN1; (-) strand; PAM type: YTN; PAM sequence: TTT
tcaacagcatgcctttttgg

SEQ ID NO: 169441 - DNA, 20 bp, Artificial Sequence
  Description of Artificial Sequence: Synthetic oligonucleotide
  Target: ATXN1; (-) strand; PAM type: YTN; PAM sequence: CTG
cattttcaacagcatgcctt

SEQ ID NO: 169442 - DNA, 20 bp, Artificial Sequence
  Description of Artificial Sequence: Synthetic oligonucleotide
  Target: ATXN1; (-) strand; PAM type: YTN; PAM sequence: CTA
gtatctgcattttcaacagc

SEQ ID NO: 169443 - DNA, 20 bp, Artificial Sequence
  Description of Artificial Sequence: Synthetic oligonucleotide
  Target: ATXN1; (-) strand; PAM type: YTN; PAM sequence: TTG
ggggtcagggtgagtctagt

SEQ ID NO: 169444 - DNA, 20 bp, Artificial Sequence
  Description of Artificial Sequence: Synthetic oligonucleotide
  Target: ATXN1; (-) strand; PAM type: YTN; PAM sequence: TTT
gggggtcagggtgagtctag

SEQ ID NO: 169445 - DNA, 20 bp, Artificial Sequence
  Description of Artificial Sequence: Synthetic oligonucleotide
  Target: ATXN1; (-) strand; PAM type: YTN; PAM sequence: TTT
tgggggtcagggtgagtcta

SEQ ID NO: 169446 - DNA, 20 bp, Artificial Sequence
  Description of Artificial Sequence: Synthetic oligonucleotide
  Target: ATXN1; (-) strand; PAM type: YTN; PAM sequence: TTT
ttgggggtcagggtgagtct

SEQ ID NO: 169447 - DNA, 20 bp, Artificial Sequence
  Description of Artificial Sequence: Synthetic oligonucleotide
  Target: ATXN1; (-) strand; PAM type: YTN; PAM sequence: TTT
tttgggggtcagggtgagtc

SEQ ID NO: 169448 - DNA, 20 bp, Artificial Sequence
  Description of Artificial Sequence: Synthetic oligonucleotide
  Target: ATXN1; (-) strand; PAM type: YTN; PAM sequence: CTG
ccagtggtagttttttgggg

SEQ ID NO: 169449 - DNA, 20 bp, Artificial Sequence
  Description of Artificial Sequence: Synthetic oligonucleotide
  Target: ATXN1; (-) strand; PAM type: YTN; PAM sequence: TTC
agcccataacaatgcctgcc

SEQ ID NO: 169450 - DNA, 20 bp, Artificial Sequence
  Description of Artificial Sequence: Synthetic oligonucleotide
  Target: ATXN1; (-) strand; PAM type: YTN; PAM sequence: TTG
gagggacagaattcagccca

SEQ ID NO: 169451 - DNA, 20 bp, Artificial Sequence
  Description of Artificial Sequence: Synthetic oligonucleotide
  Target: ATXN1; (-) strand; PAM type: YTN; PAM sequence: TTT
ggagggacagaattcagccc

SEQ ID NO: 169452 - DNA, 20 bp, Artificial Sequence
  Description of Artificial Sequence: Synthetic oligonucleotide
  Target: ATXN1; (-) strand; PAM type: YTN; PAM sequence: TTA
ggggtcaggatgtcaatata

SEQ ID NO: 169453 - DNA, 20 bp, Artificial Sequence
  Description of Artificial Sequence: Synthetic oligonucleotide
  Target: ATXN1; (-) strand; PAM type: YTN; PAM sequence: TTC
agaggtattaggggtcagga

SEQ ID NO: 169454 - DNA, 20 bp, Artificial Sequence
  Description of Artificial Sequence: Synthetic oligonucleotide
  Target: ATXN1; (-) strand; PAM type: YTN; PAM sequence: TTC
acattcagaggtattagggg

SEQ ID NO: 169455 - DNA, 20 bp, Artificial Sequence
  Description of Artificial Sequence: Synthetic oligonucleotide
  Target: ATXN1; (-) strand; PAM type: YTN; PAM sequence: TTC
caagtaagttcacattcaga

SEQ ID NO: 169456 - DNA, 20 bp, Artificial Sequence
  Description of Artificial Sequence: Synthetic oligonucleotide
  Target: ATXN1; (-) strand; PAM type: YTN; PAM sequence: TTT
ccaagtaagttcacattcag

SEQ ID NO: 169457 - DNA, 20 bp, Artificial Sequence
  Description of Artificial Sequence: Synthetic oligonucleotide
  Target: ATXN1; (-) strand; PAM type: YTN; PAM sequence: CTA
tttccaagtaagttcacatt

SEQ ID NO: 169458 - DNA, 20 bp, Artificial Sequence
  Description of Artificial Sequence: Synthetic oligonucleotide
  Target: ATXN1; (-) strand; PAM type: YTN; PAM sequence: CTG
caacaaccctatttccaagt

SEQ ID NO: 169459 - DNA, 20 bp, Artificial Sequence
  Description of Artificial Sequence: Synthetic oligonucleotide
  Target: ATXN1; (-) strand; PAM type: YTN; PAM sequence: TTA
tatctgcaacaaccctattt

SEQ ID NO: 169460 - DNA, 20 bp, Artificial Sequence
  Description of Artificial Sequence: Synthetic oligonucleotide
  Target: ATXN1; (-) strand; PAM type: YTN; PAM sequence: CTA
attatatctgcaacaaccct

SEQ ID NO: 169461 - DNA, 20 bp, Artificial Sequence
  Description of Artificial Sequence: Synthetic oligonucleotide
  Target: ATXN1; (-) strand; PAM type: YTN; PAM sequence: TTA
actaattatatctgcaacaa

SEQ ID NO: 169462 - DNA, 20 bp, Artificial Sequence
  Description of Artificial Sequence: Synthetic oligonucleotide
  Target: ATXN1; (-) strand; PAM type: YTN; PAM sequence: CTT
aactaattatatctgcaaca

SEQ ID NO: 169463 - DNA, 20 bp, Artificial Sequence
  Description of Artificial Sequence: Synthetic oligonucleotide
  Target: ATXN1; (-) strand; PAM type: YTN; PAM sequence: CTC
atcttaactaattatatctg

SEQ ID NO: 169464 - DNA, 20 bp, Artificial Sequence
  Description of Artificial Sequence: Synthetic oligonucleotide
  Target: ATXN1; (-) strand; PAM type: YTN; PAM sequence: CTC
caggatgacctcatcttaac

SEQ ID NO: 169465 - DNA, 20 bp, Artificial Sequence
  Description of Artificial Sequence: Synthetic oligonucleotide
  Target: ATXN1; (-) strand; PAM type: YTN; PAM sequence: CTC
ctccaggatgacctcatctt

SEQ ID NO: 169466 - DNA, 20 bp, Artificial Sequence
  Description of Artificial Sequence: Synthetic oligonucleotide
  Target: ATXN1; (-) strand; PAM type: YTN; PAM sequence: CTC
tcctccaggatgacctcatc

SEQ ID NO: 169467 - DNA, 20 bp, Artificial Sequence
  Description of Artificial Sequence: Synthetic oligonucleotide
  Target: ATXN1; (-) strand; PAM type: YTN; PAM sequence: TTA
ggaacccctctcctccagga

SEQ ID NO: 169468 - DNA, 20 bp, Artificial Sequence
  Description of Artificial Sequence: Synthetic oligonucleotide
  Target: ATXN1; (-) strand; PAM type: YTN; PAM sequence: CTG
tcagattaggaacccctctc

SEQ ID NO: 169469 - DNA, 20 bp, Artificial Sequence
  Description of Artificial Sequence: Synthetic oligonucleotide
  Target: ATXN1; (-) strand; PAM type: YTN; PAM sequence: TTC
tgtcagattaggaacccctc

SEQ ID NO: 169470 - DNA, 20 bp, Artificial Sequence
  Description of Artificial Sequence: Synthetic oligonucleotide
  Target: ATXN1; (-) strand; PAM type: YTN; PAM sequence: TTC
acaaggacaccagttctgtc

SEQ ID NO: 169471 - DNA, 20 bp, Artificial Sequence
  Description of Artificial Sequence: Synthetic oligonucleotide
  Target: ATXN1; (-) strand; PAM type: YTN; PAM sequence: TTT
cacaaggacaccagttctgt

SEQ ID NO: 169472 - DNA, 20 bp, Artificial Sequence
  Description of Artificial Sequence: Synthetic oligonucleotide
  Target: ATXN1; (-) strand; PAM type: YTN; PAM sequence: TTT
tcacaaggacaccagttctg

SEQ ID NO: 169473 - DNA, 20 bp, Artificial Sequence
  Description of Artificial Sequence: Synthetic oligonucleotide
  Target: ATXN1; (-) strand; PAM type: YTN; PAM sequence: CTT
ttcacaaggacaccagttct

SEQ ID NO: 169474 - DNA, 20 bp, Artificial Sequence
  Description of Artificial Sequence: Synthetic oligonucleotide
  Target: ATXN1; (-) strand; PAM type: YTN; PAM sequence: TTC
cccttttcacaaggacacca

SEQ ID NO: 169475 - DNA, 20 bp, Artificial Sequence
  Description of Artificial Sequence: Synthetic oligonucleotide
  Target: ATXN1; (-) strand; PAM type: YTN; PAM sequence: TTT
ccccttttcacaaggacacc

SEQ ID NO: 169476 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccgcgcc

SEQ ID NO: 169477 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 169478 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 169479 - DNA, 20 bp, Artificial Sequence
  Description of Artificial Sequence: Synthetic oligonucleotide
  Target: ATXN1; (-) strand; PAM type: YTN; PAM sequence: CTC
gacctcccaaagtgctggga

SEQ ID NO: 169480 - DNA, 20 bp, Artificial Sequence
  Description of Artificial Sequence: Synthetic oligonucleotide
  Target: ATXN1; (-) strand; PAM type: YTN; PAM sequence: CTG
cctcgacctcccaaagtgct

SEQ ID NO: 169481 - DNA, 20 bp, Artificial Sequence
  Description of Artificial Sequence: Synthetic oligonucleotide
  Target: ATXN1; (-) strand; PAM type: YTN; PAM sequence: CTC
atgatccgcctgcctcgacc

SEQ ID NO: 169482 - DNA, 20 bp, Artificial Sequence
  Description of Artificial Sequence: Synthetic oligonucleotide
  Target: ATXN1; (-) strand; PAM type: YTN; PAM sequence: CTG
acctcatgatccgcctgcct

SEQ ID NO: 169483 - DNA, 20 bp, Artificial Sequence
  Description of Artificial Sequence: Synthetic oligonucleotide
  Target: ATXN1; (-) strand; PAM type: YTN; PAM sequence: CTC
ctgacctcatgatccgcctg

SEQ ID NO: 169484 - DNA, 20 bp, Artificial Sequence
  Description of Artificial Sequence: Synthetic oligonucleotide
  Target: ATXN1; (-) strand; PAM type: YTN; PAM sequence: CTC
gaactcctgacctcatgatc

SEQ ID NO: 169485 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctgacctca

SEQ ID NO: 169486 - DNA, 20 bp, Artificial Sequence
  Description of Artificial Sequence: Synthetic oligonucleotide
  Target: ATXN1; (-) strand; PAM type: YTN; PAM sequence: CTA
gactggtctcgaactcctga

SEQ ID NO: 169487 - DNA, 20 bp, Artificial Sequence
  Description of Artificial Sequence: Synthetic oligonucleotide
  Target: ATXN1; (-) strand; PAM type: YTN; PAM sequence: TTG
gctagactggtctcgaactc

SEQ ID NO: 169488 - DNA, 20 bp, Artificial Sequence
  Description of Artificial Sequence: Synthetic oligonucleotide
  Target: ATXN1; (-) strand; PAM type: YTN; PAM sequence: TTC
accatgttggctagactggt

SEQ ID NO: 169489 - DNA, 20 bp, Artificial Sequence
  Description of Artificial Sequence: Synthetic oligonucleotide
  Target: ATXN1; (-) strand; PAM type: YTN; PAM sequence: TTT
caccatgttggctagactgg

SEQ ID NO: 169490 - DNA, 20 bp, Artificial Sequence
  Description of Artificial Sequence: Synthetic oligonucleotide
  Target: ATXN1; (-) strand; PAM type: YTN; PAM sequence: TTG
taatagtagagacagggttt

SEQ ID NO: 169491 - DNA, 20 bp, Artificial Sequence
  Description of Artificial Sequence: Synthetic oligonucleotide
  Target: ATXN1; (-) strand; PAM type: YTN; PAM sequence: TTT
gtaatagtagagacagggtt

SEQ ID NO: 169492 - DNA, 20 bp, Artificial Sequence
  Description of Artificial Sequence: Synthetic oligonucleotide
  Target: ATXN1; (-) strand; PAM type: YTN; PAM sequence: TTT
tgtaatagtagagacagggt

SEQ ID NO: 169493 - DNA, 20 bp, Artificial Sequence
  Description of Artificial Sequence: Synthetic oligonucleotide
  Target: ATXN1; (-) strand; PAM type: YTN; PAM sequence: TTT
ttgtaatagtagagacaggg

SEQ ID NO: 169494 - DNA, 20 bp, Artificial Sequence
  Description of Artificial Sequence: Synthetic oligonucleotide
  Target: ATXN1; (-) strand; PAM type: YTN; PAM sequence: CTA
atttttgtaatagtagagac

SEQ ID NO: 169495 - DNA, 20 bp, Artificial Sequence
  Description of Artificial Sequence: Synthetic oligonucleotide
  Target: ATXN1; (-) strand; PAM type: YTN; PAM sequence: TTA
taggcgcccgccaccacgcc

SEQ ID NO: 169496 - DNA, 20 bp, Artificial Sequence
  Description of Artificial Sequence: Synthetic oligonucleotide
  Target: ATXN1; (-) strand; PAM type: YTN; PAM sequence: CTG
gaattataggcgcccgccac

SEQ ID NO: 169497 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctggaattatag

SEQ ID NO: 169498 - DNA, 20 bp, Artificial Sequence
  Description of Artificial Sequence: Synthetic oligonucleotide
  Target: ATXN1; (-) strand; PAM type: YTN; PAM sequence: TTC
tcccgagtagctggaattat

SEQ ID NO: 169499 - DNA, 20 bp, Artificial Sequence
  Description of Artificial Sequence: Synthetic oligonucleotide
  Target: ATXN1; (-) strand; PAM type: YTN; PAM sequence: CTC
attctcccgagtagctggaa

SEQ ID NO: 169500 - DNA, 20 bp, Artificial Sequence
  Description of Artificial Sequence: Synthetic oligonucleotide
  Target: ATXN1; (-) strand; PAM type: YTN; PAM sequence: CTC
cctcattctcccgagtagct

SEQ ID NO: 169501 - DNA, 20 bp, Artificial Sequence
  Description of Artificial Sequence: Synthetic oligonucleotide
  Target: ATXN1; (-) strand; PAM type: YTN; PAM sequence: CTC
ctccctcattctcccgagta

SEQ ID NO: 169502 - DNA, 20 bp, Artificial Sequence
  Description of Artificial Sequence: Synthetic oligonucleotide
  Target: ATXN1; (-) strand; PAM type: YTN; PAM sequence: TTC
tcctccctcattctcccgag

SEQ ID NO: 169503 - DNA, 20 bp, Artificial Sequence
  Description of Artificial Sequence: Synthetic oligonucleotide
  Target: ATXN1; (-) strand; PAM type: YTN; PAM sequence: TTC
aagagattctcctccctcat

SEQ ID NO: 169504 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagagattctcc

SEQ ID NO: 169505 - DNA, 20 bp, Artificial Sequence
  Description of Artificial Sequence: Synthetic oligonucleotide
  Target: ATXN1; (-) strand; PAM type: YTN; PAM sequence: CTG
cctcccaggttcaagagatt

SEQ ID NO: 169506 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaggttcaagaga

SEQ ID NO: 169507 - DNA, 20 bp, Artificial Sequence
  Description of Artificial Sequence: Synthetic oligonucleotide
  Target: ATXN1; (-) strand; PAM type: YTN; PAM sequence: CTG
caacctctgcctcccaggtt

SEQ ID NO: 169508 - DNA, 20 bp, Artificial Sequence
  Description of Artificial Sequence: Synthetic oligonucleotide
  Target: ATXN1; (-) strand; PAM type: YTN; PAM sequence: TTA
ctgcaacctctgcctcccag

SEQ ID NO: 169509 - DNA, 20 bp, Artificial Sequence
  Description of Artificial Sequence: Synthetic oligonucleotide
  Target: ATXN1; (-) strand; PAM type: YTN; PAM sequence: CTT
actgcaacctctgcctccca

SEQ ID NO: 169510 - DNA, 20 bp, Artificial Sequence
  Description of Artificial Sequence: Synthetic oligonucleotide
  Target: ATXN1; (-) strand; PAM type: YTN; PAM sequence: CTC
acttactgcaacctctgcct

SEQ ID NO: 169511 - DNA, 20 bp, Artificial Sequence
  Description of Artificial Sequence: Synthetic oligonucleotide
  Target: ATXN1; (-) strand; PAM type: YTN; PAM sequence: CTG
gggtgcagtggtgcgatctc

SEQ ID NO: 169512 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggggtgcag

SEQ ID NO: 169513 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctggggtgc

SEQ ID NO: 169514 - DNA, 20 bp, Artificial Sequence
  Description of Artificial Sequence: Synthetic oligonucleotide
  Target: ATXN1; (-) strand; PAM type: YTN; PAM sequence: TTG
ctctgtcacccaggctgggg

SEQ ID NO: 169515 - DNA, 20 bp, Artificial Sequence
  Description of Artificial Sequence: Synthetic oligonucleotide
  Target: ATXN1; (-) strand; PAM type: YTN; PAM sequence: CTT
gctctgtcacccaggctggg

SEQ ID NO: 169516 - DNA, 20 bp, Artificial Sequence
  Description of Artificial Sequence: Synthetic oligonucleotide
  Target: ATXN1; (-) strand; PAM type: YTN; PAM sequence: TTC
atgatggagtcttgctctgt

SEQ ID NO: 169517 - DNA, 20 bp, Artificial Sequence
  Description of Artificial Sequence: Synthetic oligonucleotide
  Target: ATXN1; (-) strand; PAM type: YTN; PAM sequence: TTT
catgatggagtcttgctctg

SEQ ID NO: 169518 - DNA, 20 bp, Artificial Sequence
  Description of Artificial Sequence: Synthetic oligonucleotide
  Target: ATXN1; (-) strand; PAM type: YTN; PAM sequence: TTT
tcatgatggagtcttgctct

SEQ ID NO: 169519 - DNA, 20 bp, Artificial Sequence
  Description of Artificial Sequence: Synthetic oligonucleotide
  Target: ATXN1; (-) strand; PAM type: YTN; PAM sequence: TTT
ttcatgatggagtcttgctc

SEQ ID NO: 169520 - DNA, 20 bp, Artificial Sequence
  Description of Artificial Sequence: Synthetic oligonucleotide
  Target: ATXN1; (-) strand; PAM type: YTN; PAM sequence: TTT
tttcatgatggagtcttgct

SEQ ID NO: 169521 - DNA, 20 bp, Artificial Sequence
  Description of Artificial Sequence: Synthetic oligonucleotide
  Target: ATXN1; (-) strand; PAM type: YTN; PAM sequence: TTT
ttttcatgatggagtcttgc

SEQ ID NO: 169522 - DNA, 20 bp, Artificial Sequence
  Description of Artificial Sequence: Synthetic oligonucleotide
  Target: ATXN1; (-) strand; PAM type: YTN; PAM sequence: TTT
tttttcatgatggagtcttg

SEQ ID NO: 169523 - DNA, 20 bp, Artificial Sequence
  Description of Artificial Sequence: Synthetic oligonucleotide
  Target: ATXN1; (-) strand; PAM type: YTN; PAM sequence: TTT
ttttttcatgatggagtctt

SEQ ID NO: 169524 - DNA, 20 bp, Artificial Sequence
  Description of Artificial Sequence: Synthetic oligonucleotide
  Target: ATXN1; (-) strand; PAM type: YTN; PAM sequence: CTT
tttttttcatgatggagtct

SEQ ID NO: 169525 - DNA, 20 bp, Artificial Sequence
  Description of Artificial Sequence: Synthetic oligonucleotide
  Target: ATXN1; (-) strand; PAM type: YTN; PAM sequence: TTC
cccctttttttttcatgatg

SEQ ID NO: 169526 - DNA, 20 bp, Artificial Sequence
  Description of Artificial Sequence: Synthetic oligonucleotide
  Target: ATXN1; (-) strand; PAM type: YTN; PAM sequence: TTT
ccccctttttttttcatgat

SEQ ID NO: 169527 - DNA, 20 bp, Artificial Sequence
  Description of Artificial Sequence: Synthetic oligonucleotide
  Target: ATXN1; (-) strand; PAM type: YTN; PAM sequence: CTG
agtccacatttccccctttt

SEQ ID NO: 169528 - DNA, 20 bp, Artificial Sequence
  Description of Artificial Sequence: Synthetic oligonucleotide
  Target: ATXN1; (-) strand; PAM type: YTN; PAM sequence: CTG
tgtgcctgagtccacatttc

SEQ ID NO: 169529 - DNA, 20 bp, Artificial Sequence
  Description of Artificial Sequence: Synthetic oligonucleotide
  Target: ATXN1; (-) strand; PAM type: YTN; PAM sequence: CTG
cctgtgtgcctgagtccaca

SEQ ID NO: 169530 - DNA, 20 bp, Artificial Sequence
  Description of Artificial Sequence: Synthetic oligonucleotide
  Target: ATXN1; (-) strand; PAM type: YTN; PAM sequence: CTC
tgcctgtgtgcctgagtcca

SEQ ID NO: 169531 - DNA, 20 bp, Artificial Sequence
  Description of Artificial Sequence: Synthetic oligonucleotide
  Target: ATXN1; (-) strand; PAM type: YTN; PAM sequence: CTC
acagagcactctgcctgtgt

SEQ ID NO: 169532 - DNA, 20 bp, Artificial Sequence
  Description of Artificial Sequence: Synthetic oligonucleotide
  Target: ATXN1; (-) strand; PAM type: YTN; PAM sequence: CTC
cagtcctcacagagcactct

SEQ ID NO: 169533 - DNA, 20 bp, Artificial Sequence
  Description of Artificial Sequence: Synthetic oligonucleotide
  Target: ATXN1; (-) strand; PAM type: YTN; PAM sequence: CTG
tcactccagtcctcacagag

SEQ ID NO: 169534 - DNA, 20 bp, Artificial Sequence
  Description of Artificial Sequence: Synthetic oligonucleotide
  Target: ATXN1; (-) strand; PAM type: YTN; PAM sequence: CTC
tgtcactccagtcctcacag

SEQ ID NO: 169535 - DNA, 20 bp, Artificial Sequence
  Description of Artificial Sequence: Synthetic oligonucleotide
  Target: ATXN1; (-) strand; PAM type: YTN; PAM sequence: TTA
gcatgtggctctgtcactcc

SEQ ID NO: 169536 - DNA, 20 bp, Artificial Sequence
  Description of Artificial Sequence: Synthetic oligonucleotide
  Target: ATXN1; (-) strand; PAM type: YTN; PAM sequence: CTT
agcatgtggctctgtcactc

SEQ ID NO: 169537 - DNA, 20 bp, Artificial Sequence
  Description of Artificial Sequence: Synthetic oligonucleotide
  Target: ATXN1; (-) strand; PAM type: YTN; PAM sequence: CTC
cttagcatgtggctctgtca

SEQ ID NO: 169538 - DNA, 20 bp, Artificial Sequence
  Description of Artificial Sequence: Synthetic oligonucleotide
  Target: ATXN1; (-) strand; PAM type: YTN; PAM sequence: CTG
gtggctccttagcatgtggc

SEQ ID NO: 169539 - DNA, 20 bp, Artificial Sequence
  Description of Artificial Sequence: Synthetic oligonucleotide
  Target: ATXN1; (-) strand; PAM type: YTN; PAM sequence: TTC
tggtggctccttagcatgtg

SEQ ID NO: 169540 - DNA, 20 bp, Artificial Sequence
  Description of Artificial Sequence: Synthetic oligonucleotide
  Target: ATXN1; (-) strand; PAM type: YTN; PAM sequence: CTT
ctggtggctccttagcatgt

SEQ ID NO: 169541 - DNA, 20 bp, Artificial Sequence
  Description of Artificial Sequence: Synthetic oligonucleotide
  Target: ATXN1; (-) strand; PAM type: YTN; PAM sequence: CTA
gcttctggtggctccttagc

SEQ ID NO: 169542 - DNA, 20 bp, Artificial Sequence
  Description of Artificial Sequence: Synthetic oligonucleotide
  Target: ATXN1; (-) strand; PAM type: YTN; PAM sequence: CTC
cctagcttctggtggctcct

SEQ ID NO: 169543 - DNA, 20 bp, Artificial Sequence
  Description of Artificial Sequence: Synthetic oligonucleotide
  Target: ATXN1; (-) strand; PAM type: YTN; PAM sequence: TTC
caggtcactccctagcttct

SEQ ID NO: 169544 - DNA, 20 bp, Artificial Sequence
  Description of Artificial Sequence: Synthetic oligonucleotide
  Target: ATXN1; (-) strand; PAM type: YTN; PAM sequence: CTG
ttccaggtcactccctagct

SEQ ID NO: 169545 - DNA, 20 bp, Artificial Sequence
  Description of Artificial Sequence: Synthetic oligonucleotide
  Target: ATXN1; (-) strand; PAM type: YTN; PAM sequence: CTC
gggaaggatctgttccaggt

SEQ ID NO: 169546 - DNA, 20 bp, Artificial Sequence
  Description of Artificial Sequence: Synthetic oligonucleotide
  Target: ATXN1; (-) strand; PAM type: YTN; PAM sequence: CTG
tgaagatgctcgggaaggat

SEQ ID NO: 169547 - DNA, 20 bp, Artificial Sequence
  Description of Artificial Sequence: Synthetic oligonucleotide
  Target: ATXN1; (-) strand; PAM type: YTN; PAM sequence: CTC
cctgtgaagatgctcgggaa

SEQ ID NO: 169548 - DNA, 20 bp, Artificial Sequence
  Description of Artificial Sequence: Synthetic oligonucleotide
  Target: ATXN1; (-) strand; PAM type: YTN; PAM sequence: CTG
gaagtcagagatcaaggtgt

SEQ ID NO: 169549 - DNA, 20 bp, Artificial Sequence
  Description of Artificial Sequence: Synthetic oligonucleotide
  Target: ATXN1; (-) strand; PAM type: YTN; PAM sequence: CTG
gggggcctggaagtcagaga

SEQ ID NO: 169550 - DNA, 20 bp, Artificial Sequence
  Description of Artificial Sequence: Synthetic oligonucleotide
  Target: ATXN1; (-) strand; PAM type: YTN; PAM sequence: CTC
acagctggggggcctggaag

SEQ ID NO: 169551 - DNA, 20 bp, Artificial Sequence
  Description of Artificial Sequence: Synthetic oligonucleotide
  Target: ATXN1; (-) strand; PAM type: YTN; PAM sequence: TTG
agtgtctcacagctgggggg

SEQ ID NO: 169552 - DNA, 20 bp, Artificial Sequence
  Description of Artificial Sequence: Synthetic oligonucleotide
  Target: ATXN1; (-) strand; PAM type: YTN; PAM sequence: TTA
acagacattgagtgtctcac

SEQ ID NO: 169553 - DNA, 20 bp, Artificial Sequence
  Description of Artificial Sequence: Synthetic oligonucleotide
  Target: ATXN1; (-) strand; PAM type: YTN; PAM sequence: CTT
aacagacattgagtgtctca

SEQ ID NO: 169554 - DNA, 20 bp, Artificial Sequence
  Description of Artificial Sequence: Synthetic oligonucleotide
  Target: ATXN1; (-) strand; PAM type: YTN; PAM sequence: CTG
ggtgacttaacagacattga

SEQ ID NO: 169555 - DNA, 20 bp, Artificial Sequence
  Description of Artificial Sequence: Synthetic oligonucleotide
  Target: ATXN1; (-) strand; PAM type: YTN; PAM sequence: TTA
caaagtgccagaaactgggt

SEQ ID NO: 169556 - DNA, 20 bp, Artificial Sequence
  Description of Artificial Sequence: Synthetic oligonucleotide
  Target: ATXN1; (-) strand; PAM type: YTN; PAM sequence: CTG
ccattacaaagtgccagaaa

SEQ ID NO: 169557 - DNA, 20 bp, Artificial Sequence
  Description of Artificial Sequence: Synthetic oligonucleotide
  Target: ATXN1; (-) strand; PAM type: YTN; PAM sequence: TTC
cagggctgccattacaaagt

SEQ ID NO: 169558 - DNA, 20 bp, Artificial Sequence
  Description of Artificial Sequence: Synthetic oligonucleotide
  Target: ATXN1; (-) strand; PAM type: YTN; PAM sequence: TTT
ccagggctgccattacaaag

SEQ ID NO: 169559 - DNA, 20 bp, Artificial Sequence
  Description of Artificial Sequence: Synthetic oligonucleotide
  Target: ATXN1; (-) strand; PAM type: YTN; PAM sequence: TTT
tccagggctgccattacaaa

SEQ ID NO: 169560 - DNA, 20 bp, Artificial Sequence
  Description of Artificial Sequence: Synthetic oligonucleotide
  Target: ATXN1; (-) strand; PAM type: YTN; PAM sequence: TTT
ttccagggctgccattacaa

SEQ ID NO: 169561 - DNA, 20 bp, Artificial Sequence
  Description of Artificial Sequence: Synthetic oligonucleotide
  Target: ATXN1; (-) strand; PAM type: YTN; PAM sequence: CTG
taatatttttccagggctgc

SEQ ID NO: 169562 - DNA, 20 bp, Artificial Sequence
  Description of Artificial Sequence: Synthetic oligonucleotide
  Target: ATXN1; (-) strand; PAM type: YTN; PAM sequence: TTA
tatgcctgtaatatttttcc

SEQ ID NO: 169563 - DNA, 20 bp, Artificial Sequence
  Description of Artificial Sequence: Synthetic oligonucleotide
  Target: ATXN1; (-) strand; PAM type: YTN; PAM sequence: TTC
acacacaaacggcattatat

SEQ ID NO: 169564 - DNA, 20 bp, Artificial Sequence
  Description of Artificial Sequence: Synthetic oligonucleotide
  Target: ATXN1; (-) strand; PAM type: YTN; PAM sequence: CTT
cacacacaaacggcattata

SEQ ID NO: 169565 - DNA, 20 bp, Artificial Sequence
  Description of Artificial Sequence: Synthetic oligonucleotide
  Target: ATXN1; (-) strand; PAM type: YTN; PAM sequence: TTC
cttcacacacaaacggcatt

SEQ ID NO: 169566 - DNA, 20 bp, Artificial Sequence
  Description of Artificial Sequence: Synthetic oligonucleotide
  Target: ATXN1; (-) strand; PAM type: YTN; PAM sequence: CTG
gatgatgaagtcattccttc

SEQ ID NO: 169567 - DNA, 20 bp, Artificial Sequence
  Description of Artificial Sequence: Synthetic oligonucleotide
  Target: ATXN1; (-) strand; PAM type: YTN; PAM sequence: TTC
cagccactggatgatgaagt

SEQ ID NO: 169568 - DNA, 20 bp, Artificial Sequence
  Description of Artificial Sequence: Synthetic oligonucleotide
  Target: ATXN1; (-) strand; PAM type: YTN; PAM sequence: TTA
aattccagccactggatgat

SEQ ID NO: 169569 - DNA, 20 bp, Artificial Sequence
  Description of Artificial Sequence: Synthetic oligonucleotide
  Target: ATXN1; (-) strand; PAM type: YTN; PAM sequence: TTG
atagcatcacatcataatta

SEQ ID NO: 169570 - DNA, 20 bp, Artificial Sequence
  Description of Artificial Sequence: Synthetic oligonucleotide
  Target: ATXN1; (-) strand; PAM type: YTN; PAM sequence: TTG
ttgatagcatcacatcataa

SEQ ID NO: 169571 - DNA, 20 bp, Artificial Sequence
  Description of Artificial Sequence: Synthetic oligonucleotide
  Target: ATXN1; (-) strand; PAM type: YTN; PAM sequence: TTG
cagtcaggtgaggggcacaa

SEQ ID NO: 169572 - DNA, 20 bp, Artificial Sequence
  Description of Artificial Sequence: Synthetic oligonucleotide
  Target: ATXN1; (-) strand; PAM type: YTN; PAM sequence: TTT
gcagtcaggtgaggggcaca

SEQ ID NO: 169573 - DNA, 20 bp, Artificial Sequence
  Description of Artificial Sequence: Synthetic oligonucleotide
  Target: ATXN1; (-) strand; PAM type: YTN; PAM sequence: TTT
tgcagtcaggtgaggggcac

SEQ ID NO: 169574 - DNA, 20 bp, Artificial Sequence
  Description of Artificial Sequence: Synthetic oligonucleotide
  Target: ATXN1; (-) strand; PAM type: YTN; PAM sequence: TTG
caatgggaattttgcagtca

SEQ ID NO: 169575 - DNA, 20 bp, Artificial Sequence
  Description of Artificial Sequence: Synthetic oligonucleotide
  Target: ATXN1; (-) strand; PAM type: YTN; PAM sequence: CTT
gcaatgggaattttgcagtc

SEQ ID NO: 169576 - DNA, 20 bp, Artificial Sequence
  Description of Artificial Sequence: Synthetic oligonucleotide
  Target: ATXN1; (-) strand; PAM type: YTN; PAM sequence: TTA
acttgcaatgggaattttgc

SEQ ID NO: 169577 - DNA, 20 bp, Artificial Sequence
  Description of Artificial Sequence: Synthetic oligonucleotide
  Target: ATXN1; (-) strand; PAM type: YTN; PAM sequence: CTT
aacttgcaatgggaattttg

SEQ ID NO: 169578 - DNA, 20 bp, Artificial Sequence
  Description of Artificial Sequence: Synthetic oligonucleotide
  Target: ATXN1; (-) strand; PAM type: YTN; PAM sequence: CTG
tcttaacttgcaatgggaat

SEQ ID NO: 169579 - DNA, 20 bp, Artificial Sequence
  Description of Artificial Sequence: Synthetic oligonucleotide
  Target: ATXN1; (-) strand; PAM type: YTN; PAM sequence: CTG
tgtaaggcacctgtcttaac

SEQ ID NO: 169580 - DNA, 20 bp, Artificial Sequence
  Description of Artificial Sequence: Synthetic oligonucleotide
  Target: ATXN1; (-) strand; PAM type: YTN; PAM sequence: CTC
aggtcactgtgtaaggcacc

SEQ ID NO: 169581 - DNA, 20 bp, Artificial Sequence
  Description of Artificial Sequence: Synthetic oligonucleotide
  Target: ATXN1; (-) strand; PAM type: YTN; PAM sequence: CTG
gaagagaggcagctcaggtc

SEQ ID NO: 169582 - DNA, 20 bp, Artificial Sequence
  Description of Artificial Sequence: Synthetic oligonucleotide
  Target: ATXN1; (-) strand; PAM type: YTN; PAM sequence: TTC
tggaagagaggcagctcagg

SEQ ID NO: 169583 - DNA, 20 bp, Artificial Sequence
  Description of Artificial Sequence: Synthetic oligonucleotide
  Target: ATXN1; (-) strand; PAM type: YTN; PAM sequence: CTT
ctggaagagaggcagctcag

SEQ ID NO: 169584 - DNA, 20 bp, Artificial Sequence
  Description of Artificial Sequence: Synthetic oligonucleotide
  Target: ATXN1; (-) strand; PAM type: YTN; PAM sequence: TTG
tcccttctggaagagaggca

SEQ ID NO: 169585 - DNA, 20 bp, Artificial Sequence
  Description of Artificial Sequence: Synthetic oligonucleotide
  Target: ATXN1; (-) strand; PAM type: YTN; PAM sequence: CTG
gcagagttgtcccttctgga

SEQ ID NO: 169586 - DNA, 20 bp, Artificial Sequence
  Description of Artificial Sequence: Synthetic oligonucleotide
  Target: ATXN1; (-) strand; PAM type: YTN; PAM sequence: CTG
actggcagagttgtcccttc

SEQ ID NO: 169587 - DNA, 20 bp, Artificial Sequence
  Description of Artificial Sequence: Synthetic oligonucleotide
  Target: ATXN1; (-) strand; PAM type: YTN; PAM sequence: CTG
tggataacctgactggcaga

SEQ ID NO: 169588 - DNA, 20 bp, Artificial Sequence
  Description of Artificial Sequence: Synthetic oligonucleotide
  Target: ATXN1; (-) strand; PAM type: YTN; PAM sequence: TTC
actgtggataacctgactgg

SEQ ID NO: 169589 - DNA, 20 bp, Artificial Sequence
  Description of Artificial Sequence: Synthetic oligonucleotide
  Target: ATXN1; (-) strand; PAM type: YTN; PAM sequence: CTG
taatgttcactgtggataac

SEQ ID NO: 169590 - DNA, 20 bp, Artificial Sequence
  Description of Artificial Sequence: Synthetic oligonucleotide
  Target: ATXN1; (-) strand; PAM type: YTN; PAM sequence: CTG
ctgtaatgttcactgtggat

SEQ ID NO: 169591 - DNA, 20 bp, Artificial Sequence
  Description of Artificial Sequence: Synthetic oligonucleotide
  Target: ATXN1; (-) strand; PAM type: YTN; PAM sequence: CTG
agaaatagtggagtctgctg

SEQ ID NO: 169592 - DNA, 20 bp, Artificial Sequence
  Description of Artificial Sequence: Synthetic oligonucleotide
  Target: ATXN1; (-) strand; PAM type: YTN; PAM sequence: CTA
ccaaacgtagatacctgaga

SEQ ID NO: 169593 - DNA, 20 bp, Artificial Sequence
  Description of Artificial Sequence: Synthetic oligonucleotide
  Target: ATXN1; (-) strand; PAM type: YTN; PAM sequence: CTC
aaggagcaggagaagtatct

SEQ ID NO: 169594 - DNA, 20 bp, Artificial Sequence
  Description of Artificial Sequence: Synthetic oligonucleotide
  Target: ATXN1; (-) strand; PAM type: YTN; PAM sequence: TTC
tcaaggagcaggagaagtat

SEQ ID NO: 169595 - DNA, 20 bp, Artificial Sequence
  Description of Artificial Sequence: Synthetic oligonucleotide
  Target: ATXN1; (-) strand; PAM type: YTN; PAM sequence: CTT
ctcaaggagcaggagaagta

SEQ ID NO: 169596 - DNA, 20 bp, Artificial Sequence
  Description of Artificial Sequence: Synthetic oligonucleotide
  Target: ATXN1; (-) strand; PAM type: YTN; PAM sequence: CTG
gggacttctcaaggagcagg

SEQ ID NO: 169597 - DNA, 20 bp, Artificial Sequence
  Description of Artificial Sequence: Synthetic oligonucleotide
  Target: ATXN1; (-) strand; PAM type: YTN; PAM sequence: CTG
accactggggacttctcaag

SEQ ID NO: 169598 - DNA, 20 bp, Artificial Sequence
  Description of Artificial Sequence: Synthetic oligonucleotide
  Target: ATXN1; (-) strand; PAM type: YTN; PAM sequence: CTC
catgactgaccactggggac

SEQ ID NO: 169599 - DNA, 20 bp, Artificial Sequence
  Description of Artificial Sequence: Synthetic oligonucleotide
  Target: ATXN1; (-) strand; PAM type: YTN; PAM sequence: CTC
tccatgactgaccactgggg

SEQ ID NO: 169600 - DNA, 20 bp, Artificial Sequence
  Description of Artificial Sequence: Synthetic oligonucleotide
  Target: ATXN1; (-) strand; PAM type: YTN; PAM sequence: TTA
ataataactctccatgactg

SEQ ID NO: 169601 - DNA, 20 bp, Artificial Sequence
  Description of Artificial Sequence: Synthetic oligonucleotide
  Target: ATXN1; (-) strand; PAM type: YTN; PAM sequence: TTT
aataataactctccatgact

SEQ ID NO: 169602 - DNA, 20 bp, Artificial Sequence
  Description of Artificial Sequence: Synthetic oligonucleotide
  Target: ATXN1; (-) strand; PAM type: YTN; PAM sequence: CTT
taataataactctccatgac

SEQ ID NO: 169603 - DNA, 20 bp, Artificial Sequence
  Description of Artificial Sequence: Synthetic oligonucleotide
  Target: ATXN1; (-) strand; PAM type: YTN; PAM sequence: TTG
ggtactttaataataactct

SEQ ID NO: 169604 - DNA, 20 bp, Artificial Sequence
  Description of Artificial Sequence: Synthetic oligonucleotide
  Target: ATXN1; (-) strand; PAM type: YTN; PAM sequence: TTA
gattgggtactttaataata

SEQ ID NO: 169605 - DNA, 20 bp, Artificial Sequence
  Description of Artificial Sequence: Synthetic oligonucleotide
  Target: ATXN1; (-) strand; PAM type: YTN; PAM sequence: CTT
agattgggtactttaataat

SEQ ID NO: 169606 - DNA, 20 bp, Artificial Sequence
  Description of Artificial Sequence: Synthetic oligonucleotide
  Target: ATXN1; (-) strand; PAM type: YTN; PAM sequence: CTC
ttagattgggtactttaata

SEQ ID NO: 169607 - DNA, 20 bp, Artificial Sequence
  Description of Artificial Sequence: Synthetic oligonucleotide
  Target: ATXN1; (-) strand; PAM type: YTN; PAM sequence: CTA
taaatgtagacatacatcag

SEQ ID NO: 169608 - DNA, 20 bp, Artificial Sequence
  Description of Artificial Sequence: Synthetic oligonucleotide
  Target: ATXN1; (-) strand; PAM type: YTN; PAM sequence: CTA
aatctataaatgtagacata

SEQ ID NO: 169609 - DNA, 20 bp, Artificial Sequence
  Description of Artificial Sequence: Synthetic oligonucleotide
  Target: ATXN1; (-) strand; PAM type: YTN; PAM sequence: CTC
catgtctaaatctataaatg

SEQ ID NO: 169610 - DNA, 20 bp, Artificial Sequence
  Description of Artificial Sequence: Synthetic oligonucleotide
  Target: ATXN1; (-) strand; PAM type: YTN; PAM sequence: CTG
tataactccatgtctaaatc

SEQ ID NO: 169611 - DNA, 20 bp, Artificial Sequence
  Description of Artificial Sequence: Synthetic oligonucleotide
  Target: ATXN1; (-) strand; PAM type: YTN; PAM sequence: TTC
tgtataactccatgtctaaa

SEQ ID NO: 169612 - DNA, 20 bp, Artificial Sequence
  Description of Artificial Sequence: Synthetic oligonucleotide
  Target: ATXN1; (-) strand; PAM type: YTN; PAM sequence: TTC
attctgtataactccatgtc

SEQ ID NO: 169613 - DNA, 20 bp, Artificial Sequence
  Description of Artificial Sequence: Synthetic oligonucleotide
  Target: ATXN1; (-) strand; PAM type: YTN; PAM sequence: TTT
cattctgtataactccatgt

SEQ ID NO: 169614 - DNA, 20 bp, Artificial Sequence
  Description of Artificial Sequence: Synthetic oligonucleotide
  Target: ATXN1; (-) strand; PAM type: YTN; PAM sequence: CTT
tcattctgtataactccatg

SEQ ID NO: 169615 - DNA, 20 bp, Artificial Sequence
  Description of Artificial Sequence: Synthetic oligonucleotide
  Target: ATXN1; (-) strand; PAM type: YTN; PAM sequence: TTG
aataaactttcattctgtat

SEQ ID NO: 169616 - DNA, 20 bp, Artificial Sequence
  Description of Artificial Sequence: Synthetic oligonucleotide
  Target: ATXN1; (-) strand; PAM type: YTN; PAM sequence: TTT
gaataaactttcattctgta

SEQ ID NO: 169617 - DNA, 20 bp, Artificial Sequence
  Description of Artificial Sequence: Synthetic oligonucleotide
  Target: ATXN1; (-) strand; PAM type: YTN; PAM sequence: CTA
tttgaataaactttcattct

SEQ ID NO: 169618 - DNA, 20 bp, Artificial Sequence
  Description of Artificial Sequence: Synthetic oligonucleotide
  Target: ATXN1; (-) strand; PAM type: YTN; PAM sequence: TTA
tctatttgaataaactttca

SEQ ID NO: 169619 - DNA, 20 bp, Artificial Sequence
  Description of Artificial Sequence: Synthetic oligonucleotide
  Target: ATXN1; (-) strand; PAM type: YTN; PAM sequence: TTT
atctatttgaataaactttc

SEQ ID NO: 169620 - DNA, 20 bp, Artificial Sequence
  Description of Artificial Sequence: Synthetic oligonucleotide
  Target: ATXN1; (-) strand; PAM type: YTN; PAM sequence: TTT
tatctatttgaataaacttt

SEQ ID NO: 169621 - DNA, 20 bp, Artificial Sequence
  Description of Artificial Sequence: Synthetic oligonucleotide
  Target: ATXN1; (-) strand; PAM type: YTN; PAM sequence: TTT
ttatctatttgaataaactt

SEQ ID NO: 169622 - DNA, 20 bp, Artificial Sequence
  Description of Artificial Sequence: Synthetic oligonucleotide
  Target: ATXN1; (-) strand; PAM type: YTN; PAM sequence: TTG
ggatgtttttatctatttga

SEQ ID NO: 169623 - DNA, 20 bp, Artificial Sequence
  Description of Artificial Sequence: Synthetic oligonucleotide
  Target: ATXN1; (-) strand; PAM type: YTN; PAM sequence: TTT
gggatgtttttatctatttg

SEQ ID NO: 169624 - DNA, 20 bp, Artificial Sequence
  Description of Artificial Sequence: Synthetic oligonucleotide
  Target: ATXN1; (-) strand; PAM type: YTN; PAM sequence: TTC
aatttgggatgtttttatct

SEQ ID NO: 169625 - DNA, 20 bp, Artificial Sequence
  Description of Artificial Sequence: Synthetic oligonucleotide
  Target: ATXN1; (-) strand; PAM type: YTN; PAM sequence: CTT
caatttgggatgtttttatc

SEQ ID NO: 169626 - DNA, 20 bp, Artificial Sequence
  Description of Artificial Sequence: Synthetic oligonucleotide
  Target: ATXN1; (-) strand; PAM type: YTN; PAM sequence: TTA
gtggaacttcaatttgggat

SEQ ID NO: 169627 - DNA, 20 bp, Artificial Sequence
  Description of Artificial Sequence: Synthetic oligonucleotide
  Target: ATXN1; (-) strand; PAM type: YTN; PAM sequence: CTA
gttagtggaacttcaatttg

SEQ ID NO: 169628 - DNA, 20 bp, Artificial Sequence
  Description of Artificial Sequence: Synthetic oligonucleotide
  Target: ATXN1; (-) strand; PAM type: YTN; PAM sequence: TTA
ctagttagtggaacttcaat

SEQ ID NO: 169629 - DNA, 20 bp, Artificial Sequence
  Description of Artificial Sequence: Synthetic oligonucleotide
  Target: ATXN1; (-) strand; PAM type: YTN; PAM sequence: CTA
atagccaattactagttagt

SEQ ID NO: 169630 - DNA, 20 bp, Artificial Sequence
  Description of Artificial Sequence: Synthetic oligonucleotide
  Target: ATXN1; (-) strand; PAM type: YTN; PAM sequence: TTA
ctaatagccaattactagtt

SEQ ID NO: 169631 - DNA, 20 bp, Artificial Sequence
  Description of Artificial Sequence: Synthetic oligonucleotide
  Target: ATXN1; (-) strand; PAM type: YTN; PAM sequence: TTG
ggtagaattactaatagcca

SEQ ID NO: 169632 - DNA, 20 bp, Artificial Sequence
  Description of Artificial Sequence: Synthetic oligonucleotide
  Target: ATXN1; (-) strand; PAM type: YTN; PAM sequence: TTT
gggtagaattactaatagcc

SEQ ID NO: 169633 - DNA, 20 bp, Artificial Sequence
  Description of Artificial Sequence: Synthetic oligonucleotide
  Target: ATXN1; (-) strand; PAM type: YTN; PAM sequence: TTT
tgggtagaattactaatagc

SEQ ID NO: 169634 - DNA, 20 bp, Artificial Sequence
  Description of Artificial Sequence: Synthetic oligonucleotide
  Target: ATXN1; (-) strand; PAM type: YTN; PAM sequence: TTG
ttttgggtagaattactaat

SEQ ID NO: 169635 - DNA, 20 bp, Artificial Sequence
  Description of Artificial Sequence: Synthetic oligonucleotide
  Target: ATXN1; (-) strand; PAM type: YTN; PAM sequence: TTT
gttttgggtagaattactaa

SEQ ID NO: 169636 - DNA, 20 bp, Artificial Sequence
  Description of Artificial Sequence: Synthetic oligonucleotide
  Target: ATXN1; (-) strand; PAM type: YTN; PAM sequence: TTA
atttgttttgggtagaatta

SEQ ID NO: 169637 - DNA, 20 bp, Artificial Sequence
  Description of Artificial Sequence: Synthetic oligonucleotide
  Target: ATXN1; (-) strand; PAM type: YTN; PAM sequence: TTA
ttaatttgttttgggtagaa

SEQ ID NO: 169638 - DNA, 20 bp, Artificial Sequence
  Description of Artificial Sequence: Synthetic oligonucleotide
  Target: ATXN1; (-) strand; PAM type: YTN; PAM sequence: CTG
gcccaaatgaattattaatt

SEQ ID NO: 169639 - DNA, 20 bp, Artificial Sequence
  Description of Artificial Sequence: Synthetic oligonucleotide
  Target: ATXN1; (-) strand; PAM type: YTN; PAM sequence: TTA
gagccataagccaccaggcc

SEQ ID NO: 169640 - DNA, 20 bp, Artificial Sequence
  Description of Artificial Sequence: Synthetic oligonucleotide
  Target: ATXN1; (-) strand; PAM type: YTN; PAM sequence: CTG
agattagagccataagccac

SEQ ID NO: 169641 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgagattagag

SEQ ID NO: 169642 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgagat

SEQ ID NO: 169643 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctgaga

SEQ ID NO: 169644 - DNA, 20 bp, Artificial Sequence
  Description of Artificial Sequence: Synthetic oligonucleotide
  Target: ATXN1; (-) strand; PAM type: YTN; PAM sequence: CTG
ccttggcctcccaaagtgct

SEQ ID NO: 169645 - DNA, 20 bp, Artificial Sequence
  Description of Artificial Sequence: Synthetic oligonucleotide
  Target: ATXN1; (-) strand; PAM type: YTN; PAM sequence: CTC
ctgccttggcctcccaaagt

SEQ ID NO: 169646 - DNA, 20 bp, Artificial Sequence
  Description of Artificial Sequence: Synthetic oligonucleotide
  Target: ATXN1; (-) strand; PAM type: YTN; PAM sequence: CTC
aagggatcctcctgccttgg

SEQ ID NO: 169647 - DNA, 20 bp, Artificial Sequence
  Description of Artificial Sequence: Synthetic oligonucleotide
  Target: ATXN1; (-) strand; PAM type: YTN; PAM sequence: CTG
gcctcaagggatcctcctgc

SEQ ID NO: 169648 - DNA, 20 bp, Artificial Sequence
  Description of Artificial Sequence: Synthetic oligonucleotide
  Target: ATXN1; (-) strand; PAM type: YTN; PAM sequence: CTC
ctggcctcaagggatcctcc

SEQ ID NO: 169649 - DNA, 20 bp, Artificial Sequence
  Description of Artificial Sequence: Synthetic oligonucleotide
  Target: ATXN1; (-) strand; PAM type: YTN; PAM sequence: TTA
aactcctggcctcaagggat

SEQ ID NO: 169650 - DNA, 20 bp, Artificial Sequence
  Description of Artificial Sequence: Synthetic oligonucleotide
  Target: ATXN1; (-) strand; PAM type: YTN; PAM sequence: CTT
aaactcctggcctcaaggga

SEQ ID NO: 169651 - DNA, 20 bp, Artificial Sequence
  Description of Artificial Sequence: Synthetic oligonucleotide
  Target: ATXN1; (-) strand; PAM type: YTN; PAM sequence: CTG
gtcttaaactcctggcctca

SEQ ID NO: 169652 - DNA, 20 bp, Artificial Sequence
  Description of Artificial Sequence: Synthetic oligonucleotide
  Target: ATXN1; (-) strand; PAM type: YTN; PAM sequence: TTG
cccaggctggtcttaaactc

SEQ ID NO: 169653 - DNA, 20 bp, Artificial Sequence
  Description of Artificial Sequence: Synthetic oligonucleotide
  Target: ATXN1; (-) strand; PAM type: YTN; PAM sequence: CTA
tgttgcccaggctggtctta

SEQ ID NO: 169654 - DNA, 20 bp, Artificial Sequence
  Description of Artificial Sequence: Synthetic oligonucleotide
  Target: ATXN1; (-) strand; PAM type: YTN; PAM sequence: TTG
ctatgttgcccaggctggtc

SEQ ID NO: 169655 - DNA, 20 bp, Artificial Sequence
  Description of Artificial Sequence: Synthetic oligonucleotide
  Target: ATXN1; (-) strand; PAM type: YTN; PAM sequence: CTT
gctatgttgcccaggctggt

SEQ ID NO: 169656 - DNA, 20 bp, Artificial Sequence
  Description of Artificial Sequence: Synthetic oligonucleotide
  Target: ATXN1; (-) strand; PAM type: YTN; PAM sequence: TTG
tatagatggggtcttgctat

SEQ ID NO: 169657 - DNA, 20 bp, Artificial Sequence
  Description of Artificial Sequence: Synthetic oligonucleotide
  Target: ATXN1; (-) strand; PAM type: YTN; PAM sequence: CTT
gtatagatggggtcttgcta

SEQ ID NO: 169658 - DNA, 20 bp, Artificial Sequence
  Description of Artificial Sequence: Synthetic oligonucleotide
  Target: ATXN1; (-) strand; PAM type: YTN; PAM sequence: TTC
ttgtatagatggggtcttgc

SEQ ID NO: 169659 - DNA, 20 bp, Artificial Sequence
  Description of Artificial Sequence: Synthetic oligonucleotide
  Target: ATXN1; (-) strand; PAM type: YTN; PAM sequence: CTT
cttgtatagatggggtcttg

SEQ ID NO: 169660 - DNA, 20 bp, Artificial Sequence
  Description of Artificial Sequence: Synthetic oligonucleotide
  Target: ATXN1; (-) strand; PAM type: YTN; PAM sequence: TTA
agcttcttgtatagatgggg

SEQ ID NO: 169661 - DNA, 20 bp, Artificial Sequence
  Description of Artificial Sequence: Synthetic oligonucleotide
  Target: ATXN1; (-) strand; PAM type: YTN; PAM sequence: TTT
aagcttcttgtatagatggg

SEQ ID NO: 169662 - DNA, 20 bp, Artificial Sequence
  Description of Artificial Sequence: Synthetic oligonucleotide
  Target: ATXN1; (-) strand; PAM type: YTN; PAM sequence: TTT
taagcttcttgtatagatgg

SEQ ID NO: 169663 - DNA, 20 bp, Artificial Sequence
  Description of Artificial Sequence: Synthetic oligonucleotide
  Target: ATXN1; (-) strand; PAM type: YTN; PAM sequence: TTT
ttaagcttcttgtatagatg

SEQ ID NO: 169664 - DNA, 20 bp, Artificial Sequence
  Description of Artificial Sequence: Synthetic oligonucleotide
  Target: ATXN1; (-) strand; PAM type: YTN; PAM sequence: TTT
tttaagcttcttgtatagat

SEQ ID NO: 169665 - DNA, 20 bp, Artificial Sequence
  Description of Artificial Sequence: Synthetic oligonucleotide
  Target: ATXN1; (-) strand; PAM type: YTN; PAM sequence: TTT
ttttaagcttcttgtataga

SEQ ID NO: 169666 - DNA, 20 bp, Artificial Sequence
  Description of Artificial Sequence: Synthetic oligonucleotide
  Target: ATXN1; (-) strand; PAM type: YTN; PAM sequence: CTA
tttttttaagcttcttgtat

SEQ ID NO: 169667 - DNA, 20 bp, Artificial Sequence
  Description of Artificial Sequence: Synthetic oligonucleotide
  Target: ATXN1; (-) strand; PAM type: YTN; PAM sequence: CTG
gctatttttttaagcttctt

SEQ ID NO: 169668 - DNA, 20 bp, Artificial Sequence
  Description of Artificial Sequence: Synthetic oligonucleotide
  Target: ATXN1; (-) strand; PAM type: YTN; PAM sequence: CTG
cctggctatttttttaagct

SEQ ID NO: 169669 - DNA, 20 bp, Artificial Sequence
  Description of Artificial Sequence: Synthetic oligonucleotide
  Target: ATXN1; (-) strand; PAM type: YTN; PAM sequence: CTC
ctgcctggctatttttttaa

SEQ ID NO: 169670 - DNA, 20 bp, Artificial Sequence
  Description of Artificial Sequence: Synthetic oligonucleotide
  Target: ATXN1; (-) strand; PAM type: YTN; PAM sequence: TTC
tcctgcctggctattttttt

SEQ ID NO: 169671 - DNA, 20 bp, Artificial Sequence
  Description of Artificial Sequence: Synthetic oligonucleotide
  Target: ATXN1; (-) strand; PAM type: YTN; PAM sequence: TTC
acaccattctcctgcctggc

SEQ ID NO: 169672 - DNA, 20 bp, Artificial Sequence
  Description of Artificial Sequence: Synthetic oligonucleotide
  Target: ATXN1; (-) strand; PAM type: YTN; PAM sequence: CTC
ccaggttcacaccattctcc

SEQ ID NO: 169673 - DNA, 20 bp, Artificial Sequence
  Description of Artificial Sequence: Synthetic oligonucleotide
  Target: ATXN1; (-) strand; PAM type: YTN; PAM sequence: CTC
cgcctcccaggttcacacca

SEQ ID NO: 169674 - DNA, 20 bp, Artificial Sequence
  Description of Artificial Sequence: Synthetic oligonucleotide
  Target: ATXN1; (-) strand; PAM type: YTN; PAM sequence: CTG
caagctccgcctcccaggtt

SEQ ID NO: 169675 - DNA, 20 bp, Artificial Sequence
  Description of Artificial Sequence: Synthetic oligonucleotide
  Target: ATXN1; (-) strand; PAM type: YTN; PAM sequence: CTC
actgcaagctccgcctccca

SEQ ID NO: 169676 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtagtgtgatccc

SEQ ID NO: 169677 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtgcagtag

SEQ ID NO: 169678 - DNA, 20 bp, Artificial Sequence
  Description of Artificial Sequence: Synthetic oligonucleotide
  Target: ATXN1; (-) strand; PAM type: YTN; PAM sequence: CTG
ttgcccaggctggagtgcag

SEQ ID NO: 169679 - DNA, 20 bp, Artificial Sequence
  Description of Artificial Sequence: Synthetic oligonucleotide
  Target: ATXN1; (-) strand; PAM type: YTN; PAM sequence: CTC
tgttgcccaggctggagtgc

SEQ ID NO: 169680 - DNA, 20 bp, Artificial Sequence
  Description of Artificial Sequence: Synthetic oligonucleotide
  Target: ATXN1; (-) strand; PAM type: YTN; PAM sequence: CTC
gctctgttgcccaggctgga

SEQ ID NO: 169681 - DNA, 20 bp, Artificial Sequence
  Description of Artificial Sequence: Synthetic oligonucleotide
  Target: ATXN1; (-) strand; PAM type: YTN; PAM sequence: TTG
agatggaatctcgctctgtt

SEQ ID NO: 169682 - DNA, 20 bp, Artificial Sequence
  Description of Artificial Sequence: Synthetic oligonucleotide
  Target: ATXN1; (-) strand; PAM type: YTN; PAM sequence: TTT
gagatggaatctcgctctgt

SEQ ID NO: 169683 - DNA, 20 bp, Artificial Sequence
  Description of Artificial Sequence: Synthetic oligonucleotide
  Target: ATXN1; (-) strand; PAM type: YTN; PAM sequence: TTT
tgagatggaatctcgctctg

SEQ ID NO: 169684 - DNA, 20 bp, Artificial Sequence
  Description of Artificial Sequence: Synthetic oligonucleotide
  Target: ATXN1; (-) strand; PAM type: YTN; PAM sequence: TTT
ttgagatggaatctcgctct

SEQ ID NO: 169685 - DNA, 20 bp, Artificial Sequence
  Description of Artificial Sequence: Synthetic oligonucleotide
  Target: ATXN1; (-) strand; PAM type: YTN; PAM sequence: TTT
tttgagatggaatctcgctc

SEQ ID NO: 169686 - DNA, 20 bp, Artificial Sequence
  Description of Artificial Sequence: Synthetic oligonucleotide
  Target: ATXN1; (-) strand; PAM type: YTN; PAM sequence: TTT
ttttgagatggaatctcgct

SEQ ID NO: 169687 - DNA, 20 bp, Artificial Sequence
  Description of Artificial Sequence: Synthetic oligonucleotide
  Target: ATXN1; (-) strand; PAM type: YTN; PAM sequence: TTT
tttttgagatggaatctcgc

SEQ ID NO: 169688 - DNA, 20 bp, Artificial Sequence
  Description of Artificial Sequence: Synthetic oligonucleotide
  Target: ATXN1; (-) strand; PAM type: YTN; PAM sequence: TTT
ttttttgagatggaatctcg

SEQ ID NO: 169689 - DNA, 20 bp, Artificial Sequence
  Description of Artificial Sequence: Synthetic oligonucleotide
  Target: ATXN1; (-) strand; PAM type: YTN; PAM sequence: TTT
tttttttgagatggaatctc

SEQ ID NO: 169690 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagatggaatct

SEQ ID NO: 169691 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagatggaatc

SEQ ID NO: 169692 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagatggaat

SEQ ID NO: 169693 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagatggaa

SEQ ID NO: 169694 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagatgga

SEQ ID NO: 169695 - DNA, 20 bp, Artificial Sequence
  Description of Artificial Sequence: Synthetic oligonucleotide
  Target: ATXN1; (-) strand; PAM type: YTN; PAM sequence: CTG
ggtatttttttttttttttg

SEQ ID NO: 169696 - DNA, 20 bp, Artificial Sequence
  Description of Artificial Sequence: Synthetic oligonucleotide
  Target: ATXN1; (-) strand; PAM type: YTN; PAM sequence: CTA
taagtgcacaccaccgtacc

SEQ ID NO: 169697 - DNA, 20 bp, Artificial Sequence
  Description of Artificial Sequence: Synthetic oligonucleotide
  Target: ATXN1; (-) strand; PAM type: YTN; PAM sequence: CTG
ggactataagtgcacaccac

SEQ ID NO: 169698 - DNA, 20 bp, Artificial Sequence
  Description of Artificial Sequence: Synthetic oligonucleotide
  Target: ATXN1; (-) strand; PAM type: YTN; PAM sequence: TTG
ctgggactataagtgcacac

SEQ ID NO: 169699 - DNA, 20 bp, Artificial Sequence
  Description of Artificial Sequence: Synthetic oligonucleotide
  Target: ATXN1; (-) strand; PAM type: YTN; PAM sequence: CTC
ccaagttgctgggactataa

SEQ ID NO: 169700 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagttgctggga

SEQ ID NO: 169701 - DNA, 20 bp, Artificial Sequence
  Description of Artificial Sequence: Synthetic oligonucleotide
  Target: ATXN1; (-) strand; PAM type: YTN; PAM sequence: TTC
cacctcagcctcccaagttg

SEQ ID NO: 169702 - DNA, 20 bp, Artificial Sequence
  Description of Artificial Sequence: Synthetic oligonucleotide
  Target: ATXN1; (-) strand; PAM type: YTN; PAM sequence: CTT
ccacctcagcctcccaagtt

SEQ ID NO: 169703 - DNA, 20 bp, Artificial Sequence
  Description of Artificial Sequence: Synthetic oligonucleotide
  Target: ATXN1; (-) strand; PAM type: YTN; PAM sequence: CTG
ggcccaagtgatgcttccac

SEQ ID NO: 169704 - DNA, 20 bp, Artificial Sequence
  Description of Artificial Sequence: Synthetic oligonucleotide
  Target: ATXN1; (-) strand; PAM type: YTN; PAM sequence: TTC
tgggcccaagtgatgcttcc

SEQ ID NO: 169705 - DNA, 20 bp, Artificial Sequence
  Description of Artificial Sequence: Synthetic oligonucleotide
  Target: ATXN1; (-) strand; PAM type: YTN; PAM sequence: CTT
ctgggcccaagtgatgcttc

SEQ ID NO: 169706 - DNA, 20 bp, Artificial Sequence
  Description of Artificial Sequence: Synthetic oligonucleotide
  Target: ATXN1; (-) strand; PAM type: YTN; PAM sequence: CTC
aaacttctgggcccaagtga

SEQ ID NO: 169707 - DNA, 20 bp, Artificial Sequence
  Description of Artificial Sequence: Synthetic oligonucleotide
  Target: ATXN1; (-) strand; PAM type: YTN; PAM sequence: CTG
catcctcaaacttctgggcc

SEQ ID NO: 169708 - DNA, 20 bp, Artificial Sequence
  Description of Artificial Sequence: Synthetic oligonucleotide
  Target: ATXN1; (-) strand; PAM type: YTN; PAM sequence: CTC
actgcatcctcaaacttctg

SEQ ID NO: 169709 - DNA, 20 bp, Artificial Sequence
  Description of Artificial Sequence: Synthetic oligonucleotide
  Target: ATXN1; (-) strand; PAM type: YTN; PAM sequence: CTG
gcacgatcatagctcactgc

SEQ ID NO: 169710 - DNA, 20 bp, Artificial Sequence
  Description of Artificial Sequence: Synthetic oligonucleotide
  Target: ATXN1; (-) strand; PAM type: YTN; PAM sequence: CTG
gagagcactggcacgatcat

SEQ ID NO: 169711 - DNA, 20 bp, Artificial Sequence
  Description of Artificial Sequence: Synthetic oligonucleotide
  Target: ATXN1; (-) strand; PAM type: YTN; PAM sequence: TTG
tcacccaggctggagagcac

SEQ ID NO: 169712 - DNA, 20 bp, Artificial Sequence
  Description of Artificial Sequence: Synthetic oligonucleotide
  Target: ATXN1; (-) strand; PAM type: YTN; PAM sequence: CTT
gtcacccaggctggagagca

SEQ ID NO: 169713 - DNA, 20 bp, Artificial Sequence
  Description of Artificial Sequence: Synthetic oligonucleotide
  Target: ATXN1; (-) strand; PAM type: YTN; PAM sequence: CTC
ttgtcacccaggctggagag

SEQ ID NO: 169714 - DNA, 20 bp, Artificial Sequence
  Description of Artificial Sequence: Synthetic oligonucleotide
  Target: ATXN1; (-) strand; PAM type: YTN; PAM sequence: CTC
actcttgtcacccaggctgg

SEQ ID NO: 169715 - DNA, 20 bp, Artificial Sequence
  Description of Artificial Sequence: Synthetic oligonucleotide
  Target: ATXN1; (-) strand; PAM type: YTN; PAM sequence: TTA
gggagagagtctcactcttg

SEQ ID NO: 169716 - DNA, 20 bp, Artificial Sequence
  Description of Artificial Sequence: Synthetic oligonucleotide
  Target: ATXN1; (-) strand; PAM type: YTN; PAM sequence: TTT
agggagagagtctcactctt

SEQ ID NO: 169717 - DNA, 20 bp, Artificial Sequence
  Description of Artificial Sequence: Synthetic oligonucleotide
  Target: ATXN1; (-) strand; PAM type: YTN; PAM sequence: CTT
tagggagagagtctcactct

SEQ ID NO: 169718 - DNA, 20 bp, Artificial Sequence
  Description of Artificial Sequence: Synthetic oligonucleotide
  Target: ATXN1; (-) strand; PAM type: YTN; PAM sequence: TTC
tttagggagagagtctcact

SEQ ID NO: 169719 - DNA, 20 bp, Artificial Sequence
  Description of Artificial Sequence: Synthetic oligonucleotide
  Target: ATXN1; (-) strand; PAM type: YTN; PAM sequence: TTT
ctttagggagagagtctcac

SEQ ID NO: 169720 - DNA, 20 bp, Artificial Sequence
  Description of Artificial Sequence: Synthetic oligonucleotide
  Target: ATXN1; (-) strand; PAM type: YTN; PAM sequence: TTT
tctttagggagagagtctca

SEQ ID NO: 169721 - DNA, 20 bp, Artificial Sequence
  Description of Artificial Sequence: Synthetic oligonucleotide
  Target: ATXN1; (-) strand; PAM type: YTN; PAM sequence: CTT
ttctttagggagagagtctc

SEQ ID NO: 169722 - DNA, 20 bp, Artificial Sequence
  Description of Artificial Sequence: Synthetic oligonucleotide
  Target: ATXN1; (-) strand; PAM type: YTN; PAM sequence: TTC
ttttctttagggagagagtc

SEQ ID NO: 169723 - DNA, 20 bp, Artificial Sequence
  Description of Artificial Sequence: Synthetic oligonucleotide
  Target: ATXN1; (-) strand; PAM type: YTN; PAM sequence: TTT
cttttctttagggagagagt

SEQ ID NO: 169724 - DNA, 20 bp, Artificial Sequence
  Description of Artificial Sequence: Synthetic oligonucleotide
  Target: ATXN1; (-) strand; PAM type: YTN; PAM sequence: TTT
tcttttctttagggagagag

SEQ ID NO: 169725 - DNA, 20 bp, Artificial Sequence
  Description of Artificial Sequence: Synthetic oligonucleotide
  Target: ATXN1; (-) strand; PAM type: YTN; PAM sequence: TTT
ttcttttctttagggagaga

SEQ ID NO: 169726 - DNA, 20 bp, Artificial Sequence
  Description of Artificial Sequence: Synthetic oligonucleotide
  Target: ATXN1; (-) strand; PAM type: YTN; PAM sequence: CTT
tttcttttctttagggagag

SEQ ID NO: 169727 - DNA, 20 bp, Artificial Sequence
  Description of Artificial Sequence: Synthetic oligonucleotide
  Target: ATXN1; (-) strand; PAM type: YTN; PAM sequence: TTC
tttttcttttctttagggag

SEQ ID NO: 169728 - DNA, 20 bp, Artificial Sequence
  Description of Artificial Sequence: Synthetic oligonucleotide
  Target: ATXN1; (-) strand; PAM type: YTN; PAM sequence: TTC
caagggaattctttttcttt

SEQ ID NO: 169729 - DNA, 20 bp, Artificial Sequence
  Description of Artificial Sequence: Synthetic oligonucleotide
  Target: ATXN1; (-) strand; PAM type: YTN; PAM sequence: CTT
ccaagggaattctttttctt

SEQ ID NO: 169730 - DNA, 20 bp, Artificial Sequence
  Description of Artificial Sequence: Synthetic oligonucleotide
  Target: ATXN1; (-) strand; PAM type: YTN; PAM sequence: CTA
aaaaagcaaaaccttccaag

SEQ ID NO: 169731 - DNA, 20 bp, Artificial Sequence
  Description of Artificial Sequence: Synthetic oligonucleotide
  Target: ATXN1; (-) strand; PAM type: YTN; PAM sequence: TTC
taaaaaagcaaaaccttcca

SEQ ID NO: 169732 - DNA, 20 bp, Artificial Sequence
  Description of Artificial Sequence: Synthetic oligonucleotide
  Target: ATXN1; (-) strand; PAM type: YTN; PAM sequence: TTT
ctaaaaaagcaaaaccttcc

SEQ ID NO: 169733 - DNA, 20 bp, Artificial Sequence
  Description of Artificial Sequence: Synthetic oligonucleotide
  Target: ATXN1; (-) strand; PAM type: YTN; PAM sequence: TTA
tttctaaaaaagcaaaacct

SEQ ID NO: 169734 - DNA, 20 bp, Artificial Sequence
  Description of Artificial Sequence: Synthetic oligonucleotide
  Target: ATXN1; (-) strand; PAM type: YTN; PAM sequence: CTT
atttctaaaaaagcaaaacc

SEQ ID NO: 169735 - DNA, 20 bp, Artificial Sequence
  Description of Artificial Sequence: Synthetic oligonucleotide
  Target: ATXN1; (-) strand; PAM type: YTN; PAM sequence: CTA
atcttatttctaaaaaagca

SEQ ID NO: 169736 - DNA, 20 bp, Artificial Sequence
  Description of Artificial Sequence: Synthetic oligonucleotide
  Target: ATXN1; (-) strand; PAM type: YTN; PAM sequence: TTA
gctaatcttatttctaaaaa

SEQ ID NO: 169737 - DNA, 20 bp, Artificial Sequence
  Description of Artificial Sequence: Synthetic oligonucleotide
  Target: ATXN1; (-) strand; PAM type: YTN; PAM sequence: CTT
agctaatcttatttctaaaa

SEQ ID NO: 169738 - DNA, 20 bp, Artificial Sequence
  Description of Artificial Sequence: Synthetic oligonucleotide
  Target: ATXN1; (-) strand; PAM type: YTN; PAM sequence: TTC
ttagctaatcttatttctaa

SEQ ID NO: 169739 - DNA, 20 bp, Artificial Sequence
  Description of Artificial Sequence: Synthetic oligonucleotide
  Target: ATXN1; (-) strand; PAM type: YTN; PAM sequence: TTT
cttagctaatcttatttcta

SEQ ID NO: 169740 - DNA, 20 bp, Artificial Sequence
  Description of Artificial Sequence: Synthetic oligonucleotide
  Target: ATXN1; (-) strand; PAM type: YTN; PAM sequence: TTT
tcttagctaatcttatttct

SEQ ID NO: 169741 - DNA, 20 bp, Artificial Sequence
  Description of Artificial Sequence: Synthetic oligonucleotide
  Target: ATXN1; (-) strand; PAM type: YTN; PAM sequence: TTA
attttcttagctaatcttat

SEQ ID NO: 169742 - DNA, 20 bp, Artificial Sequence
  Description of Artificial Sequence: Synthetic oligonucleotide
  Target: ATXN1; (-) strand; PAM type: YTN; PAM sequence: TTA
ttaattttcttagctaatct

SEQ ID NO: 169743 - DNA, 20 bp, Artificial Sequence
  Description of Artificial Sequence: Synthetic oligonucleotide
  Target: ATXN1; (-) strand; PAM type: YTN; PAM sequence: TTG
cattattaattttcttagct

SEQ ID NO: 169744 - DNA, 20 bp, Artificial Sequence
  Description of Artificial Sequence: Synthetic oligonucleotide
  Target: ATXN1; (-) strand; PAM type: YTN; PAM sequence: TTT
gcattattaattttcttagc

SEQ ID NO: 169745 - DNA, 20 bp, Artificial Sequence
  Description of Artificial Sequence: Synthetic oligonucleotide
  Target: ATXN1; (-) strand; PAM type: YTN; PAM sequence: CTT
tgcattattaattttcttag

SEQ ID NO: 169746 - DNA, 20 bp, Artificial Sequence
  Description of Artificial Sequence: Synthetic oligonucleotide
  Target: ATXN1; (-) strand; PAM type: YTN; PAM sequence: TTC
tttgcattattaattttctt

SEQ ID NO: 169747 - DNA, 20 bp, Artificial Sequence
  Description of Artificial Sequence: Synthetic oligonucleotide
  Target: ATXN1; (-) strand; PAM type: YTN; PAM sequence: CTT
ctttgcattattaattttct

SEQ ID NO: 169748 - DNA, 20 bp, Artificial Sequence
  Description of Artificial Sequence: Synthetic oligonucleotide
  Target: ATXN1; (-) strand; PAM type: YTN; PAM sequence: CTA
acttctttgcattattaatt

SEQ ID NO: 169749 - DNA, 20 bp, Artificial Sequence
  Description of Artificial Sequence: Synthetic oligonucleotide
  Target: ATXN1; (-) strand; PAM type: YTN; PAM sequence: CTC
accccacccacccctaactt

SEQ ID NO: 169750 - DNA, 20 bp, Artificial Sequence
  Description of Artificial Sequence: Synthetic oligonucleotide
  Target: ATXN1; (-) strand; PAM type: YTN; PAM sequence: CTC
tcaccccacccacccctaac

SEQ ID NO: 169751 - DNA, 20 bp, Artificial Sequence
  Description of Artificial Sequence: Synthetic oligonucleotide
  Target: ATXN1; (-) strand; PAM type: YTN; PAM sequence: TTC
tctcaccccacccaccccta

SEQ ID NO: 169752 - DNA, 20 bp, Artificial Sequence
  Description of Artificial Sequence: Synthetic oligonucleotide
  Target: ATXN1; (-) strand; PAM type: YTN; PAM sequence: CTG
ttctctcaccccacccaccc

SEQ ID NO: 169753 - DNA, 20 bp, Artificial Sequence
  Description of Artificial Sequence: Synthetic oligonucleotide
  Target: ATXN1; (-) strand; PAM type: YTN; PAM sequence: TTC
ctgttctctcaccccaccca

SEQ ID NO: 169754 - DNA, 20 bp, Artificial Sequence
  Description of Artificial Sequence: Synthetic oligonucleotide
  Target: ATXN1; (-) strand; PAM type: YTN; PAM sequence: TTA
aatattcctgttctctcacc

SEQ ID NO: 169755 - DNA, 20 bp, Artificial Sequence
  Description of Artificial Sequence: Synthetic oligonucleotide
  Target: ATXN1; (-) strand; PAM type: YTN; PAM sequence: TTT
aaatattcctgttctctcac

SEQ ID NO: 169756 - DNA, 20 bp, Artificial Sequence
  Description of Artificial Sequence: Synthetic oligonucleotide
  Target: ATXN1; (-) strand; PAM type: YTN; PAM sequence: TTA
aaaaaatagtttaaatattc

SEQ ID NO: 169757 - DNA, 20 bp, Artificial Sequence
  Description of Artificial Sequence: Synthetic oligonucleotide
  Target: ATXN1; (-) strand; PAM type: YTN; PAM sequence: TTT
aaaaaaatagtttaaatatt

SEQ ID NO: 169758 - DNA, 20 bp, Artificial Sequence
  Description of Artificial Sequence: Synthetic oligonucleotide
  Target: ATXN1; (-) strand; PAM type: YTN; PAM sequence: TTG
gatttaaaaaaatagtttaa

SEQ ID NO: 169759 - DNA, 20 bp, Artificial Sequence
  Description of Artificial Sequence: Synthetic oligonucleotide
  Target: ATXN1; (-) strand; PAM type: YTN; PAM sequence: TTT
ggatttaaaaaaatagttta

SEQ ID NO: 169760 - DNA, 20 bp, Artificial Sequence
  Description of Artificial Sequence: Synthetic oligonucleotide
  Target: ATXN1; (-) strand; PAM type: YTN; PAM sequence: TTT
tggatttaaaaaaatagttt

SEQ ID NO: 169761 - DNA, 20 bp, Artificial Sequence
  Description of Artificial Sequence: Synthetic oligonucleotide
  Target: ATXN1; (-) strand; PAM type: YTN; PAM sequence: TTA
aaacaattttggatttaaaa

SEQ ID NO: 169762 - DNA, 20 bp, Artificial Sequence
  Description of Artificial Sequence: Synthetic oligonucleotide
  Target: ATXN1; (-) strand; PAM type: YTN; PAM sequence: TTT
aaaacaattttggatttaaa

SEQ ID NO: 169763 - DNA, 20 bp, Artificial Sequence
  Description of Artificial Sequence: Synthetic oligonucleotide
  Target: ATXN1; (-) strand; PAM type: YTN; PAM sequence: TTT
taaaacaattttggatttaa

SEQ ID NO: 169764 - DNA, 20 bp, Artificial Sequence
  Description of Artificial Sequence: Synthetic oligonucleotide
  Target: ATXN1; (-) strand; PAM type: YTN; PAM sequence: CTA
ttttaaaacaattttggatt

SEQ ID NO: 169765 - DNA, 20 bp, Artificial Sequence
  Description of Artificial Sequence: Synthetic oligonucleotide
  Target: ATXN1; (-) strand; PAM type: YTN; PAM sequence: TTA
tggaggaatggaaatgggat

SEQ ID NO: 169766 - DNA, 20 bp, Artificial Sequence
  Description of Artificial Sequence: Synthetic oligonucleotide
  Target: ATXN1; (-) strand; PAM type: YTN; PAM sequence: TTG
ttatggaggaatggaaatgg

SEQ ID NO: 169767 - DNA, 20 bp, Artificial Sequence
  Description of Artificial Sequence: Synthetic oligonucleotide
  Target: ATXN1; (-) strand; PAM type: YTN; PAM sequence: TTC
attgttatggaggaatggaa

SEQ ID NO: 169768 - DNA, 20 bp, Artificial Sequence
  Description of Artificial Sequence: Synthetic oligonucleotide
  Target: ATXN1; (-) strand; PAM type: YTN; PAM sequence: CTT
cattgttatggaggaatgga

SEQ ID NO: 169769 - DNA, 20 bp, Artificial Sequence
  Description of Artificial Sequence: Synthetic oligonucleotide
  Target: ATXN1; (-) strand; PAM type: YTN; PAM sequence: TTG
aaagtcagcatcttcattgt

SEQ ID NO: 169770 - DNA, 20 bp, Artificial Sequence
  Description of Artificial Sequence: Synthetic oligonucleotide
  Target: ATXN1; (-) strand; PAM type: YTN; PAM sequence: CTA
cagtaacagacgttgaaagt

SEQ ID NO: 169771 - DNA, 20 bp, Artificial Sequence
  Description of Artificial Sequence: Synthetic oligonucleotide
  Target: ATXN1; (-) strand; PAM type: YTN; PAM sequence: CTA
ggctacagtaacagacgttg

SEQ ID NO: 169772 - DNA, 20 bp, Artificial Sequence
  Description of Artificial Sequence: Synthetic oligonucleotide
  Target: ATXN1; (-) strand; PAM type: YTN; PAM sequence: CTA
cctaggctacagtaacagac

SEQ ID NO: 169773 - DNA, 20 bp, Artificial Sequence
  Description of Artificial Sequence: Synthetic oligonucleotide
  Target: ATXN1; (-) strand; PAM type: YTN; PAM sequence: CTC
tacctaggctacagtaacag

SEQ ID NO: 169774 - DNA, 20 bp, Artificial Sequence
  Description of Artificial Sequence: Synthetic oligonucleotide
  Target: ATXN1; (-) strand; PAM type: YTN; PAM sequence: TTC
actctacctaggctacagta

SEQ ID NO: 169775 - DNA, 20 bp, Artificial Sequence
  Description of Artificial Sequence: Synthetic oligonucleotide
  Target: ATXN1; (-) strand; PAM type: YTN; PAM sequence: CTT
cactctacctaggctacagt

SEQ ID NO: 169776 - DNA, 20 bp, Artificial Sequence
  Description of Artificial Sequence: Synthetic oligonucleotide
  Target: ATXN1; (-) strand; PAM type: YTN; PAM sequence: TTG
gatgaccacccttcactcta

SEQ ID NO: 169777 - DNA, 20 bp, Artificial Sequence
  Description of Artificial Sequence: Synthetic oligonucleotide
  Target: ATXN1; (-) strand; PAM type: YTN; PAM sequence: CTT
ggatgaccacccttcactct

SEQ ID NO: 169778 - DNA, 20 bp, Artificial Sequence
  Description of Artificial Sequence: Synthetic oligonucleotide
  Target: ATXN1; (-) strand; PAM type: YTN; PAM sequence: CTA
gatgtgagtcttggatgacc

SEQ ID NO: 169779 - DNA, 20 bp, Artificial Sequence
  Description of Artificial Sequence: Synthetic oligonucleotide
  Target: ATXN1; (-) strand; PAM type: YTN; PAM sequence: CTC
tagatgtgagtcttggatga

SEQ ID NO: 169780 - DNA, 20 bp, Artificial Sequence
  Description of Artificial Sequence: Synthetic oligonucleotide
  Target: ATXN1; (-) strand; PAM type: YTN; PAM sequence: CTG
ctctagatgtgagtcttgga

SEQ ID NO: 169781 - DNA, 20 bp, Artificial Sequence
  Description of Artificial Sequence: Synthetic oligonucleotide
  Target: ATXN1; (-) strand; PAM type: YTN; PAM sequence: TTG
gacacccctgctctagatgt

SEQ ID NO: 169782 - DNA, 20 bp, Artificial Sequence
  Description of Artificial Sequence: Synthetic oligonucleotide
  Target: ATXN1; (-) strand; PAM type: YTN; PAM sequence: TTC
cagtgtggcccagggaagcc

SEQ ID NO: 169783 - DNA, 20 bp, Artificial Sequence
  Description of Artificial Sequence: Synthetic oligonucleotide
  Target: ATXN1; (-) strand; PAM type: YTN; PAM sequence: CTT
ccagtgtggcccagggaagc

SEQ ID NO: 169784 - DNA, 20 bp, Artificial Sequence
  Description of Artificial Sequence: Synthetic oligonucleotide
  Target: ATXN1; (-) strand; PAM type: YTN; PAM sequence: CTC
cttccagtgtggcccaggga

SEQ ID NO: 169785 - DNA, 20 bp, Artificial Sequence
  Description of Artificial Sequence: Synthetic oligonucleotide
  Target: ATXN1; (-) strand; PAM type: YTN; PAM sequence: TTC
tccttccagtgtggcccagg

SEQ ID NO: 169786 - DNA, 20 bp, Artificial Sequence
  Description of Artificial Sequence: Synthetic oligonucleotide
  Target: ATXN1; (-) strand; PAM type: YTN; PAM sequence: TTT
ctccttccagtgtggcccag

SEQ ID NO: 169787 - DNA, 20 bp, Artificial Sequence
  Description of Artificial Sequence: Synthetic oligonucleotide
  Target: ATXN1; (-) strand; PAM type: YTN; PAM sequence: TTT
tctccttccagtgtggccca

SEQ ID NO: 169788 - DNA, 20 bp, Artificial Sequence
  Description of Artificial Sequence: Synthetic oligonucleotide
  Target: ATXN1; (-) strand; PAM type: YTN; PAM sequence: TTT
ttctccttccagtgtggccc

SEQ ID NO: 169789 - DNA, 20 bp, Artificial Sequence
  Description of Artificial Sequence: Synthetic oligonucleotide
  Target: ATXN1; (-) strand; PAM type: YTN; PAM sequence: TTA
tgtgcagcccaagacaattt

SEQ ID NO: 169790 - DNA, 20 bp, Artificial Sequence
  Description of Artificial Sequence: Synthetic oligonucleotide
  Target: ATXN1; (-) strand; PAM type: YTN; PAM sequence: TTT
atgtgcagcccaagacaatt

SEQ ID NO: 169791 - DNA, 20 bp, Artificial Sequence
  Description of Artificial Sequence: Synthetic oligonucleotide
  Target: ATXN1; (-) strand; PAM type: YTN; PAM sequence: TTT
tatgtgcagcccaagacaat

SEQ ID NO: 169792 - DNA, 20 bp, Artificial Sequence
  Description of Artificial Sequence: Synthetic oligonucleotide
  Target: ATXN1; (-) strand; PAM type: YTN; PAM sequence: CTT
ttatgtgcagcccaagacaa

SEQ ID NO: 169793 - DNA, 20 bp, Artificial Sequence
  Description of Artificial Sequence: Synthetic oligonucleotide
  Target: ATXN1; (-) strand; PAM type: YTN; PAM sequence: TTA
gtgatagtgtcttttatgtg

SEQ ID NO: 169794 - DNA, 20 bp, Artificial Sequence
  Description of Artificial Sequence: Synthetic oligonucleotide
  Target: ATXN1; (-) strand; PAM type: YTN; PAM sequence: CTG
tcattagtgatagtgtcttt

SEQ ID NO: 169795 - DNA, 20 bp, Artificial Sequence
  Description of Artificial Sequence: Synthetic oligonucleotide
  Target: ATXN1; (-) strand; PAM type: YTN; PAM sequence: CTC
atcagctgtcattagtgata

SEQ ID NO: 169796 - DNA, 20 bp, Artificial Sequence
  Description of Artificial Sequence: Synthetic oligonucleotide
  Target: ATXN1; (-) strand; PAM type: YTN; PAM sequence: TTA
gctcatcagctgtcattagt

SEQ ID NO: 169797 - DNA, 20 bp, Artificial Sequence
  Description of Artificial Sequence: Synthetic oligonucleotide
  Target: ATXN1; (-) strand; PAM type: YTN; PAM sequence: TTT
agctcatcagctgtcattag

SEQ ID NO: 169798 - DNA, 20 bp, Artificial Sequence
  Description of Artificial Sequence: Synthetic oligonucleotide
  Target: ATXN1; (-) strand; PAM type: YTN; PAM sequence: TTT
tagctcatcagctgtcatta

SEQ ID NO: 169799 - DNA, 20 bp, Artificial Sequence
  Description of Artificial Sequence: Synthetic oligonucleotide
  Target: ATXN1; (-) strand; PAM type: YTN; PAM sequence: TTT
ttagctcatcagctgtcatt

SEQ ID NO: 169800 - DNA, 20 bp, Artificial Sequence
  Description of Artificial Sequence: Synthetic oligonucleotide
  Target: ATXN1; (-) strand; PAM type: YTN; PAM sequence: TTT
tttagctcatcagctgtcat

SEQ ID NO: 169801 - DNA, 20 bp, Artificial Sequence
  Description of Artificial Sequence: Synthetic oligonucleotide
  Target: ATXN1; (-) strand; PAM type: YTN; PAM sequence: TTT
ttttagctcatcagctgtca

SEQ ID NO: 169802 - DNA, 20 bp, Artificial Sequence
  Description of Artificial Sequence: Synthetic oligonucleotide
  Target: ATXN1; (-) strand; PAM type: YTN; PAM sequence: TTT
tttttagctcatcagctgtc

SEQ ID NO: 169803 - DNA, 20 bp, Artificial Sequence
  Description of Artificial Sequence: Synthetic oligonucleotide
  Target: ATXN1; (-) strand; PAM type: YTN; PAM sequence: TTT
ttttttagctcatcagctgt

SEQ ID NO: 169804 - DNA, 20 bp, Artificial Sequence
  Description of Artificial Sequence: Synthetic oligonucleotide
  Target: ATXN1; (-) strand; PAM type: YTN; PAM sequence: TTT
tttttttagctcatcagctg

SEQ ID NO: 169805 - DNA, 20 bp, Artificial Sequence
  Description of Artificial Sequence: Synthetic oligonucleotide
  Target: ATXN1; (-) strand; PAM type: YTN; PAM sequence: TTA
ttttttttttagctcatcag

SEQ ID NO: 169806 - DNA, 20 bp, Artificial Sequence
  Description of Artificial Sequence: Synthetic oligonucleotide
  Target: ATXN1; (-) strand; PAM type: YTN; PAM sequence: TTT
attttttttttagctcatca

SEQ ID NO: 169807 - DNA, 20 bp, Artificial Sequence
  Description of Artificial Sequence: Synthetic oligonucleotide
  Target: ATXN1; (-) strand; PAM type: YTN; PAM sequence: TTA
tttattttttttttagctca

SEQ ID NO: 169808 - DNA, 20 bp, Artificial Sequence
  Description of Artificial Sequence: Synthetic oligonucleotide
  Target: ATXN1; (-) strand; PAM type: YTN; PAM sequence: TTT
atttattttttttttagctc

SEQ ID NO: 169809 - DNA, 20 bp, Artificial Sequence
  Description of Artificial Sequence: Synthetic oligonucleotide
  Target: ATXN1; (-) strand; PAM type: YTN; PAM sequence: TTG
caagtttatttatttttttt

SEQ ID NO: 169810 - DNA, 20 bp, Artificial Sequence
  Description of Artificial Sequence: Synthetic oligonucleotide
  Target: ATXN1; (-) strand; PAM type: YTN; PAM sequence: CTT
gcaagtttatttattttttt

SEQ ID NO: 169811 - DNA, 20 bp, Artificial Sequence
  Description of Artificial Sequence: Synthetic oligonucleotide
  Target: ATXN1; (-) strand; PAM type: YTN; PAM sequence: TTG
gccaagacttgcaagtttat

SEQ ID NO: 169812 - DNA, 20 bp, Artificial Sequence
  Description of Artificial Sequence: Synthetic oligonucleotide
  Target: ATXN1; (-) strand; PAM type: YTN; PAM sequence: CTT
ggccaagacttgcaagttta

SEQ ID NO: 169813 - DNA, 20 bp, Artificial Sequence
  Description of Artificial Sequence: Synthetic oligonucleotide
  Target: ATXN1; (-) strand; PAM type: YTN; PAM sequence: TTC
ccaggaacacttggccaaga

SEQ ID NO: 169814 - DNA, 20 bp, Artificial Sequence
  Description of Artificial Sequence: Synthetic oligonucleotide
  Target: ATXN1; (-) strand; PAM type: YTN; PAM sequence: CTT
cccaggaacacttggccaag

SEQ ID NO: 169815 - DNA, 20 bp, Artificial Sequence
  Description of Artificial Sequence: Synthetic oligonucleotide
  Target: ATXN1; (-) strand; PAM type: YTN; PAM sequence: CTG
ccatccaggccttcccagga

SEQ ID NO: 169816 - DNA, 20 bp, Artificial Sequence
  Description of Artificial Sequence: Synthetic oligonucleotide
  Target: ATXN1; (-) strand; PAM type: YTN; PAM sequence: CTC
tgccatccaggccttcccag

SEQ ID NO: 169817 - DNA, 20 bp, Artificial Sequence
  Description of Artificial Sequence: Synthetic oligonucleotide
  Target: ATXN1; (-) strand; PAM type: YTN; PAM sequence: TTC
acctctgccatccaggcctt

SEQ ID NO: 169818 - DNA, 20 bp, Artificial Sequence
  Description of Artificial Sequence: Synthetic oligonucleotide
  Target: ATXN1; (-) strand; PAM type: YTN; PAM sequence: CTC
ccattcacctctgccatcca

SEQ ID NO: 169819 - DNA, 20 bp, Artificial Sequence
  Description of Artificial Sequence: Synthetic oligonucleotide
  Target: ATXN1; (-) strand; PAM type: YTN; PAM sequence: CTC
cccccctcccattcacctct

SEQ ID NO: 169820 - DNA, 20 bp, Artificial Sequence
  Description of Artificial Sequence: Synthetic oligonucleotide
  Target: ATXN1; (-) strand; PAM type: YTN; PAM sequence: CTC
cccactccccccctcccatt

SEQ ID NO: 169821 - DNA, 20 bp, Artificial Sequence
  Description of Artificial Sequence: Synthetic oligonucleotide
  Target: ATXN1; (-) strand; PAM type: YTN; PAM sequence: TTC
caccctccccactccccccc

SEQ ID NO: 169822 - DNA, 20 bp, Artificial Sequence
  Description of Artificial Sequence: Synthetic oligonucleotide
  Target: ATXN1; (-) strand; PAM type: YTN; PAM sequence: CTT
ccaccctccccactcccccc

SEQ ID NO: 169823 - DNA, 20 bp, Artificial Sequence
  Description of Artificial Sequence: Synthetic oligonucleotide
  Target: ATXN1; (-) strand; PAM type: YTN; PAM sequence: CTC
cccacttccaccctccccac

SEQ ID NO: 169824 - DNA, 20 bp, Artificial Sequence
  Description of Artificial Sequence: Synthetic oligonucleotide
  Target: ATXN1; (-) strand; PAM type: YTN; PAM sequence: CTA
ctccccacttccaccctccc

SEQ ID NO: 169825 - DNA, 20 bp, Artificial Sequence
  Description of Artificial Sequence: Synthetic oligonucleotide
  Target: ATXN1; (-) strand; PAM type: YTN; PAM sequence: CTC
cctactccccacttccaccc

SEQ ID NO: 169826 - DNA, 20 bp, Artificial Sequence
  Description of Artificial Sequence: Synthetic oligonucleotide
  Target: ATXN1; (-) strand; PAM type: YTN; PAM sequence: CTG
agcatggtgccatgctccct

SEQ ID NO: 169827 - DNA, 20 bp, Artificial Sequence
  Description of Artificial Sequence: Synthetic oligonucleotide
  Target: ATXN1; (-) strand; PAM type: YTN; PAM sequence: TTC
tgagcatggtgccatgctcc

SEQ ID NO: 169828 - DNA, 20 bp, Artificial Sequence
  Description of Artificial Sequence: Synthetic oligonucleotide
  Target: ATXN1; (-) strand; PAM type: YTN; PAM sequence: TTT
ctgagcatggtgccatgctc

SEQ ID NO: 169829 - DNA, 20 bp, Artificial Sequence
  Description of Artificial Sequence: Synthetic oligonucleotide
  Target: ATXN1; (-) strand; PAM type: YTN; PAM sequence: CTT
tctgagcatggtgccatgct

SEQ ID NO: 169830 - DNA, 20 bp, Artificial Sequence
  Description of Artificial Sequence: Synthetic oligonucleotide
  Target: ATXN1; (-) strand; PAM type: YTN; PAM sequence: TTC
agggagtctttctgagcatg

SEQ ID NO: 169831 - DNA, 20 bp, Artificial Sequence
  Description of Artificial Sequence: Synthetic oligonucleotide
  Target: ATXN1; (-) strand; PAM type: YTN; PAM sequence: TTT
cagggagtctttctgagcat

SEQ ID NO: 169832 - DNA, 20 bp, Artificial Sequence
  Description of Artificial Sequence: Synthetic oligonucleotide
  Target: ATXN1; (-) strand; PAM type: YTN; PAM sequence: CTT
tcagggagtctttctgagca

SEQ ID NO: 169833 - DNA, 20 bp, Artificial Sequence
  Description of Artificial Sequence: Synthetic oligonucleotide
  Target: ATXN1; (-) strand; PAM type: YTN; PAM sequence: TTG
ggacagagaggagtaacaag

SEQ ID NO: 169834 - DNA, 20 bp, Artificial Sequence
  Description of Artificial Sequence: Synthetic oligonucleotide
  Target: ATXN1; (-) strand; PAM type: YTN; PAM sequence: CTT
gggacagagaggagtaacaa

SEQ ID NO: 169835 - DNA, 20 bp, Artificial Sequence
  Description of Artificial Sequence: Synthetic oligonucleotide
  Target: ATXN1; (-) strand; PAM type: YTN; PAM sequence: CTG
ggaaaagggaacttgggaca

SEQ ID NO: 169836 - DNA, 20 bp, Artificial Sequence
  Description of Artificial Sequence: Synthetic oligonucleotide
  Target: ATXN1; (-) strand; PAM type: YTN; PAM sequence: CTG
taagagaggagggcgagatg

SEQ ID NO: 169837 - DNA, 20 bp, Artificial Sequence
  Description of Artificial Sequence: Synthetic oligonucleotide
  Target: ATXN1; (-) strand; PAM type: YTN; PAM sequence: TTA
tagggacctgtaagagagga

SEQ ID NO: 169838 - DNA, 20 bp, Artificial Sequence
  Description of Artificial Sequence: Synthetic oligonucleotide
  Target: ATXN1; (-) strand; PAM type: YTN; PAM sequence: TTA
agagaagatatggtgcgggg

SEQ ID NO: 169839 - DNA, 20 bp, Artificial Sequence
  Description of Artificial Sequence: Synthetic oligonucleotide
  Target: ATXN1; (-) strand; PAM type: YTN; PAM sequence: CTT
aagagaagatatggtgcggg

SEQ ID NO: 169840 - DNA, 20 bp, Artificial Sequence
  Description of Artificial Sequence: Synthetic oligonucleotide
  Target: ATXN1; (-) strand; PAM type: YTN; PAM sequence: CTC
cttaagagaagatatggtgc

SEQ ID NO: 169841 - DNA, 20 bp, Artificial Sequence
  Description of Artificial Sequence: Synthetic oligonucleotide
  Target: ATXN1; (-) strand; PAM type: YTN; PAM sequence: TTC
ctccttaagagaagatatgg

SEQ ID NO: 169842 - DNA, 20 bp, Artificial Sequence
  Description of Artificial Sequence: Synthetic oligonucleotide
  Target: ATXN1; (-) strand; PAM type: YTN; PAM sequence: TTA
ggccaaattcctccttaaga

SEQ ID NO: 169843 - DNA, 20 bp, Artificial Sequence
  Description of Artificial Sequence: Synthetic oligonucleotide
  Target: ATXN1; (-) strand; PAM type: YTN; PAM sequence: TTA
gattaggccaaattcctcct

SEQ ID NO: 169844 - DNA, 20 bp, Artificial Sequence
  Description of Artificial Sequence: Synthetic oligonucleotide
  Target: ATXN1; (-) strand; PAM type: YTN; PAM sequence: CTT
agattaggccaaattcctcc

SEQ ID NO: 169845 - DNA, 20 bp, Artificial Sequence
  Description of Artificial Sequence: Synthetic oligonucleotide
  Target: ATXN1; (-) strand; PAM type: YTN; PAM sequence: TTA
aacttagattaggccaaatt

SEQ ID NO: 169846 - DNA, 20 bp, Artificial Sequence
  Description of Artificial Sequence: Synthetic oligonucleotide
  Target: ATXN1; (-) strand; PAM type: YTN; PAM sequence: TTG
tgaggtcagaaaggtcaatg

SEQ ID NO: 169847 - DNA, 20 bp, Artificial Sequence
  Description of Artificial Sequence: Synthetic oligonucleotide
  Target: ATXN1; (-) strand; PAM type: YTN; PAM sequence: CTT
gtgaggtcagaaaggtcaat

SEQ ID NO: 169848 - DNA, 20 bp, Artificial Sequence
  Description of Artificial Sequence: Synthetic oligonucleotide
  Target: ATXN1; (-) strand; PAM type: YTN; PAM sequence: TTC
cttgtgaggtcagaaaggtc

SEQ ID NO: 169849 - DNA, 20 bp, Artificial Sequence
  Description of Artificial Sequence: Synthetic oligonucleotide
  Target: ATXN1; (-) strand; PAM type: YTN; PAM sequence: CTA
ttccttgtgaggtcagaaag

SEQ ID NO: 169850 - DNA, 20 bp, Artificial Sequence
  Description of Artificial Sequence: Synthetic oligonucleotide
  Target: ATXN1; (-) strand; PAM type: YTN; PAM sequence: TTG
ctattccttgtgaggtcaga

SEQ ID NO: 169851 - DNA, 20 bp, Artificial Sequence
  Description of Artificial Sequence: Synthetic oligonucleotide
  Target: ATXN1; (-) strand; PAM type: YTN; PAM sequence: CTT
gctattccttgtgaggtcag

SEQ ID NO: 169852 - DNA, 20 bp, Artificial Sequence
  Description of Artificial Sequence: Synthetic oligonucleotide
  Target: ATXN1; (-) strand; PAM type: YTN; PAM sequence: TTA
gcttgctattccttgtgagg

SEQ ID NO: 169853 - DNA, 20 bp, Artificial Sequence
  Description of Artificial Sequence: Synthetic oligonucleotide
  Target: ATXN1; (-) strand; PAM type: YTN; PAM sequence: TTT
agcttgctattccttgtgag

SEQ ID NO: 169854 - DNA, 20 bp, Artificial Sequence
  Description of Artificial Sequence: Synthetic oligonucleotide
  Target: ATXN1; (-) strand; PAM type: YTN; PAM sequence: TTA
tttagcttgctattccttgt

SEQ ID NO: 169855 - DNA, 20 bp, Artificial Sequence
  Description of Artificial Sequence: Synthetic oligonucleotide
  Target: ATXN1; (-) strand; PAM type: YTN; PAM sequence: CTT
atttagcttgctattccttg

SEQ ID NO: 169856 - DNA, 20 bp, Artificial Sequence
  Description of Artificial Sequence: Synthetic oligonucleotide
  Target: ATXN1; (-) strand; PAM type: YTN; PAM sequence: CTG
tgcttatttagcttgctatt

SEQ ID NO: 169857 - DNA, 20 bp, Artificial Sequence
  Description of Artificial Sequence: Synthetic oligonucleotide
  Target: ATXN1; (-) strand; PAM type: YTN; PAM sequence: TTC
tgtgcttatttagcttgcta

SEQ ID NO: 169858 - DNA, 20 bp, Artificial Sequence
  Description of Artificial Sequence: Synthetic oligonucleotide
  Target: ATXN1; (-) strand; PAM type: YTN; PAM sequence: CTA
aggaggacaagttctgtgct

SEQ ID NO: 169859 - DNA, 20 bp, Artificial Sequence
  Description of Artificial Sequence: Synthetic oligonucleotide
  Target: ATXN1; (-) strand; PAM type: YTN; PAM sequence: CTC
accatctaaggaggacaagt

SEQ ID NO: 169860 - DNA, 20 bp, Artificial Sequence
  Description of Artificial Sequence: Synthetic oligonucleotide
  Target: ATXN1; (-) strand; PAM type: YTN; PAM sequence: TTC
ctcaccatctaaggaggaca

SEQ ID NO: 169861 - DNA, 20 bp, Artificial Sequence
  Description of Artificial Sequence: Synthetic oligonucleotide
  Target: ATXN1; (-) strand; PAM type: YTN; PAM sequence: TTT
cctcaccatctaaggaggac

SEQ ID NO: 169862 - DNA, 20 bp, Artificial Sequence
  Description of Artificial Sequence: Synthetic oligonucleotide
  Target: ATXN1; (-) strand; PAM type: YTN; PAM sequence: CTT
tcctcaccatctaaggagga

SEQ ID NO: 169863 - DNA, 20 bp, Artificial Sequence
  Description of Artificial Sequence: Synthetic oligonucleotide
  Target: ATXN1; (-) strand; PAM type: YTN; PAM sequence: CTC
tttcctcaccatctaaggag

SEQ ID NO: 169864 - DNA, 20 bp, Artificial Sequence
  Description of Artificial Sequence: Synthetic oligonucleotide
  Target: ATXN1; (-) strand; PAM type: YTN; PAM sequence: TTC
tctttcctcaccatctaagg

SEQ ID NO: 169865 - DNA, 20 bp, Artificial Sequence
  Description of Artificial Sequence: Synthetic oligonucleotide
  Target: ATXN1; (-) strand; PAM type: YTN; PAM sequence: TTA
caattctctttcctcaccat

SEQ ID NO: 169866 - DNA, 20 bp, Artificial Sequence
  Description of Artificial Sequence: Synthetic oligonucleotide
  Target: ATXN1; (-) strand; PAM type: YTN; PAM sequence: TTT
acaattctctttcctcacca

SEQ ID NO: 169867 - DNA, 20 bp, Artificial Sequence
  Description of Artificial Sequence: Synthetic oligonucleotide
  Target: ATXN1; (-) strand; PAM type: YTN; PAM sequence: TTA
aagaaaaatatagcaagtca

SEQ ID NO: 169868 - DNA, 20 bp, Artificial Sequence
  Description of Artificial Sequence: Synthetic oligonucleotide
  Target: ATXN1; (-) strand; PAM type: YTN; PAM sequence: TTC
catgaattaaagaaaaatat

SEQ ID NO: 169869 - DNA, 20 bp, Artificial Sequence
  Description of Artificial Sequence: Synthetic oligonucleotide
  Target: ATXN1; (-) strand; PAM type: YTN; PAM sequence: TTA
atataaaatgttccatgaat

SEQ ID NO: 169870 - DNA, 20 bp, Artificial Sequence
  Description of Artificial Sequence: Synthetic oligonucleotide
  Target: ATXN1; (-) strand; PAM type: YTN; PAM sequence: TTA
cattaatataaaatgttcca

SEQ ID NO: 169871 - DNA, 20 bp, Artificial Sequence
  Description of Artificial Sequence: Synthetic oligonucleotide
  Target: ATXN1; (-) strand; PAM type: YTN; PAM sequence: TTT
acattaatataaaatgttcc

SEQ ID NO: 169872 - DNA, 20 bp, Artificial Sequence
  Description of Artificial Sequence: Synthetic oligonucleotide
  Target: ATXN1; (-) strand; PAM type: YTN; PAM sequence: TTT
tacattaatataaaatgttc

SEQ ID NO: 169873 - DNA, 20 bp, Artificial Sequence
  Description of Artificial Sequence: Synthetic oligonucleotide
  Target: ATXN1; (-) strand; PAM type: YTN; PAM sequence: TTT
ttacattaatataaaatgtt

SEQ ID NO: 169874 - DNA, 20 bp, Artificial Sequence
  Description of Artificial Sequence: Synthetic oligonucleotide
  Target: ATXN1; (-) strand; PAM type: YTN; PAM sequence: CTT
tttacattaatataaaatgt

SEQ ID NO: 169875 - DNA, 20 bp, Artificial Sequence
  Description of Artificial Sequence: Synthetic oligonucleotide
  Target: ATXN1; (-) strand; PAM type: YTN; PAM sequence: TTC
tttttacattaatataaaat

SEQ ID NO: 169876 - DNA, 20 bp, Artificial Sequence
  Description of Artificial Sequence: Synthetic oligonucleotide
  Target: ATXN1; (-) strand; PAM type: YTN; PAM sequence: CTC
ccagttctttttacattaat

SEQ ID NO: 169877 - DNA, 20 bp, Artificial Sequence
  Description of Artificial Sequence: Synthetic oligonucleotide
  Target: ATXN1; (-) strand; PAM type: YTN; PAM sequence: TTC
ccaacagtcctcccagttct

SEQ ID NO: 169878 - DNA, 20 bp, Artificial Sequence
  Description of Artificial Sequence: Synthetic oligonucleotide
  Target: ATXN1; (-) strand; PAM type: YTN; PAM sequence: CTG
gtatgacagagtattcccaa

SEQ ID NO: 169879 - DNA, 20 bp, Artificial Sequence
  Description of Artificial Sequence: Synthetic oligonucleotide
  Target: ATXN1; (-) strand; PAM type: YTN; PAM sequence: CTC
aagtggaatgatgctggtat

SEQ ID NO: 169880 - DNA, 20 bp, Artificial Sequence
  Description of Artificial Sequence: Synthetic oligonucleotide
  Target: ATXN1; (-) strand; PAM type: YTN; PAM sequence: TTA
tagcataaagggctcaagtg

SEQ ID NO: 169881 - DNA, 20 bp, Artificial Sequence
  Description of Artificial Sequence: Synthetic oligonucleotide
  Target: ATXN1; (-) strand; PAM type: YTN; PAM sequence: TTA
atattatagcataaagggct

SEQ ID NO: 169882 - DNA, 20 bp, Artificial Sequence
  Description of Artificial Sequence: Synthetic oligonucleotide
  Target: ATXN1; (-) strand; PAM type: YTN; PAM sequence: TTT
aatattatagcataaagggc

SEQ ID NO: 169883 - DNA, 20 bp, Artificial Sequence
  Description of Artificial Sequence: Synthetic oligonucleotide
  Target: ATXN1; (-) strand; PAM type: YTN; PAM sequence: CTA
catttaatattatagcataa

SEQ ID NO: 169884 - DNA, 20 bp, Artificial Sequence
  Description of Artificial Sequence: Synthetic oligonucleotide
  Target: ATXN1; (-) strand; PAM type: YTN; PAM sequence: TTG
aaaagaaggaaaataggaaa

SEQ ID NO: 169885 - DNA, 20 bp, Artificial Sequence
  Description of Artificial Sequence: Synthetic oligonucleotide
  Target: ATXN1; (-) strand; PAM type: YTN; PAM sequence: TTT
gaaaagaaggaaaataggaa

SEQ ID NO: 169886 - DNA, 20 bp, Artificial Sequence
  Description of Artificial Sequence: Synthetic oligonucleotide
  Target: ATXN1; (-) strand; PAM type: YTN; PAM sequence: TTA
tagtttgaaaagaaggaaaa

SEQ ID NO: 169887 - DNA, 20 bp, Artificial Sequence
  Description of Artificial Sequence: Synthetic oligonucleotide
  Target: ATXN1; (-) strand; PAM type: YTN; PAM sequence: TTT
atagtttgaaaagaaggaaa

SEQ ID NO: 169888 - DNA, 20 bp, Artificial Sequence
  Description of Artificial Sequence: Synthetic oligonucleotide
  Target: ATXN1; (-) strand; PAM type: YTN; PAM sequence: TTT
tatagtttgaaaagaaggaa

SEQ ID NO: 169889 - DNA, 20 bp, Artificial Sequence
  Description of Artificial Sequence: Synthetic oligonucleotide
  Target: ATXN1; (-) strand; PAM type: YTN; PAM sequence: CTA
agttttatagtttgaaaaga

SEQ ID NO: 169890 - DNA, 20 bp, Artificial Sequence
  Description of Artificial Sequence: Synthetic oligonucleotide
  Target: ATXN1; (-) strand; PAM type: YTN; PAM sequence: TTA
cgtgaaagactaagttttat

SEQ ID NO: 169891 - DNA, 20 bp, Artificial Sequence
  Description of Artificial Sequence: Synthetic oligonucleotide
  Target: ATXN1; (-) strand; PAM type: YTN; PAM sequence: CTC
ccattacgtgaaagactaag

SEQ ID NO: 169892 - DNA, 20 bp, Artificial Sequence
  Description of Artificial Sequence: Synthetic oligonucleotide
  Target: ATXN1; (-) strand; PAM type: YTN; PAM sequence: CTC
tcccattacgtgaaagacta

SEQ ID NO: 169893 - DNA, 20 bp, Artificial Sequence
  Description of Artificial Sequence: Synthetic oligonucleotide
  Target: ATXN1; (-) strand; PAM type: YTN; PAM sequence: CTA
tcgcctctcccattacgtga

SEQ ID NO: 169894 - DNA, 20 bp, Artificial Sequence
  Description of Artificial Sequence: Synthetic oligonucleotide
  Target: ATXN1; (-) strand; PAM type: YTN; PAM sequence: TTC
tatcgcctctcccattacgt

SEQ ID NO: 169895 - DNA, 20 bp, Artificial Sequence
  Description of Artificial Sequence: Synthetic oligonucleotide
  Target: ATXN1; (-) strand; PAM type: YTN; PAM sequence: TTA
ccataagcaccatattctat

SEQ ID NO: 169896 - DNA, 20 bp, Artificial Sequence
  Description of Artificial Sequence: Synthetic oligonucleotide
  Target: ATXN1; (-) strand; PAM type: YTN; PAM sequence: TTT
accataagcaccatattcta

SEQ ID NO: 169897 - DNA, 20 bp, Artificial Sequence
  Description of Artificial Sequence: Synthetic oligonucleotide
  Target: ATXN1; (-) strand; PAM type: YTN; PAM sequence: TTG
agcatttaccataagcacca

SEQ ID NO: 169898 - DNA, 20 bp, Artificial Sequence
  Description of Artificial Sequence: Synthetic oligonucleotide
  Target: ATXN1; (-) strand; PAM type: YTN; PAM sequence: TTA
ataatagataaatatattga

SEQ ID NO: 169899 - DNA, 20 bp, Artificial Sequence
  Description of Artificial Sequence: Synthetic oligonucleotide
  Target: ATXN1; (-) strand; PAM type: YTN; PAM sequence: TTA
tcattaataatagataaata

SEQ ID NO: 169900 - DNA, 20 bp, Artificial Sequence
  Description of Artificial Sequence: Synthetic oligonucleotide
  Target: ATXN1; (-) strand; PAM type: YTN; PAM sequence: TTC
agtataaatccagtattatc

SEQ ID NO: 169901 - DNA, 20 bp, Artificial Sequence
  Description of Artificial Sequence: Synthetic oligonucleotide
  Target: ATXN1; (-) strand; PAM type: YTN; PAM sequence: TTT
cagtataaatccagtattat

SEQ ID NO: 169902 - DNA, 20 bp, Artificial Sequence
  Description of Artificial Sequence: Synthetic oligonucleotide
  Target: ATXN1; (-) strand; PAM type: YTN; PAM sequence: TTA
tttcagtataaatccagtat

SEQ ID NO: 169903 - DNA, 20 bp, Artificial Sequence
  Description of Artificial Sequence: Synthetic oligonucleotide
  Target: ATXN1; (-) strand; PAM type: YTN; PAM sequence: TTA
ataagtggtgaattatttca

SEQ ID NO: 169904 - DNA, 20 bp, Artificial Sequence
  Description of Artificial Sequence: Synthetic oligonucleotide
  Target: ATXN1; (-) strand; PAM type: YTN; PAM sequence: TTT
aataagtggtgaattatttc

SEQ ID NO: 169905 - DNA, 20 bp, Artificial Sequence
  Description of Artificial Sequence: Synthetic oligonucleotide
  Target: ATXN1; (-) strand; PAM type: YTN; PAM sequence: TTT
taataagtggtgaattattt

SEQ ID NO: 169906 - DNA, 20 bp, Artificial Sequence
  Description of Artificial Sequence: Synthetic oligonucleotide
  Target: ATXN1; (-) strand; PAM type: YTN; PAM sequence: TTG
tgttttaataagtggtgaat

SEQ ID NO: 169907 - DNA, 20 bp, Artificial Sequence
  Description of Artificial Sequence: Synthetic oligonucleotide
  Target: ATXN1; (-) strand; PAM type: YTN; PAM sequence: TTA
agaattgtgttttaataagt

SEQ ID NO: 169908 - DNA, 20 bp, Artificial Sequence
  Description of Artificial Sequence: Synthetic oligonucleotide
  Target: ATXN1; (-) strand; PAM type: YTN; PAM sequence: TTT
aagaattgtgttttaataag

SEQ ID NO: 169909 - DNA, 20 bp, Artificial Sequence
  Description of Artificial Sequence: Synthetic oligonucleotide
  Target: ATXN1; (-) strand; PAM type: YTN; PAM sequence: TTT
taagaattgtgttttaataa

SEQ ID NO: 169910 - DNA, 20 bp, Artificial Sequence
  Description of Artificial Sequence: Synthetic oligonucleotide
  Target: ATXN1; (-) strand; PAM type: YTN; PAM sequence: TTA
tattttaagaattgtgtttt

SEQ ID NO: 169911 - DNA, 20 bp, Artificial Sequence
  Description of Artificial Sequence: Synthetic oligonucleotide
  Target: ATXN1; (-) strand; PAM type: YTN; PAM sequence: CTT
atattttaagaattgtgttt

SEQ ID NO: 169912 - DNA, 20 bp, Artificial Sequence
  Description of Artificial Sequence: Synthetic oligonucleotide
  Target: ATXN1; (-) strand; PAM type: YTN; PAM sequence: CTA
atgaccacaaacagaaaagt

SEQ ID NO: 169913 - DNA, 20 bp, Artificial Sequence
  Description of Artificial Sequence: Synthetic oligonucleotide
  Target: ATXN1; (-) strand; PAM type: YTN; PAM sequence: TTA
gtagcatgatctaatgacca

SEQ ID NO: 169914 - DNA, 20 bp, Artificial Sequence
  Description of Artificial Sequence: Synthetic oligonucleotide
  Target: ATXN1; (-) strand; PAM type: YTN; PAM sequence: TTA
ggcaaagccgttagtagcat

SEQ ID NO: 169915 - DNA, 20 bp, Artificial Sequence
  Description of Artificial Sequence: Synthetic oligonucleotide
  Target: ATXN1; (-) strand; PAM type: YTN; PAM sequence: TTT
aggcaaagccgttagtagca

SEQ ID NO: 169916 - DNA, 20 bp, Artificial Sequence
  Description of Artificial Sequence: Synthetic oligonucleotide
  Target: ATXN1; (-) strand; PAM type: YTN; PAM sequence: TTG
tttaggcaaagccgttagta

SEQ ID NO: 169917 - DNA, 20 bp, Artificial Sequence
  Description of Artificial Sequence: Synthetic oligonucleotide
  Target: ATXN1; (-) strand; PAM type: YTN; PAM sequence: TTA
aatgaataaattgtttaggc

SEQ ID NO: 169918 - DNA, 20 bp, Artificial Sequence
  Description of Artificial Sequence: Synthetic oligonucleotide
  Target: ATXN1; (-) strand; PAM type: YTN; PAM sequence: CTG
gtgtgtagatgttaaatgaa

SEQ ID NO: 169919 - DNA, 20 bp, Artificial Sequence
  Description of Artificial Sequence: Synthetic oligonucleotide
  Target: ATXN1; (-) strand; PAM type: YTN; PAM sequence: CTG
ggtgcctggtgtgtagatgt

SEQ ID NO: 169920 - DNA, 20 bp, Artificial Sequence
  Description of Artificial Sequence: Synthetic oligonucleotide
  Target: ATXN1; (-) strand; PAM type: YTN; PAM sequence: CTA
gctgggtgcctggtgtgtag

SEQ ID NO: 169921 - DNA, 20 bp, Artificial Sequence
  Description of Artificial Sequence: Synthetic oligonucleotide
  Target: ATXN1; (-) strand; PAM type: YTN; PAM sequence: TTG
tccccagactagctgggtgc

SEQ ID NO: 169922 - DNA, 20 bp, Artificial Sequence
  Description of Artificial Sequence: Synthetic oligonucleotide
  Target: ATXN1; (-) strand; PAM type: YTN; PAM sequence: TTT
gtccccagactagctgggtg

SEQ ID NO: 169923 - DNA, 20 bp, Artificial Sequence
  Description of Artificial Sequence: Synthetic oligonucleotide
  Target: ATXN1; (-) strand; PAM type: YTN; PAM sequence: TTT
tgtccccagactagctgggt

SEQ ID NO: 169924 - DNA, 20 bp, Artificial Sequence
  Description of Artificial Sequence: Synthetic oligonucleotide
  Target: ATXN1; (-) strand; PAM type: YTN; PAM sequence: TTT
ttgtccccagactagctggg

SEQ ID NO: 169925 - DNA, 20 bp, Artificial Sequence
  Description of Artificial Sequence: Synthetic oligonucleotide
  Target: ATXN1; (-) strand; PAM type: YTN; PAM sequence: TTA
cccgtttttgtccccagact

SEQ ID NO: 169926 - DNA, 20 bp, Artificial Sequence
  Description of Artificial Sequence: Synthetic oligonucleotide
  Target: ATXN1; (-) strand; PAM type: YTN; PAM sequence: CTT
acccgtttttgtccccagac

SEQ ID NO: 169927 - DNA, 20 bp, Artificial Sequence
  Description of Artificial Sequence: Synthetic oligonucleotide
  Target: ATXN1; (-) strand; PAM type: YTN; PAM sequence: CTG
tcttacccgtttttgtcccc

SEQ ID NO: 169928 - DNA, 20 bp, Artificial Sequence
  Description of Artificial Sequence: Synthetic oligonucleotide
  Target: ATXN1; (-) strand; PAM type: YTN; PAM sequence: TTG
gggcagaaaagatgctgtct

SEQ ID NO: 169929 - DNA, 20 bp, Artificial Sequence
  Description of Artificial Sequence: Synthetic oligonucleotide
  Target: ATXN1; (-) strand; PAM type: YTN; PAM sequence: TTT
ggggcagaaaagatgctgtc

SEQ ID NO: 169930 - DNA, 20 bp, Artificial Sequence
  Description of Artificial Sequence: Synthetic oligonucleotide
  Target: ATXN1; (-) strand; PAM type: YTN; PAM sequence: CTT
tggggcagaaaagatgctgt

SEQ ID NO: 169931 - DNA, 20 bp, Artificial Sequence
  Description of Artificial Sequence: Synthetic oligonucleotide
  Target: ATXN1; (-) strand; PAM type: YTN; PAM sequence: TTC
catcatccctttggggcaga

SEQ ID NO: 169932 - DNA, 20 bp, Artificial Sequence
  Description of Artificial Sequence: Synthetic oligonucleotide
  Target: ATXN1; (-) strand; PAM type: YTN; PAM sequence: CTC
cattccatcatccctttggg

SEQ ID NO: 169933 - DNA, 20 bp, Artificial Sequence
  Description of Artificial Sequence: Synthetic oligonucleotide
  Target: ATXN1; (-) strand; PAM type: YTN; PAM sequence: TTC
ctccattccatcatcccttt

SEQ ID NO: 169934 - DNA, 20 bp, Artificial Sequence
  Description of Artificial Sequence: Synthetic oligonucleotide
  Target: ATXN1; (-) strand; PAM type: YTN; PAM sequence: CTC
gttcctccattccatcatcc

SEQ ID NO: 169935 - DNA, 20 bp, Artificial Sequence
  Description of Artificial Sequence: Synthetic oligonucleotide
  Target: ATXN1; (-) strand; PAM type: YTN; PAM sequence: TTG
gccaaaggagtgccccatgt

SEQ ID NO: 169936 - DNA, 20 bp, Artificial Sequence
  Description of Artificial Sequence: Synthetic oligonucleotide
  Target: ATXN1; (-) strand; PAM type: YTN; PAM sequence: TTC
attggccaaaggagtgcccc

SEQ ID NO: 169937 - DNA, 20 bp, Artificial Sequence
  Description of Artificial Sequence: Synthetic oligonucleotide
  Target: ATXN1; (-) strand; PAM type: YTN; PAM sequence: CTT
cattggccaaaggagtgccc

SEQ ID NO: 169938 - DNA, 20 bp, Artificial Sequence
  Description of Artificial Sequence: Synthetic oligonucleotide
  Target: ATXN1; (-) strand; PAM type: YTN; PAM sequence: TTA
cttcattggccaaaggagtg

SEQ ID NO: 169939 - DNA, 20 bp, Artificial Sequence
  Description of Artificial Sequence: Synthetic oligonucleotide
  Target: ATXN1; (-) strand; PAM type: YTN; PAM sequence: TTT
acttcattggccaaaggagt

SEQ ID NO: 169940 - DNA, 20 bp, Artificial Sequence
  Description of Artificial Sequence: Synthetic oligonucleotide
  Target: ATXN1; (-) strand; PAM type: YTN; PAM sequence: CTT
tacttcattggccaaaggag

SEQ ID NO: 169941 - DNA, 20 bp, Artificial Sequence
  Description of Artificial Sequence: Synthetic oligonucleotide
  Target: ATXN1; (-) strand; PAM type: YTN; PAM sequence: CTG
acctttacttcattggccaa

SEQ ID NO: 169942 - DNA, 20 bp, Artificial Sequence
  Description of Artificial Sequence: Synthetic oligonucleotide
  Target: ATXN1; (-) strand; PAM type: YTN; PAM sequence: CTC
actgacctttacttcattgg

SEQ ID NO: 169943 - DNA, 20 bp, Artificial Sequence
  Description of Artificial Sequence: Synthetic oligonucleotide
  Target: ATXN1; (-) strand; PAM type: YTN; PAM sequence: TTC
actcactgacctttacttca

SEQ ID NO: 169944 - DNA, 20 bp, Artificial Sequence
  Description of Artificial Sequence: Synthetic oligonucleotide
  Target: ATXN1; (-) strand; PAM type: YTN; PAM sequence: TTG
tgtgttcactcactgacctt

SEQ ID NO: 169945 - DNA, 20 bp, Artificial Sequence
  Description of Artificial Sequence: Synthetic oligonucleotide
  Target: ATXN1; (-) strand; PAM type: YTN; PAM sequence: TTT
gtgtgttcactcactgacct

SEQ ID NO: 169946 - DNA, 20 bp, Artificial Sequence
  Description of Artificial Sequence: Synthetic oligonucleotide
  Target: ATXN1; (-) strand; PAM type: YTN; PAM sequence: CTT
tgtgtgttcactcactgacc

SEQ ID NO: 169947 - DNA, 20 bp, Artificial Sequence
  Description of Artificial Sequence: Synthetic oligonucleotide
  Target: ATXN1; (-) strand; PAM type: YTN; PAM sequence: TTC
tttgtgtgttcactcactga

SEQ ID NO: 169948 - DNA, 20 bp, Artificial Sequence
  Description of Artificial Sequence: Synthetic oligonucleotide
  Target: ATXN1; (-) strand; PAM type: YTN; PAM sequence: TTT
ctttgtgtgttcactcactg

SEQ ID NO: 169949 - DNA, 20 bp, Artificial Sequence
  Description of Artificial Sequence: Synthetic oligonucleotide
  Target: ATXN1; (-) strand; PAM type: YTN; PAM sequence: TTA
atcatttctttgtgtgttca

SEQ ID NO: 169950 - DNA, 20 bp, Artificial Sequence
  Description of Artificial Sequence: Synthetic oligonucleotide
  Target: ATXN1; (-) strand; PAM type: YTN; PAM sequence: CTA
tgacaggttaatcatttctt

SEQ ID NO: 169951 - DNA, 20 bp, Artificial Sequence
  Description of Artificial Sequence: Synthetic oligonucleotide
  Target: ATXN1; (-) strand; PAM type: YTN; PAM sequence: TTC
tatgacaggttaatcatttc

SEQ ID NO: 169952 - DNA, 20 bp, Artificial Sequence
  Description of Artificial Sequence: Synthetic oligonucleotide
  Target: ATXN1; (-) strand; PAM type: YTN; PAM sequence: TTT
ctatgacaggttaatcattt

SEQ ID NO: 169953 - DNA, 20 bp, Artificial Sequence
  Description of Artificial Sequence: Synthetic oligonucleotide
  Target: ATXN1; (-) strand; PAM type: YTN; PAM sequence: TTT
tctatgacaggttaatcatt

SEQ ID NO: 169954 - DNA, 20 bp, Artificial Sequence
  Description of Artificial Sequence: Synthetic oligonucleotide
  Target: ATXN1; (-) strand; PAM type: YTN; PAM sequence: CTT
ttctatgacaggttaatcat

SEQ ID NO: 169955 - DNA, 20 bp, Artificial Sequence
  Description of Artificial Sequence: Synthetic oligonucleotide
  Target: ATXN1; (-) strand; PAM type: YTN; PAM sequence: TTC
atgaccttttctatgacagg

SEQ ID NO: 169956 - DNA, 20 bp, Artificial Sequence
  Description of Artificial Sequence: Synthetic oligonucleotide
  Target: ATXN1; (-) strand; PAM type: YTN; PAM sequence: CTA
cattcatgaccttttctatg

SEQ ID NO: 169957 - DNA, 20 bp, Artificial Sequence
  Description of Artificial Sequence: Synthetic oligonucleotide
  Target: ATXN1; (-) strand; PAM type: YTN; PAM sequence: CTG
gcactacattcatgaccttt

SEQ ID NO: 169958 - DNA, 20 bp, Artificial Sequence
  Description of Artificial Sequence: Synthetic oligonucleotide
  Target: ATXN1; (-) strand; PAM type: YTN; PAM sequence: CTG
tagctggcactacattcatg

SEQ ID NO: 169959 - DNA, 20 bp, Artificial Sequence
  Description of Artificial Sequence: Synthetic oligonucleotide
  Target: ATXN1; (-) strand; PAM type: YTN; PAM sequence: CTC
atgagagcaaagtgaagtat

SEQ ID NO: 169960 - DNA, 20 bp, Artificial Sequence
  Description of Artificial Sequence: Synthetic oligonucleotide
  Target: ATXN1; (-) strand; PAM type: YTN; PAM sequence: CTG
accaaatctcatgagagcaa

SEQ ID NO: 169961 - DNA, 20 bp, Artificial Sequence
  Description of Artificial Sequence: Synthetic oligonucleotide
  Target: ATXN1; (-) strand; PAM type: YTN; PAM sequence: TTA
ctgaccaaatctcatgagag

SEQ ID NO: 169962 - DNA, 20 bp, Artificial Sequence
  Description of Artificial Sequence: Synthetic oligonucleotide
  Target: ATXN1; (-) strand; PAM type: YTN; PAM sequence: TTT
actgaccaaatctcatgaga

SEQ ID NO: 169963 - DNA, 20 bp, Artificial Sequence
  Description of Artificial Sequence: Synthetic oligonucleotide
  Target: ATXN1; (-) strand; PAM type: YTN; PAM sequence: CTT
tactgaccaaatctcatgag

SEQ ID NO: 169964 - DNA, 20 bp, Artificial Sequence
  Description of Artificial Sequence: Synthetic oligonucleotide
  Target: ATXN1; (-) strand; PAM type: YTN; PAM sequence: TTC
ctttactgaccaaatctcat

SEQ ID NO: 169965 - DNA, 20 bp, Artificial Sequence
  Description of Artificial Sequence: Synthetic oligonucleotide
  Target: ATXN1; (-) strand; PAM type: YTN; PAM sequence: TTA
cacggataattcctttactg

SEQ ID NO: 169966 - DNA, 20 bp, Artificial Sequence
  Description of Artificial Sequence: Synthetic oligonucleotide
  Target: ATXN1; (-) strand; PAM type: YTN; PAM sequence: TTT
acacggataattcctttact

SEQ ID NO: 169967 - DNA, 20 bp, Artificial Sequence
  Description of Artificial Sequence: Synthetic oligonucleotide
  Target: ATXN1; (-) strand; PAM type: YTN; PAM sequence: CTT
tacacggataattcctttac

SEQ ID NO: 169968 - DNA, 20 bp, Artificial Sequence
  Description of Artificial Sequence: Synthetic oligonucleotide
  Target: ATXN1; (-) strand; PAM type: YTN; PAM sequence: CTC
tttacacggataattccttt

SEQ ID NO: 169969 - DNA, 20 bp, Artificial Sequence
  Description of Artificial Sequence: Synthetic oligonucleotide
  Target: ATXN1; (-) strand; PAM type: YTN; PAM sequence: TTC
tctttacacggataattcct

SEQ ID NO: 169970 - DNA, 20 bp, Artificial Sequence
  Description of Artificial Sequence: Synthetic oligonucleotide
  Target: ATXN1; (-) strand; PAM type: YTN; PAM sequence: TTT
ctctttacacggataattcc

SEQ ID NO: 169971 - DNA, 20 bp, Artificial Sequence
  Description of Artificial Sequence: Synthetic oligonucleotide
  Target: ATXN1; (-) strand; PAM type: YTN; PAM sequence: TTT
tctctttacacggataattc

SEQ ID NO: 169972 - DNA, 20 bp, Artificial Sequence
  Description of Artificial Sequence: Synthetic oligonucleotide
  Target: ATXN1; (-) strand; PAM type: YTN; PAM sequence: CTG
attttctctttacacggata

SEQ ID NO: 169973 - DNA, 20 bp, Artificial Sequence
  Description of Artificial Sequence: Synthetic oligonucleotide
  Target: ATXN1; (-) strand; PAM type: YTN; PAM sequence: CTC
ctgattttctctttacacgg

SEQ ID NO: 169974 - DNA, 20 bp, Artificial Sequence
  Description of Artificial Sequence: Synthetic oligonucleotide
  Target: ATXN1; (-) strand; PAM type: YTN; PAM sequence: TTG
ctcctgattttctctttaca

SEQ ID NO: 169975 - DNA, 20 bp, Artificial Sequence
  Description of Artificial Sequence: Synthetic oligonucleotide
  Target: ATXN1; (-) strand; PAM type: YTN; PAM sequence: CTG
gcaaggttgctcctgatttt

SEQ ID NO: 169976 - DNA, 20 bp, Artificial Sequence
  Description of Artificial Sequence: Synthetic oligonucleotide
  Target: ATXN1; (-) strand; PAM type: YTN; PAM sequence: TTC
acaggctggcaaggttgctc

SEQ ID NO: 169977 - DNA, 20 bp, Artificial Sequence
  Description of Artificial Sequence: Synthetic oligonucleotide
  Target: ATXN1; (-) strand; PAM type: YTN; PAM sequence: TTG
ttcacaggctggcaaggttg

SEQ ID NO: 169978 - DNA, 20 bp, Artificial Sequence
  Description of Artificial Sequence: Synthetic oligonucleotide
  Target: ATXN1; (-) strand; PAM type: YTN; PAM sequence: TTT
gttcacaggctggcaaggtt

SEQ ID NO: 169979 - DNA, 20 bp, Artificial Sequence
  Description of Artificial Sequence: Synthetic oligonucleotide
  Target: ATXN1; (-) strand; PAM type: YTN; PAM sequence: TTT
tgttcacaggctggcaaggt

SEQ ID NO: 169980 - DNA, 20 bp, Artificial Sequence
  Description of Artificial Sequence: Synthetic oligonucleotide
  Target: ATXN1; (-) strand; PAM type: YTN; PAM sequence: CTT
ttgttcacaggctggcaagg

SEQ ID NO: 169981 - DNA, 20 bp, Artificial Sequence
  Description of Artificial Sequence: Synthetic oligonucleotide
  Target: ATXN1; (-) strand; PAM type: YTN; PAM sequence: CTA
gtcttttgttcacaggctgg

SEQ ID NO: 169982 - DNA, 20 bp, Artificial Sequence
  Description of Artificial Sequence: Synthetic oligonucleotide
  Target: ATXN1; (-) strand; PAM type: YTN; PAM sequence: TTG
gctagtcttttgttcacagg

SEQ ID NO: 169983 - DNA, 20 bp, Artificial Sequence
  Description of Artificial Sequence: Synthetic oligonucleotide
  Target: ATXN1; (-) strand; PAM type: YTN; PAM sequence: CTG
gtaagaagtggcattggcta

SEQ ID NO: 169984 - DNA, 20 bp, Artificial Sequence
  Description of Artificial Sequence: Synthetic oligonucleotide
  Target: ATXN1; (-) strand; PAM type: YTN; PAM sequence: TTG
ctggtaagaagtggcattgg

SEQ ID NO: 169985 - DNA, 20 bp, Artificial Sequence
  Description of Artificial Sequence: Synthetic oligonucleotide
  Target: ATXN1; (-) strand; PAM type: YTN; PAM sequence: CTT
gctggtaagaagtggcattg

SEQ ID NO: 169986 - DNA, 20 bp, Artificial Sequence
  Description of Artificial Sequence: Synthetic oligonucleotide
  Target: ATXN1; (-) strand; PAM type: YTN; PAM sequence: TTG
gaccttgctggtaagaagtg

SEQ ID NO: 169987 - DNA, 20 bp, Artificial Sequence
  Description of Artificial Sequence: Synthetic oligonucleotide
  Target: ATXN1; (-) strand; PAM type: YTN; PAM sequence: TTT
ggaccttgctggtaagaagt

SEQ ID NO: 169988 - DNA, 20 bp, Artificial Sequence
  Description of Artificial Sequence: Synthetic oligonucleotide
  Target: ATXN1; (-) strand; PAM type: YTN; PAM sequence: CTG
tttggaccttgctggtaaga

SEQ ID NO: 169989 - DNA, 20 bp, Artificial Sequence
  Description of Artificial Sequence: Synthetic oligonucleotide
  Target: ATXN1; (-) strand; PAM type: YTN; PAM sequence: TTG
gcatgactgtttggaccttg

SEQ ID NO: 169990 - DNA, 20 bp, Artificial Sequence
  Description of Artificial Sequence: Synthetic oligonucleotide
  Target: ATXN1; (-) strand; PAM type: YTN; PAM sequence: CTT
ggcatgactgtttggacctt

SEQ ID NO: 169991 - DNA, 20 bp, Artificial Sequence
  Description of Artificial Sequence: Synthetic oligonucleotide
  Target: ATXN1; (-) strand; PAM type: YTN; PAM sequence: CTA
cataccccacataaccttgg

SEQ ID NO: 169992 - DNA, 20 bp, Artificial Sequence
  Description of Artificial Sequence: Synthetic oligonucleotide
  Target: ATXN1; (-) strand; PAM type: YTN; PAM sequence: TTC
tacataccccacataacctt

SEQ ID NO: 169993 - DNA, 20 bp, Artificial Sequence
  Description of Artificial Sequence: Synthetic oligonucleotide
  Target: ATXN1; (-) strand; PAM type: YTN; PAM sequence: TTC
aagacagggtacagagagaa

SEQ ID NO: 169994 - DNA, 20 bp, Artificial Sequence
  Description of Artificial Sequence: Synthetic oligonucleotide
  Target: ATXN1; (-) strand; PAM type: YTN; PAM sequence: CTG
gatgtgcaaaatagaattca

SEQ ID NO: 169995 - DNA, 20 bp, Artificial Sequence
  Description of Artificial Sequence: Synthetic oligonucleotide
  Target: ATXN1; (-) strand; PAM type: YTN; PAM sequence: TTC
ctggatgtgcaaaatagaat

SEQ ID NO: 169996 - DNA, 20 bp, Artificial Sequence
  Description of Artificial Sequence: Synthetic oligonucleotide
  Target: ATXN1; (-) strand; PAM type: YTN; PAM sequence: TTT
cctggatgtgcaaaatagaa

SEQ ID NO: 169997 - DNA, 20 bp, Artificial Sequence
  Description of Artificial Sequence: Synthetic oligonucleotide
  Target: ATXN1; (-) strand; PAM type: YTN; PAM sequence: CTT
tcctggatgtgcaaaataga

SEQ ID NO: 169998 - DNA, 20 bp, Artificial Sequence
  Description of Artificial Sequence: Synthetic oligonucleotide
  Target: ATXN1; (-) strand; PAM type: YTN; PAM sequence: TTG
gctttcctggatgtgcaaaa

SEQ ID NO: 169999 - DNA, 20 bp, Artificial Sequence
  Description of Artificial Sequence: Synthetic oligonucleotide
  Target: ATXN1; (-) strand; PAM type: YTN; PAM sequence: CTT
ggctttcctggatgtgcaaa

SEQ ID NO: 170000 - DNA, 20 bp, Artificial Sequence
  Description of Artificial Sequence: Synthetic oligonucleotide
  Target: ATXN1; (-) strand; PAM type: YTN; PAM sequence: TTC
ttggctttcctggatgtgca

SEQ ID NO: 170001 - DNA, 20 bp, Artificial Sequence
  Description of Artificial Sequence: Synthetic oligonucleotide
  Target: ATXN1; (-) strand; PAM type: YTN; PAM sequence: TTT
cttggctttcctggatgtgc

SEQ ID NO: 170002 - DNA, 20 bp, Artificial Sequence
  Description of Artificial Sequence: Synthetic oligonucleotide
  Target: ATXN1; (-) strand; PAM type: YTN; PAM sequence: TTG
caatcaggtgcatgcgtttc

SEQ ID NO: 170003 - DNA, 20 bp, Artificial Sequence
  Description of Artificial Sequence: Synthetic oligonucleotide
  Target: ATXN1; (-) strand; PAM type: YTN; PAM sequence: CTA
tatatgttgcaatcaggtgc

SEQ ID NO: 170004 - DNA, 20 bp, Artificial Sequence
  Description of Artificial Sequence: Synthetic oligonucleotide
  Target: ATXN1; (-) strand; PAM type: YTN; PAM sequence: CTG
tggtatcaaaatatgactat

SEQ ID NO: 170005 - DNA, 20 bp, Artificial Sequence
  Description of Artificial Sequence: Synthetic oligonucleotide
  Target: ATXN1; (-) strand; PAM type: YTN; PAM sequence: TTG
ccatccaaactgtggtatca

SEQ ID NO: 170006 - DNA, 20 bp, Artificial Sequence
  Description of Artificial Sequence: Synthetic oligonucleotide
  Target: ATXN1; (-) strand; PAM type: YTN; PAM sequence: CTT
gccatccaaactgtggtatc

SEQ ID NO: 170007 - DNA, 20 bp, Artificial Sequence
  Description of Artificial Sequence: Synthetic oligonucleotide
  Target: ATXN1; (-) strand; PAM type: YTN; PAM sequence: TTG
aataatcttgccatccaaac

SEQ ID NO: 170008 - DNA, 20 bp, Artificial Sequence
  Description of Artificial Sequence: Synthetic oligonucleotide
  Target: ATXN1; (-) strand; PAM type: YTN; PAM sequence: CTG
ataggaaaaaggattgaata

SEQ ID NO: 170009 - DNA, 20 bp, Artificial Sequence
  Description of Artificial Sequence: Synthetic oligonucleotide
  Target: ATXN1; (-) strand; PAM type: YTN; PAM sequence: CTC
tgataggaaaaaggattgaa

SEQ ID NO: 170010 - DNA, 20 bp, Artificial Sequence
  Description of Artificial Sequence: Synthetic oligonucleotide
  Target: ATXN1; (-) strand; PAM type: YTN; PAM sequence: CTC
tctgataggaaaaaggattg

SEQ ID NO: 170011 - DNA, 20 bp, Artificial Sequence
  Description of Artificial Sequence: Synthetic oligonucleotide
  Target: ATXN1; (-) strand; PAM type: YTN; PAM sequence: TTG
tggatccatggagaagtcag

SEQ ID NO: 170012 - DNA, 20 bp, Artificial Sequence
  Description of Artificial Sequence: Synthetic oligonucleotide
  Target: ATXN1; (-) strand; PAM type: YTN; PAM sequence: CTG
ttgtggatccatggagaagt

SEQ ID NO: 170013 - DNA, 20 bp, Artificial Sequence
  Description of Artificial Sequence: Synthetic oligonucleotide
  Target: ATXN1; (-) strand; PAM type: YTN; PAM sequence: TTG
actgttgtggatccatggag

SEQ ID NO: 170014 - DNA, 20 bp, Artificial Sequence
  Description of Artificial Sequence: Synthetic oligonucleotide
  Target: ATXN1; (-) strand; PAM type: YTN; PAM sequence: TTA
aagcattgactgttgtggat

SEQ ID NO: 170015 - DNA, 20 bp, Artificial Sequence
  Description of Artificial Sequence: Synthetic oligonucleotide
  Target: ATXN1; (-) strand; PAM type: YTN; PAM sequence: TTT
aaagcattgactgttgtgga

SEQ ID NO: 170016 - DNA, 20 bp, Artificial Sequence
  Description of Artificial Sequence: Synthetic oligonucleotide
  Target: ATXN1; (-) strand; PAM type: YTN; PAM sequence: TTT
taaagcattgactgttgtgg

SEQ ID NO: 170017 - DNA, 20 bp, Artificial Sequence
  Description of Artificial Sequence: Synthetic oligonucleotide
  Target: ATXN1; (-) strand; PAM type: YTN; PAM sequence: TTT
ttaaagcattgactgttgtg

SEQ ID NO: 170018 - DNA, 20 bp, Artificial Sequence
  Description of Artificial Sequence: Synthetic oligonucleotide
  Target: ATXN1; (-) strand; PAM type: YTN; PAM sequence: TTT
tttaaagcattgactgttgt

SEQ ID NO: 170019 - DNA, 20 bp, Artificial Sequence
  Description of Artificial Sequence: Synthetic oligonucleotide
  Target: ATXN1; (-) strand; PAM type: YTN; PAM sequence: CTG
agtattttttaaagcattga

SEQ ID NO: 170020 - DNA, 20 bp, Artificial Sequence
  Description of Artificial Sequence: Synthetic oligonucleotide
  Target: ATXN1; (-) strand; PAM type: YTN; PAM sequence: TTG
gtccatgtcctgagtatttt

SEQ ID NO: 170021 - DNA, 20 bp, Artificial Sequence
  Description of Artificial Sequence: Synthetic oligonucleotide
  Target: ATXN1; (-) strand; PAM type: YTN; PAM sequence: TTG
tattggtccatgtcctgagt

SEQ ID NO: 170022 - DNA, 20 bp, Artificial Sequence
  Description of Artificial Sequence: Synthetic oligonucleotide
  Target: ATXN1; (-) strand; PAM type: YTN; PAM sequence: TTT
gtattggtccatgtcctgag

SEQ ID NO: 170023 - DNA, 20 bp, Artificial Sequence
  Description of Artificial Sequence: Synthetic oligonucleotide
  Target: ATXN1; (-) strand; PAM type: YTN; PAM sequence: TTT
tgtattggtccatgtcctga

SEQ ID NO: 170024 - DNA, 20 bp, Artificial Sequence
  Description of Artificial Sequence: Synthetic oligonucleotide
  Target: ATXN1; (-) strand; PAM type: YTN; PAM sequence: TTT
ttgtattggtccatgtcctg

SEQ ID NO: 170025 - DNA, 20 bp, Artificial Sequence
  Description of Artificial Sequence: Synthetic oligonucleotide
  Target: ATXN1; (-) strand; PAM type: YTN; PAM sequence: TTA
tttttgtattggtccatgtc

SEQ ID NO: 170026 - DNA, 20 bp, Artificial Sequence
  Description of Artificial Sequence: Synthetic oligonucleotide
  Target: ATXN1; (-) strand; PAM type: YTN; PAM sequence: TTT
atttttgtattggtccatgt

SEQ ID NO: 170027 - DNA, 20 bp, Artificial Sequence
  Description of Artificial Sequence: Synthetic oligonucleotide
  Target: ATXN1; (-) strand; PAM type: YTN; PAM sequence: CTT
tatttttgtattggtccatg

SEQ ID NO: 170028 - DNA, 20 bp, Artificial Sequence
  Description of Artificial Sequence: Synthetic oligonucleotide
  Target: ATXN1; (-) strand; PAM type: YTN; PAM sequence: TTA
cctttatttttgtattggtc

SEQ ID NO: 170029 - DNA, 20 bp, Artificial Sequence
  Description of Artificial Sequence: Synthetic oligonucleotide
  Target: ATXN1; (-) strand; PAM type: YTN; PAM sequence: TTA
atcacgattacctttatttt

SEQ ID NO: 170030 - DNA, 20 bp, Artificial Sequence
  Description of Artificial Sequence: Synthetic oligonucleotide
  Target: ATXN1; (-) strand; PAM type: YTN; PAM sequence: TTT
aatcacgattacctttattt

SEQ ID NO: 170031 - DNA, 20 bp, Artificial Sequence
  Description of Artificial Sequence: Synthetic oligonucleotide
  Target: ATXN1; (-) strand; PAM type: YTN; PAM sequence: TTG
tttaatcacgattaccttta

SEQ ID NO: 170032 - DNA, 20 bp, Artificial Sequence
  Description of Artificial Sequence: Synthetic oligonucleotide
  Target: ATXN1; (-) strand; PAM type: YTN; PAM sequence: TTC
agttgtttaatcacgattac

SEQ ID NO: 170033 - DNA, 20 bp, Artificial Sequence
  Description of Artificial Sequence: Synthetic oligonucleotide
  Target: ATXN1; (-) strand; PAM type: YTN; PAM sequence: TTC
catgttcagttgtttaatca

SEQ ID NO: 170034 - DNA, 20 bp, Artificial Sequence
  Description of Artificial Sequence: Synthetic oligonucleotide
  Target: ATXN1; (-) strand; PAM type: YTN; PAM sequence: TTA
ttccatgttcagttgtttaa

SEQ ID NO: 170035 - DNA, 20 bp, Artificial Sequence
  Description of Artificial Sequence: Synthetic oligonucleotide
  Target: ATXN1; (-) strand; PAM type: YTN; PAM sequence: CTT
attccatgttcagttgttta

SEQ ID NO: 170036 - DNA, 20 bp, Artificial Sequence
  Description of Artificial Sequence: Synthetic oligonucleotide
  Target: ATXN1; (-) strand; PAM type: YTN; PAM sequence: CTG
tggccttattccatgttcag

SEQ ID NO: 170037 - DNA, 20 bp, Artificial Sequence
  Description of Artificial Sequence: Synthetic oligonucleotide
  Target: ATXN1; (-) strand; PAM type: YTN; PAM sequence: TTC
tgtggccttattccatgttc

SEQ ID NO: 170038 - DNA, 20 bp, Artificial Sequence
  Description of Artificial Sequence: Synthetic oligonucleotide
  Target: ATXN1; (-) strand; PAM type: YTN; PAM sequence: CTT
ctgtggccttattccatgtt

SEQ ID NO: 170039 - DNA, 20 bp, Artificial Sequence
  Description of Artificial Sequence: Synthetic oligonucleotide
  Target: ATXN1; (-) strand; PAM type: YTN; PAM sequence: TTA
gagaaccttctgtggcctta

SEQ ID NO: 170040 - DNA, 20 bp, Artificial Sequence
  Description of Artificial Sequence: Synthetic oligonucleotide
  Target: ATXN1; (-) strand; PAM type: YTN; PAM sequence: TTT
agagaaccttctgtggcctt

SEQ ID NO: 170041 - DNA, 20 bp, Artificial Sequence
  Description of Artificial Sequence: Synthetic oligonucleotide
  Target: ATXN1; (-) strand; PAM type: YTN; PAM sequence: TTT
tagagaaccttctgtggcct

SEQ ID NO: 170042 - DNA, 20 bp, Artificial Sequence
  Description of Artificial Sequence: Synthetic oligonucleotide
  Target: ATXN1; (-) strand; PAM type: YTN; PAM sequence: TTT
ttagagaaccttctgtggcc

SEQ ID NO: 170043 - DNA, 20 bp, Artificial Sequence
  Description of Artificial Sequence: Synthetic oligonucleotide
  Target: ATXN1; (-) strand; PAM type: YTN; PAM sequence: CTT
tttagagaaccttctgtggc

SEQ ID NO: 170044 - DNA, 20 bp, Artificial Sequence
  Description of Artificial Sequence: Synthetic oligonucleotide
  Target: ATXN1; (-) strand; PAM type: YTN; PAM sequence: CTC
tttttagagaaccttctgtg

SEQ ID NO: 170045 - DNA, 20 bp, Artificial Sequence
  Description of Artificial Sequence: Synthetic oligonucleotide
  Target: ATXN1; (-) strand; PAM type: YTN; PAM sequence: CTG
agcaaggtcagatactcttt

SEQ ID NO: 170046 - DNA, 20 bp, Artificial Sequence
  Description of Artificial Sequence: Synthetic oligonucleotide
  Target: ATXN1; (-) strand; PAM type: YTN; PAM sequence: CTC
atggtcacaccagtctgagc

SEQ ID NO: 170047 - DNA, 20 bp, Artificial Sequence
  Description of Artificial Sequence: Synthetic oligonucleotide
  Target: ATXN1; (-) strand; PAM type: YTN; PAM sequence: CTC
atatctcatggtcacaccag

SEQ ID NO: 170048 - DNA, 20 bp, Artificial Sequence
  Description of Artificial Sequence: Synthetic oligonucleotide
  Target: ATXN1; (-) strand; PAM type: YTN; PAM sequence: TTC
catctcatatctcatggtca

SEQ ID NO: 170049 - DNA, 20 bp, Artificial Sequence
  Description of Artificial Sequence: Synthetic oligonucleotide
  Target: ATXN1; (-) strand; PAM type: YTN; PAM sequence: TTG
ttccatctcatatctcatgg

SEQ ID NO: 170050 - DNA, 20 bp, Artificial Sequence
  Description of Artificial Sequence: Synthetic oligonucleotide
  Target: ATXN1; (-) strand; PAM type: YTN; PAM sequence: TTT
gttccatctcatatctcatg

SEQ ID NO: 170051 - DNA, 20 bp, Artificial Sequence
  Description of Artificial Sequence: Synthetic oligonucleotide
  Target: ATXN1; (-) strand; PAM type: YTN; PAM sequence: CTG
tgccatttgttccatctcat

SEQ ID NO: 170052 - DNA, 20 bp, Artificial Sequence
  Description of Artificial Sequence: Synthetic oligonucleotide
  Target: ATXN1; (-) strand; PAM type: YTN; PAM sequence: CTA
tctgtgccatttgttccatc

SEQ ID NO: 170053 - DNA, 20 bp, Artificial Sequence
  Description of Artificial Sequence: Synthetic oligonucleotide
  Target: ATXN1; (-) strand; PAM type: YTN; PAM sequence: TTG
ctatctgtgccatttgttcc

SEQ ID NO: 170054 - DNA, 20 bp, Artificial Sequence
  Description of Artificial Sequence: Synthetic oligonucleotide
  Target: ATXN1; (-) strand; PAM type: YTN; PAM sequence: CTT
gctatctgtgccatttgttc

SEQ ID NO: 170055 - DNA, 20 bp, Artificial Sequence
  Description of Artificial Sequence: Synthetic oligonucleotide
  Target: ATXN1; (-) strand; PAM type: YTN; PAM sequence: TTC
cttgctatctgtgccatttg

SEQ ID NO: 170056 - DNA, 20 bp, Artificial Sequence
  Description of Artificial Sequence: Synthetic oligonucleotide
  Target: ATXN1; (-) strand; PAM type: YTN; PAM sequence: CTG
cattccttgctatctgtgcc

SEQ ID NO: 170057 - DNA, 20 bp, Artificial Sequence
  Description of Artificial Sequence: Synthetic oligonucleotide
  Target: ATXN1; (-) strand; PAM type: YTN; PAM sequence: CTG
aagtgggaatgaatatgaag

SEQ ID NO: 170058 - DNA, 20 bp, Artificial Sequence
  Description of Artificial Sequence: Synthetic oligonucleotide
  Target: ATXN1; (-) strand; PAM type: YTN; PAM sequence: CTG
aactgaagtgggaatgaata

SEQ ID NO: 170059 - DNA, 20 bp, Artificial Sequence
  Description of Artificial Sequence: Synthetic oligonucleotide
  Target: ATXN1; (-) strand; PAM type: YTN; PAM sequence: TTA
ggctgaactgaagtgggaat

SEQ ID NO: 170060 - DNA, 20 bp, Artificial Sequence
  Description of Artificial Sequence: Synthetic oligonucleotide
  Target: ATXN1; (-) strand; PAM type: YTN; PAM sequence: TTG
gtgaatgaagtgttaggctg

SEQ ID NO: 170061 - DNA, 20 bp, Artificial Sequence
  Description of Artificial Sequence: Synthetic oligonucleotide
  Target: ATXN1; (-) strand; PAM type: YTN; PAM sequence: TTT
ggtgaatgaagtgttaggct

SEQ ID NO: 170062 - DNA, 20 bp, Artificial Sequence
  Description of Artificial Sequence: Synthetic oligonucleotide
  Target: ATXN1; (-) strand; PAM type: YTN; PAM sequence: CTC
atttggtgaatgaagtgtta

SEQ ID NO: 170063 - DNA, 20 bp, Artificial Sequence
  Description of Artificial Sequence: Synthetic oligonucleotide
  Target: ATXN1; (-) strand; PAM type: YTN; PAM sequence: TTG
gtgatcactcatttggtgaa

SEQ ID NO: 170064 - DNA, 20 bp, Artificial Sequence
  Description of Artificial Sequence: Synthetic oligonucleotide
  Target: ATXN1; (-) strand; PAM type: YTN; PAM sequence: CTG
atgcatagtaggcagttggt

SEQ ID NO: 170065 - DNA, 20 bp, Artificial Sequence
  Description of Artificial Sequence: Synthetic oligonucleotide
  Target: ATXN1; (-) strand; PAM type: YTN; PAM sequence: TTA
tatgtctgatgcatagtagg

SEQ ID NO: 170066 - DNA, 20 bp, Artificial Sequence
  Description of Artificial Sequence: Synthetic oligonucleotide
  Target: ATXN1; (-) strand; PAM type: YTN; PAM sequence: TTT
atatgtctgatgcatagtag

SEQ ID NO: 170067 - DNA, 20 bp, Artificial Sequence
  Description of Artificial Sequence: Synthetic oligonucleotide
  Target: ATXN1; (-) strand; PAM type: YTN; PAM sequence: TTT
tatatgtctgatgcatagta

SEQ ID NO: 170068 - DNA, 20 bp, Artificial Sequence
  Description of Artificial Sequence: Synthetic oligonucleotide
  Target: ATXN1; (-) strand; PAM type: YTN; PAM sequence: CTG
ttttatatgtctgatgcata

SEQ ID NO: 170069 - DNA, 20 bp, Artificial Sequence
  Description of Artificial Sequence: Synthetic oligonucleotide
  Target: ATXN1; (-) strand; PAM type: YTN; PAM sequence: TTC
tgttttatatgtctgatgca

SEQ ID NO: 170070 - DNA, 20 bp, Artificial Sequence
  Description of Artificial Sequence: Synthetic oligonucleotide
  Target: ATXN1; (-) strand; PAM type: YTN; PAM sequence: CTT
ctgttttatatgtctgatgc

SEQ ID NO: 170071 - DNA, 20 bp, Artificial Sequence
  Description of Artificial Sequence: Synthetic oligonucleotide
  Target: ATXN1; (-) strand; PAM type: YTN; PAM sequence: TTA
gatcttctgttttatatgtc

SEQ ID NO: 170072 - DNA, 20 bp, Artificial Sequence
  Description of Artificial Sequence: Synthetic oligonucleotide
  Target: ATXN1; (-) strand; PAM type: YTN; PAM sequence: TTT
agatcttctgttttatatgt

SEQ ID NO: 170073 - DNA, 20 bp, Artificial Sequence
  Description of Artificial Sequence: Synthetic oligonucleotide
  Target: ATXN1; (-) strand; PAM type: YTN; PAM sequence: TTT
tagatcttctgttttatatg

SEQ ID NO: 170074 - DNA, 20 bp, Artificial Sequence
  Description of Artificial Sequence: Synthetic oligonucleotide
  Target: ATXN1; (-) strand; PAM type: YTN; PAM sequence: CTT
ttagatcttctgttttatat

SEQ ID NO: 170075 - DNA, 20 bp, Artificial Sequence
  Description of Artificial Sequence: Synthetic oligonucleotide
  Target: ATXN1; (-) strand; PAM type: YTN; PAM sequence: CTG
tgtcttttagatcttctgtt

SEQ ID NO: 170076 - DNA, 20 bp, Artificial Sequence
  Description of Artificial Sequence: Synthetic oligonucleotide
  Target: ATXN1; (-) strand; PAM type: YTN; PAM sequence: TTG
agaacaggaactgtgtcttt

SEQ ID NO: 170077 - DNA, 20 bp, Artificial Sequence
  Description of Artificial Sequence: Synthetic oligonucleotide
  Target: ATXN1; (-) strand; PAM type: YTN; PAM sequence: CTT
gagaacaggaactgtgtctt

SEQ ID NO: 170078 - DNA, 20 bp, Artificial Sequence
  Description of Artificial Sequence: Synthetic oligonucleotide
  Target: ATXN1; (-) strand; PAM type: YTN; PAM sequence: CTC
cttgagaacaggaactgtgt

SEQ ID NO: 170079 - DNA, 20 bp, Artificial Sequence
  Description of Artificial Sequence: Synthetic oligonucleotide
  Target: ATXN1; (-) strand; PAM type: YTN; PAM sequence: TTG
ggtggggacacaaatgccaa

SEQ ID NO: 170080 - DNA, 20 bp, Artificial Sequence
  Description of Artificial Sequence: Synthetic oligonucleotide
  Target: ATXN1; (-) strand; PAM type: YTN; PAM sequence: TTT
gggtggggacacaaatgcca

SEQ ID NO: 170081 - DNA, 20 bp, Artificial Sequence
  Description of Artificial Sequence: Synthetic oligonucleotide
  Target: ATXN1; (-) strand; PAM type: YTN; PAM sequence: TTG
acatgagatttgggtgggga

SEQ ID NO: 170082 - DNA, 20 bp, Artificial Sequence
  Description of Artificial Sequence: Synthetic oligonucleotide
  Target: ATXN1; (-) strand; PAM type: YTN; PAM sequence: TTT
gacatgagatttgggtgggg

SEQ ID NO: 170083 - DNA, 20 bp, Artificial Sequence
  Description of Artificial Sequence: Synthetic oligonucleotide
  Target: ATXN1; (-) strand; PAM type: YTN; PAM sequence: TTA
caatttgacatgagatttgg

SEQ ID NO: 170084 - DNA, 20 bp, Artificial Sequence
  Description of Artificial Sequence: Synthetic oligonucleotide
  Target: ATXN1; (-) strand; PAM type: YTN; PAM sequence: CTG
gggattacaatttgacatga

SEQ ID NO: 170085 - DNA, 20 bp, Artificial Sequence
  Description of Artificial Sequence: Synthetic oligonucleotide
  Target: ATXN1; (-) strand; PAM type: YTN; PAM sequence: CTC
caaacactggggattacaat

SEQ ID NO: 170086 - DNA, 20 bp, Artificial Sequence
  Description of Artificial Sequence: Synthetic oligonucleotide
  Target: ATXN1; (-) strand; PAM type: YTN; PAM sequence: TTC
ctccaaacactggggattac

SEQ ID NO: 170087 - DNA, 20 bp, Artificial Sequence
  Description of Artificial Sequence: Synthetic oligonucleotide
  Target: ATXN1; (-) strand; PAM type: YTN; PAM sequence: CTT
cctccaaacactggggatta

SEQ ID NO: 170088 - DNA, 20 bp, Artificial Sequence
  Description of Artificial Sequence: Synthetic oligonucleotide
  Target: ATXN1; (-) strand; PAM type: YTN; PAM sequence: CTC
ccaccaggcccttcctccaa

SEQ ID NO: 170089 - DNA, 20 bp, Artificial Sequence
  Description of Artificial Sequence: Synthetic oligonucleotide
  Target: ATXN1; (-) strand; PAM type: YTN; PAM sequence: CTA
agcccgtgatccagtcatct

SEQ ID NO: 170090 - DNA, 20 bp, Artificial Sequence
  Description of Artificial Sequence: Synthetic oligonucleotide
  Target: ATXN1; (-) strand; PAM type: YTN; PAM sequence: CTA
tcatgagaacagagagggag

SEQ ID NO: 170091 - DNA, 20 bp, Artificial Sequence
  Description of Artificial Sequence: Synthetic oligonucleotide
  Target: ATXN1; (-) strand; PAM type: YTN; PAM sequence: CTC
actatcatgagaacagagag

SEQ ID NO: 170092 - DNA, 20 bp, Artificial Sequence
  Description of Artificial Sequence: Synthetic oligonucleotide
  Target: ATXN1; (-) strand; PAM type: YTN; PAM sequence: CTC
atgagaactcactatcatga

SEQ ID NO: 170093 - DNA, 20 bp, Artificial Sequence
  Description of Artificial Sequence: Synthetic oligonucleotide
  Target: ATXN1; (-) strand; PAM type: YTN; PAM sequence: TTA
aacaaccagatctcatgaga

SEQ ID NO: 170094 - DNA, 20 bp, Artificial Sequence
  Description of Artificial Sequence: Synthetic oligonucleotide
  Target: ATXN1; (-) strand; PAM type: YTN; PAM sequence: TTT
aaacaaccagatctcatgag

SEQ ID NO: 170095 - DNA, 20 bp, Artificial Sequence
  Description of Artificial Sequence: Synthetic oligonucleotide
  Target: ATXN1; (-) strand; PAM type: YTN; PAM sequence: TTT
taaacaaccagatctcatga

SEQ ID NO: 170096 - DNA, 20 bp, Artificial Sequence
  Description of Artificial Sequence: Synthetic oligonucleotide
  Target: ATXN1; (-) strand; PAM type: YTN; PAM sequence: CTT
ttaaacaaccagatctcatg

SEQ ID NO: 170097 - DNA, 20 bp, Artificial Sequence
  Description of Artificial Sequence: Synthetic oligonucleotide
  Target: ATXN1; (-) strand; PAM type: YTN; PAM sequence: CTA
cacacttttaaacaaccaga

SEQ ID NO: 170098 - DNA, 20 bp, Artificial Sequence
  Description of Artificial Sequence: Synthetic oligonucleotide
  Target: ATXN1; (-) strand; PAM type: YTN; PAM sequence: CTG
gagcaggaggaagggaaagg

SEQ ID NO: 170099 - DNA, 20 bp, Artificial Sequence
  Description of Artificial Sequence: Synthetic oligonucleotide
  Target: ATXN1; (-) strand; PAM type: YTN; PAM sequence: CTA
cgtggctggagcaggaggaa

SEQ ID NO: 170100 - DNA, 20 bp, Artificial Sequence
  Description of Artificial Sequence: Synthetic oligonucleotide
  Target: ATXN1; (-) strand; PAM type: YTN; PAM sequence: TTA
caatcatggcagaaggagaa

SEQ ID NO: 170101 - DNA, 20 bp, Artificial Sequence
  Description of Artificial Sequence: Synthetic oligonucleotide
  Target: ATXN1; (-) strand; PAM type: YTN; PAM sequence: CTT
acaatcatggcagaaggaga

SEQ ID NO: 170102 - DNA, 20 bp, Artificial Sequence
  Description of Artificial Sequence: Synthetic oligonucleotide
  Target: ATXN1; (-) strand; PAM type: YTN; PAM sequence: CTC
aggaaacttacaatcatggc

SEQ ID NO: 170103 - DNA, 20 bp, Artificial Sequence
  Description of Artificial Sequence: Synthetic oligonucleotide
  Target: ATXN1; (-) strand; PAM type: YTN; PAM sequence: CTG
gggaggcctcaggaaactta

SEQ ID NO: 170104 - DNA, 20 bp, Artificial Sequence
  Description of Artificial Sequence: Synthetic oligonucleotide
  Target: ATXN1; (-) strand; PAM type: YTN; PAM sequence: CTG
tacaggaaacatggctgggg

SEQ ID NO: 170105 - DNA, 20 bp, Artificial Sequence
  Description of Artificial Sequence: Synthetic oligonucleotide
  Target: ATXN1; (-) strand; PAM type: YTN; PAM sequence: TTC
cacaggctgtacaggaaaca

SEQ ID NO: 170106 - DNA, 20 bp, Artificial Sequence
  Description of Artificial Sequence: Synthetic oligonucleotide
  Target: ATXN1; (-) strand; PAM type: YTN; PAM sequence: TTT
ccacaggctgtacaggaaac

SEQ ID NO: 170107 - DNA, 20 bp, Artificial Sequence
  Description of Artificial Sequence: Synthetic oligonucleotide
  Target: ATXN1; (-) strand; PAM type: YTN; PAM sequence: CTC
atgtttccacaggctgtaca

SEQ ID NO: 170108 - DNA, 20 bp, Artificial Sequence
  Description of Artificial Sequence: Synthetic oligonucleotide
  Target: ATXN1; (-) strand; PAM type: YTN; PAM sequence: TTG
gctcatgtttccacaggctg

SEQ ID NO: 170109 - DNA, 20 bp, Artificial Sequence
  Description of Artificial Sequence: Synthetic oligonucleotide
  Target: ATXN1; (-) strand; PAM type: YTN; PAM sequence: TTA
attggctcatgtttccacag

SEQ ID NO: 170110 - DNA, 20 bp, Artificial Sequence
  Description of Artificial Sequence: Synthetic oligonucleotide
  Target: ATXN1; (-) strand; PAM type: YTN; PAM sequence: TTT
aattggctcatgtttccaca

SEQ ID NO: 170111 - DNA, 20 bp, Artificial Sequence
  Description of Artificial Sequence: Synthetic oligonucleotide
  Target: ATXN1; (-) strand; PAM type: YTN; PAM sequence: CTG
gataatgtgtaaagaaaaga

SEQ ID NO: 170112 - DNA, 20 bp, Artificial Sequence
  Description of Artificial Sequence: Synthetic oligonucleotide
  Target: ATXN1; (-) strand; PAM type: YTN; PAM sequence: CTG
agactggataatgtgtaaag

SEQ ID NO: 170113 - DNA, 20 bp, Artificial Sequence
  Description of Artificial Sequence: Synthetic oligonucleotide
  Target: ATXN1; (-) strand; PAM type: YTN; PAM sequence: CTA
cctgagactggataatgtgt

SEQ ID NO: 170114 - DNA, 20 bp, Artificial Sequence
  Description of Artificial Sequence: Synthetic oligonucleotide
  Target: ATXN1; (-) strand; PAM type: YTN; PAM sequence: CTA
tgagaactacctgagactgg

SEQ ID NO: 170115 - DNA, 20 bp, Artificial Sequence
  Description of Artificial Sequence: Synthetic oligonucleotide
  Target: ATXN1; (-) strand; PAM type: YTN; PAM sequence: TTG
ctatgagaactacctgagac

SEQ ID NO: 170116 - DNA, 20 bp, Artificial Sequence
  Description of Artificial Sequence: Synthetic oligonucleotide
  Target: ATXN1; (-) strand; PAM type: YTN; PAM sequence: CTC
acattgctatgagaactacc

SEQ ID NO: 170117 - DNA, 20 bp, Artificial Sequence
  Description of Artificial Sequence: Synthetic oligonucleotide
  Target: ATXN1; (-) strand; PAM type: YTN; PAM sequence: TTC
tcacattgctatgagaacta

SEQ ID NO: 170118 - DNA, 20 bp, Artificial Sequence
  Description of Artificial Sequence: Synthetic oligonucleotide
  Target: ATXN1; (-) strand; PAM type: YTN; PAM sequence: CTT
ctcacattgctatgagaact

SEQ ID NO: 170119 - DNA, 20 bp, Artificial Sequence
  Description of Artificial Sequence: Synthetic oligonucleotide
  Target: ATXN1; (-) strand; PAM type: YTN; PAM sequence: CTC
ttctcacattgctatgagaa

SEQ ID NO: 170120 - DNA, 20 bp, Artificial Sequence
  Description of Artificial Sequence: Synthetic oligonucleotide
  Target: ATXN1; (-) strand; PAM type: YTN; PAM sequence: TTA
gtctcttctcacattgctat

SEQ ID NO: 170121 - DNA, 20 bp, Artificial Sequence
  Description of Artificial Sequence: Synthetic oligonucleotide
  Target: ATXN1; (-) strand; PAM type: YTN; PAM sequence: CTG
gatacagatgtattagtctc

SEQ ID NO: 170122 - DNA, 20 bp, Artificial Sequence
  Description of Artificial Sequence: Synthetic oligonucleotide
  Target: ATXN1; (-) strand; PAM type: YTN; PAM sequence: CTG
cacactggatacagatgtat

SEQ ID NO: 170123 - DNA, 20 bp, Artificial Sequence
  Description of Artificial Sequence: Synthetic oligonucleotide
  Target: ATXN1; (-) strand; PAM type: YTN; PAM sequence: CTC
tgcacactggatacagatgt

SEQ ID NO: 170124 - DNA, 20 bp, Artificial Sequence
  Description of Artificial Sequence: Synthetic oligonucleotide
  Target: ATXN1; (-) strand; PAM type: YTN; PAM sequence: TTG
accatctctgcacactggat

SEQ ID NO: 170125 - DNA, 20 bp, Artificial Sequence
  Description of Artificial Sequence: Synthetic oligonucleotide
  Target: ATXN1; (-) strand; PAM type: YTN; PAM sequence: CTT
gaccatctctgcacactgga

SEQ ID NO: 170126 - DNA, 20 bp, Artificial Sequence
  Description of Artificial Sequence: Synthetic oligonucleotide
  Target: ATXN1; (-) strand; PAM type: YTN; PAM sequence: CTC
ttgaccatctctgcacactg

SEQ ID NO: 170127 - DNA, 20 bp, Artificial Sequence
  Description of Artificial Sequence: Synthetic oligonucleotide
  Target: ATXN1; (-) strand; PAM type: YTN; PAM sequence: TTC
tcttgaccatctctgcacac

SEQ ID NO: 170128 - DNA, 20 bp, Artificial Sequence
  Description of Artificial Sequence: Synthetic oligonucleotide
  Target: ATXN1; (-) strand; PAM type: YTN; PAM sequence: CTG
ttctcttgaccatctctgca

SEQ ID NO: 170129 - DNA, 20 bp, Artificial Sequence
  Description of Artificial Sequence: Synthetic oligonucleotide
  Target: ATXN1; (-) strand; PAM type: YTN; PAM sequence: TTA
gtgtctgttctcttgaccat

SEQ ID NO: 170130 - DNA, 20 bp, Artificial Sequence
  Description of Artificial Sequence: Synthetic oligonucleotide
  Target: ATXN1; (-) strand; PAM type: YTN; PAM sequence: TTT
agtgtctgttctcttgacca

SEQ ID NO: 170131 - DNA, 20 bp, Artificial Sequence
  Description of Artificial Sequence: Synthetic oligonucleotide
  Target: ATXN1; (-) strand; PAM type: YTN; PAM sequence: TTT
tagtgtctgttctcttgacc

SEQ ID NO: 170132 - DNA, 20 bp, Artificial Sequence
  Description of Artificial Sequence: Synthetic oligonucleotide
  Target: ATXN1; (-) strand; PAM type: YTN; PAM sequence: TTT
ttagtgtctgttctcttgac

SEQ ID NO: 170133 - DNA, 20 bp, Artificial Sequence
  Description of Artificial Sequence: Synthetic oligonucleotide
  Target: ATXN1; (-) strand; PAM type: YTN; PAM sequence: CTC
atatgtaagatttttagtgt

SEQ ID NO: 170134 - DNA, 20 bp, Artificial Sequence
  Description of Artificial Sequence: Synthetic oligonucleotide
  Target: ATXN1; (-) strand; PAM type: YTN; PAM sequence: TTC
ccacccatgaaactcatatg

SEQ ID NO: 170135 - DNA, 20 bp, Artificial Sequence
  Description of Artificial Sequence: Synthetic oligonucleotide
  Target: ATXN1; (-) strand; PAM type: YTN; PAM sequence: CTT
cccacccatgaaactcatat

SEQ ID NO: 170136 - DNA, 20 bp, Artificial Sequence
  Description of Artificial Sequence: Synthetic oligonucleotide
  Target: ATXN1; (-) strand; PAM type: YTN; PAM sequence: CTG
tgcttcccacccatgaaact

SEQ ID NO: 170137 - DNA, 20 bp, Artificial Sequence
  Description of Artificial Sequence: Synthetic oligonucleotide
  Target: ATXN1; (-) strand; PAM type: YTN; PAM sequence: CTC
tgtgcttcccacccatgaaa

SEQ ID NO: 170138 - DNA, 20 bp, Artificial Sequence
  Description of Artificial Sequence: Synthetic oligonucleotide
  Target: ATXN1; (-) strand; PAM type: YTN; PAM sequence: CTG
agccactctgtgcttcccac

SEQ ID NO: 170139 - DNA, 20 bp, Artificial Sequence
  Description of Artificial Sequence: Synthetic oligonucleotide
  Target: ATXN1; (-) strand; PAM type: YTN; PAM sequence: CTC
actgagccactctgtgcttc

SEQ ID NO: 170140 - DNA, 20 bp, Artificial Sequence
  Description of Artificial Sequence: Synthetic oligonucleotide
  Target: ATXN1; (-) strand; PAM type: YTN; PAM sequence: CTG
gtctcactgagccactctgt

SEQ ID NO: 170141 - DNA, 20 bp, Artificial Sequence
  Description of Artificial Sequence: Synthetic oligonucleotide
  Target: ATXN1; (-) strand; PAM type: YTN; PAM sequence: CTC
ctggtctcactgagccactc

SEQ ID NO: 170142 - DNA, 20 bp, Artificial Sequence
  Description of Artificial Sequence: Synthetic oligonucleotide
  Target: ATXN1; (-) strand; PAM type: YTN; PAM sequence: TTC
cctcctggtctcactgagcc

SEQ ID NO: 170143 - DNA, 20 bp, Artificial Sequence
  Description of Artificial Sequence: Synthetic oligonucleotide
  Target: ATXN1; (-) strand; PAM type: YTN; PAM sequence: TTT
ccctcctggtctcactgagc

SEQ ID NO: 170144 - DNA, 20 bp, Artificial Sequence
  Description of Artificial Sequence: Synthetic oligonucleotide
  Target: ATXN1; (-) strand; PAM type: YTN; PAM sequence: TTT
tccctcctggtctcactgag

SEQ ID NO: 170145 - DNA, 20 bp, Artificial Sequence
  Description of Artificial Sequence: Synthetic oligonucleotide
  Target: ATXN1; (-) strand; PAM type: YTN; PAM sequence: CTT
ttccctcctggtctcactga

SEQ ID NO: 170146 - DNA, 20 bp, Artificial Sequence
  Description of Artificial Sequence: Synthetic oligonucleotide
  Target: ATXN1; (-) strand; PAM type: YTN; PAM sequence: CTA
acttttccctcctggtctca

SEQ ID NO: 170147 - DNA, 20 bp, Artificial Sequence
  Description of Artificial Sequence: Synthetic oligonucleotide
  Target: ATXN1; (-) strand; PAM type: YTN; PAM sequence: CTC
caaggagcccaccctaactt

SEQ ID NO: 170148 - DNA, 20 bp, Artificial Sequence
  Description of Artificial Sequence: Synthetic oligonucleotide
  Target: ATXN1; (-) strand; PAM type: YTN; PAM sequence: CTG
ccatcagctccaaggagccc

SEQ ID NO: 170149 - DNA, 20 bp, Artificial Sequence
  Description of Artificial Sequence: Synthetic oligonucleotide
  Target: ATXN1; (-) strand; PAM type: YTN; PAM sequence: CTC
aaccctgccatcagctccaa

SEQ ID NO: 170150 - DNA, 20 bp, Artificial Sequence
  Description of Artificial Sequence: Synthetic oligonucleotide
  Target: ATXN1; (-) strand; PAM type: YTN; PAM sequence: TTC
aaaactcaaccctgccatca

SEQ ID NO: 170151 - DNA, 20 bp, Artificial Sequence
  Description of Artificial Sequence: Synthetic oligonucleotide
  Target: ATXN1; (-) strand; PAM type: YTN; PAM sequence: CTT
caaaactcaaccctgccatc

SEQ ID NO: 170152 - DNA, 20 bp, Artificial Sequence
  Description of Artificial Sequence: Synthetic oligonucleotide
  Target: ATXN1; (-) strand; PAM type: YTN; PAM sequence: CTC
ttcaaaactcaaccctgcca

SEQ ID NO: 170153 - DNA, 20 bp, Artificial Sequence
  Description of Artificial Sequence: Synthetic oligonucleotide
  Target: ATXN1; (-) strand; PAM type: YTN; PAM sequence: CTG
tgtactcttcaaaactcaac

SEQ ID NO: 170154 - DNA, 20 bp, Artificial Sequence
  Description of Artificial Sequence: Synthetic oligonucleotide
  Target: ATXN1; (-) strand; PAM type: YTN; PAM sequence: TTC
ctgtgtactcttcaaaactc

SEQ ID NO: 170155 - DNA, 20 bp, Artificial Sequence
  Description of Artificial Sequence: Synthetic oligonucleotide
  Target: ATXN1; (-) strand; PAM type: YTN; PAM sequence: CTC
acatcacatgcagtcacaca

SEQ ID NO: 170156 - DNA, 20 bp, Artificial Sequence
  Description of Artificial Sequence: Synthetic oligonucleotide
  Target: ATXN1; (-) strand; PAM type: YTN; PAM sequence: CTC
tcacatcacatgcagtcaca

SEQ ID NO: 170157 - DNA, 20 bp, Artificial Sequence
  Description of Artificial Sequence: Synthetic oligonucleotide
  Target: ATXN1; (-) strand; PAM type: YTN; PAM sequence: TTC
cctctcacatcacatgcagt

SEQ ID NO: 170158 - DNA, 20 bp, Artificial Sequence
  Description of Artificial Sequence: Synthetic oligonucleotide
  Target: ATXN1; (-) strand; PAM type: YTN; PAM sequence: CTA
gacaatgttccctctcacat

SEQ ID NO: 170159 - DNA, 20 bp, Artificial Sequence
  Description of Artificial Sequence: Synthetic oligonucleotide
  Target: ATXN1; (-) strand; PAM type: YTN; PAM sequence: CTG
tctagacaatgttccctctc

SEQ ID NO: 170160 - DNA, 20 bp, Artificial Sequence
  Description of Artificial Sequence: Synthetic oligonucleotide
  Target: ATXN1; (-) strand; PAM type: YTN; PAM sequence: CTC
tgtctagacaatgttccctc

SEQ ID NO: 170161 - DNA, 20 bp, Artificial Sequence
  Description of Artificial Sequence: Synthetic oligonucleotide
  Target: ATXN1; (-) strand; PAM type: YTN; PAM sequence: CTC
ctctgtctagacaatgttcc

SEQ ID NO: 170162 - DNA, 20 bp, Artificial Sequence
  Description of Artificial Sequence: Synthetic oligonucleotide
  Target: ATXN1; (-) strand; PAM type: YTN; PAM sequence: CTC
cctcctctgtctagacaatg

SEQ ID NO: 170163 - DNA, 20 bp, Artificial Sequence
  Description of Artificial Sequence: Synthetic oligonucleotide
  Target: ATXN1; (-) strand; PAM type: YTN; PAM sequence: CTG
catgagctccctcctctgtc

SEQ ID NO: 170164 - DNA, 20 bp, Artificial Sequence
  Description of Artificial Sequence: Synthetic oligonucleotide
  Target: ATXN1; (-) strand; PAM type: YTN; PAM sequence: CTC
tgcatgagctccctcctctg

SEQ ID NO: 170165 - DNA, 20 bp, Artificial Sequence
  Description of Artificial Sequence: Synthetic oligonucleotide
  Target: ATXN1; (-) strand; PAM type: YTN; PAM sequence: TTA
tgtgactctgcatgagctcc

SEQ ID NO: 170166 - DNA, 20 bp, Artificial Sequence
  Description of Artificial Sequence: Synthetic oligonucleotide
  Target: ATXN1; (-) strand; PAM type: YTN; PAM sequence: CTT
atgtgactctgcatgagctc

SEQ ID NO: 170167 - DNA, 20 bp, Artificial Sequence
  Description of Artificial Sequence: Synthetic oligonucleotide
  Target: ATXN1; (-) strand; PAM type: YTN; PAM sequence: CTG
aatgtggcatgtccccttat

SEQ ID NO: 170168 - DNA, 20 bp, Artificial Sequence
  Description of Artificial Sequence: Synthetic oligonucleotide
  Target: ATXN1; (-) strand; PAM type: YTN; PAM sequence: TTC
cctgaatgtggcatgtcccc

SEQ ID NO: 170169 - DNA, 20 bp, Artificial Sequence
  Description of Artificial Sequence: Synthetic oligonucleotide
  Target: ATXN1; (-) strand; PAM type: YTN; PAM sequence: CTT
ccctgaatgtggcatgtccc

SEQ ID NO: 170170 - DNA, 20 bp, Artificial Sequence
  Description of Artificial Sequence: Synthetic oligonucleotide
  Target: ATXN1; (-) strand; PAM type: YTN; PAM sequence: TTG
tgcttccctgaatgtggcat

SEQ ID NO: 170171 - DNA, 20 bp, Artificial Sequence
  Description of Artificial Sequence: Synthetic oligonucleotide
  Target: ATXN1; (-) strand; PAM type: YTN; PAM sequence: CTT
gtgcttccctgaatgtggca

SEQ ID NO: 170172 - DNA, 20 bp, Artificial Sequence
  Description of Artificial Sequence: Synthetic oligonucleotide
  Target: ATXN1; (-) strand; PAM type: YTN; PAM sequence: CTG
gcatgccatacttgtgcttc

SEQ ID NO: 170173 - DNA, 20 bp, Artificial Sequence
  Description of Artificial Sequence: Synthetic oligonucleotide
  Target: ATXN1; (-) strand; PAM type: YTN; PAM sequence: CTC
ctggcatgccatacttgtgc

SEQ ID NO: 170174 - DNA, 20 bp, Artificial Sequence
  Description of Artificial Sequence: Synthetic oligonucleotide
  Target: ATXN1; (-) strand; PAM type: YTN; PAM sequence: CTC
ccctcctggcatgccatact

SEQ ID NO: 170175 - DNA, 20 bp, Artificial Sequence
  Description of Artificial Sequence: Synthetic oligonucleotide
  Target: ATXN1; (-) strand; PAM type: YTN; PAM sequence: TTC
ctcccctcctggcatgccat

SEQ ID NO: 170176 - DNA, 20 bp, Artificial Sequence
  Description of Artificial Sequence: Synthetic oligonucleotide
  Target: ATXN1; (-) strand; PAM type: YTN; PAM sequence: CTT
cctcccctcctggcatgcca

SEQ ID NO: 170177 - DNA, 20 bp, Artificial Sequence
  Description of Artificial Sequence: Synthetic oligonucleotide
  Target: ATXN1; (-) strand; PAM type: YTN; PAM sequence: CTC
cttcctcccctcctggcatg

SEQ ID NO: 170178 - DNA, 20 bp, Artificial Sequence
  Description of Artificial Sequence: Synthetic oligonucleotide
  Target: ATXN1; (-) strand; PAM type: YTN; PAM sequence: TTA
cctccttcctcccctcctgg

SEQ ID NO: 170179 - DNA, 20 bp, Artificial Sequence
  Description of Artificial Sequence: Synthetic oligonucleotide
  Target: ATXN1; (-) strand; PAM type: YTN; PAM sequence: CTC
gttacctccttcctcccctc

SEQ ID NO: 170180 - DNA, 20 bp, Artificial Sequence
  Description of Artificial Sequence: Synthetic oligonucleotide
  Target: ATXN1; (-) strand; PAM type: YTN; PAM sequence: TTG
gggagagaagggcactcgtt

SEQ ID NO: 170181 - DNA, 20 bp, Artificial Sequence
  Description of Artificial Sequence: Synthetic oligonucleotide
  Target: ATXN1; (-) strand; PAM type: YTN; PAM sequence: CTT
ggggagagaagggcactcgt

SEQ ID NO: 170182 - DNA, 20 bp, Artificial Sequence
  Description of Artificial Sequence: Synthetic oligonucleotide
  Target: ATXN1; (-) strand; PAM type: YTN; PAM sequence: TTC
aagagatatcttggggagag

SEQ ID NO: 170183 - DNA, 20 bp, Artificial Sequence
  Description of Artificial Sequence: Synthetic oligonucleotide
  Target: ATXN1; (-) strand; PAM type: YTN; PAM sequence: CTT
caagagatatcttggggaga

SEQ ID NO: 170184 - DNA, 20 bp, Artificial Sequence
  Description of Artificial Sequence: Synthetic oligonucleotide
  Target: ATXN1; (-) strand; PAM type: YTN; PAM sequence: CTC
cataccttcaagagatatct

SEQ ID NO: 170185 - DNA, 20 bp, Artificial Sequence
  Description of Artificial Sequence: Synthetic oligonucleotide
  Target: ATXN1; (-) strand; PAM type: YTN; PAM sequence: TTC
tccataccttcaagagatat

SEQ ID NO: 170186 - DNA, 20 bp, Artificial Sequence
  Description of Artificial Sequence: Synthetic oligonucleotide
  Target: ATXN1; (-) strand; PAM type: YTN; PAM sequence: CTG
agattctccataccttcaag

SEQ ID NO: 170187 - DNA, 20 bp, Artificial Sequence
  Description of Artificial Sequence: Synthetic oligonucleotide
  Target: ATXN1; (-) strand; PAM type: YTN; PAM sequence: TTC
tgagattctccataccttca

SEQ ID NO: 170188 - DNA, 20 bp, Artificial Sequence
  Description of Artificial Sequence: Synthetic oligonucleotide
  Target: ATXN1; (-) strand; PAM type: YTN; PAM sequence: CTT
ctgagattctccataccttc

SEQ ID NO: 170189 - DNA, 20 bp, Artificial Sequence
  Description of Artificial Sequence: Synthetic oligonucleotide
  Target: ATXN1; (-) strand; PAM type: YTN; PAM sequence: CTA
acccttctgagattctccat

SEQ ID NO: 170190 - DNA, 20 bp, Artificial Sequence
  Description of Artificial Sequence: Synthetic oligonucleotide
  Target: ATXN1; (-) strand; PAM type: YTN; PAM sequence: CTG
cctaacccttctgagattct

SEQ ID NO: 170191 - DNA, 20 bp, Artificial Sequence
  Description of Artificial Sequence: Synthetic oligonucleotide
  Target: ATXN1; (-) strand; PAM type: YTN; PAM sequence: TTC
ctgcctaacccttctgagat

SEQ ID NO: 170192 - DNA, 20 bp, Artificial Sequence
  Description of Artificial Sequence: Synthetic oligonucleotide
  Target: ATXN1; (-) strand; PAM type: YTN; PAM sequence: TTA
atcaaaaaatgttcctgcct

SEQ ID NO: 170193 - DNA, 20 bp, Artificial Sequence
  Description of Artificial Sequence: Synthetic oligonucleotide
  Target: ATXN1; (-) strand; PAM type: YTN; PAM sequence: TTT
aatcaaaaaatgttcctgcc

SEQ ID NO: 170194 - DNA, 20 bp, Artificial Sequence
  Description of Artificial Sequence: Synthetic oligonucleotide
  Target: ATXN1; (-) strand; PAM type: YTN; PAM sequence: TTT
taatcaaaaaatgttcctgc

SEQ ID NO: 170195 - DNA, 20 bp, Artificial Sequence
  Description of Artificial Sequence: Synthetic oligonucleotide
  Target: ATXN1; (-) strand; PAM type: YTN; PAM sequence: TTT
ttaatcaaaaaatgttcctg

SEQ ID NO: 170196 - DNA, 20 bp, Artificial Sequence
  Description of Artificial Sequence: Synthetic oligonucleotide
  Target: ATXN1; (-) strand; PAM type: YTN; PAM sequence: CTA
tgaccagagtgacattttta

SEQ ID NO: 170197 - DNA, 20 bp, Artificial Sequence
  Description of Artificial Sequence: Synthetic oligonucleotide
  Target: ATXN1; (-) strand; PAM type: YTN; PAM sequence: CTC
tatgaccagagtgacatttt

SEQ ID NO: 170198 - DNA, 20 bp, Artificial Sequence
  Description of Artificial Sequence: Synthetic oligonucleotide
  Target: ATXN1; (-) strand; PAM type: YTN; PAM sequence: CTA
ctctatgaccagagtgacat

SEQ ID NO: 170199 - DNA, 20 bp, Artificial Sequence
  Description of Artificial Sequence: Synthetic oligonucleotide
  Target: ATXN1; (-) strand; PAM type: YTN; PAM sequence: TTC
tactctatgaccagagtgac

SEQ ID NO: 170200 - DNA, 20 bp, Artificial Sequence
  Description of Artificial Sequence: Synthetic oligonucleotide
  Target: ATXN1; (-) strand; PAM type: YTN; PAM sequence: CTT
ctactctatgaccagagtga

SEQ ID NO: 170201 - DNA, 20 bp, Artificial Sequence
  Description of Artificial Sequence: Synthetic oligonucleotide
  Target: ATXN1; (-) strand; PAM type: YTN; PAM sequence: CTC
atccatcttctactctatga

SEQ ID NO: 170202 - DNA, 20 bp, Artificial Sequence
  Description of Artificial Sequence: Synthetic oligonucleotide
  Target: ATXN1; (-) strand; PAM type: YTN; PAM sequence: TTC
tcatccatcttctactctat

SEQ ID NO: 170203 - DNA, 20 bp, Artificial Sequence
  Description of Artificial Sequence: Synthetic oligonucleotide
  Target: ATXN1; (-) strand; PAM type: YTN; PAM sequence: CTT
ctcatccatcttctactcta

SEQ ID NO: 170204 - DNA, 20 bp, Artificial Sequence
  Description of Artificial Sequence: Synthetic oligonucleotide
  Target: ATXN1; (-) strand; PAM type: YTN; PAM sequence: CTG
gtcccttctcatccatcttc

SEQ ID NO: 170205 - DNA, 20 bp, Artificial Sequence
  Description of Artificial Sequence: Synthetic oligonucleotide
  Target: ATXN1; (-) strand; PAM type: YTN; PAM sequence: CTG
tagaacctggtcccttctca

SEQ ID NO: 170206 - DNA, 20 bp, Artificial Sequence
  Description of Artificial Sequence: Synthetic oligonucleotide
  Target: ATXN1; (-) strand; PAM type: YTN; PAM sequence: TTG
cctgtagaacctggtccctt

SEQ ID NO: 170207 - DNA, 20 bp, Artificial Sequence
  Description of Artificial Sequence: Synthetic oligonucleotide
  Target: ATXN1; (-) strand; PAM type: YTN; PAM sequence: CTT
gcctgtagaacctggtccct

SEQ ID NO: 170208 - DNA, 20 bp, Artificial Sequence
  Description of Artificial Sequence: Synthetic oligonucleotide
  Target: ATXN1; (-) strand; PAM type: YTN; PAM sequence: TTG
ccttgcctgtagaacctggt

SEQ ID NO: 170209 - DNA, 20 bp, Artificial Sequence
  Description of Artificial Sequence: Synthetic oligonucleotide
  Target: ATXN1; (-) strand; PAM type: YTN; PAM sequence: TTT
gccttgcctgtagaacctgg

SEQ ID NO: 170210 - DNA, 20 bp, Artificial Sequence
  Description of Artificial Sequence: Synthetic oligonucleotide
  Target: ATXN1; (-) strand; PAM type: YTN; PAM sequence: CTG
tttgccttgcctgtagaacc

SEQ ID NO: 170211 - DNA, 20 bp, Artificial Sequence
  Description of Artificial Sequence: Synthetic oligonucleotide
  Target: ATXN1; (-) strand; PAM type: YTN; PAM sequence: CTC
ccgactgtttgccttgcctg

SEQ ID NO: 170212 - DNA, 20 bp, Artificial Sequence
  Description of Artificial Sequence: Synthetic oligonucleotide
  Target: ATXN1; (-) strand; PAM type: YTN; PAM sequence: TTC
ctcccgactgtttgccttgc

SEQ ID NO: 170213 - DNA, 20 bp, Artificial Sequence
  Description of Artificial Sequence: Synthetic oligonucleotide
  Target: ATXN1; (-) strand; PAM type: YTN; PAM sequence: TTG
cagcaagttcctcccgactg

SEQ ID NO: 170214 - DNA, 20 bp, Artificial Sequence
  Description of Artificial Sequence: Synthetic oligonucleotide
  Target: ATXN1; (-) strand; PAM type: YTN; PAM sequence: CTC
agtggcattgcagcaagttc

SEQ ID NO: 170215 - DNA, 20 bp, Artificial Sequence
  Description of Artificial Sequence: Synthetic oligonucleotide
  Target: ATXN1; (-) strand; PAM type: YTN; PAM sequence: CTG
atgacagctcagtggcattg

SEQ ID NO: 170216 - DNA, 20 bp, Artificial Sequence
  Description of Artificial Sequence: Synthetic oligonucleotide
  Target: ATXN1; (-) strand; PAM type: YTN; PAM sequence: CTG
cagcaggccaaacctgatga

SEQ ID NO: 170217 - DNA, 20 bp, Artificial Sequence
  Description of Artificial Sequence: Synthetic oligonucleotide
  Target: ATXN1; (-) strand; PAM type: YTN; PAM sequence: CTG
cccctgcagcaggccaaacc

SEQ ID NO: 170218 - DNA, 20 bp, Artificial Sequence
  Description of Artificial Sequence: Synthetic oligonucleotide
  Target: ATXN1; (-) strand; PAM type: YTN; PAM sequence: TTA
ctgcccctgcagcaggccaa

SEQ ID NO: 170219 - DNA, 20 bp, Artificial Sequence
  Description of Artificial Sequence: Synthetic oligonucleotide
  Target: ATXN1; (-) strand; PAM type: YTN; PAM sequence: CTT
actgcccctgcagcaggcca

SEQ ID NO: 170220 - DNA, 20 bp, Artificial Sequence
  Description of Artificial Sequence: Synthetic oligonucleotide
  Target: ATXN1; (-) strand; PAM type: YTN; PAM sequence: CTC
catgcttactgcccctgcag

SEQ ID NO: 170221 - DNA, 20 bp, Artificial Sequence
  Description of Artificial Sequence: Synthetic oligonucleotide
  Target: ATXN1; (-) strand; PAM type: YTN; PAM sequence: TTC
tccatgcttactgcccctgc

SEQ ID NO: 170222 - DNA, 20 bp, Artificial Sequence
  Description of Artificial Sequence: Synthetic oligonucleotide
  Target: ATXN1; (-) strand; PAM type: YTN; PAM sequence: CTT
ctccatgcttactgcccctg

SEQ ID NO: 170223 - DNA, 20 bp, Artificial Sequence
  Description of Artificial Sequence: Synthetic oligonucleotide
  Target: ATXN1; (-) strand; PAM type: YTN; PAM sequence: CTC
ttctccatgcttactgcccc

SEQ ID NO: 170224 - DNA, 20 bp, Artificial Sequence
  Description of Artificial Sequence: Synthetic oligonucleotide
  Target: ATXN1; (-) strand; PAM type: YTN; PAM sequence: CTC
ctcttctccatgcttactgc

SEQ ID NO: 170225 - DNA, 20 bp, Artificial Sequence
  Description of Artificial Sequence: Synthetic oligonucleotide
  Target: ATXN1; (-) strand; PAM type: YTN; PAM sequence: CTG
tccgcctcctcttctccatg

SEQ ID NO: 170226 - DNA, 20 bp, Artificial Sequence
  Description of Artificial Sequence: Synthetic oligonucleotide
  Target: ATXN1; (-) strand; PAM type: YTN; PAM sequence: CTC
ccctgtccgcctcctcttct

SEQ ID NO: 170227 - DNA, 20 bp, Artificial Sequence
  Description of Artificial Sequence: Synthetic oligonucleotide
  Target: ATXN1; (-) strand; PAM type: YTN; PAM sequence: CTG
ggacatctcccctgtccgcc

SEQ ID NO: 170228 - DNA, 20 bp, Artificial Sequence
  Description of Artificial Sequence: Synthetic oligonucleotide
  Target: ATXN1; (-) strand; PAM type: YTN; PAM sequence: CTG
cctgggacatctcccctgtc

SEQ ID NO: 170229 - DNA, 20 bp, Artificial Sequence
  Description of Artificial Sequence: Synthetic oligonucleotide
  Target: ATXN1; (-) strand; PAM type: YTN; PAM sequence: CTG
agtctgcctgggacatctcc

SEQ ID NO: 170230 - DNA, 20 bp, Artificial Sequence
  Description of Artificial Sequence: Synthetic oligonucleotide
  Target: ATXN1; (-) strand; PAM type: YTN; PAM sequence: TTG
gtgctgagtctgcctgggac

SEQ ID NO: 170231 - DNA, 20 bp, Artificial Sequence
  Description of Artificial Sequence: Synthetic oligonucleotide
  Target: ATXN1; (-) strand; PAM type: YTN; PAM sequence: CTT
ggtgctgagtctgcctggga

SEQ ID NO: 170232 - DNA, 20 bp, Artificial Sequence
  Description of Artificial Sequence: Synthetic oligonucleotide
  Target: ATXN1; (-) strand; PAM type: YTN; PAM sequence: TTC
agcagccttggtgctgagtc

SEQ ID NO: 170233 - DNA, 20 bp, Artificial Sequence
  Description of Artificial Sequence: Synthetic oligonucleotide
  Target: ATXN1; (-) strand; PAM type: YTN; PAM sequence: CTG
cccagccattcagcagcctt

SEQ ID NO: 170234 - DNA, 20 bp, Artificial Sequence
  Description of Artificial Sequence: Synthetic oligonucleotide
  Target: ATXN1; (-) strand; PAM type: YTN; PAM sequence: CTC
catgtgcccctgcccagcca

SEQ ID NO: 170235 - DNA, 20 bp, Artificial Sequence
  Description of Artificial Sequence: Synthetic oligonucleotide
  Target: ATXN1; (-) strand; PAM type: YTN; PAM sequence: TTC
ctccatgtgcccctgcccag

SEQ ID NO: 170236 - DNA, 20 bp, Artificial Sequence
  Description of Artificial Sequence: Synthetic oligonucleotide
  Target: ATXN1; (-) strand; PAM type: YTN; PAM sequence: CTG
ttcctccatgtgcccctgcc

SEQ ID NO: 170237 - DNA, 20 bp, Artificial Sequence
  Description of Artificial Sequence: Synthetic oligonucleotide
  Target: ATXN1; (-) strand; PAM type: YTN; PAM sequence: CTA
tgctgttcctccatgtgccc

SEQ ID NO: 170238 - DNA, 20 bp, Artificial Sequence
  Description of Artificial Sequence: Synthetic oligonucleotide
  Target: ATXN1; (-) strand; PAM type: YTN; PAM sequence: CTA
gccaagccagaagcccctat

SEQ ID NO: 170239 - DNA, 20 bp, Artificial Sequence
  Description of Artificial Sequence: Synthetic oligonucleotide
  Target: ATXN1; (-) strand; PAM type: YTN; PAM sequence: TTG
tgcaaatggcactagccaag

SEQ ID NO: 170240 - DNA, 20 bp, Artificial Sequence
  Description of Artificial Sequence: Synthetic oligonucleotide
  Target: ATXN1; (-) strand; PAM type: YTN; PAM sequence: CTT
gtgcaaatggcactagccaa

SEQ ID NO: 170241 - DNA, 20 bp, Artificial Sequence
  Description of Artificial Sequence: Synthetic oligonucleotide
  Target: ATXN1; (-) strand; PAM type: YTN; PAM sequence: CTC
ttgtgcaaatggcactagcc

SEQ ID NO: 170242 - DNA, 20 bp, Artificial Sequence
  Description of Artificial Sequence: Synthetic oligonucleotide
  Target: ATXN1; (-) strand; PAM type: YTN; PAM sequence: CTC
ccatatctcttgtgcaaatg

SEQ ID NO: 170243 - DNA, 20 bp, Artificial Sequence
  Description of Artificial Sequence: Synthetic oligonucleotide
  Target: ATXN1; (-) strand; PAM type: YTN; PAM sequence: TTC
tcccatatctcttgtgcaaa

SEQ ID NO: 170244 - DNA, 20 bp, Artificial Sequence
  Description of Artificial Sequence: Synthetic oligonucleotide
  Target: ATXN1; (-) strand; PAM type: YTN; PAM sequence: TTT
ctcccatatctcttgtgcaa

SEQ ID NO: 170245 - DNA, 20 bp, Artificial Sequence
  Description of Artificial Sequence: Synthetic oligonucleotide
  Target: ATXN1; (-) strand; PAM type: YTN; PAM sequence: CTA
gaccatgatttctcccatat

SEQ ID NO: 170246 - DNA, 20 bp, Artificial Sequence
  Description of Artificial Sequence: Synthetic oligonucleotide
  Target: ATXN1; (-) strand; PAM type: YTN; PAM sequence: TTA
gaaaggagctagaccatgat

SEQ ID NO: 170247 - DNA, 20 bp, Artificial Sequence
  Description of Artificial Sequence: Synthetic oligonucleotide
  Target: ATXN1; (-) strand; PAM type: YTN; PAM sequence: CTG
agttagaaaggagctagacc

SEQ ID NO: 170248 - DNA, 20 bp, Artificial Sequence
  Description of Artificial Sequence: Synthetic oligonucleotide
  Target: ATXN1; (-) strand; PAM type: YTN; PAM sequence: TTA
aggcactgagttagaaagga

SEQ ID NO: 170249 - DNA, 20 bp, Artificial Sequence
  Description of Artificial Sequence: Synthetic oligonucleotide
  Target: ATXN1; (-) strand; PAM type: YTN; PAM sequence: CTA
gaagtaaaacgagaaattaa

SEQ ID NO: 170250 - DNA, 20 bp, Artificial Sequence
  Description of Artificial Sequence: Synthetic oligonucleotide
  Target: ATXN1; (-) strand; PAM type: YTN; PAM sequence: TTA
tcctagaagtaaaacgagaa

SEQ ID NO: 170251 - DNA, 20 bp, Artificial Sequence
  Description of Artificial Sequence: Synthetic oligonucleotide
  Target: ATXN1; (-) strand; PAM type: YTN; PAM sequence: TTT
atcctagaagtaaaacgaga

SEQ ID NO: 170252 - DNA, 20 bp, Artificial Sequence
  Description of Artificial Sequence: Synthetic oligonucleotide
  Target: ATXN1; (-) strand; PAM type: YTN; PAM sequence: CTT
tatcctagaagtaaaacgag

SEQ ID NO: 170253 - DNA, 20 bp, Artificial Sequence
  Description of Artificial Sequence: Synthetic oligonucleotide
  Target: ATXN1; (-) strand; PAM type: YTN; PAM sequence: TTA
aactttatcctagaagtaaa

SEQ ID NO: 170254 - DNA, 20 bp, Artificial Sequence
  Description of Artificial Sequence: Synthetic oligonucleotide
  Target: ATXN1; (-) strand; PAM type: YTN; PAM sequence: TTT
aaactttatcctagaagtaa

SEQ ID NO: 170255 - DNA, 20 bp, Artificial Sequence
  Description of Artificial Sequence: Synthetic oligonucleotide
  Target: ATXN1; (-) strand; PAM type: YTN; PAM sequence: TTT
taaactttatcctagaagta

SEQ ID NO: 170256 - DNA, 20 bp, Artificial Sequence
  Description of Artificial Sequence: Synthetic oligonucleotide
  Target: ATXN1; (-) strand; PAM type: YTN; PAM sequence: TTA
gagattttaaactttatcct

SEQ ID NO: 170257 - DNA, 20 bp, Artificial Sequence
  Description of Artificial Sequence: Synthetic oligonucleotide
  Target: ATXN1; (-) strand; PAM type: YTN; PAM sequence: TTC
agcgtcaagttagagatttt

SEQ ID NO: 170258 - DNA, 20 bp, Artificial Sequence
  Description of Artificial Sequence: Synthetic oligonucleotide
  Target: ATXN1; (-) strand; PAM type: YTN; PAM sequence: TTT
cagcgtcaagttagagattt

SEQ ID NO: 170259 - DNA, 20 bp, Artificial Sequence
  Description of Artificial Sequence: Synthetic oligonucleotide
  Target: ATXN1; (-) strand; PAM type: YTN; PAM sequence: CTT
tcagcgtcaagttagagatt

SEQ ID NO: 170260 - DNA, 20 bp, Artificial Sequence
  Description of Artificial Sequence: Synthetic oligonucleotide
  Target: ATXN1; (-) strand; PAM type: YTN; PAM sequence: TTG
tagagaactttcagcgtcaa

SEQ ID NO: 170261 - DNA, 20 bp, Artificial Sequence
  Description of Artificial Sequence: Synthetic oligonucleotide
  Target: ATXN1; (-) strand; PAM type: YTN; PAM sequence: CTG
catgtagggggattgtagag

SEQ ID NO: 170262 - DNA, 20 bp, Artificial Sequence
  Description of Artificial Sequence: Synthetic oligonucleotide
  Target: ATXN1; (-) strand; PAM type: YTN; PAM sequence: CTA
ctgcatgtagggggattgta

SEQ ID NO: 170263 - DNA, 20 bp, Artificial Sequence
  Description of Artificial Sequence: Synthetic oligonucleotide
  Target: ATXN1; (-) strand; PAM type: YTN; PAM sequence: CTG
gtatgtatcgagtacctact

SEQ ID NO: 170264 - DNA, 20 bp, Artificial Sequence
  Description of Artificial Sequence: Synthetic oligonucleotide
  Target: ATXN1; (-) strand; PAM type: YTN; PAM sequence: TTG
aatcaactggtatgtatcga

SEQ ID NO: 170265 - DNA, 20 bp, Artificial Sequence
  Description of Artificial Sequence: Synthetic oligonucleotide
  Target: ATXN1; (-) strand; PAM type: YTN; PAM sequence: TTG
ttgaatcaactggtatgtat

SEQ ID NO: 170266 - DNA, 20 bp, Artificial Sequence
  Description of Artificial Sequence: Synthetic oligonucleotide
  Target: ATXN1; (-) strand; PAM type: YTN; PAM sequence: TTC
agttgttgaatcaactggta

SEQ ID NO: 170267 - DNA, 20 bp, Artificial Sequence
  Description of Artificial Sequence: Synthetic oligonucleotide
  Target: ATXN1; (-) strand; PAM type: YTN; PAM sequence: TTT
cagttgttgaatcaactggt

SEQ ID NO: 170268 - DNA, 20 bp, Artificial Sequence
  Description of Artificial Sequence: Synthetic oligonucleotide
  Target: ATXN1; (-) strand; PAM type: YTN; PAM sequence: TTG
tttcagttgttgaatcaact

SEQ ID NO: 170269 - DNA, 20 bp, Artificial Sequence
  Description of Artificial Sequence: Synthetic oligonucleotide
  Target: ATXN1; (-) strand; PAM type: YTN; PAM sequence: TTT
gtttcagttgttgaatcaac

SEQ ID NO: 170270 - DNA, 20 bp, Artificial Sequence
  Description of Artificial Sequence: Synthetic oligonucleotide
  Target: ATXN1; (-) strand; PAM type: YTN; PAM sequence: TTG
tgtgtttgtttcagttgttg

SEQ ID NO: 170271 - DNA, 20 bp, Artificial Sequence
  Description of Artificial Sequence: Synthetic oligonucleotide
  Target: ATXN1; (-) strand; PAM type: YTN; PAM sequence: TTT
gtgtgtttgtttcagttgtt

SEQ ID NO: 170272 - DNA, 20 bp, Artificial Sequence
  Description of Artificial Sequence: Synthetic oligonucleotide
  Target: ATXN1; (-) strand; PAM type: YTN; PAM sequence: TTT
tgtgtgtttgtttcagttgt

SEQ ID NO: 170273 - DNA, 20 bp, Artificial Sequence
  Description of Artificial Sequence: Synthetic oligonucleotide
  Target: ATXN1; (-) strand; PAM type: YTN; PAM sequence: TTT
ttgtgtgtttgtttcagttg

SEQ ID NO: 170274 - DNA, 20 bp, Artificial Sequence
  Description of Artificial Sequence: Synthetic oligonucleotide
  Target: ATXN1; (-) strand; PAM type: YTN; PAM sequence: TTA
tttttgtgtgtttgtttcag

SEQ ID NO: 170275 - DNA, 20 bp, Artificial Sequence
  Description of Artificial Sequence: Synthetic oligonucleotide
  Target: ATXN1; (-) strand; PAM type: YTN; PAM sequence: TTA
gatagagaaagttatttttg

SEQ ID NO: 170276 - DNA, 20 bp, Artificial Sequence
  Description of Artificial Sequence: Synthetic oligonucleotide
  Target: ATXN1; (-) strand; PAM type: YTN; PAM sequence: TTG
atatgttagatagagaaagt

SEQ ID NO: 170277 - DNA, 20 bp, Artificial Sequence
  Description of Artificial Sequence: Synthetic oligonucleotide
  Target: ATXN1; (-) strand; PAM type: YTN; PAM sequence: CTG
taatcagaaaaatattgata

SEQ ID NO: 170278 - DNA, 20 bp, Artificial Sequence
  Description of Artificial Sequence: Synthetic oligonucleotide
  Target: ATXN1; (-) strand; PAM type: YTN; PAM sequence: TTC
acaaaggcaaagtagtaagc

SEQ ID NO: 170279 - DNA, 20 bp, Artificial Sequence
  Description of Artificial Sequence: Synthetic oligonucleotide
  Target: ATXN1; (-) strand; PAM type: YTN; PAM sequence: TTT
cacaaaggcaaagtagtaag

SEQ ID NO: 170280 - DNA, 20 bp, Artificial Sequence
  Description of Artificial Sequence: Synthetic oligonucleotide
  Target: ATXN1; (-) strand; PAM type: YTN; PAM sequence: CTT
tcacaaaggcaaagtagtaa

SEQ ID NO: 170281 - DNA, 20 bp, Artificial Sequence
  Description of Artificial Sequence: Synthetic oligonucleotide
  Target: ATXN1; (-) strand; PAM type: YTN; PAM sequence: TTC
tttcacaaaggcaaagtagt

SEQ ID NO: 170282 - DNA, 20 bp, Artificial Sequence
  Description of Artificial Sequence: Synthetic oligonucleotide
  Target: ATXN1; (-) strand; PAM type: YTN; PAM sequence: CTT
ctttcacaaaggcaaagtag

SEQ ID NO: 170283 - DNA, 20 bp, Artificial Sequence
  Description of Artificial Sequence: Synthetic oligonucleotide
  Target: ATXN1; (-) strand; PAM type: YTN; PAM sequence: CTC
ttctttcacaaaggcaaagt

SEQ ID NO: 170284 - DNA, 20 bp, Artificial Sequence
  Description of Artificial Sequence: Synthetic oligonucleotide
  Target: ATXN1; (-) strand; PAM type: YTN; PAM sequence: TTC
tcttctttcacaaaggcaaa

SEQ ID NO: 170285 - DNA, 20 bp, Artificial Sequence
  Description of Artificial Sequence: Synthetic oligonucleotide
  Target: ATXN1; (-) strand; PAM type: YTN; PAM sequence: TTT
ctcttctttcacaaaggcaa

SEQ ID NO: 170286 - DNA, 20 bp, Artificial Sequence
  Description of Artificial Sequence: Synthetic oligonucleotide
  Target: ATXN1; (-) strand; PAM type: YTN; PAM sequence: CTA
tttctcttctttcacaaagg

SEQ ID NO: 170287 - DNA, 20 bp, Artificial Sequence
  Description of Artificial Sequence: Synthetic oligonucleotide
  Target: ATXN1; (-) strand; PAM type: YTN; PAM sequence: TTG
caagctatttctcttctttc

SEQ ID NO: 170288 - DNA, 20 bp, Artificial Sequence
  Description of Artificial Sequence: Synthetic oligonucleotide
  Target: ATXN1; (-) strand; PAM type: YTN; PAM sequence: TTG
aataagttgcaagctatttc

SEQ ID NO: 170289 - DNA, 20 bp, Artificial Sequence
  Description of Artificial Sequence: Synthetic oligonucleotide
  Target: ATXN1; (-) strand; PAM type: YTN; PAM sequence: TTT
gaataagttgcaagctattt

SEQ ID NO: 170290 - DNA, 20 bp, Artificial Sequence
  Description of Artificial Sequence: Synthetic oligonucleotide
  Target: ATXN1; (-) strand; PAM type: YTN; PAM sequence: CTT
tgaataagttgcaagctatt

SEQ ID NO: 170291 - DNA, 20 bp, Artificial Sequence
  Description of Artificial Sequence: Synthetic oligonucleotide
  Target: ATXN1; (-) strand; PAM type: YTN; PAM sequence: TTC
tttgaataagttgcaagcta

SEQ ID NO: 170292 - DNA, 20 bp, Artificial Sequence
  Description of Artificial Sequence: Synthetic oligonucleotide
  Target: ATXN1; (-) strand; PAM type: YTN; PAM sequence: TTA
ttctttgaataagttgcaag

SEQ ID NO: 170293 - DNA, 20 bp, Artificial Sequence
  Description of Artificial Sequence: Synthetic oligonucleotide
  Target: ATXN1; (-) strand; PAM type: YTN; PAM sequence: CTT
attctttgaataagttgcaa

SEQ ID NO: 170294 - DNA, 20 bp, Artificial Sequence
  Description of Artificial Sequence: Synthetic oligonucleotide
  Target: ATXN1; (-) strand; PAM type: YTN; PAM sequence: TTA
tcttattctttgaataagtt

SEQ ID NO: 170295 - DNA, 20 bp, Artificial Sequence
  Description of Artificial Sequence: Synthetic oligonucleotide
  Target: ATXN1; (-) strand; PAM type: YTN; PAM sequence: CTT
atcttattctttgaataagt

SEQ ID NO: 170296 - DNA, 20 bp, Artificial Sequence
  Description of Artificial Sequence: Synthetic oligonucleotide
  Target: ATXN1; (-) strand; PAM type: YTN; PAM sequence: TTG
cacttatcttattctttgaa

SEQ ID NO: 170297 - DNA, 20 bp, Artificial Sequence
  Description of Artificial Sequence: Synthetic oligonucleotide
  Target: ATXN1; (-) strand; PAM type: YTN; PAM sequence: TTT
gcacttatcttattctttga

SEQ ID NO: 170298 - DNA, 20 bp, Artificial Sequence
  Description of Artificial Sequence: Synthetic oligonucleotide
  Target: ATXN1; (-) strand; PAM type: YTN; PAM sequence: TTA
tcagaaaaatgtttgcactt

SEQ ID NO: 170299 - DNA, 20 bp, Artificial Sequence
  Description of Artificial Sequence: Synthetic oligonucleotide
  Target: ATXN1; (-) strand; PAM type: YTN; PAM sequence: TTA
gcacgttatcagaaaaatgt

SEQ ID NO: 170300 - DNA, 20 bp, Artificial Sequence
  Description of Artificial Sequence: Synthetic oligonucleotide
  Target: ATXN1; (-) strand; PAM type: YTN; PAM sequence: TTG
agattagcacgttatcagaa

SEQ ID NO: 170301 - DNA, 20 bp, Artificial Sequence
  Description of Artificial Sequence: Synthetic oligonucleotide
  Target: ATXN1; (-) strand; PAM type: YTN; PAM sequence: TTT
gagattagcacgttatcaga

SEQ ID NO: 170302 - DNA, 20 bp, Artificial Sequence
  Description of Artificial Sequence: Synthetic oligonucleotide
  Target: ATXN1; (-) strand; PAM type: YTN; PAM sequence: CTG
tatcaggagagaaaatgtgt

SEQ ID NO: 170303 - DNA, 20 bp, Artificial Sequence
  Description of Artificial Sequence: Synthetic oligonucleotide
  Target: ATXN1; (-) strand; PAM type: YTN; PAM sequence: CTG
tagccctgtatcaggagaga

SEQ ID NO: 170304 - DNA, 20 bp, Artificial Sequence
  Description of Artificial Sequence: Synthetic oligonucleotide
  Target: ATXN1; (-) strand; PAM type: YTN; PAM sequence: TTG
gtgataatcagatgaacaca

SEQ ID NO: 170305 - DNA, 20 bp, Artificial Sequence
  Description of Artificial Sequence: Synthetic oligonucleotide
  Target: ATXN1; (-) strand; PAM type: YTN; PAM sequence: TTG
ttggtgataatcagatgaac

SEQ ID NO: 170306 - DNA, 20 bp, Artificial Sequence
  Description of Artificial Sequence: Synthetic oligonucleotide
  Target: ATXN1; (-) strand; PAM type: YTN; PAM sequence: TTA
ggaatgattgttggtgataa

SEQ ID NO: 170307 - DNA, 20 bp, Artificial Sequence
  Description of Artificial Sequence: Synthetic oligonucleotide
  Target: ATXN1; (-) strand; PAM type: YTN; PAM sequence: CTA
acccagagtaagataggaat

SEQ ID NO: 170308 - DNA, 20 bp, Artificial Sequence
  Description of Artificial Sequence: Synthetic oligonucleotide
  Target: ATXN1; (-) strand; PAM type: YTN; PAM sequence: TTA
agggtgaaggagaggacaga

SEQ ID NO: 170309 - DNA, 20 bp, Artificial Sequence
  Description of Artificial Sequence: Synthetic oligonucleotide
  Target: ATXN1; (-) strand; PAM type: YTN; PAM sequence: CTT
aagggtgaaggagaggacag

SEQ ID NO: 170310 - DNA, 20 bp, Artificial Sequence
  Description of Artificial Sequence: Synthetic oligonucleotide
  Target: ATXN1; (-) strand; PAM type: YTN; PAM sequence: CTA
atagccttaagggtgaagga

SEQ ID NO: 170311 - DNA, 20 bp, Artificial Sequence
  Description of Artificial Sequence: Synthetic oligonucleotide
  Target: ATXN1; (-) strand; PAM type: YTN; PAM sequence: TTA
tcgtgaagactaatagcctt

SEQ ID NO: 170312 - DNA, 20 bp, Artificial Sequence
  Description of Artificial Sequence: Synthetic oligonucleotide
  Target: ATXN1; (-) strand; PAM type: YTN; PAM sequence: TTT
atcgtgaagactaatagcct

SEQ ID NO: 170313 - DNA, 20 bp, Artificial Sequence
  Description of Artificial Sequence: Synthetic oligonucleotide
  Target: ATXN1; (-) strand; PAM type: YTN; PAM sequence: TTT
tatcgtgaagactaatagcc

SEQ ID NO: 170314 - DNA, 20 bp, Artificial Sequence
  Description of Artificial Sequence: Synthetic oligonucleotide
  Target: ATXN1; (-) strand; PAM type: YTN; PAM sequence: TTT
ttatcgtgaagactaatagc

SEQ ID NO: 170315 - DNA, 20 bp, Artificial Sequence
  Description of Artificial Sequence: Synthetic oligonucleotide
  Target: ATXN1; (-) strand; PAM type: YTN; PAM sequence: TTT
tttatcgtgaagactaatag

SEQ ID NO: 170316 - DNA, 20 bp, Artificial Sequence
  Description of Artificial Sequence: Synthetic oligonucleotide
  Target: ATXN1; (-) strand; PAM type: YTN; PAM sequence: CTA
gaaattttttatcgtgaaga

SEQ ID NO: 170317 - DNA, 20 bp, Artificial Sequence
  Description of Artificial Sequence: Synthetic oligonucleotide
  Target: ATXN1; (-) strand; PAM type: YTN; PAM sequence: CTA
cctagaaattttttatcgtg

SEQ ID NO: 170318 - DNA, 20 bp, Artificial Sequence
  Description of Artificial Sequence: Synthetic oligonucleotide
  Target: ATXN1; (-) strand; PAM type: YTN; PAM sequence: CTC
tacctagaaattttttatcg

SEQ ID NO: 170319 - DNA, 20 bp, Artificial Sequence
  Description of Artificial Sequence: Synthetic oligonucleotide
  Target: ATXN1; (-) strand; PAM type: YTN; PAM sequence: CTA
tctctacctagaaatttttt

SEQ ID NO: 170320 - DNA, 20 bp, Artificial Sequence
  Description of Artificial Sequence: Synthetic oligonucleotide
  Target: ATXN1; (-) strand; PAM type: YTN; PAM sequence: TTA
gaaccccaagcatctatctc

SEQ ID NO: 170321 - DNA, 20 bp, Artificial Sequence
  Description of Artificial Sequence: Synthetic oligonucleotide
  Target: ATXN1; (-) strand; PAM type: YTN; PAM sequence: TTT
agaaccccaagcatctatct

SEQ ID NO: 170322 - DNA, 20 bp, Artificial Sequence
  Description of Artificial Sequence: Synthetic oligonucleotide
  Target: ATXN1; (-) strand; PAM type: YTN; PAM sequence: TTT
tagaaccccaagcatctatc

SEQ ID NO: 170323 - DNA, 20 bp, Artificial Sequence
  Description of Artificial Sequence: Synthetic oligonucleotide
  Target: ATXN1; (-) strand; PAM type: YTN; PAM sequence: CTT
ttagaaccccaagcatctat

SEQ ID NO: 170324 - DNA, 20 bp, Artificial Sequence
  Description of Artificial Sequence: Synthetic oligonucleotide
  Target: ATXN1; (-) strand; PAM type: YTN; PAM sequence: CTC
ttttagaaccccaagcatct

SEQ ID NO: 170325 - DNA, 20 bp, Artificial Sequence
  Description of Artificial Sequence: Synthetic oligonucleotide
  Target: ATXN1; (-) strand; PAM type: YTN; PAM sequence: TTG
ctcttttagaaccccaagca

SEQ ID NO: 170326 - DNA, 20 bp, Artificial Sequence
  Description of Artificial Sequence: Synthetic oligonucleotide
  Target: ATXN1; (-) strand; PAM type: YTN; PAM sequence: CTT
gctcttttagaaccccaagc

SEQ ID NO: 170327 - DNA, 20 bp, Artificial Sequence
  Description of Artificial Sequence: Synthetic oligonucleotide
  Target: ATXN1; (-) strand; PAM type: YTN; PAM sequence: TTA
ccacttgctcttttagaacc

SEQ ID NO: 170328 - DNA, 20 bp, Artificial Sequence
  Description of Artificial Sequence: Synthetic oligonucleotide
  Target: ATXN1; (-) strand; PAM type: YTN; PAM sequence: CTG
gaatgtgtcatcgtatgtga

SEQ ID NO: 170329 - DNA, 20 bp, Artificial Sequence
  Description of Artificial Sequence: Synthetic oligonucleotide
  Target: ATXN1; (-) strand; PAM type: YTN; PAM sequence: TTA
gaggctggaatgtgtcatcg

SEQ ID NO: 170330 - DNA, 20 bp, Artificial Sequence
  Description of Artificial Sequence: Synthetic oligonucleotide
  Target: ATXN1; (-) strand; PAM type: YTN; PAM sequence: TTT
agaggctggaatgtgtcatc

SEQ ID NO: 170331 - DNA, 20 bp, Artificial Sequence
  Description of Artificial Sequence: Synthetic oligonucleotide
  Target: ATXN1; (-) strand; PAM type: YTN; PAM sequence: CTT
tagaggctggaatgtgtcat

SEQ ID NO: 170332 - DNA, 20 bp, Artificial Sequence
  Description of Artificial Sequence: Synthetic oligonucleotide
  Target: ATXN1; (-) strand; PAM type: YTN; PAM sequence: CTG
ctttagaggctggaatgtgt

SEQ ID NO: 170333 - DNA, 20 bp, Artificial Sequence
  Description of Artificial Sequence: Synthetic oligonucleotide
  Target: ATXN1; (-) strand; PAM type: YTN; PAM sequence: CTG
taatgcagactgctttagag

SEQ ID NO: 170334 - DNA, 20 bp, Artificial Sequence
  Description of Artificial Sequence: Synthetic oligonucleotide
  Target: ATXN1; (-) strand; PAM type: YTN; PAM sequence: CTG
gaaaaaataataatgatcct

SEQ ID NO: 170335 - DNA, 20 bp, Artificial Sequence
  Description of Artificial Sequence: Synthetic oligonucleotide
  Target: ATXN1; (-) strand; PAM type: YTN; PAM sequence: TTG
ctggaaaaaataataatgat

SEQ ID NO: 170336 - DNA, 20 bp, Artificial Sequence
  Description of Artificial Sequence: Synthetic oligonucleotide
  Target: ATXN1; (-) strand; PAM type: YTN; PAM sequence: TTT
gctggaaaaaataataatga

SEQ ID NO: 170337 - DNA, 20 bp, Artificial Sequence
  Description of Artificial Sequence: Synthetic oligonucleotide
  Target: ATXN1; (-) strand; PAM type: YTN; PAM sequence: CTT
tgctggaaaaaataataatg

SEQ ID NO: 170338 - DNA, 20 bp, Artificial Sequence
  Description of Artificial Sequence: Synthetic oligonucleotide
  Target: ATXN1; (-) strand; PAM type: YTN; PAM sequence: TTC
tttgctggaaaaaataataa

SEQ ID NO: 170339 - DNA, 20 bp, Artificial Sequence
  Description of Artificial Sequence: Synthetic oligonucleotide
  Target: ATXN1; (-) strand; PAM type: YTN; PAM sequence: CTT
ctttgctggaaaaaataata

SEQ ID NO: 170340 - DNA, 20 bp, Artificial Sequence
  Description of Artificial Sequence: Synthetic oligonucleotide
  Target: ATXN1; (-) strand; PAM type: YTN; PAM sequence: TTG
tggcttctttgctggaaaaa

SEQ ID NO: 170341 - DNA, 20 bp, Artificial Sequence
  Description of Artificial Sequence: Synthetic oligonucleotide
  Target: ATXN1; (-) strand; PAM type: YTN; PAM sequence: CTG
aattgtggcttctttgctgg

SEQ ID NO: 170342 - DNA, 20 bp, Artificial Sequence
  Description of Artificial Sequence: Synthetic oligonucleotide
  Target: ATXN1; (-) strand; PAM type: YTN; PAM sequence: TTC
ctgaattgtggcttctttgc

SEQ ID NO: 170343 - DNA, 20 bp, Artificial Sequence
  Description of Artificial Sequence: Synthetic oligonucleotide
  Target: ATXN1; (-) strand; PAM type: YTN; PAM sequence: TTG
catagattcctgaattgtgg

SEQ ID NO: 170344 - DNA, 20 bp, Artificial Sequence
  Description of Artificial Sequence: Synthetic oligonucleotide
  Target: ATXN1; (-) strand; PAM type: YTN; PAM sequence: TTT
gcatagattcctgaattgtg

SEQ ID NO: 170345 - DNA, 20 bp, Artificial Sequence
  Description of Artificial Sequence: Synthetic oligonucleotide
  Target: ATXN1; (-) strand; PAM type: YTN; PAM sequence: TTT
tgcatagattcctgaattgt

SEQ ID NO: 170346 - DNA, 20 bp, Artificial Sequence
  Description of Artificial Sequence: Synthetic oligonucleotide
  Target: ATXN1; (-) strand; PAM type: YTN; PAM sequence: TTT
ttgcatagattcctgaattg

SEQ ID NO: 170347 - DNA, 20 bp, Artificial Sequence
  Description of Artificial Sequence: Synthetic oligonucleotide
  Target: ATXN1; (-) strand; PAM type: YTN; PAM sequence: TTA
tttttgcatagattcctgaa

SEQ ID NO: 170348 - DNA, 20 bp, Artificial Sequence
  Description of Artificial Sequence: Synthetic oligonucleotide
  Target: ATXN1; (-) strand; PAM type: YTN; PAM sequence: TTA
attatttttgcatagattcc

SEQ ID NO: 170349 - DNA, 20 bp, Artificial Sequence
  Description of Artificial Sequence: Synthetic oligonucleotide
  Target: ATXN1; (-) strand; PAM type: YTN; PAM sequence: CTT
aattatttttgcatagattc

SEQ ID NO: 170350 - DNA, 20 bp, Artificial Sequence
  Description of Artificial Sequence: Synthetic oligonucleotide
  Target: ATXN1; (-) strand; PAM type: YTN; PAM sequence: TTC
acttaattatttttgcatag

SEQ ID NO: 170351 - DNA, 20 bp, Artificial Sequence
  Description of Artificial Sequence: Synthetic oligonucleotide
  Target: ATXN1; (-) strand; PAM type: YTN; PAM sequence: CTT
cacttaattatttttgcata

SEQ ID NO: 170352 - DNA, 20 bp, Artificial Sequence
  Description of Artificial Sequence: Synthetic oligonucleotide
  Target: ATXN1; (-) strand; PAM type: YTN; PAM sequence: TTG
atggagcaaccttcacttaa

SEQ ID NO: 170353 - DNA, 20 bp, Artificial Sequence
  Description of Artificial Sequence: Synthetic oligonucleotide
  Target: ATXN1; (-) strand; PAM type: YTN; PAM sequence: CTT
gatggagcaaccttcactta

SEQ ID NO: 170354 - DNA, 20 bp, Artificial Sequence
  Description of Artificial Sequence: Synthetic oligonucleotide
  Target: ATXN1; (-) strand; PAM type: YTN; PAM sequence: TTG
atggaaacttgatggagcaa

SEQ ID NO: 170355 - DNA, 20 bp, Artificial Sequence
  Description of Artificial Sequence: Synthetic oligonucleotide
  Target: ATXN1; (-) strand; PAM type: YTN; PAM sequence: CTC
aggaagggcagaatggcaag

SEQ ID NO: 170356 - DNA, 20 bp, Artificial Sequence
  Description of Artificial Sequence: Synthetic oligonucleotide
  Target: ATXN1; (-) strand; PAM type: YTN; PAM sequence: TTG
tcatctcaggaagggcagaa

SEQ ID NO: 170357 - DNA, 20 bp, Artificial Sequence
  Description of Artificial Sequence: Synthetic oligonucleotide
  Target: ATXN1; (-) strand; PAM type: YTN; PAM sequence: CTG
acatgttgtcatctcaggaa

SEQ ID NO: 170358 - DNA, 20 bp, Artificial Sequence
  Description of Artificial Sequence: Synthetic oligonucleotide
  Target: ATXN1; (-) strand; PAM type: YTN; PAM sequence: TTC
aaagcagctgacatgttgtc

SEQ ID NO: 170359 - DNA, 20 bp, Artificial Sequence
  Description of Artificial Sequence: Synthetic oligonucleotide
  Target: ATXN1; (-) strand; PAM type: YTN; PAM sequence: TTG
ttcaaagcagctgacatgtt

SEQ ID NO: 170360 - DNA, 20 bp, Artificial Sequence
  Description of Artificial Sequence: Synthetic oligonucleotide
  Target: ATXN1; (-) strand; PAM type: YTN; PAM sequence: CTT
gttcaaagcagctgacatgt

SEQ ID NO: 170361 - DNA, 20 bp, Artificial Sequence
  Description of Artificial Sequence: Synthetic oligonucleotide
  Target: ATXN1; (-) strand; PAM type: YTN; PAM sequence: CTA
caaagcagcagcaagtgcaa

SEQ ID NO: 170362 - DNA, 20 bp, Artificial Sequence
  Description of Artificial Sequence: Synthetic oligonucleotide
  Target: ATXN1; (-) strand; PAM type: YTN; PAM sequence: CTA
cccagcagactacaaagcag

SEQ ID NO: 170363 - DNA, 20 bp, Artificial Sequence
  Description of Artificial Sequence: Synthetic oligonucleotide
  Target: ATXN1; (-) strand; PAM type: YTN; PAM sequence: CTG
tcaccactacccagcagact

SEQ ID NO: 170364 - DNA, 20 bp, Artificial Sequence
  Description of Artificial Sequence: Synthetic oligonucleotide
  Target: ATXN1; (-) strand; PAM type: YTN; PAM sequence: TTA
acgcgctgtcaccactaccc

SEQ ID NO: 170365 - DNA, 20 bp, Artificial Sequence
  Description of Artificial Sequence: Synthetic oligonucleotide
  Target: ATXN1; (-) strand; PAM type: YTN; PAM sequence: TTA
tggttaacgcgctgtcacca

SEQ ID NO: 170366 - DNA, 20 bp, Artificial Sequence
  Description of Artificial Sequence: Synthetic oligonucleotide
  Target: ATXN1; (-) strand; PAM type: YTN; PAM sequence: TTT
atggttaacgcgctgtcacc

SEQ ID NO: 170367 - DNA, 20 bp, Artificial Sequence
  Description of Artificial Sequence: Synthetic oligonucleotide
  Target: ATXN1; (-) strand; PAM type: YTN; PAM sequence: TTT
tatggttaacgcgctgtcac

SEQ ID NO: 170368 - DNA, 20 bp, Artificial Sequence
  Description of Artificial Sequence: Synthetic oligonucleotide
  Target: ATXN1; (-) strand; PAM type: YTN; PAM sequence: TTT
ttatggttaacgcgctgtca

SEQ ID NO: 170369 - DNA, 20 bp, Artificial Sequence
  Description of Artificial Sequence: Synthetic oligonucleotide
  Target: ATXN1; (-) strand; PAM type: YTN; PAM sequence: TTT
tttatggttaacgcgctgtc

SEQ ID NO: 170370 - DNA, 20 bp, Artificial Sequence
  Description of Artificial Sequence: Synthetic oligonucleotide
  Target: ATXN1; (-) strand; PAM type: YTN; PAM sequence: TTT
ttttatggttaacgcgctgt

SEQ ID NO: 170371 - DNA, 20 bp, Artificial Sequence
  Description of Artificial Sequence: Synthetic oligonucleotide
  Target: ATXN1; (-) strand; PAM type: YTN; PAM sequence: CTC
cccatttttttatggttaac

SEQ ID NO: 170372 - DNA, 20 bp, Artificial Sequence
  Description of Artificial Sequence: Synthetic oligonucleotide
  Target: ATXN1; (-) strand; PAM type: YTN; PAM sequence: CTG
aactccccatttttttatgg

SEQ ID NO: 170373 - DNA, 20 bp, Artificial Sequence
  Description of Artificial Sequence: Synthetic oligonucleotide
  Target: ATXN1; (-) strand; PAM type: YTN; PAM sequence: CTC
cagtcctgaactccccattt

SEQ ID NO: 170374 - DNA, 20 bp, Artificial Sequence
  Description of Artificial Sequence: Synthetic oligonucleotide
  Target: ATXN1; (-) strand; PAM type: YTN; PAM sequence: CTC
agccccctccagtcctgaac

SEQ ID NO: 170375 - DNA, 20 bp, Artificial Sequence
  Description of Artificial Sequence: Synthetic oligonucleotide
  Target: ATXN1; (-) strand; PAM type: YTN; PAM sequence: TTC
tcagccccctccagtcctga

SEQ ID NO: 170376 - DNA, 20 bp, Artificial Sequence
  Description of Artificial Sequence: Synthetic oligonucleotide
  Target: ATXN1; (-) strand; PAM type: YTN; PAM sequence: TTA
aaatgttctcagccccctcc

SEQ ID NO: 170377 - DNA, 20 bp, Artificial Sequence
  Description of Artificial Sequence: Synthetic oligonucleotide
  Target: ATXN1; (-) strand; PAM type: YTN; PAM sequence: TTG
caaatatgttaaaatgttct

SEQ ID NO: 170378 - DNA, 20 bp, Artificial Sequence
  Description of Artificial Sequence: Synthetic oligonucleotide
  Target: ATXN1; (-) strand; PAM type: YTN; PAM sequence: TTT
gcaaatatgttaaaatgttc

SEQ ID NO: 170379 - DNA, 20 bp, Artificial Sequence
  Description of Artificial Sequence: Synthetic oligonucleotide
  Target: ATXN1; (-) strand; PAM type: YTN; PAM sequence: CTT
tgcaaatatgttaaaatgtt

SEQ ID NO: 170380 - DNA, 20 bp, Artificial Sequence
  Description of Artificial Sequence: Synthetic oligonucleotide
  Target: ATXN1; (-) strand; PAM type: YTN; PAM sequence: TTG
tgcctttgcaaatatgttaa

SEQ ID NO: 170381 - DNA, 20 bp, Artificial Sequence
  Description of Artificial Sequence: Synthetic oligonucleotide
  Target: ATXN1; (-) strand; PAM type: YTN; PAM sequence: CTT
gtgcctttgcaaatatgtta

SEQ ID NO: 170382 - DNA, 20 bp, Artificial Sequence
  Description of Artificial Sequence: Synthetic oligonucleotide
  Target: ATXN1; (-) strand; PAM type: YTN; PAM sequence: TTA
caatcttgtgcctttgcaaa

SEQ ID NO: 170383 - DNA, 20 bp, Artificial Sequence
  Description of Artificial Sequence: Synthetic oligonucleotide
  Target: ATXN1; (-) strand; PAM type: YTN; PAM sequence: CTT
acaatcttgtgcctttgcaa

SEQ ID NO: 170384 - DNA, 20 bp, Artificial Sequence
  Description of Artificial Sequence: Synthetic oligonucleotide
  Target: ATXN1; (-) strand; PAM type: YTN; PAM sequence: TTC
ttacaatcttgtgcctttgc

SEQ ID NO: 170385 - DNA, 20 bp, Artificial Sequence
  Description of Artificial Sequence: Synthetic oligonucleotide
  Target: ATXN1; (-) strand; PAM type: YTN; PAM sequence: CTA
ttcttacaatcttgtgcctt

SEQ ID NO: 170386 - DNA, 20 bp, Artificial Sequence
  Description of Artificial Sequence: Synthetic oligonucleotide
  Target: ATXN1; (-) strand; PAM type: YTN; PAM sequence: CTC
agcataactattcttacaat

SEQ ID NO: 170387 - DNA, 20 bp, Artificial Sequence
  Description of Artificial Sequence: Synthetic oligonucleotide
  Target: ATXN1; (-) strand; PAM type: YTN; PAM sequence: TTC
tcagcataactattcttaca

SEQ ID NO: 170388 - DNA, 20 bp, Artificial Sequence
  Description of Artificial Sequence: Synthetic oligonucleotide
  Target: ATXN1; (-) strand; PAM type: YTN; PAM sequence: TTA
agttctcagcataactattc

SEQ ID NO: 170389 - DNA, 20 bp, Artificial Sequence
  Description of Artificial Sequence: Synthetic oligonucleotide
  Target: ATXN1; (-) strand; PAM type: YTN; PAM sequence: TTT
aagttctcagcataactatt

SEQ ID NO: 170390 - DNA, 20 bp, Artificial Sequence
  Description of Artificial Sequence: Synthetic oligonucleotide
  Target: ATXN1; (-) strand; PAM type: YTN; PAM sequence: CTG
aaagcaaaagtttaagttct

SEQ ID NO: 170391 - DNA, 20 bp, Artificial Sequence
  Description of Artificial Sequence: Synthetic oligonucleotide
  Target: ATXN1; (-) strand; PAM type: YTN; PAM sequence: CTG
atctgaaagcaaaagtttaa

SEQ ID NO: 170392 - DNA, 20 bp, Artificial Sequence
  Description of Artificial Sequence: Synthetic oligonucleotide
  Target: ATXN1; (-) strand; PAM type: YTN; PAM sequence: TTC
agtctgatctgaaagcaaaa

SEQ ID NO: 170393 - DNA, 20 bp, Artificial Sequence
  Description of Artificial Sequence: Synthetic oligonucleotide
  Target: ATXN1; (-) strand; PAM type: YTN; PAM sequence: TTA
agagttcagtctgatctgaa

SEQ ID NO: 170394 - DNA, 20 bp, Artificial Sequence
  Description of Artificial Sequence: Synthetic oligonucleotide
  Target: ATXN1; (-) strand; PAM type: YTN; PAM sequence: TTC
atgtaaaagtgttaagagtt

SEQ ID NO: 170395 - DNA, 20 bp, Artificial Sequence
  Description of Artificial Sequence: Synthetic oligonucleotide
  Target: ATXN1; (-) strand; PAM type: YTN; PAM sequence: TTT
catgtaaaagtgttaagagt

SEQ ID NO: 170396 - DNA, 20 bp, Artificial Sequence
  Description of Artificial Sequence: Synthetic oligonucleotide
  Target: ATXN1; (-) strand; PAM type: YTN; PAM sequence: CTT
tcatgtaaaagtgttaagag

SEQ ID NO: 170397 - DNA, 20 bp, Artificial Sequence
  Description of Artificial Sequence: Synthetic oligonucleotide
  Target: ATXN1; (-) strand; PAM type: YTN; PAM sequence: TTC
tttcatgtaaaagtgttaag

SEQ ID NO: 170398 - DNA, 20 bp, Artificial Sequence
  Description of Artificial Sequence: Synthetic oligonucleotide
  Target: ATXN1; (-) strand; PAM type: YTN; PAM sequence: TTT
ctttcatgtaaaagtgttaa

SEQ ID NO: 170399 - DNA, 20 bp, Artificial Sequence
  Description of Artificial Sequence: Synthetic oligonucleotide
  Target: ATXN1; (-) strand; PAM type: YTN; PAM sequence: TTG
catttctttcatgtaaaagt

SEQ ID NO: 170400 - DNA, 20 bp, Artificial Sequence
  Description of Artificial Sequence: Synthetic oligonucleotide
  Target: ATXN1; (-) strand; PAM type: YTN; PAM sequence: CTT
gcatttctttcatgtaaaag

SEQ ID NO: 170401 - DNA, 20 bp, Artificial Sequence
  Description of Artificial Sequence: Synthetic oligonucleotide
  Target: ATXN1; (-) strand; PAM type: YTN; PAM sequence: CTC
cttgcatttctttcatgtaa

SEQ ID NO: 170402 - DNA, 20 bp, Artificial Sequence
  Description of Artificial Sequence: Synthetic oligonucleotide
  Target: ATXN1; (-) strand; PAM type: YTN; PAM sequence: TTC
tccttgcatttctttcatgt

SEQ ID NO: 170403 - DNA, 20 bp, Artificial Sequence
  Description of Artificial Sequence: Synthetic oligonucleotide
  Target: ATXN1; (-) strand; PAM type: YTN; PAM sequence: TTT
ctccttgcatttctttcatg

SEQ ID NO: 170404 - DNA, 20 bp, Artificial Sequence
  Description of Artificial Sequence: Synthetic oligonucleotide
  Target: ATXN1; (-) strand; PAM type: YTN; PAM sequence: TTA
tcataggtttctccttgcat

SEQ ID NO: 170405 - DNA, 20 bp, Artificial Sequence
  Description of Artificial Sequence: Synthetic oligonucleotide
  Target: ATXN1; (-) strand; PAM type: YTN; PAM sequence: TTT
atcataggtttctccttgca

SEQ ID NO: 170406 - DNA, 20 bp, Artificial Sequence
  Description of Artificial Sequence: Synthetic oligonucleotide
  Target: ATXN1; (-) strand; PAM type: YTN; PAM sequence: TTT
tatcataggtttctccttgc

SEQ ID NO: 170407 - DNA, 20 bp, Artificial Sequence
  Description of Artificial Sequence: Synthetic oligonucleotide
  Target: ATXN1; (-) strand; PAM type: YTN; PAM sequence: TTG
gttttatcataggtttctcc

SEQ ID NO: 170408 - DNA, 20 bp, Artificial Sequence
  Description of Artificial Sequence: Synthetic oligonucleotide
  Target: ATXN1; (-) strand; PAM type: YTN; PAM sequence: TTA
atgtattggttttatcatag

SEQ ID NO: 170409 - DNA, 20 bp, Artificial Sequence
  Description of Artificial Sequence: Synthetic oligonucleotide
  Target: ATXN1; (-) strand; PAM type: YTN; PAM sequence: CTA
gaggcacacgatatccacat

SEQ ID NO: 170410 - DNA, 20 bp, Artificial Sequence
  Description of Artificial Sequence: Synthetic oligonucleotide
  Target: ATXN1; (-) strand; PAM type: YTN; PAM sequence: TTC
tagaggcacacgatatccac

SEQ ID NO: 170411 - DNA, 20 bp, Artificial Sequence
  Description of Artificial Sequence: Synthetic oligonucleotide
  Target: ATXN1; (-) strand; PAM type: YTN; PAM sequence: TTT
ctagaggcacacgatatcca

SEQ ID NO: 170412 - DNA, 20 bp, Artificial Sequence
  Description of Artificial Sequence: Synthetic oligonucleotide
  Target: ATXN1; (-) strand; PAM type: YTN; PAM sequence: CTT
tctagaggcacacgatatcc

SEQ ID NO: 170413 - DNA, 20 bp, Artificial Sequence
  Description of Artificial Sequence: Synthetic oligonucleotide
  Target: ATXN1; (-) strand; PAM type: YTN; PAM sequence: CTG
actttctagaggcacacgat

SEQ ID NO: 170414 - DNA, 20 bp, Artificial Sequence
  Description of Artificial Sequence: Synthetic oligonucleotide
  Target: ATXN1; (-) strand; PAM type: YTN; PAM sequence: CTC
ctgactttctagaggcacac

SEQ ID NO: 170415 - DNA, 20 bp, Artificial Sequence
  Description of Artificial Sequence: Synthetic oligonucleotide
  Target: ATXN1; (-) strand; PAM type: YTN; PAM sequence: CTC
tcctgactttctagaggcac

SEQ ID NO: 170416 - DNA, 20 bp, Artificial Sequence
  Description of Artificial Sequence: Synthetic oligonucleotide
  Target: ATXN1; (-) strand; PAM type: YTN; PAM sequence: TTG
ctctcctgactttctagagg

SEQ ID NO: 170417 - DNA, 20 bp, Artificial Sequence
  Description of Artificial Sequence: Synthetic oligonucleotide
  Target: ATXN1; (-) strand; PAM type: YTN; PAM sequence: TTT
gctctcctgactttctagag

SEQ ID NO: 170418 - DNA, 20 bp, Artificial Sequence
  Description of Artificial Sequence: Synthetic oligonucleotide
  Target: ATXN1; (-) strand; PAM type: YTN; PAM sequence: CTC
ccacatttgctctcctgact

SEQ ID NO: 170419 - DNA, 20 bp, Artificial Sequence
  Description of Artificial Sequence: Synthetic oligonucleotide
  Target: ATXN1; (-) strand; PAM type: YTN; PAM sequence: CTC
aaggagctcccacatttgct

SEQ ID NO: 170420 - DNA, 20 bp, Artificial Sequence
  Description of Artificial Sequence: Synthetic oligonucleotide
  Target: ATXN1; (-) strand; PAM type: YTN; PAM sequence: TTG
tgcagcagatcagaataact

SEQ ID NO: 170421 - DNA, 20 bp, Artificial Sequence
  Description of Artificial Sequence: Synthetic oligonucleotide
  Target: ATXN1; (-) strand; PAM type: YTN; PAM sequence: CTT
gtgcagcagatcagaataac

SEQ ID NO: 170422 - DNA, 20 bp, Artificial Sequence
  Description of Artificial Sequence: Synthetic oligonucleotide
  Target: ATXN1; (-) strand; PAM type: YTN; PAM sequence: CTG
gtggccttgtgcagcagatc

SEQ ID NO: 170423 - DNA, 20 bp, Artificial Sequence
  Description of Artificial Sequence: Synthetic oligonucleotide
  Target: ATXN1; (-) strand; PAM type: YTN; PAM sequence: TTA
tcagtgtcagagacccagcc

SEQ ID NO: 170424 - DNA, 20 bp, Artificial Sequence
  Description of Artificial Sequence: Synthetic oligonucleotide
  Target: ATXN1; (-) strand; PAM type: YTN; PAM sequence: CTG
ttatcagtgtcagagaccca

SEQ ID NO: 170425 - DNA, 20 bp, Artificial Sequence
  Description of Artificial Sequence: Synthetic oligonucleotide
  Target: ATXN1; (-) strand; PAM type: YTN; PAM sequence: TTC
accagagacctgttatcagt

SEQ ID NO: 170426 - DNA, 20 bp, Artificial Sequence
  Description of Artificial Sequence: Synthetic oligonucleotide
  Target: ATXN1; (-) strand; PAM type: YTN; PAM sequence: CTT
caccagagacctgttatcag

SEQ ID NO: 170427 - DNA, 20 bp, Artificial Sequence
  Description of Artificial Sequence: Synthetic oligonucleotide
  Target: ATXN1; (-) strand; PAM type: YTN; PAM sequence: TTA
cacaaggtccttcaccagag

SEQ ID NO: 170428 - DNA, 20 bp, Artificial Sequence
  Description of Artificial Sequence: Synthetic oligonucleotide
  Target: ATXN1; (-) strand; PAM type: YTN; PAM sequence: TTT
acacaaggtccttcaccaga

SEQ ID NO: 170429 - DNA, 20 bp, Artificial Sequence
  Description of Artificial Sequence: Synthetic oligonucleotide
  Target: ATXN1; (-) strand; PAM type: YTN; PAM sequence: CTT
tacacaaggtccttcaccag

SEQ ID NO: 170430 - DNA, 20 bp, Artificial Sequence
  Description of Artificial Sequence: Synthetic oligonucleotide
  Target: ATXN1; (-) strand; PAM type: YTN; PAM sequence: CTC
tttacacaaggtccttcacc

SEQ ID NO: 170431 - DNA, 20 bp, Artificial Sequence
  Description of Artificial Sequence: Synthetic oligonucleotide
  Target: ATXN1; (-) strand; PAM type: YTN; PAM sequence: TTA
tactctttacacaaggtcct

SEQ ID NO: 170432 - DNA, 20 bp, Artificial Sequence
  Description of Artificial Sequence: Synthetic oligonucleotide
  Target: ATXN1; (-) strand; PAM type: YTN; PAM sequence: TTA
ccattatactctttacacaa

SEQ ID NO: 170433 - DNA, 20 bp, Artificial Sequence
  Description of Artificial Sequence: Synthetic oligonucleotide
  Target: ATXN1; (-) strand; PAM type: YTN; PAM sequence: TTG
ttaccattatactctttaca

SEQ ID NO: 170434 - DNA, 20 bp, Artificial Sequence
  Description of Artificial Sequence: Synthetic oligonucleotide
  Target: ATXN1; (-) strand; PAM type: YTN; PAM sequence: TTT
gttaccattatactctttac

SEQ ID NO: 170435 - DNA, 20 bp, Artificial Sequence
  Description of Artificial Sequence: Synthetic oligonucleotide
  Target: ATXN1; (-) strand; PAM type: YTN; PAM sequence: TTT
tgttaccattatactcttta

SEQ ID NO: 170436 - DNA, 20 bp, Artificial Sequence
  Description of Artificial Sequence: Synthetic oligonucleotide
  Target: ATXN1; (-) strand; PAM type: YTN; PAM sequence: TTT
ttgttaccattatactcttt

SEQ ID NO: 170437 - DNA, 20 bp, Artificial Sequence
  Description of Artificial Sequence: Synthetic oligonucleotide
  Target: ATXN1; (-) strand; PAM type: YTN; PAM sequence: TTA
tttttgttaccattatactc

SEQ ID NO: 170438 - DNA, 20 bp, Artificial Sequence
  Description of Artificial Sequence: Synthetic oligonucleotide
  Target: ATXN1; (-) strand; PAM type: YTN; PAM sequence: TTT
atttttgttaccattatact

SEQ ID NO: 170439 - DNA, 20 bp, Artificial Sequence
  Description of Artificial Sequence: Synthetic oligonucleotide
  Target: ATXN1; (-) strand; PAM type: YTN; PAM sequence: TTT
tatttttgttaccattatac

SEQ ID NO: 170440 - DNA, 20 bp, Artificial Sequence
  Description of Artificial Sequence: Synthetic oligonucleotide
  Target: ATXN1; (-) strand; PAM type: YTN; PAM sequence: CTT
ttatttttgttaccattata

SEQ ID NO: 170441 - DNA, 20 bp, Artificial Sequence
  Description of Artificial Sequence: Synthetic oligonucleotide
  Target: ATXN1; (-) strand; PAM type: YTN; PAM sequence: TTC
ttttatttttgttaccatta

SEQ ID NO: 170442 - DNA, 20 bp, Artificial Sequence
  Description of Artificial Sequence: Synthetic oligonucleotide
  Target: ATXN1; (-) strand; PAM type: YTN; PAM sequence: TTT
cttttatttttgttaccatt

SEQ ID NO: 170443 - DNA, 20 bp, Artificial Sequence
  Description of Artificial Sequence: Synthetic oligonucleotide
  Target: ATXN1; (-) strand; PAM type: YTN; PAM sequence: TTC
atttcttttatttttgttac

SEQ ID NO: 170444 - DNA, 20 bp, Artificial Sequence
  Description of Artificial Sequence: Synthetic oligonucleotide
  Target: ATXN1; (-) strand; PAM type: YTN; PAM sequence: CTT
catttcttttatttttgtta

SEQ ID NO: 170445 - DNA, 20 bp, Artificial Sequence
  Description of Artificial Sequence: Synthetic oligonucleotide
  Target: ATXN1; (-) strand; PAM type: YTN; PAM sequence: TTC
ttcatttcttttatttttgt

SEQ ID NO: 170446 - DNA, 20 bp, Artificial Sequence
  Description of Artificial Sequence: Synthetic oligonucleotide
  Target: ATXN1; (-) strand; PAM type: YTN; PAM sequence: TTT
cttcatttcttttatttttg

SEQ ID NO: 170447 - DNA, 20 bp, Artificial Sequence
  Description of Artificial Sequence: Synthetic oligonucleotide
  Target: ATXN1; (-) strand; PAM type: YTN; PAM sequence: CTA
atatgcgtttcttcatttct

SEQ ID NO: 170448 - DNA, 20 bp, Artificial Sequence
  Description of Artificial Sequence: Synthetic oligonucleotide
  Target: ATXN1; (-) strand; PAM type: YTN; PAM sequence: TTA
gtcctaatatgcgtttcttc

SEQ ID NO: 170449 - DNA, 20 bp, Artificial Sequence
  Description of Artificial Sequence: Synthetic oligonucleotide
  Target: ATXN1; (-) strand; PAM type: YTN; PAM sequence: TTT
agtcctaatatgcgtttctt

SEQ ID NO: 170450 - DNA, 20 bp, Artificial Sequence
  Description of Artificial Sequence: Synthetic oligonucleotide
  Target: ATXN1; (-) strand; PAM type: YTN; PAM sequence: TTT
tagtcctaatatgcgtttct

SEQ ID NO: 170451 - DNA, 20 bp, Artificial Sequence
  Description of Artificial Sequence: Synthetic oligonucleotide
  Target: ATXN1; (-) strand; PAM type: YTN; PAM sequence: CTT
ttagtcctaatatgcgtttc

SEQ ID NO: 170452 - DNA, 20 bp, Artificial Sequence
  Description of Artificial Sequence: Synthetic oligonucleotide
  Target: ATXN1; (-) strand; PAM type: YTN; PAM sequence: CTA
tgtacatcttttagtcctaa

SEQ ID NO: 170453 - DNA, 20 bp, Artificial Sequence
  Description of Artificial Sequence: Synthetic oligonucleotide
  Target: ATXN1; (-) strand; PAM type: YTN; PAM sequence: CTC
tatgtacatcttttagtcct

SEQ ID NO: 170454 - DNA, 20 bp, Artificial Sequence
  Description of Artificial Sequence: Synthetic oligonucleotide
  Target: ATXN1; (-) strand; PAM type: YTN; PAM sequence: CTC
tctatgtacatcttttagtc

SEQ ID NO: 170455 - DNA, 20 bp, Artificial Sequence
  Description of Artificial Sequence: Synthetic oligonucleotide
  Target: ATXN1; (-) strand; PAM type: YTN; PAM sequence: TTC
tctctatgtacatcttttag

SEQ ID NO: 170456 - DNA, 20 bp, Artificial Sequence
  Description of Artificial Sequence: Synthetic oligonucleotide
  Target: ATXN1; (-) strand; PAM type: YTN; PAM sequence: TTT
ctctctatgtacatctttta

SEQ ID NO: 170457 - DNA, 20 bp, Artificial Sequence
  Description of Artificial Sequence: Synthetic oligonucleotide
  Target: ATXN1; (-) strand; PAM type: YTN; PAM sequence: CTC
atttctctctatgtacatct

SEQ ID NO: 170458 - DNA, 20 bp, Artificial Sequence
  Description of Artificial Sequence: Synthetic oligonucleotide
  Target: ATXN1; (-) strand; PAM type: YTN; PAM sequence: TTA
cgctcatttctctctatgta

SEQ ID NO: 170459 - DNA, 20 bp, Artificial Sequence
  Description of Artificial Sequence: Synthetic oligonucleotide
  Target: ATXN1; (-) strand; PAM type: YTN; PAM sequence: CTA
tgagcccaaggagttacgct

SEQ ID NO: 170460 - DNA, 20 bp, Artificial Sequence
  Description of Artificial Sequence: Synthetic oligonucleotide
  Target: ATXN1; (-) strand; PAM type: YTN; PAM sequence: TTC
agcctatgagcccaaggagt

SEQ ID NO: 170461 - DNA, 20 bp, Artificial Sequence
  Description of Artificial Sequence: Synthetic oligonucleotide
  Target: ATXN1; (-) strand; PAM type: YTN; PAM sequence: TTC
agaggcattcagcctatgag

SEQ ID NO: 170462 - DNA, 20 bp, Artificial Sequence
  Description of Artificial Sequence: Synthetic oligonucleotide
  Target: ATXN1; (-) strand; PAM type: YTN; PAM sequence: TTC
atgttcagaggcattcagcc

SEQ ID NO: 170463 - DNA, 20 bp, Artificial Sequence
  Description of Artificial Sequence: Synthetic oligonucleotide
  Target: ATXN1; (-) strand; PAM type: YTN; PAM sequence: CTG
ttcatgttcagaggcattca

SEQ ID NO: 170464 - DNA, 20 bp, Artificial Sequence
  Description of Artificial Sequence: Synthetic oligonucleotide
  Target: ATXN1; (-) strand; PAM type: YTN; PAM sequence: TTG
aaggagtaacatcctgttca

SEQ ID NO: 170465 - DNA, 20 bp, Artificial Sequence
  Description of Artificial Sequence: Synthetic oligonucleotide
  Target: ATXN1; (-) strand; PAM type: YTN; PAM sequence: TTT
gaaggagtaacatcctgttc

SEQ ID NO: 170466 - DNA, 20 bp, Artificial Sequence
  Description of Artificial Sequence: Synthetic oligonucleotide
  Target: ATXN1; (-) strand; PAM type: YTN; PAM sequence: TTA
aaaagtgatttgaaggagta

SEQ ID NO: 170467 - DNA, 20 bp, Artificial Sequence
  Description of Artificial Sequence: Synthetic oligonucleotide
  Target: ATXN1; (-) strand; PAM type: YTN; PAM sequence: TTT
aaaaagtgatttgaaggagt

SEQ ID NO: 170468 - DNA, 20 bp, Artificial Sequence
  Description of Artificial Sequence: Synthetic oligonucleotide
  Target: ATXN1; (-) strand; PAM type: YTN; PAM sequence: TTT
taaaaagtgatttgaaggag

SEQ ID NO: 170469 - DNA, 20 bp, Artificial Sequence
  Description of Artificial Sequence: Synthetic oligonucleotide
  Target: ATXN1; (-) strand; PAM type: YTN; PAM sequence: TTT
ttaaaaagtgatttgaagga

SEQ ID NO: 170470 - DNA, 20 bp, Artificial Sequence
  Description of Artificial Sequence: Synthetic oligonucleotide
  Target: ATXN1; (-) strand; PAM type: YTN; PAM sequence: TTA
aaaataatcaaaatattttt

SEQ ID NO: 170471 - DNA, 20 bp, Artificial Sequence
  Description of Artificial Sequence: Synthetic oligonucleotide
  Target: ATXN1; (-) strand; PAM type: YTN; PAM sequence: TTT
aaaaataatcaaaatatttt

SEQ ID NO: 170472 - DNA, 20 bp, Artificial Sequence
  Description of Artificial Sequence: Synthetic oligonucleotide
  Target: ATXN1; (-) strand; PAM type: YTN; PAM sequence: CTT
taaaaataatcaaaatattt

SEQ ID NO: 170473 - DNA, 20 bp, Artificial Sequence
  Description of Artificial Sequence: Synthetic oligonucleotide
  Target: ATXN1; (-) strand; PAM type: YTN; PAM sequence: CTC
ctttaaaaataatcaaaata

SEQ ID NO: 170474 - DNA, 20 bp, Artificial Sequence
  Description of Artificial Sequence: Synthetic oligonucleotide
  Target: ATXN1; (-) strand; PAM type: YTN; PAM sequence: CTG
ggcaacatagtgaaaccccg

SEQ ID NO: 170475 - DNA, 20 bp, Artificial Sequence
  Description of Artificial Sequence: Synthetic oligonucleotide
  Target: ATXN1; (-) strand; PAM type: YTN; PAM sequence: TTG
agaccagcctgggcaacata

SEQ ID NO: 170476 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctgggcaacat

SEQ ID NO: 170477 - DNA, 20 bp, Artificial Sequence
  Description of Artificial Sequence: Synthetic oligonucleotide
  Target: ATXN1; (-) strand; PAM type: YTN; PAM sequence: TTG
agcccaggagtttgagacca

SEQ ID NO: 170478 - DNA, 20 bp, Artificial Sequence
  Description of Artificial Sequence: Synthetic oligonucleotide
  Target: ATXN1; (-) strand; PAM type: YTN; PAM sequence: CTT
gagcccaggagtttgagacc

SEQ ID NO: 170479 - DNA, 20 bp, Artificial Sequence
  Description of Artificial Sequence: Synthetic oligonucleotide
  Target: ATXN1; (-) strand; PAM type: YTN; PAM sequence: TTG
cttgagcccaggagtttgag

SEQ ID NO: 170480 - DNA, 20 bp, Artificial Sequence
  Description of Artificial Sequence: Synthetic oligonucleotide
  Target: ATXN1; (-) strand; PAM type: YTN; PAM sequence: CTG
aggcaggcagattgcttgag

SEQ ID NO: 170481 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggcagat

SEQ ID NO: 170482 - DNA, 20 bp, Artificial Sequence
  Description of Artificial Sequence: Synthetic oligonucleotide
  Target: ATXN1; (-) strand; PAM type: YTN; PAM sequence: TTT
gggaggctgaggcaggcaga

SEQ ID NO: 170483 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgaggcaggcag

SEQ ID NO: 170484 - DNA, 20 bp, Artificial Sequence
  Description of Artificial Sequence: Synthetic oligonucleotide
  Target: ATXN1; (-) strand; PAM type: YTN; PAM sequence: CTA
gcactttgggaggctgaggc

SEQ ID NO: 170485 - DNA, 20 bp, Artificial Sequence
  Description of Artificial Sequence: Synthetic oligonucleotide
  Target: ATXN1; (-) strand; PAM type: YTN; PAM sequence: CTG
taatcctagcactttgggag

SEQ ID NO: 170486 - DNA, 20 bp, Artificial Sequence
  Description of Artificial Sequence: Synthetic oligonucleotide
  Target: ATXN1; (-) strand; PAM type: YTN; PAM sequence: TTC
acgcctgtaatcctagcact

SEQ ID NO: 170487 - DNA, 20 bp, Artificial Sequence
  Description of Artificial Sequence: Synthetic oligonucleotide
  Target: ATXN1; (-) strand; PAM type: YTN; PAM sequence: CTG
ggcacggtagttcacgcctg

SEQ ID NO: 170488 - DNA, 20 bp, Artificial Sequence
  Description of Artificial Sequence: Synthetic oligonucleotide
  Target: ATXN1; (-) strand; PAM type: YTN; PAM sequence: CTG
ggagtaaaaatgatataggg

SEQ ID NO: 170489 - DNA, 20 bp, Artificial Sequence
  Description of Artificial Sequence: Synthetic oligonucleotide
  Target: ATXN1; (-) strand; PAM type: YTN; PAM sequence: CTC
aaagaaatagtagccctggg

SEQ ID NO: 170490 - DNA, 20 bp, Artificial Sequence
  Description of Artificial Sequence: Synthetic oligonucleotide
  Target: ATXN1; (-) strand; PAM type: YTN; PAM sequence: TTG
tcctcaaagaaatagtagcc

SEQ ID NO: 170491 - DNA, 20 bp, Artificial Sequence
  Description of Artificial Sequence: Synthetic oligonucleotide
  Target: ATXN1; (-) strand; PAM type: YTN; PAM sequence: CTT
gtcctcaaagaaatagtagc

SEQ ID NO: 170492 - DNA, 20 bp, Artificial Sequence
  Description of Artificial Sequence: Synthetic oligonucleotide
  Target: ATXN1; (-) strand; PAM type: YTN; PAM sequence: CTA
agacacagtccttgtcctca

SEQ ID NO: 170493 - DNA, 20 bp, Artificial Sequence
  Description of Artificial Sequence: Synthetic oligonucleotide
  Target: ATXN1; (-) strand; PAM type: YTN; PAM sequence: CTA
caatgactaagacacagtcc

SEQ ID NO: 170494 - DNA, 20 bp, Artificial Sequence
  Description of Artificial Sequence: Synthetic oligonucleotide
  Target: ATXN1; (-) strand; PAM type: YTN; PAM sequence: TTA
gacgcatcatactacaatga

SEQ ID NO: 170495 - DNA, 20 bp, Artificial Sequence
  Description of Artificial Sequence: Synthetic oligonucleotide
  Target: ATXN1; (-) strand; PAM type: YTN; PAM sequence: CTA
ttagacgcatcatactacaa

SEQ ID NO: 170496 - DNA, 20 bp, Artificial Sequence
  Description of Artificial Sequence: Synthetic oligonucleotide
  Target: ATXN1; (-) strand; PAM type: YTN; PAM sequence: CTA
tgtgtcaggtactattagac

SEQ ID NO: 170497 - DNA, 20 bp, Artificial Sequence
  Description of Artificial Sequence: Synthetic oligonucleotide
  Target: ATXN1; (-) strand; PAM type: YTN; PAM sequence: CTG
ctatgtgtcaggtactatta

SEQ ID NO: 170498 - DNA, 20 bp, Artificial Sequence
  Description of Artificial Sequence: Synthetic oligonucleotide
  Target: ATXN1; (-) strand; PAM type: YTN; PAM sequence: CTA
agcatctgctatgtgtcagg

SEQ ID NO: 170499 - DNA, 20 bp, Artificial Sequence
  Description of Artificial Sequence: Synthetic oligonucleotide
  Target: ATXN1; (-) strand; PAM type: YTN; PAM sequence: CTA
acatgcactaagcatctgct

SEQ ID NO: 170500 - DNA, 20 bp, Artificial Sequence
  Description of Artificial Sequence: Synthetic oligonucleotide
  Target: ATXN1; (-) strand; PAM type: YTN; PAM sequence: TTA
acaagctaacatgcactaag

SEQ ID NO: 170501 - DNA, 20 bp, Artificial Sequence
  Description of Artificial Sequence: Synthetic oligonucleotide
  Target: ATXN1; (-) strand; PAM type: YTN; PAM sequence: TTT
aacaagctaacatgcactaa

SEQ ID NO: 170502 - DNA, 20 bp, Artificial Sequence
  Description of Artificial Sequence: Synthetic oligonucleotide
  Target: ATXN1; (-) strand; PAM type: YTN; PAM sequence: TTG
tgccagatgcatgtatttaa

SEQ ID NO: 170503 - DNA, 20 bp, Artificial Sequence
  Description of Artificial Sequence: Synthetic oligonucleotide
  Target: ATXN1; (-) strand; PAM type: YTN; PAM sequence: CTT
gtgccagatgcatgtattta

SEQ ID NO: 170504 - DNA, 20 bp, Artificial Sequence
  Description of Artificial Sequence: Synthetic oligonucleotide
  Target: ATXN1; (-) strand; PAM type: YTN; PAM sequence: TTG
atcccttgtgccagatgcat

SEQ ID NO: 170505 - DNA, 20 bp, Artificial Sequence
  Description of Artificial Sequence: Synthetic oligonucleotide
  Target: ATXN1; (-) strand; PAM type: YTN; PAM sequence: CTT
gatcccttgtgccagatgca

SEQ ID NO: 170506 - DNA, 20 bp, Artificial Sequence
  Description of Artificial Sequence: Synthetic oligonucleotide
  Target: ATXN1; (-) strand; PAM type: YTN; PAM sequence: TTG
cttgatcccttgtgccagat

SEQ ID NO: 170507 - DNA, 20 bp, Artificial Sequence
  Description of Artificial Sequence: Synthetic oligonucleotide
  Target: ATXN1; (-) strand; PAM type: YTN; PAM sequence: TTT
gcttgatcccttgtgccaga

SEQ ID NO: 170508 - DNA, 20 bp, Artificial Sequence
  Description of Artificial Sequence: Synthetic oligonucleotide
  Target: ATXN1; (-) strand; PAM type: YTN; PAM sequence: TTC
agagatttgcttgatccctt

SEQ ID NO: 170509 - DNA, 20 bp, Artificial Sequence
  Description of Artificial Sequence: Synthetic oligonucleotide
  Target: ATXN1; (-) strand; PAM type: YTN; PAM sequence: CTG
tcattcagagatttgcttga

SEQ ID NO: 170510 - DNA, 20 bp, Artificial Sequence
  Description of Artificial Sequence: Synthetic oligonucleotide
  Target: ATXN1; (-) strand; PAM type: YTN; PAM sequence: CTA
gtcaatctgtcattcagaga

SEQ ID NO: 170511 - DNA, 20 bp, Artificial Sequence
  Description of Artificial Sequence: Synthetic oligonucleotide
  Target: ATXN1; (-) strand; PAM type: YTN; PAM sequence: TTC
ctagtcaatctgtcattcag

SEQ ID NO: 170512 - DNA, 20 bp, Artificial Sequence
  Description of Artificial Sequence: Synthetic oligonucleotide
  Target: ATXN1; (-) strand; PAM type: YTN; PAM sequence: CTT
cctagtcaatctgtcattca

SEQ ID NO: 170513 - DNA, 20 bp, Artificial Sequence
  Description of Artificial Sequence: Synthetic oligonucleotide
  Target: ATXN1; (-) strand; PAM type: YTN; PAM sequence: CTC
ttcctagtcaatctgtcatt

SEQ ID NO: 170514 - DNA, 20 bp, Artificial Sequence
  Description of Artificial Sequence: Synthetic oligonucleotide
  Target: ATXN1; (-) strand; PAM type: YTN; PAM sequence: CTC
ccgctcttcctagtcaatct

SEQ ID NO: 170515 - DNA, 20 bp, Artificial Sequence
  Description of Artificial Sequence: Synthetic oligonucleotide
  Target: ATXN1; (-) strand; PAM type: YTN; PAM sequence: TTG
atctcccgctcttcctagtc

SEQ ID NO: 170516 - DNA, 20 bp, Artificial Sequence
  Description of Artificial Sequence: Synthetic oligonucleotide
  Target: ATXN1; (-) strand; PAM type: YTN; PAM sequence: TTG
agtcattgatctcccgctct

SEQ ID NO: 170517 - DNA, 20 bp, Artificial Sequence
  Description of Artificial Sequence: Synthetic oligonucleotide
  Target: ATXN1; (-) strand; PAM type: YTN; PAM sequence: CTG
atccgtgaccaccattgagt

SEQ ID NO: 170518 - DNA, 20 bp, Artificial Sequence
  Description of Artificial Sequence: Synthetic oligonucleotide
  Target: ATXN1; (-) strand; PAM type: YTN; PAM sequence: TTG
agagtgctgatccgtgacca

SEQ ID NO: 170519 - DNA, 20 bp, Artificial Sequence
  Description of Artificial Sequence: Synthetic oligonucleotide
  Target: ATXN1; (-) strand; PAM type: YTN; PAM sequence: TTA
gttgagagtgctgatccgtg

SEQ ID NO: 170520 - DNA, 20 bp, Artificial Sequence
  Description of Artificial Sequence: Synthetic oligonucleotide
  Target: ATXN1; (-) strand; PAM type: YTN; PAM sequence: CTC
atggttagttgagagtgctg

SEQ ID NO: 170521 - DNA, 20 bp, Artificial Sequence
  Description of Artificial Sequence: Synthetic oligonucleotide
  Target: ATXN1; (-) strand; PAM type: YTN; PAM sequence: TTC
tcatggttagttgagagtgc

SEQ ID NO: 170522 - DNA, 20 bp, Artificial Sequence
  Description of Artificial Sequence: Synthetic oligonucleotide
  Target: ATXN1; (-) strand; PAM type: YTN; PAM sequence: TTC
atccgggttctcatggttag

SEQ ID NO: 170523 - DNA, 20 bp, Artificial Sequence
  Description of Artificial Sequence: Synthetic oligonucleotide
  Target: ATXN1; (-) strand; PAM type: YTN; PAM sequence: CTT
catccgggttctcatggtta

SEQ ID NO: 170524 - DNA, 20 bp, Artificial Sequence
  Description of Artificial Sequence: Synthetic oligonucleotide
  Target: ATXN1; (-) strand; PAM type: YTN; PAM sequence: CTA
cttcatccgggttctcatgg

SEQ ID NO: 170525 - DNA, 20 bp, Artificial Sequence
  Description of Artificial Sequence: Synthetic oligonucleotide
  Target: ATXN1; (-) strand; PAM type: YTN; PAM sequence: TTC
tacttcatccgggttctcat

SEQ ID NO: 170526 - DNA, 20 bp, Artificial Sequence
  Description of Artificial Sequence: Synthetic oligonucleotide
  Target: ATXN1; (-) strand; PAM type: YTN; PAM sequence: CTT
ctacttcatccgggttctca

SEQ ID NO: 170527 - DNA, 20 bp, Artificial Sequence
  Description of Artificial Sequence: Synthetic oligonucleotide
  Target: ATXN1; (-) strand; PAM type: YTN; PAM sequence: CTA
gcttctacttcatccgggtt

SEQ ID NO: 170528 - DNA, 20 bp, Artificial Sequence
  Description of Artificial Sequence: Synthetic oligonucleotide
  Target: ATXN1; (-) strand; PAM type: YTN; PAM sequence: TTA
acctagcttctacttcatcc

SEQ ID NO: 170529 - DNA, 20 bp, Artificial Sequence
  Description of Artificial Sequence: Synthetic oligonucleotide
  Target: ATXN1; (-) strand; PAM type: YTN; PAM sequence: CTT
aacctagcttctacttcatc

SEQ ID NO: 170530 - DNA, 20 bp, Artificial Sequence
  Description of Artificial Sequence: Synthetic oligonucleotide
  Target: ATXN1; (-) strand; PAM type: YTN; PAM sequence: TTA
atgaggaggggaaaagatca

SEQ ID NO: 170531 - DNA, 20 bp, Artificial Sequence
  Description of Artificial Sequence: Synthetic oligonucleotide
  Target: ATXN1; (-) strand; PAM type: YTN; PAM sequence: TTT
aatgaggaggggaaaagatc

SEQ ID NO: 170532 - DNA, 20 bp, Artificial Sequence
  Description of Artificial Sequence: Synthetic oligonucleotide
  Target: ATXN1; (-) strand; PAM type: YTN; PAM sequence: CTA
tagggagcaatggcaattta

SEQ ID NO: 170533 - DNA, 20 bp, Artificial Sequence
  Description of Artificial Sequence: Synthetic oligonucleotide
  Target: ATXN1; (-) strand; PAM type: YTN; PAM sequence: CTG
atgaccctatagggagcaat

SEQ ID NO: 170534 - DNA, 20 bp, Artificial Sequence
  Description of Artificial Sequence: Synthetic oligonucleotide
  Target: ATXN1; (-) strand; PAM type: YTN; PAM sequence: TTC
tgatgaccctatagggagca

SEQ ID NO: 170535 - DNA, 20 bp, Artificial Sequence
  Description of Artificial Sequence: Synthetic oligonucleotide
  Target: ATXN1; (-) strand; PAM type: YTN; PAM sequence: TTT
ctgatgaccctatagggagc

SEQ ID NO: 170536 - DNA, 20 bp, Artificial Sequence
  Description of Artificial Sequence: Synthetic oligonucleotide
  Target: ATXN1; (-) strand; PAM type: YTN; PAM sequence: CTT
tctgatgaccctatagggag

SEQ ID NO: 170537 - DNA, 20 bp, Artificial Sequence
  Description of Artificial Sequence: Synthetic oligonucleotide
  Target: ATXN1; (-) strand; PAM type: YTN; PAM sequence: CTC
cacaggggccatatccaggc

SEQ ID NO: 170538 - DNA, 20 bp, Artificial Sequence
  Description of Artificial Sequence: Synthetic oligonucleotide
  Target: ATXN1; (-) strand; PAM type: YTN; PAM sequence: TTC
agagatatgtggtgcctcca

SEQ ID NO: 170539 - DNA, 20 bp, Artificial Sequence
  Description of Artificial Sequence: Synthetic oligonucleotide
  Target: ATXN1; (-) strand; PAM type: YTN; PAM sequence: CTC
agcattcagagatatgtggt

SEQ ID NO: 170540 - DNA, 20 bp, Artificial Sequence
  Description of Artificial Sequence: Synthetic oligonucleotide
  Target: ATXN1; (-) strand; PAM type: YTN; PAM sequence: TTA
ctcagcattcagagatatgt

SEQ ID NO: 170541 - DNA, 20 bp, Artificial Sequence
  Description of Artificial Sequence: Synthetic oligonucleotide
  Target: ATXN1; (-) strand; PAM type: YTN; PAM sequence: TTT
actcagcattcagagatatg

SEQ ID NO: 170542 - DNA, 20 bp, Artificial Sequence
  Description of Artificial Sequence: Synthetic oligonucleotide
  Target: ATXN1; (-) strand; PAM type: YTN; PAM sequence: TTT
tactcagcattcagagatat

SEQ ID NO: 170543 - DNA, 20 bp, Artificial Sequence
  Description of Artificial Sequence: Synthetic oligonucleotide
  Target: ATXN1; (-) strand; PAM type: YTN; PAM sequence: CTG
ttttactcagcattcagaga

SEQ ID NO: 170544 - DNA, 20 bp, Artificial Sequence
  Description of Artificial Sequence: Synthetic oligonucleotide
  Target: ATXN1; (-) strand; PAM type: YTN; PAM sequence: TTA
tctgttttactcagcattca

SEQ ID NO: 170545 - DNA, 20 bp, Artificial Sequence
  Description of Artificial Sequence: Synthetic oligonucleotide
  Target: ATXN1; (-) strand; PAM type: YTN; PAM sequence: CTA
cattatctgttttactcagc

SEQ ID NO: 170546 - DNA, 20 bp, Artificial Sequence
  Description of Artificial Sequence: Synthetic oligonucleotide
  Target: ATXN1; (-) strand; PAM type: YTN; PAM sequence: CTC
tacattatctgttttactca

SEQ ID NO: 170547 - DNA, 20 bp, Artificial Sequence
  Description of Artificial Sequence: Synthetic oligonucleotide
  Target: ATXN1; (-) strand; PAM type: YTN; PAM sequence: CTC
tctacattatctgttttact

SEQ ID NO: 170548 - DNA, 20 bp, Artificial Sequence
  Description of Artificial Sequence: Synthetic oligonucleotide
  Target: ATXN1; (-) strand; PAM type: YTN; PAM sequence: TTC
atgtctctctacattatctg

SEQ ID NO: 170549 - DNA, 20 bp, Artificial Sequence
  Description of Artificial Sequence: Synthetic oligonucleotide
  Target: ATXN1; (-) strand; PAM type: YTN; PAM sequence: TTC
agtgaagaagttcatgtctc

SEQ ID NO: 170550 - DNA, 20 bp, Artificial Sequence
  Description of Artificial Sequence: Synthetic oligonucleotide
  Target: ATXN1; (-) strand; PAM type: YTN; PAM sequence: TTT
cagtgaagaagttcatgtct

SEQ ID NO: 170551 - DNA, 20 bp, Artificial Sequence
  Description of Artificial Sequence: Synthetic oligonucleotide
  Target: ATXN1; (-) strand; PAM type: YTN; PAM sequence: CTT
tcagtgaagaagttcatgtc

SEQ ID NO: 170552 - DNA, 20 bp, Artificial Sequence
  Description of Artificial Sequence: Synthetic oligonucleotide
  Target: ATXN1; (-) strand; PAM type: YTN; PAM sequence: TTC
cacagtgaactttcagtgaa

SEQ ID NO: 170553 - DNA, 20 bp, Artificial Sequence
  Description of Artificial Sequence: Synthetic oligonucleotide
  Target: ATXN1; (-) strand; PAM type: YTN; PAM sequence: CTT
ccacagtgaactttcagtga

SEQ ID NO: 170554 - DNA, 20 bp, Artificial Sequence
  Description of Artificial Sequence: Synthetic oligonucleotide
  Target: ATXN1; (-) strand; PAM type: YTN; PAM sequence: CTG
atggagaggtcttccacagt

SEQ ID NO: 170555 - DNA, 20 bp, Artificial Sequence
  Description of Artificial Sequence: Synthetic oligonucleotide
  Target: ATXN1; (-) strand; PAM type: YTN; PAM sequence: CTC
agtggctgatggagaggtct

SEQ ID NO: 170556 - DNA, 20 bp, Artificial Sequence
  Description of Artificial Sequence: Synthetic oligonucleotide
  Target: ATXN1; (-) strand; PAM type: YTN; PAM sequence: CTC
tcagtggctgatggagaggt

SEQ ID NO: 170557 - DNA, 20 bp, Artificial Sequence
  Description of Artificial Sequence: Synthetic oligonucleotide
  Target: ATXN1; (-) strand; PAM type: YTN; PAM sequence: CTC
cctctcagtggctgatggag

SEQ ID NO: 170558 - DNA, 20 bp, Artificial Sequence
  Description of Artificial Sequence: Synthetic oligonucleotide
  Target: ATXN1; (-) strand; PAM type: YTN; PAM sequence: CTG
tacccaagtagcagggcacc

SEQ ID NO: 170559 - DNA, 20 bp, Artificial Sequence
  Description of Artificial Sequence: Synthetic oligonucleotide
  Target: ATXN1; (-) strand; PAM type: YTN; PAM sequence: TTC
tgtacccaagtagcagggca

SEQ ID NO: 170560 - DNA, 20 bp, Artificial Sequence
  Description of Artificial Sequence: Synthetic oligonucleotide
  Target: ATXN1; (-) strand; PAM type: YTN; PAM sequence: CTT
ctgtacccaagtagcagggc

SEQ ID NO: 170561 - DNA, 20 bp, Artificial Sequence
  Description of Artificial Sequence: Synthetic oligonucleotide
  Target: ATXN1; (-) strand; PAM type: YTN; PAM sequence: TTG
acttctgtacccaagtagca

SEQ ID NO: 170562 - DNA, 20 bp, Artificial Sequence
  Description of Artificial Sequence: Synthetic oligonucleotide
  Target: ATXN1; (-) strand; PAM type: YTN; PAM sequence: TTT
gacttctgtacccaagtagc

SEQ ID NO: 170563 - DNA, 20 bp, Artificial Sequence
  Description of Artificial Sequence: Synthetic oligonucleotide
  Target: ATXN1; (-) strand; PAM type: YTN; PAM sequence: CTG
agtttgacttctgtacccaa

SEQ ID NO: 170564 - DNA, 20 bp, Artificial Sequence
  Description of Artificial Sequence: Synthetic oligonucleotide
  Target: ATXN1; (-) strand; PAM type: YTN; PAM sequence: TTG
agaatcacgagcaagcatag

SEQ ID NO: 170565 - DNA, 20 bp, Artificial Sequence
  Description of Artificial Sequence: Synthetic oligonucleotide
  Target: ATXN1; (-) strand; PAM type: YTN; PAM sequence: TTT
gagaatcacgagcaagcata

SEQ ID NO: 170566 - DNA, 20 bp, Artificial Sequence
  Description of Artificial Sequence: Synthetic oligonucleotide
  Target: ATXN1; (-) strand; PAM type: YTN; PAM sequence: TTG
tttgagaatcacgagcaagc

SEQ ID NO: 170567 - DNA, 20 bp, Artificial Sequence
  Description of Artificial Sequence: Synthetic oligonucleotide
  Target: ATXN1; (-) strand; PAM type: YTN; PAM sequence: CTT
gtttgagaatcacgagcaag

SEQ ID NO: 170568 - DNA, 20 bp, Artificial Sequence
  Description of Artificial Sequence: Synthetic oligonucleotide
  Target: ATXN1; (-) strand; PAM type: YTN; PAM sequence: CTG
ccttgtttgagaatcacgag

SEQ ID NO: 170569 - DNA, 20 bp, Artificial Sequence
  Description of Artificial Sequence: Synthetic oligonucleotide
  Target: ATXN1; (-) strand; PAM type: YTN; PAM sequence: CTG
ggagggtaacccctgccttg

SEQ ID NO: 170570 - DNA, 20 bp, Artificial Sequence
  Description of Artificial Sequence: Synthetic oligonucleotide
  Target: ATXN1; (-) strand; PAM type: YTN; PAM sequence: TTC
agatgtccctgggagggtaa

SEQ ID NO: 170571 - DNA, 20 bp, Artificial Sequence
  Description of Artificial Sequence: Synthetic oligonucleotide
  Target: ATXN1; (-) strand; PAM type: YTN; PAM sequence: TTT
cagatgtccctgggagggta

SEQ ID NO: 170572 - DNA, 20 bp, Artificial Sequence
  Description of Artificial Sequence: Synthetic oligonucleotide
  Target: ATXN1; (-) strand; PAM type: YTN; PAM sequence: TTT
tcagatgtccctgggagggt

SEQ ID NO: 170573 - DNA, 20 bp, Artificial Sequence
  Description of Artificial Sequence: Synthetic oligonucleotide
  Target: ATXN1; (-) strand; PAM type: YTN; PAM sequence: CTT
ttcagatgtccctgggaggg

SEQ ID NO: 170574 - DNA, 20 bp, Artificial Sequence
  Description of Artificial Sequence: Synthetic oligonucleotide
  Target: ATXN1; (-) strand; PAM type: YTN; PAM sequence: CTC
cttttcagatgtccctggga

SEQ ID NO: 170575 - DNA, 20 bp, Artificial Sequence
  Description of Artificial Sequence: Synthetic oligonucleotide
  Target: ATXN1; (-) strand; PAM type: YTN; PAM sequence: TTC
agaatggccccactcctttt

SEQ ID NO: 170576 - DNA, 20 bp, Artificial Sequence
  Description of Artificial Sequence: Synthetic oligonucleotide
  Target: ATXN1; (-) strand; PAM type: YTN; PAM sequence: TTA
aggattcagaatggccccac

SEQ ID NO: 170577 - DNA, 20 bp, Artificial Sequence
  Description of Artificial Sequence: Synthetic oligonucleotide
  Target: ATXN1; (-) strand; PAM type: YTN; PAM sequence: TTT
aaggattcagaatggcccca

SEQ ID NO: 170578 - DNA, 20 bp, Artificial Sequence
  Description of Artificial Sequence: Synthetic oligonucleotide
  Target: ATXN1; (-) strand; PAM type: YTN; PAM sequence: TTT
taaggattcagaatggcccc

SEQ ID NO: 170579 - DNA, 20 bp, Artificial Sequence
  Description of Artificial Sequence: Synthetic oligonucleotide
  Target: ATXN1; (-) strand; PAM type: YTN; PAM sequence: TTG
ttttaaggattcagaatggc

SEQ ID NO: 170580 - DNA, 20 bp, Artificial Sequence
  Description of Artificial Sequence: Synthetic oligonucleotide
  Target: ATXN1; (-) strand; PAM type: YTN; PAM sequence: TTC
caagttgttttaaggattca

SEQ ID NO: 170581 - DNA, 20 bp, Artificial Sequence
  Description of Artificial Sequence: Synthetic oligonucleotide
  Target: ATXN1; (-) strand; PAM type: YTN; PAM sequence: TTT
ccaagttgttttaaggattc

SEQ ID NO: 170582 - DNA, 20 bp, Artificial Sequence
  Description of Artificial Sequence: Synthetic oligonucleotide
  Target: ATXN1; (-) strand; PAM type: YTN; PAM sequence: CTC
atcccaacaatgtttccaag

SEQ ID NO: 170583 - DNA, 20 bp, Artificial Sequence
  Description of Artificial Sequence: Synthetic oligonucleotide
  Target: ATXN1; (-) strand; PAM type: YTN; PAM sequence: CTA
ctcatcccaacaatgtttcc

SEQ ID NO: 170584 - DNA, 20 bp, Artificial Sequence
  Description of Artificial Sequence: Synthetic oligonucleotide
  Target: ATXN1; (-) strand; PAM type: YTN; PAM sequence: CTA
cctactcatcccaacaatgt

SEQ ID NO: 170585 - DNA, 20 bp, Artificial Sequence
  Description of Artificial Sequence: Synthetic oligonucleotide
  Target: ATXN1; (-) strand; PAM type: YTN; PAM sequence: TTC
atccctacctactcatccca

SEQ ID NO: 170586 - DNA, 20 bp, Artificial Sequence
  Description of Artificial Sequence: Synthetic oligonucleotide
  Target: ATXN1; (-) strand; PAM type: YTN; PAM sequence: CTC
ccggttcatccctacctact

SEQ ID NO: 170587 - DNA, 20 bp, Artificial Sequence
  Description of Artificial Sequence: Synthetic oligonucleotide
  Target: ATXN1; (-) strand; PAM type: YTN; PAM sequence: CTC
atgacaacacaacaagcact

SEQ ID NO: 170588 - DNA, 20 bp, Artificial Sequence
  Description of Artificial Sequence: Synthetic oligonucleotide
  Target: ATXN1; (-) strand; PAM type: YTN; PAM sequence: CTC
ccgctcatgacaacacaaca

SEQ ID NO: 170589 - DNA, 20 bp, Artificial Sequence
  Description of Artificial Sequence: Synthetic oligonucleotide
  Target: ATXN1; (-) strand; PAM type: YTN; PAM sequence: CTC
tcccgctcatgacaacacaa

SEQ ID NO: 170590 - DNA, 20 bp, Artificial Sequence
  Description of Artificial Sequence: Synthetic oligonucleotide
  Target: ATXN1; (-) strand; PAM type: YTN; PAM sequence: CTA
tgcagagctctcccgctcat

SEQ ID NO: 170591 - DNA, 20 bp, Artificial Sequence
  Description of Artificial Sequence: Synthetic oligonucleotide
  Target: ATXN1; (-) strand; PAM type: YTN; PAM sequence: CTG
ctatgcagagctctcccgct

SEQ ID NO: 170592 - DNA, 20 bp, Artificial Sequence
  Description of Artificial Sequence: Synthetic oligonucleotide
  Target: ATXN1; (-) strand; PAM type: YTN; PAM sequence: CTC
tgctatgcagagctctcccg

SEQ ID NO: 170593 - DNA, 20 bp, Artificial Sequence
  Description of Artificial Sequence: Synthetic oligonucleotide
  Target: ATXN1; (-) strand; PAM type: YTN; PAM sequence: TTC
ataacgaagcaggcaggacg

SEQ ID NO: 170594 - DNA, 20 bp, Artificial Sequence
  Description of Artificial Sequence: Synthetic oligonucleotide
  Target: ATXN1; (-) strand; PAM type: YTN; PAM sequence: TTT
cataacgaagcaggcaggac

SEQ ID NO: 170595 - DNA, 20 bp, Artificial Sequence
  Description of Artificial Sequence: Synthetic oligonucleotide
  Target: ATXN1; (-) strand; PAM type: YTN; PAM sequence: TTG
cagtgtttcataacgaagca

SEQ ID NO: 170596 - DNA, 20 bp, Artificial Sequence
  Description of Artificial Sequence: Synthetic oligonucleotide
  Target: ATXN1; (-) strand; PAM type: YTN; PAM sequence: TTA
aagttgcagtgtttcataac

SEQ ID NO: 170597 - DNA, 20 bp, Artificial Sequence
  Description of Artificial Sequence: Synthetic oligonucleotide
  Target: ATXN1; (-) strand; PAM type: YTN; PAM sequence: TTC
gttaaagttgcagtgtttca

SEQ ID NO: 170598 - DNA, 20 bp, Artificial Sequence
  Description of Artificial Sequence: Synthetic oligonucleotide
  Target: ATXN1; (-) strand; PAM type: YTN; PAM sequence: TTT
cgttaaagttgcagtgtttc

SEQ ID NO: 170599 - DNA, 20 bp, Artificial Sequence
  Description of Artificial Sequence: Synthetic oligonucleotide
  Target: ATXN1; (-) strand; PAM type: YTN; PAM sequence: CTA
gagagtgtttcgttaaagtt

SEQ ID NO: 170600 - DNA, 20 bp, Artificial Sequence
  Description of Artificial Sequence: Synthetic oligonucleotide
  Target: ATXN1; (-) strand; PAM type: YTN; PAM sequence: TTC
tagagagtgtttcgttaaag

SEQ ID NO: 170601 - DNA, 20 bp, Artificial Sequence
  Description of Artificial Sequence: Synthetic oligonucleotide
  Target: ATXN1; (-) strand; PAM type: YTN; PAM sequence: CTG
ttctagagagtgtttcgtta

SEQ ID NO: 170602 - DNA, 20 bp, Artificial Sequence
  Description of Artificial Sequence: Synthetic oligonucleotide
  Target: ATXN1; (-) strand; PAM type: YTN; PAM sequence: CTA
tctgttctagagagtgtttc

SEQ ID NO: 170603 - DNA, 20 bp, Artificial Sequence
  Description of Artificial Sequence: Synthetic oligonucleotide
  Target: ATXN1; (-) strand; PAM type: YTN; PAM sequence: CTA
agacaatgctatctgttcta

SEQ ID NO: 170604 - DNA, 20 bp, Artificial Sequence
  Description of Artificial Sequence: Synthetic oligonucleotide
  Target: ATXN1; (-) strand; PAM type: YTN; PAM sequence: TTA
aatacagaagaaccctaaga

SEQ ID NO: 170605 - DNA, 20 bp, Artificial Sequence
  Description of Artificial Sequence: Synthetic oligonucleotide
  Target: ATXN1; (-) strand; PAM type: YTN; PAM sequence: TTA
tgtggaaggaagaattaaat

SEQ ID NO: 170606 - DNA, 20 bp, Artificial Sequence
  Description of Artificial Sequence: Synthetic oligonucleotide
  Target: ATXN1; (-) strand; PAM type: YTN; PAM sequence: TTT
atgtggaaggaagaattaaa

SEQ ID NO: 170607 - DNA, 20 bp, Artificial Sequence
  Description of Artificial Sequence: Synthetic oligonucleotide
  Target: ATXN1; (-) strand; PAM type: YTN; PAM sequence: TTT
tatgtggaaggaagaattaa

SEQ ID NO: 170608 - DNA, 20 bp, Artificial Sequence
  Description of Artificial Sequence: Synthetic oligonucleotide
  Target: ATXN1; (-) strand; PAM type: YTN; PAM sequence: TTC
gatattttatgtggaaggaa

SEQ ID NO: 170609 - DNA, 20 bp, Artificial Sequence
  Description of Artificial Sequence: Synthetic oligonucleotide
  Target: ATXN1; (-) strand; PAM type: YTN; PAM sequence: CTG
attcgatattttatgtggaa

SEQ ID NO: 170610 - DNA, 20 bp, Artificial Sequence
  Description of Artificial Sequence: Synthetic oligonucleotide
  Target: ATXN1; (-) strand; PAM type: YTN; PAM sequence: CTG
atagcctgattcgatatttt

SEQ ID NO: 170611 - DNA, 20 bp, Artificial Sequence
  Description of Artificial Sequence: Synthetic oligonucleotide
  Target: ATXN1; (-) strand; PAM type: YTN; PAM sequence: TTG
acaggagatatctgatagcc

SEQ ID NO: 170612 - DNA, 20 bp, Artificial Sequence
  Description of Artificial Sequence: Synthetic oligonucleotide
  Target: ATXN1; (-) strand; PAM type: YTN; PAM sequence: TTT
gacaggagatatctgatagc

SEQ ID NO: 170613 - DNA, 20 bp, Artificial Sequence
  Description of Artificial Sequence: Synthetic oligonucleotide
  Target: ATXN1; (-) strand; PAM type: YTN; PAM sequence: TTT
tgacaggagatatctgatag

SEQ ID NO: 170614 - DNA, 20 bp, Artificial Sequence
  Description of Artificial Sequence: Synthetic oligonucleotide
  Target: ATXN1; (-) strand; PAM type: YTN; PAM sequence: TTT
ttgacaggagatatctgata

SEQ ID NO: 170615 - DNA, 20 bp, Artificial Sequence
  Description of Artificial Sequence: Synthetic oligonucleotide
  Target: ATXN1; (-) strand; PAM type: YTN; PAM sequence: TTA
tatttttgacaggagatatc

SEQ ID NO: 170616 - DNA, 20 bp, Artificial Sequence
  Description of Artificial Sequence: Synthetic oligonucleotide
  Target: ATXN1; (-) strand; PAM type: YTN; PAM sequence: CTC
aggtattatatttttgacag

SEQ ID NO: 170617 - DNA, 20 bp, Artificial Sequence
  Description of Artificial Sequence: Synthetic oligonucleotide
  Target: ATXN1; (-) strand; PAM type: YTN; PAM sequence: TTG
cagatatcctcaggtattat

SEQ ID NO: 170618 - DNA, 20 bp, Artificial Sequence
  Description of Artificial Sequence: Synthetic oligonucleotide
  Target: ATXN1; (-) strand; PAM type: YTN; PAM sequence: TTA
ttgcagatatcctcaggtat

SEQ ID NO: 170619 - DNA, 20 bp, Artificial Sequence
  Description of Artificial Sequence: Synthetic oligonucleotide
  Target: ATXN1; (-) strand; PAM type: YTN; PAM sequence: TTA
aaattattgcagatatcctc

SEQ ID NO: 170620 - DNA, 20 bp, Artificial Sequence
  Description of Artificial Sequence: Synthetic oligonucleotide
  Target: ATXN1; (-) strand; PAM type: YTN; PAM sequence: CTA
ttaaaattattgcagatatc

SEQ ID NO: 170621 - DNA, 20 bp, Artificial Sequence
  Description of Artificial Sequence: Synthetic oligonucleotide
  Target: ATXN1; (-) strand; PAM type: YTN; PAM sequence: TTG
gtcaatggtaactattaaaa

SEQ ID NO: 170622 - DNA, 20 bp, Artificial Sequence
  Description of Artificial Sequence: Synthetic oligonucleotide
  Target: ATXN1; (-) strand; PAM type: YTN; PAM sequence: TTT
ggtcaatggtaactattaaa

SEQ ID NO: 170623 - DNA, 20 bp, Artificial Sequence
  Description of Artificial Sequence: Synthetic oligonucleotide
  Target: ATXN1; (-) strand; PAM type: YTN; PAM sequence: CTG
gcatgtagtggatgtttggt

SEQ ID NO: 170624 - DNA, 20 bp, Artificial Sequence
  Description of Artificial Sequence: Synthetic oligonucleotide
  Target: ATXN1; (-) strand; PAM type: YTN; PAM sequence: CTA
cctggcatgtagtggatgtt

SEQ ID NO: 170625 - DNA, 20 bp, Artificial Sequence
  Description of Artificial Sequence: Synthetic oligonucleotide
  Target: ATXN1; (-) strand; PAM type: YTN; PAM sequence: TTG
tacactacctggcatgtagt

SEQ ID NO: 170626 - DNA, 20 bp, Artificial Sequence
  Description of Artificial Sequence: Synthetic oligonucleotide
  Target: ATXN1; (-) strand; PAM type: YTN; PAM sequence: TTG
tgtattgtacactacctggc

SEQ ID NO: 170627 - DNA, 20 bp, Artificial Sequence
  Description of Artificial Sequence: Synthetic oligonucleotide
  Target: ATXN1; (-) strand; PAM type: YTN; PAM sequence: TTA
gttgtgtattgtacactacc

SEQ ID NO: 170628 - DNA, 20 bp, Artificial Sequence
  Description of Artificial Sequence: Synthetic oligonucleotide
  Target: ATXN1; (-) strand; PAM type: YTN; PAM sequence: TTT
agttgtgtattgtacactac

SEQ ID NO: 170629 - DNA, 20 bp, Artificial Sequence
  Description of Artificial Sequence: Synthetic oligonucleotide
  Target: ATXN1; (-) strand; PAM type: YTN; PAM sequence: TTA
agatttagttgtgtattgta

SEQ ID NO: 170630 - DNA, 20 bp, Artificial Sequence
  Description of Artificial Sequence: Synthetic oligonucleotide
  Target: ATXN1; (-) strand; PAM type: YTN; PAM sequence: TTG
ttaagatttagttgtgtatt

SEQ ID NO: 170631 - DNA, 20 bp, Artificial Sequence
  Description of Artificial Sequence: Synthetic oligonucleotide
  Target: ATXN1; (-) strand; PAM type: YTN; PAM sequence: TTG
ttgttaagatttagttgtgt

SEQ ID NO: 170632 - DNA, 20 bp, Artificial Sequence
  Description of Artificial Sequence: Synthetic oligonucleotide
  Target: ATXN1; (-) strand; PAM type: YTN; PAM sequence: TTG
ttgttgttaagatttagttg

SEQ ID NO: 170633 - DNA, 20 bp, Artificial Sequence
  Description of Artificial Sequence: Synthetic oligonucleotide
  Target: ATXN1; (-) strand; PAM type: YTN; PAM sequence: TTG
ttgttgttgttaagatttag

SEQ ID NO: 170634 - DNA, 20 bp, Artificial Sequence
  Description of Artificial Sequence: Synthetic oligonucleotide
  Target: ATXN1; (-) strand; PAM type: YTN; PAM sequence: TTC
attgttgttgttgttaagat

SEQ ID NO: 170635 - DNA, 20 bp, Artificial Sequence
  Description of Artificial Sequence: Synthetic oligonucleotide
  Target: ATXN1; (-) strand; PAM type: YTN; PAM sequence: CTA
aattcattgttgttgttgtt

SEQ ID NO: 170636 - DNA, 20 bp, Artificial Sequence
  Description of Artificial Sequence: Synthetic oligonucleotide
  Target: ATXN1; (-) strand; PAM type: YTN; PAM sequence: TTA
aaaagtatccactaaattca

SEQ ID NO: 170637 - DNA, 20 bp, Artificial Sequence
  Description of Artificial Sequence: Synthetic oligonucleotide
  Target: ATXN1; (-) strand; PAM type: YTN; PAM sequence: TTT
aaaaagtatccactaaattc

SEQ ID NO: 170638 - DNA, 20 bp, Artificial Sequence
  Description of Artificial Sequence: Synthetic oligonucleotide
  Target: ATXN1; (-) strand; PAM type: YTN; PAM sequence: TTT
taaaaagtatccactaaatt

SEQ ID NO: 170639 - DNA, 20 bp, Artificial Sequence
  Description of Artificial Sequence: Synthetic oligonucleotide
  Target: ATXN1; (-) strand; PAM type: YTN; PAM sequence: TTG
ggagttttaaaaagtatcca

SEQ ID NO: 170640 - DNA, 20 bp, Artificial Sequence
  Description of Artificial Sequence: Synthetic oligonucleotide
  Target: ATXN1; (-) strand; PAM type: YTN; PAM sequence: TTA
tgcaattgggagttttaaaa

SEQ ID NO: 170641 - DNA, 20 bp, Artificial Sequence
  Description of Artificial Sequence: Synthetic oligonucleotide
  Target: ATXN1; (-) strand; PAM type: YTN; PAM sequence: TTT
atgcaattgggagttttaaa

SEQ ID NO: 170642 - DNA, 20 bp, Artificial Sequence
  Description of Artificial Sequence: Synthetic oligonucleotide
  Target: ATXN1; (-) strand; PAM type: YTN; PAM sequence: CTG
aatttatgcaattgggagtt

SEQ ID NO: 170643 - DNA, 20 bp, Artificial Sequence
  Description of Artificial Sequence: Synthetic oligonucleotide
  Target: ATXN1; (-) strand; PAM type: YTN; PAM sequence: CTG
gctgaatttatgcaattggg

SEQ ID NO: 170644 - DNA, 20 bp, Artificial Sequence
  Description of Artificial Sequence: Synthetic oligonucleotide
  Target: ATXN1; (-) strand; PAM type: YTN; PAM sequence: CTC
tggctgaatttatgcaattg

SEQ ID NO: 170645 - DNA, 20 bp, Artificial Sequence
  Description of Artificial Sequence: Synthetic oligonucleotide
  Target: ATXN1; (-) strand; PAM type: YTN; PAM sequence: CTC
tctggctgaatttatgcaat

SEQ ID NO: 170646 - DNA, 20 bp, Artificial Sequence
  Description of Artificial Sequence: Synthetic oligonucleotide
  Target: ATXN1; (-) strand; PAM type: YTN; PAM sequence: TTC
ctctctggctgaatttatgc

SEQ ID NO: 170647 - DNA, 20 bp, Artificial Sequence
  Description of Artificial Sequence: Synthetic oligonucleotide
  Target: ATXN1; (-) strand; PAM type: YTN; PAM sequence: TTT
cctctctggctgaatttatg

SEQ ID NO: 170648 - DNA, 20 bp, Artificial Sequence
  Description of Artificial Sequence: Synthetic oligonucleotide
  Target: ATXN1; (-) strand; PAM type: YTN; PAM sequence: TTT
tcctctctggctgaatttat

SEQ ID NO: 170649 - DNA, 20 bp, Artificial Sequence
  Description of Artificial Sequence: Synthetic oligonucleotide
  Target: ATXN1; (-) strand; PAM type: YTN; PAM sequence: TTT
ttcctctctggctgaattta

SEQ ID NO: 170650 - DNA, 20 bp, Artificial Sequence
  Description of Artificial Sequence: Synthetic oligonucleotide
  Target: ATXN1; (-) strand; PAM type: YTN; PAM sequence: TTT
tttcctctctggctgaattt

SEQ ID NO: 170651 - DNA, 20 bp, Artificial Sequence
  Description of Artificial Sequence: Synthetic oligonucleotide
  Target: ATXN1; (-) strand; PAM type: YTN; PAM sequence: CTT
ttttcctctctggctgaatt

SEQ ID NO: 170652 - DNA, 20 bp, Artificial Sequence
  Description of Artificial Sequence: Synthetic oligonucleotide
  Target: ATXN1; (-) strand; PAM type: YTN; PAM sequence: TTG
cttttttcctctctggctga

SEQ ID NO: 170653 - DNA, 20 bp, Artificial Sequence
  Description of Artificial Sequence: Synthetic oligonucleotide
  Target: ATXN1; (-) strand; PAM type: YTN; PAM sequence: TTA
gttgcttttttcctctctgg

SEQ ID NO: 170654 - DNA, 20 bp, Artificial Sequence
  Description of Artificial Sequence: Synthetic oligonucleotide
  Target: ATXN1; (-) strand; PAM type: YTN; PAM sequence: TTA
gattagttgcttttttcctc

SEQ ID NO: 170655 - DNA, 20 bp, Artificial Sequence
  Description of Artificial Sequence: Synthetic oligonucleotide
  Target: ATXN1; (-) strand; PAM type: YTN; PAM sequence: CTT
agattagttgcttttttcct

SEQ ID NO: 170656 - DNA, 20 bp, Artificial Sequence
  Description of Artificial Sequence: Synthetic oligonucleotide
  Target: ATXN1; (-) strand; PAM type: YTN; PAM sequence: TTG
cttagattagttgctttttt

SEQ ID NO: 170657 - DNA, 20 bp, Artificial Sequence
  Description of Artificial Sequence: Synthetic oligonucleotide
  Target: ATXN1; (-) strand; PAM type: YTN; PAM sequence: CTG
gtaagttgcttagattagtt

SEQ ID NO: 170658 - DNA, 20 bp, Artificial Sequence
  Description of Artificial Sequence: Synthetic oligonucleotide
  Target: ATXN1; (-) strand; PAM type: YTN; PAM sequence: CTG
actggtaagttgcttagatt

SEQ ID NO: 170659 - DNA, 20 bp, Artificial Sequence
  Description of Artificial Sequence: Synthetic oligonucleotide
  Target: ATXN1; (-) strand; PAM type: YTN; PAM sequence: CTC
cactgactggtaagttgctt

SEQ ID NO: 170660 - DNA, 20 bp, Artificial Sequence
  Description of Artificial Sequence: Synthetic oligonucleotide
  Target: ATXN1; (-) strand; PAM type: YTN; PAM sequence: CTC
ctccactgactggtaagttg

SEQ ID NO: 170661 - DNA, 20 bp, Artificial Sequence
  Description of Artificial Sequence: Synthetic oligonucleotide
  Target: ATXN1; (-) strand; PAM type: YTN; PAM sequence: TTG
gctcctccactgactggtaa

SEQ ID NO: 170662 - DNA, 20 bp, Artificial Sequence
  Description of Artificial Sequence: Synthetic oligonucleotide
  Target: ATXN1; (-) strand; PAM type: YTN; PAM sequence: CTT
ggctcctccactgactggta

SEQ ID NO: 170663 - DNA, 20 bp, Artificial Sequence
  Description of Artificial Sequence: Synthetic oligonucleotide
  Target: ATXN1; (-) strand; PAM type: YTN; PAM sequence: TTC
acatcttggctcctccactg

SEQ ID NO: 170664 - DNA, 20 bp, Artificial Sequence
  Description of Artificial Sequence: Synthetic oligonucleotide
  Target: ATXN1; (-) strand; PAM type: YTN; PAM sequence: CTG
gattcacatcttggctcctc

SEQ ID NO: 170665 - DNA, 20 bp, Artificial Sequence
  Description of Artificial Sequence: Synthetic oligonucleotide
  Target: ATXN1; (-) strand; PAM type: YTN; PAM sequence: TTG
gggtcggaggaacctggatt

SEQ ID NO: 170666 - DNA, 20 bp, Artificial Sequence
  Description of Artificial Sequence: Synthetic oligonucleotide
  Target: ATXN1; (-) strand; PAM type: YTN; PAM sequence: CTT
ggggtcggaggaacctggat

SEQ ID NO: 170667 - DNA, 20 bp, Artificial Sequence
  Description of Artificial Sequence: Synthetic oligonucleotide
  Target: ATXN1; (-) strand; PAM type: YTN; PAM sequence: CTA
tggacttggggtcggaggaa

SEQ ID NO: 170668 - DNA, 20 bp, Artificial Sequence
  Description of Artificial Sequence: Synthetic oligonucleotide
  Target: ATXN1; (-) strand; PAM type: YTN; PAM sequence: TTA
atgatcacatctatggactt

SEQ ID NO: 170669 - DNA, 20 bp, Artificial Sequence
  Description of Artificial Sequence: Synthetic oligonucleotide
  Target: ATXN1; (-) strand; PAM type: YTN; PAM sequence: TTT
aatgatcacatctatggact

SEQ ID NO: 170670 - DNA, 20 bp, Artificial Sequence
  Description of Artificial Sequence: Synthetic oligonucleotide
  Target: ATXN1; (-) strand; PAM type: YTN; PAM sequence: TTG
tcgtttaatgatcacatcta

SEQ ID NO: 170671 - DNA, 20 bp, Artificial Sequence
  Description of Artificial Sequence: Synthetic oligonucleotide
  Target: ATXN1; (-) strand; PAM type: YTN; PAM sequence: TTG
gccatcatgaaaaccaagat

SEQ ID NO: 170672 - DNA, 20 bp, Artificial Sequence
  Description of Artificial Sequence: Synthetic oligonucleotide
  Target: ATXN1; (-) strand; PAM type: YTN; PAM sequence: TTA
ttggccatcatgaaaaccaa

SEQ ID NO: 170673 - DNA, 20 bp, Artificial Sequence
  Description of Artificial Sequence: Synthetic oligonucleotide
  Target: ATXN1; (-) strand; PAM type: YTN; PAM sequence: TTG
ggttattggccatcatgaaa

SEQ ID NO: 170674 - DNA, 20 bp, Artificial Sequence
  Description of Artificial Sequence: Synthetic oligonucleotide
  Target: ATXN1; (-) strand; PAM type: YTN; PAM sequence: TTT
gggttattggccatcatgaa

SEQ ID NO: 170675 - DNA, 20 bp, Artificial Sequence
  Description of Artificial Sequence: Synthetic oligonucleotide
  Target: ATXN1; (-) strand; PAM type: YTN; PAM sequence: CTT
tgggttattggccatcatga

SEQ ID NO: 170676 - DNA, 20 bp, Artificial Sequence
  Description of Artificial Sequence: Synthetic oligonucleotide
  Target: ATXN1; (-) strand; PAM type: YTN; PAM sequence: CTG
tgcatagtaggctttgggtt

SEQ ID NO: 170677 - DNA, 20 bp, Artificial Sequence
  Description of Artificial Sequence: Synthetic oligonucleotide
  Target: ATXN1; (-) strand; PAM type: YTN; PAM sequence: CTC
ccctgtgcatagtaggcttt

SEQ ID NO: 170678 - DNA, 20 bp, Artificial Sequence
  Description of Artificial Sequence: Synthetic oligonucleotide
  Target: ATXN1; (-) strand; PAM type: YTN; PAM sequence: TTC
acactcccctgtgcatagta

SEQ ID NO: 170679 - DNA, 20 bp, Artificial Sequence
  Description of Artificial Sequence: Synthetic oligonucleotide
  Target: ATXN1; (-) strand; PAM type: YTN; PAM sequence: CTT
cacactcccctgtgcatagt

SEQ ID NO: 170680 - DNA, 20 bp, Artificial Sequence
  Description of Artificial Sequence: Synthetic oligonucleotide
  Target: ATXN1; (-) strand; PAM type: YTN; PAM sequence: CTC
gggatcttcacactcccctg

SEQ ID NO: 170681 - DNA, 20 bp, Artificial Sequence
  Description of Artificial Sequence: Synthetic oligonucleotide
  Target: ATXN1; (-) strand; PAM type: YTN; PAM sequence: TTC
tcgggatcttcacactcccc

SEQ ID NO: 170682 - DNA, 20 bp, Artificial Sequence
  Description of Artificial Sequence: Synthetic oligonucleotide
  Target: ATXN1; (-) strand; PAM type: YTN; PAM sequence: CTT
ctcgggatcttcacactccc

SEQ ID NO: 170683 - DNA, 20 bp, Artificial Sequence
  Description of Artificial Sequence: Synthetic oligonucleotide
  Target: ATXN1; (-) strand; PAM type: YTN; PAM sequence: CTG
ccccggcttctcgggatctt

SEQ ID NO: 170684 - DNA, 20 bp, Artificial Sequence
  Description of Artificial Sequence: Synthetic oligonucleotide
  Target: ATXN1; (-) strand; PAM type: YTN; PAM sequence: CTC
tgccccggcttctcgggatc

SEQ ID NO: 170685 - DNA, 20 bp, Artificial Sequence
  Description of Artificial Sequence: Synthetic oligonucleotide
  Target: ATXN1; (-) strand; PAM type: YTN; PAM sequence: CTG
tcagtggtcaaggctctgcc

SEQ ID NO: 170686 - DNA, 20 bp, Artificial Sequence
  Description of Artificial Sequence: Synthetic oligonucleotide
  Target: ATXN1; (-) strand; PAM type: YTN; PAM sequence: TTA
agagactgtcagtggtcaag

SEQ ID NO: 170687 - DNA, 20 bp, Artificial Sequence
  Description of Artificial Sequence: Synthetic oligonucleotide
  Target: ATXN1; (-) strand; PAM type: YTN; PAM sequence: TTG
gttaagagactgtcagtggt

SEQ ID NO: 170688 - DNA, 20 bp, Artificial Sequence
  Description of Artificial Sequence: Synthetic oligonucleotide
  Target: ATXN1; (-) strand; PAM type: YTN; PAM sequence: TTT
ggttaagagactgtcagtgg

SEQ ID NO: 170689 - DNA, 20 bp, Artificial Sequence
  Description of Artificial Sequence: Synthetic oligonucleotide
  Target: ATXN1; (-) strand; PAM type: YTN; PAM sequence: CTT
tggttaagagactgtcagtg

SEQ ID NO: 170690 - DNA, 20 bp, Artificial Sequence
  Description of Artificial Sequence: Synthetic oligonucleotide
  Target: ATXN1; (-) strand; PAM type: YTN; PAM sequence: TTC
tttggttaagagactgtcag

SEQ ID NO: 170691 - DNA, 20 bp, Artificial Sequence
  Description of Artificial Sequence: Synthetic oligonucleotide
  Target: ATXN1; (-) strand; PAM type: YTN; PAM sequence: CTG
cagattctttggttaagaga

SEQ ID NO: 170692 - DNA, 20 bp, Artificial Sequence
  Description of Artificial Sequence: Synthetic oligonucleotide
  Target: ATXN1; (-) strand; PAM type: YTN; PAM sequence: TTC
accgtgactgcagattcttt

SEQ ID NO: 170693 - DNA, 20 bp, Artificial Sequence
  Description of Artificial Sequence: Synthetic oligonucleotide
  Target: ATXN1; (-) strand; PAM type: YTN; PAM sequence: TTT
caccgtgactgcagattctt

SEQ ID NO: 170694 - DNA, 20 bp, Artificial Sequence
  Description of Artificial Sequence: Synthetic oligonucleotide
  Target: ATXN1; (-) strand; PAM type: YTN; PAM sequence: CTT
tcaccgtgactgcagattct

SEQ ID NO: 170695 - DNA, 20 bp, Artificial Sequence
  Description of Artificial Sequence: Synthetic oligonucleotide
  Target: ATXN1; (-) strand; PAM type: YTN; PAM sequence: CTG
cagcccctttcaccgtgact

SEQ ID NO: 170696 - DNA, 20 bp, Artificial Sequence
  Description of Artificial Sequence: Synthetic oligonucleotide
  Target: ATXN1; (-) strand; PAM type: YTN; PAM sequence: TTG
catgggacctgcagcccctt

SEQ ID NO: 170697 - DNA, 20 bp, Artificial Sequence
  Description of Artificial Sequence: Synthetic oligonucleotide
  Target: ATXN1; (-) strand; PAM type: YTN; PAM sequence: CTG
acagcattgcatgggacctg

SEQ ID NO: 170698 - DNA, 20 bp, Artificial Sequence
  Description of Artificial Sequence: Synthetic oligonucleotide
  Target: ATXN1; (-) strand; PAM type: YTN; PAM sequence: CTG
cagctgacagcattgcatgg

SEQ ID NO: 170699 - DNA, 20 bp, Artificial Sequence
  Description of Artificial Sequence: Synthetic oligonucleotide
  Target: ATXN1; (-) strand; PAM type: YTN; PAM sequence: TTC
ccaggcctgcagctgacagc

SEQ ID NO: 170700 - DNA, 20 bp, Artificial Sequence
  Description of Artificial Sequence: Synthetic oligonucleotide
  Target: ATXN1; (-) strand; PAM type: YTN; PAM sequence: CTT
cccaggcctgcagctgacag

SEQ ID NO: 170701 - DNA, 20 bp, Artificial Sequence
  Description of Artificial Sequence: Synthetic oligonucleotide
  Target: ATXN1; (-) strand; PAM type: YTN; PAM sequence: CTC
ttcccaggcctgcagctgac

SEQ ID NO: 170702 - DNA, 20 bp, Artificial Sequence
  Description of Artificial Sequence: Synthetic oligonucleotide
  Target: ATXN1; (-) strand; PAM type: YTN; PAM sequence: CTG
atggaactcttcccaggcct

SEQ ID NO: 170703 - DNA, 20 bp, Artificial Sequence
  Description of Artificial Sequence: Synthetic oligonucleotide
  Target: ATXN1; (-) strand; PAM type: YTN; PAM sequence: CTG
ctgatggaactcttcccagg

SEQ ID NO: 170704 - DNA, 20 bp, Artificial Sequence
  Description of Artificial Sequence: Synthetic oligonucleotide
  Target: ATXN1; (-) strand; PAM type: YTN; PAM sequence: TTA
ctgctgatggaactcttccc

SEQ ID NO: 170705 - DNA, 20 bp, Artificial Sequence
  Description of Artificial Sequence: Synthetic oligonucleotide
  Target: ATXN1; (-) strand; PAM type: YTN; PAM sequence: TTC
atcattactgctgatggaac

SEQ ID NO: 170706 - DNA, 20 bp, Artificial Sequence
  Description of Artificial Sequence: Synthetic oligonucleotide
  Target: ATXN1; (-) strand; PAM type: YTN; PAM sequence: CTG
ttcatcattactgctgatgg

SEQ ID NO: 170707 - DNA, 20 bp, Artificial Sequence
  Description of Artificial Sequence: Synthetic oligonucleotide
  Target: ATXN1; (-) strand; PAM type: YTN; PAM sequence: CTG
tcaagaaggcagtgagatag

SEQ ID NO: 170708 - DNA, 20 bp, Artificial Sequence
  Description of Artificial Sequence: Synthetic oligonucleotide
  Target: ATXN1; (-) strand; PAM type: YTN; PAM sequence: TTG
gtagcagagatcctgtcaag

SEQ ID NO: 170709 - DNA, 20 bp, Artificial Sequence
  Description of Artificial Sequence: Synthetic oligonucleotide
  Target: ATXN1; (-) strand; PAM type: YTN; PAM sequence: TTT
ggtagcagagatcctgtcaa

SEQ ID NO: 170710 - DNA, 20 bp, Artificial Sequence
  Description of Artificial Sequence: Synthetic oligonucleotide
  Target: ATXN1; (-) strand; PAM type: YTN; PAM sequence: TTT
tggtagcagagatcctgtca

SEQ ID NO: 170711 - DNA, 20 bp, Artificial Sequence
  Description of Artificial Sequence: Synthetic oligonucleotide
  Target: ATXN1; (-) strand; PAM type: YTN; PAM sequence: CTG
tattttggtagcagagatcc

SEQ ID NO: 170712 - DNA, 20 bp, Artificial Sequence
  Description of Artificial Sequence: Synthetic oligonucleotide
  Target: ATXN1; (-) strand; PAM type: YTN; PAM sequence: TTC
tgtattttggtagcagagat

SEQ ID NO: 170713 - DNA, 20 bp, Artificial Sequence
  Description of Artificial Sequence: Synthetic oligonucleotide
  Target: ATXN1; (-) strand; PAM type: YTN; PAM sequence: CTC
aggaaagttctgtattttgg

SEQ ID NO: 170714 - DNA, 20 bp, Artificial Sequence
  Description of Artificial Sequence: Synthetic oligonucleotide
  Target: ATXN1; (-) strand; PAM type: YTN; PAM sequence: CTC
tcaggaaagttctgtatttt

SEQ ID NO: 170715 - DNA, 20 bp, Artificial Sequence
  Description of Artificial Sequence: Synthetic oligonucleotide
  Target: ATXN1; (-) strand; PAM type: YTN; PAM sequence: TTA
tgtgaagaatcactctcagg

SEQ ID NO: 170716 - DNA, 20 bp, Artificial Sequence
  Description of Artificial Sequence: Synthetic oligonucleotide
  Target: ATXN1; (-) strand; PAM type: YTN; PAM sequence: TTT
atgtgaagaatcactctcag

SEQ ID NO: 170717 - DNA, 20 bp, Artificial Sequence
  Description of Artificial Sequence: Synthetic oligonucleotide
  Target: ATXN1; (-) strand; PAM type: YTN; PAM sequence: TTT
tatgtgaagaatcactctca

SEQ ID NO: 170718 - DNA, 20 bp, Artificial Sequence
  Description of Artificial Sequence: Synthetic oligonucleotide
  Target: ATXN1; (-) strand; PAM type: YTN; PAM sequence: TTT
ttatgtgaagaatcactctc

SEQ ID NO: 170719 - DNA, 20 bp, Artificial Sequence
  Description of Artificial Sequence: Synthetic oligonucleotide
  Target: ATXN1; (-) strand; PAM type: YTN; PAM sequence: TTC
atgtgtttttatgtgaagaa

SEQ ID NO: 170720 - DNA, 20 bp, Artificial Sequence
  Description of Artificial Sequence: Synthetic oligonucleotide
  Target: ATXN1; (-) strand; PAM type: YTN; PAM sequence: TTT
catgtgtttttatgtgaaga

SEQ ID NO: 170721 - DNA, 20 bp, Artificial Sequence
  Description of Artificial Sequence: Synthetic oligonucleotide
  Target: ATXN1; (-) strand; PAM type: YTN; PAM sequence: TTG
aggaatttcatgtgttttta

SEQ ID NO: 170722 - DNA, 20 bp, Artificial Sequence
  Description of Artificial Sequence: Synthetic oligonucleotide
  Target: ATXN1; (-) strand; PAM type: YTN; PAM sequence: TTT
gaggaatttcatgtgttttt

SEQ ID NO: 170723 - DNA, 20 bp, Artificial Sequence
  Description of Artificial Sequence: Synthetic oligonucleotide
  Target: ATXN1; (-) strand; PAM type: YTN; PAM sequence: TTT
tgaggaatttcatgtgtttt

SEQ ID NO: 170724 - DNA, 20 bp, Artificial Sequence
  Description of Artificial Sequence: Synthetic oligonucleotide
  Target: ATXN1; (-) strand; PAM type: YTN; PAM sequence: TTT
ttgaggaatttcatgtgttt

SEQ ID NO: 170725 - DNA, 20 bp, Artificial Sequence
  Description of Artificial Sequence: Synthetic oligonucleotide
  Target: ATXN1; (-) strand; PAM type: YTN; PAM sequence: TTT
tttgaggaatttcatgtgtt

SEQ ID NO: 170726 - DNA, 20 bp, Artificial Sequence
  Description of Artificial Sequence: Synthetic oligonucleotide
  Target: ATXN1; (-) strand; PAM type: YTN; PAM sequence: TTT
ttttgaggaatttcatgtgt

SEQ ID NO: 170727 - DNA, 20 bp, Artificial Sequence
  Description of Artificial Sequence: Synthetic oligonucleotide
  Target: ATXN1; (-) strand; PAM type: YTN; PAM sequence: CTC
agtttttttgaggaatttca

SEQ ID NO: 170728 - DNA, 20 bp, Artificial Sequence
  Description of Artificial Sequence: Synthetic oligonucleotide
  Target: ATXN1; (-) strand; PAM type: YTN; PAM sequence: TTG
atcctcagtttttttgagga

SEQ ID NO: 170729 - DNA, 20 bp, Artificial Sequence
  Description of Artificial Sequence: Synthetic oligonucleotide
  Target: ATXN1; (-) strand; PAM type: YTN; PAM sequence: CTT
gatcctcagtttttttgagg

SEQ ID NO: 170730 - DNA, 20 bp, Artificial Sequence
  Description of Artificial Sequence: Synthetic oligonucleotide
  Target: ATXN1; (-) strand; PAM type: YTN; PAM sequence: CTC
agagaaaccaccacttgatc

SEQ ID NO: 170731 - DNA, 20 bp, Artificial Sequence
  Description of Artificial Sequence: Synthetic oligonucleotide
  Target: ATXN1; (-) strand; PAM type: YTN; PAM sequence: CTA
ctcagagaaaccaccacttg

SEQ ID NO: 170732 - DNA, 20 bp, Artificial Sequence
  Description of Artificial Sequence: Synthetic oligonucleotide
  Target: ATXN1; (-) strand; PAM type: YTN; PAM sequence: CTA
gtgctactcagagaaaccac

SEQ ID NO: 170733 - DNA, 20 bp, Artificial Sequence
  Description of Artificial Sequence: Synthetic oligonucleotide
  Target: ATXN1; (-) strand; PAM type: YTN; PAM sequence: CTG
atggaagcagacaatctagt

SEQ ID NO: 170734 - DNA, 20 bp, Artificial Sequence
  Description of Artificial Sequence: Synthetic oligonucleotide
  Target: ATXN1; (-) strand; PAM type: YTN; PAM sequence: TTA
ggagagtccatatgtctgat

SEQ ID NO: 170735 - DNA, 20 bp, Artificial Sequence
  Description of Artificial Sequence: Synthetic oligonucleotide
  Target: ATXN1; (-) strand; PAM type: YTN; PAM sequence: CTT
aggagagtccatatgtctga

SEQ ID NO: 170736 - DNA, 20 bp, Artificial Sequence
  Description of Artificial Sequence: Synthetic oligonucleotide
  Target: ATXN1; (-) strand; PAM type: YTN; PAM sequence: TTC
ccgggtcttaggagagtcca

SEQ ID NO: 170737 - DNA, 20 bp, Artificial Sequence
  Description of Artificial Sequence: Synthetic oligonucleotide
  Target: ATXN1; (-) strand; PAM type: YTN; PAM sequence: CTT
cccgggtcttaggagagtcc

SEQ ID NO: 170738 - DNA, 20 bp, Artificial Sequence
  Description of Artificial Sequence: Synthetic oligonucleotide
  Target: ATXN1; (-) strand; PAM type: YTN; PAM sequence: CTG
tggtcttcccgggtcttagg

SEQ ID NO: 170739 - DNA, 20 bp, Artificial Sequence
  Description of Artificial Sequence: Synthetic oligonucleotide
  Target: ATXN1; (-) strand; PAM type: YTN; PAM sequence: CTG
cctgtggtcttcccgggtct

SEQ ID NO: 170740 - DNA, 20 bp, Artificial Sequence
  Description of Artificial Sequence: Synthetic oligonucleotide
  Target: ATXN1; (-) strand; PAM type: YTN; PAM sequence: TTC
aaaagcatacctgcctgtgg

SEQ ID NO: 170741 - DNA, 20 bp, Artificial Sequence
  Description of Artificial Sequence: Synthetic oligonucleotide
  Target: ATXN1; (-) strand; PAM type: YTN; PAM sequence: TTT
caaaagcatacctgcctgtg

SEQ ID NO: 170742 - DNA, 20 bp, Artificial Sequence
  Description of Artificial Sequence: Synthetic oligonucleotide
  Target: ATXN1; (-) strand; PAM type: YTN; PAM sequence: TTA
tttcaaaagcatacctgcct

SEQ ID NO: 170743 - DNA, 20 bp, Artificial Sequence
  Description of Artificial Sequence: Synthetic oligonucleotide
  Target: ATXN1; (-) strand; PAM type: YTN; PAM sequence: CTT
atttcaaaagcatacctgcc

SEQ ID NO: 170744 - DNA, 20 bp, Artificial Sequence
  Description of Artificial Sequence: Synthetic oligonucleotide
  Target: ATXN1; (-) strand; PAM type: YTN; PAM sequence: CTG
catccttatttcaaaagcat

SEQ ID NO: 170745 - DNA, 20 bp, Artificial Sequence
  Description of Artificial Sequence: Synthetic oligonucleotide
  Target: ATXN1; (-) strand; PAM type: YTN; PAM sequence: CTC
ctgcatccttatttcaaaag

SEQ ID NO: 170746 - DNA, 20 bp, Artificial Sequence
  Description of Artificial Sequence: Synthetic oligonucleotide
  Target: ATXN1; (-) strand; PAM type: YTN; PAM sequence: TTC
tcctgcatccttatttcaaa

SEQ ID NO: 170747 - DNA, 20 bp, Artificial Sequence
  Description of Artificial Sequence: Synthetic oligonucleotide
  Target: ATXN1; (-) strand; PAM type: YTN; PAM sequence: TTT
ctcctgcatccttatttcaa

SEQ ID NO: 170748 - DNA, 20 bp, Artificial Sequence
  Description of Artificial Sequence: Synthetic oligonucleotide
  Target: ATXN1; (-) strand; PAM type: YTN; PAM sequence: TTG
acgtagcagaatttctcctg

SEQ ID NO: 170749 - DNA, 20 bp, Artificial Sequence
  Description of Artificial Sequence: Synthetic oligonucleotide
  Target: ATXN1; (-) strand; PAM type: YTN; PAM sequence: TTT
gacgtagcagaatttctcct

SEQ ID NO: 170750 - DNA, 20 bp, Artificial Sequence
  Description of Artificial Sequence: Synthetic oligonucleotide
  Target: ATXN1; (-) strand; PAM type: YTN; PAM sequence: TTA
tttgacgtagcagaatttct

SEQ ID NO: 170751 - DNA, 20 bp, Artificial Sequence
  Description of Artificial Sequence: Synthetic oligonucleotide
  Target: ATXN1; (-) strand; PAM type: YTN; PAM sequence: TTT
atttgacgtagcagaatttc

SEQ ID NO: 170752 - DNA, 20 bp, Artificial Sequence
  Description of Artificial Sequence: Synthetic oligonucleotide
  Target: ATXN1; (-) strand; PAM type: YTN; PAM sequence: CTT
tatttgacgtagcagaattt

SEQ ID NO: 170753 - DNA, 20 bp, Artificial Sequence
  Description of Artificial Sequence: Synthetic oligonucleotide
  Target: ATXN1; (-) strand; PAM type: YTN; PAM sequence: CTA
atacactttatttgacgtag

SEQ ID NO: 170754 - DNA, 20 bp, Artificial Sequence
  Description of Artificial Sequence: Synthetic oligonucleotide
  Target: ATXN1; (-) strand; PAM type: YTN; PAM sequence: CTA
atctaatacactttatttga

SEQ ID NO: 170755 - DNA, 20 bp, Artificial Sequence
  Description of Artificial Sequence: Synthetic oligonucleotide
  Target: ATXN1; (-) strand; PAM type: YTN; PAM sequence: CTA
gacctaatctaatacacttt

SEQ ID NO: 170756 - DNA, 20 bp, Artificial Sequence
  Description of Artificial Sequence: Synthetic oligonucleotide
  Target: ATXN1; (-) strand; PAM type: YTN; PAM sequence: TTA
gaagataaatactagaccta

SEQ ID NO: 170757 - DNA, 20 bp, Artificial Sequence
  Description of Artificial Sequence: Synthetic oligonucleotide
  Target: ATXN1; (-) strand; PAM type: YTN; PAM sequence: TTT
agaagataaatactagacct

SEQ ID NO: 170758 - DNA, 20 bp, Artificial Sequence
  Description of Artificial Sequence: Synthetic oligonucleotide
  Target: ATXN1; (-) strand; PAM type: YTN; PAM sequence: CTT
tagaagataaatactagacc

SEQ ID NO: 170759 - DNA, 20 bp, Artificial Sequence
  Description of Artificial Sequence: Synthetic oligonucleotide
  Target: ATXN1; (-) strand; PAM type: YTN; PAM sequence: TTC
ctttagaagataaatactag

SEQ ID NO: 170760 - DNA, 20 bp, Artificial Sequence
  Description of Artificial Sequence: Synthetic oligonucleotide
  Target: ATXN1; (-) strand; PAM type: YTN; PAM sequence: CTT
cctttagaagataaatacta

SEQ ID NO: 170761 - DNA, 20 bp, Artificial Sequence
  Description of Artificial Sequence: Synthetic oligonucleotide
  Target: ATXN1; (-) strand; PAM type: YTN; PAM sequence: CTG
tgaggacagcagacttcctt

SEQ ID NO: 170762 - DNA, 20 bp, Artificial Sequence
  Description of Artificial Sequence: Synthetic oligonucleotide
  Target: ATXN1; (-) strand; PAM type: YTN; PAM sequence: TTC
ccaactgtgaggacagcaga

SEQ ID NO: 170763 - DNA, 20 bp, Artificial Sequence
  Description of Artificial Sequence: Synthetic oligonucleotide
  Target: ATXN1; (-) strand; PAM type: YTN; PAM sequence: CTG
atagaaatcacatgtgaagt

SEQ ID NO: 170764 - DNA, 20 bp, Artificial Sequence
  Description of Artificial Sequence: Synthetic oligonucleotide
  Target: ATXN1; (-) strand; PAM type: YTN; PAM sequence: CTG
atatggtccataaaatgctg

SEQ ID NO: 170765 - DNA, 20 bp, Artificial Sequence
  Description of Artificial Sequence: Synthetic oligonucleotide
  Target: ATXN1; (-) strand; PAM type: YTN; PAM sequence: TTC
tgatatggtccataaaatgc

SEQ ID NO: 170766 - DNA, 20 bp, Artificial Sequence
  Description of Artificial Sequence: Synthetic oligonucleotide
  Target: ATXN1; (-) strand; PAM type: YTN; PAM sequence: TTT
ctgatatggtccataaaatg

SEQ ID NO: 170767 - DNA, 20 bp, Artificial Sequence
  Description of Artificial Sequence: Synthetic oligonucleotide
  Target: ATXN1; (-) strand; PAM type: YTN; PAM sequence: CTT
tctgatatggtccataaaat

SEQ ID NO: 170768 - DNA, 20 bp, Artificial Sequence
  Description of Artificial Sequence: Synthetic oligonucleotide
  Target: ATXN1; (-) strand; PAM type: YTN; PAM sequence: TTG
aatcatgccagctttctgat

SEQ ID NO: 170769 - DNA, 20 bp, Artificial Sequence
  Description of Artificial Sequence: Synthetic oligonucleotide
  Target: ATXN1; (-) strand; PAM type: YTN; PAM sequence: TTA
ttgaatcatgccagctttct

SEQ ID NO: 170770 - DNA, 20 bp, Artificial Sequence
  Description of Artificial Sequence: Synthetic oligonucleotide
  Target: ATXN1; (-) strand; PAM type: YTN; PAM sequence: CTT
attgaatcatgccagctttc

SEQ ID NO: 170771 - DNA, 20 bp, Artificial Sequence
  Description of Artificial Sequence: Synthetic oligonucleotide
  Target: ATXN1; (-) strand; PAM type: YTN; PAM sequence: CTG
aatcttattgaatcatgcca

SEQ ID NO: 170772 - DNA, 20 bp, Artificial Sequence
  Description of Artificial Sequence: Synthetic oligonucleotide
  Target: ATXN1; (-) strand; PAM type: YTN; PAM sequence: TTC
tgaatcttattgaatcatgc

SEQ ID NO: 170773 - DNA, 20 bp, Artificial Sequence
  Description of Artificial Sequence: Synthetic oligonucleotide
  Target: ATXN1; (-) strand; PAM type: YTN; PAM sequence: TTT
ctgaatcttattgaatcatg

SEQ ID NO: 170774 - DNA, 20 bp, Artificial Sequence
  Description of Artificial Sequence: Synthetic oligonucleotide
  Target: ATXN1; (-) strand; PAM type: YTN; PAM sequence: TTT
tctgaatcttattgaatcat

SEQ ID NO: 170775 - DNA, 20 bp, Artificial Sequence
  Description of Artificial Sequence: Synthetic oligonucleotide
  Target: ATXN1; (-) strand; PAM type: YTN; PAM sequence: CTT
ttctgaatcttattgaatca

SEQ ID NO: 170776 - DNA, 20 bp, Artificial Sequence
  Description of Artificial Sequence: Synthetic oligonucleotide
  Target: ATXN1; (-) strand; PAM type: YTN; PAM sequence: CTC
atcttttctgaatcttattg

SEQ ID NO: 170777 - DNA, 20 bp, Artificial Sequence
  Description of Artificial Sequence: Synthetic oligonucleotide
  Target: ATXN1; (-) strand; PAM type: YTN; PAM sequence: CTG
gggtctcatcttttctgaat

SEQ ID NO: 170778 - DNA, 20 bp, Artificial Sequence
  Description of Artificial Sequence: Synthetic oligonucleotide
  Target: ATXN1; (-) strand; PAM type: YTN; PAM sequence: CTC
ctggggtctcatcttttctg

SEQ ID NO: 170779 - DNA, 20 bp, Artificial Sequence
  Description of Artificial Sequence: Synthetic oligonucleotide
  Target: ATXN1; (-) strand; PAM type: YTN; PAM sequence: CTC
atgacctcctggggtctcat

SEQ ID NO: 170780 - DNA, 20 bp, Artificial Sequence
  Description of Artificial Sequence: Synthetic oligonucleotide
  Target: ATXN1; (-) strand; PAM type: YTN; PAM sequence: TTA
gcactcatgacctcctgggg

SEQ ID NO: 170781 - DNA, 20 bp, Artificial Sequence
  Description of Artificial Sequence: Synthetic oligonucleotide
  Target: ATXN1; (-) strand; PAM type: YTN; PAM sequence: CTG
tggttagcactcatgacctc

SEQ ID NO: 170782 - DNA, 20 bp, Artificial Sequence
  Description of Artificial Sequence: Synthetic oligonucleotide
  Target: ATXN1; (-) strand; PAM type: YTN; PAM sequence: CTG
ggctgtggttagcactcatg

SEQ ID NO: 170783 - DNA, 20 bp, Artificial Sequence
  Description of Artificial Sequence: Synthetic oligonucleotide
  Target: ATXN1; (-) strand; PAM type: YTN; PAM sequence: CTA
gctgggctgtggttagcact

SEQ ID NO: 170784 - DNA, 20 bp, Artificial Sequence
  Description of Artificial Sequence: Synthetic oligonucleotide
  Target: ATXN1; (-) strand; PAM type: YTN; PAM sequence: TTC
cactagctgggctgtggtta

SEQ ID NO: 170785 - DNA, 20 bp, Artificial Sequence
  Description of Artificial Sequence: Synthetic oligonucleotide
  Target: ATXN1; (-) strand; PAM type: YTN; PAM sequence: CTA
aaggtcacatagcattccac

SEQ ID NO: 170786 - DNA, 20 bp, Artificial Sequence
  Description of Artificial Sequence: Synthetic oligonucleotide
  Target: ATXN1; (-) strand; PAM type: YTN; PAM sequence: TTA
aaacaagtcactaaaggtca

SEQ ID NO: 170787 - DNA, 20 bp, Artificial Sequence
  Description of Artificial Sequence: Synthetic oligonucleotide
  Target: ATXN1; (-) strand; PAM type: YTN; PAM sequence: TTC
agtaacccatgagcagaggc

SEQ ID NO: 170788 - DNA, 20 bp, Artificial Sequence
  Description of Artificial Sequence: Synthetic oligonucleotide
  Target: ATXN1; (-) strand; PAM type: YTN; PAM sequence: TTA
gaaaagttcagtaacccatg

SEQ ID NO: 170789 - DNA, 20 bp, Artificial Sequence
  Description of Artificial Sequence: Synthetic oligonucleotide
  Target: ATXN1; (-) strand; PAM type: YTN; PAM sequence: TTG
gattagaaaagttcagtaac

SEQ ID NO: 170790 - DNA, 20 bp, Artificial Sequence
  Description of Artificial Sequence: Synthetic oligonucleotide
  Target: ATXN1; (-) strand; PAM type: YTN; PAM sequence: CTT
ggattagaaaagttcagtaa

SEQ ID NO: 170791 - DNA, 20 bp, Artificial Sequence
  Description of Artificial Sequence: Synthetic oligonucleotide
  Target: ATXN1; (-) strand; PAM type: YTN; PAM sequence: CTG
taggatgcagagacccttgg

SEQ ID NO: 170792 - DNA, 20 bp, Artificial Sequence
  Description of Artificial Sequence: Synthetic oligonucleotide
  Target: ATXN1; (-) strand; PAM type: YTN; PAM sequence: TTA
cagactgtaggatgcagaga

SEQ ID NO: 170793 - DNA, 20 bp, Artificial Sequence
  Description of Artificial Sequence: Synthetic oligonucleotide
  Target: ATXN1; (-) strand; PAM type: YTN; PAM sequence: TTT
acagactgtaggatgcagag

SEQ ID NO: 170794 - DNA, 20 bp, Artificial Sequence
  Description of Artificial Sequence: Synthetic oligonucleotide
  Target: ATXN1; (-) strand; PAM type: YTN; PAM sequence: CTT
tacagactgtaggatgcaga

SEQ ID NO: 170795 - DNA, 20 bp, Artificial Sequence
  Description of Artificial Sequence: Synthetic oligonucleotide
  Target: ATXN1; (-) strand; PAM type: YTN; PAM sequence: TTA
gctttacagactgtaggatg

SEQ ID NO: 170796 - DNA, 20 bp, Artificial Sequence
  Description of Artificial Sequence: Synthetic oligonucleotide
  Target: ATXN1; (-) strand; PAM type: YTN; PAM sequence: CTA
tgaattagctttacagactg

SEQ ID NO: 170797 - DNA, 20 bp, Artificial Sequence
  Description of Artificial Sequence: Synthetic oligonucleotide
  Target: ATXN1; (-) strand; PAM type: YTN; PAM sequence: TTG
cagcaagcctatgaattagc

SEQ ID NO: 170798 - DNA, 20 bp, Artificial Sequence
  Description of Artificial Sequence: Synthetic oligonucleotide
  Target: ATXN1; (-) strand; PAM type: YTN; PAM sequence: TTT
gcagcaagcctatgaattag

SEQ ID NO: 170799 - DNA, 20 bp, Artificial Sequence
  Description of Artificial Sequence: Synthetic oligonucleotide
  Target: ATXN1; (-) strand; PAM type: YTN; PAM sequence: CTT
tgcagcaagcctatgaatta

SEQ ID NO: 170800 - DNA, 20 bp, Artificial Sequence
  Description of Artificial Sequence: Synthetic oligonucleotide
  Target: ATXN1; (-) strand; PAM type: YTN; PAM sequence: TTA
tctttgcagcaagcctatga

SEQ ID NO: 170801 - DNA, 20 bp, Artificial Sequence
  Description of Artificial Sequence: Synthetic oligonucleotide
  Target: ATXN1; (-) strand; PAM type: YTN; PAM sequence: TTT
atctttgcagcaagcctatg

SEQ ID NO: 170802 - DNA, 20 bp, Artificial Sequence
  Description of Artificial Sequence: Synthetic oligonucleotide
  Target: ATXN1; (-) strand; PAM type: YTN; PAM sequence: CTA
aagcagtatttatctttgca

SEQ ID NO: 170803 - DNA, 20 bp, Artificial Sequence
  Description of Artificial Sequence: Synthetic oligonucleotide
  Target: ATXN1; (-) strand; PAM type: YTN; PAM sequence: TTG
aatctaaagcagtatttatc

SEQ ID NO: 170804 - DNA, 20 bp, Artificial Sequence
  Description of Artificial Sequence: Synthetic oligonucleotide
  Target: ATXN1; (-) strand; PAM type: YTN; PAM sequence: CTT
gaatctaaagcagtatttat

SEQ ID NO: 170805 - DNA, 20 bp, Artificial Sequence
  Description of Artificial Sequence: Synthetic oligonucleotide
  Target: ATXN1; (-) strand; PAM type: YTN; PAM sequence: TTA
cttgaatctaaagcagtatt

SEQ ID NO: 170806 - DNA, 20 bp, Artificial Sequence
  Description of Artificial Sequence: Synthetic oligonucleotide
  Target: ATXN1; (-) strand; PAM type: YTN; PAM sequence: CTT
acttgaatctaaagcagtat

SEQ ID NO: 170807 - DNA, 20 bp, Artificial Sequence
  Description of Artificial Sequence: Synthetic oligonucleotide
  Target: ATXN1; (-) strand; PAM type: YTN; PAM sequence: TTA
cagtcatatccagagcttac

SEQ ID NO: 170808 - DNA, 20 bp, Artificial Sequence
  Description of Artificial Sequence: Synthetic oligonucleotide
  Target: ATXN1; (-) strand; PAM type: YTN; PAM sequence: CTT
acagtcatatccagagctta

SEQ ID NO: 170809 - DNA, 20 bp, Artificial Sequence
  Description of Artificial Sequence: Synthetic oligonucleotide
  Target: ATXN1; (-) strand; PAM type: YTN; PAM sequence: TTC
ttacagtcatatccagagct

SEQ ID NO: 170810 - DNA, 20 bp, Artificial Sequence
  Description of Artificial Sequence: Synthetic oligonucleotide
  Target: ATXN1; (-) strand; PAM type: YTN; PAM sequence: TTT
cttacagtcatatccagagc

SEQ ID NO: 170811 - DNA, 20 bp, Artificial Sequence
  Description of Artificial Sequence: Synthetic oligonucleotide
  Target: ATXN1; (-) strand; PAM type: YTN; PAM sequence: TTA
tatatttcttacagtcatat

SEQ ID NO: 170812 - DNA, 20 bp, Artificial Sequence
  Description of Artificial Sequence: Synthetic oligonucleotide
  Target: ATXN1; (-) strand; PAM type: YTN; PAM sequence: TTA
aataatgataattatatatt

SEQ ID NO: 170813 - DNA, 20 bp, Artificial Sequence
  Description of Artificial Sequence: Synthetic oligonucleotide
  Target: ATXN1; (-) strand; PAM type: YTN; PAM sequence: TTT
aaataatgataattatatat

SEQ ID NO: 170814 - DNA, 20 bp, Artificial Sequence
  Description of Artificial Sequence: Synthetic oligonucleotide
  Target: ATXN1; (-) strand; PAM type: YTN; PAM sequence: TTT
taaataatgataattatata

SEQ ID NO: 170815 - DNA, 20 bp, Artificial Sequence
  Description of Artificial Sequence: Synthetic oligonucleotide
  Target: ATXN1; (-) strand; PAM type: YTN; PAM sequence: TTT
ttaaataatgataattatat

SEQ ID NO: 170816 - DNA, 20 bp, Artificial Sequence
  Description of Artificial Sequence: Synthetic oligonucleotide
  Target: ATXN1; (-) strand; PAM type: YTN; PAM sequence: TTT
tttaaataatgataattata

SEQ ID NO: 170817 - DNA, 20 bp, Artificial Sequence
  Description of Artificial Sequence: Synthetic oligonucleotide
  Target: ATXN1; (-) strand; PAM type: YTN; PAM sequence: TTT
ttttaaataatgataattat

SEQ ID NO: 170818 - DNA, 20 bp, Artificial Sequence
  Description of Artificial Sequence: Synthetic oligonucleotide
  Target: ATXN1; (-) strand; PAM type: YTN; PAM sequence: TTT
tttttaaataatgataatta

SEQ ID NO: 170819 - DNA, 20 bp, Artificial Sequence
  Description of Artificial Sequence: Synthetic oligonucleotide
  Target: ATXN1; (-) strand; PAM type: YTN; PAM sequence: CTA
ttttttttaaataatgataa

SEQ ID NO: 170820 - DNA, 20 bp, Artificial Sequence
  Description of Artificial Sequence: Synthetic oligonucleotide
  Target: ATXN1; (-) strand; PAM type: YTN; PAM sequence: TTC
tattttttttaaataatgat

SEQ ID NO: 170821 - DNA, 20 bp, Artificial Sequence
  Description of Artificial Sequence: Synthetic oligonucleotide
  Target: ATXN1; (-) strand; PAM type: YTN; PAM sequence: TTG
ttctattttttttaaataat

SEQ ID NO: 170822 - DNA, 20 bp, Artificial Sequence
  Description of Artificial Sequence: Synthetic oligonucleotide
  Target: ATXN1; (-) strand; PAM type: YTN; PAM sequence: CTT
gttctattttttttaaataa

SEQ ID NO: 170823 - DNA, 20 bp, Artificial Sequence
  Description of Artificial Sequence: Synthetic oligonucleotide
  Target: ATXN1; (-) strand; PAM type: YTN; PAM sequence: CTC
ttgttctattttttttaaat

SEQ ID NO: 170824 - DNA, 20 bp, Artificial Sequence
  Description of Artificial Sequence: Synthetic oligonucleotide
  Target: ATXN1; (-) strand; PAM type: YTN; PAM sequence: TTG
gtcaggagggcagtataaac

SEQ ID NO: 170825 - DNA, 20 bp, Artificial Sequence
  Description of Artificial Sequence: Synthetic oligonucleotide
  Target: ATXN1; (-) strand; PAM type: YTN; PAM sequence: TTA
agtaaatgaagacagcattg

SEQ ID NO: 170826 - DNA, 20 bp, Artificial Sequence
  Description of Artificial Sequence: Synthetic oligonucleotide
  Target: ATXN1; (-) strand; PAM type: YTN; PAM sequence: CTC
aggaaaagacaaggatgatg

SEQ ID NO: 170827 - DNA, 20 bp, Artificial Sequence
  Description of Artificial Sequence: Synthetic oligonucleotide
  Target: ATXN1; (-) strand; PAM type: YTN; PAM sequence: TTA
ggcacatagtgctcaggaaa

SEQ ID NO: 170828 - DNA, 20 bp, Artificial Sequence
  Description of Artificial Sequence: Synthetic oligonucleotide
  Target: ATXN1; (-) strand; PAM type: YTN; PAM sequence: TTT
aggcacatagtgctcaggaa

SEQ ID NO: 170829 - DNA, 20 bp, Artificial Sequence
  Description of Artificial Sequence: Synthetic oligonucleotide
  Target: ATXN1; (-) strand; PAM type: YTN; PAM sequence: TTA
atttaggcacatagtgctca

SEQ ID NO: 170830 - DNA, 20 bp, Artificial Sequence
  Description of Artificial Sequence: Synthetic oligonucleotide
  Target: ATXN1; (-) strand; PAM type: YTN; PAM sequence: TTT
aatttaggcacatagtgctc

SEQ ID NO: 170831 - DNA, 20 bp, Artificial Sequence
  Description of Artificial Sequence: Synthetic oligonucleotide
  Target: ATXN1; (-) strand; PAM type: YTN; PAM sequence: TTT
taatttaggcacatagtgct

SEQ ID NO: 170832 - DNA, 20 bp, Artificial Sequence
  Description of Artificial Sequence: Synthetic oligonucleotide
  Target: ATXN1; (-) strand; PAM type: YTN; PAM sequence: TTT
ttaatttaggcacatagtgc

SEQ ID NO: 170833 - DNA, 20 bp, Artificial Sequence
  Description of Artificial Sequence: Synthetic oligonucleotide
  Target: ATXN1; (-) strand; PAM type: YTN; PAM sequence: CTT
tttaatttaggcacatagtg

SEQ ID NO: 170834 - DNA, 20 bp, Artificial Sequence
  Description of Artificial Sequence: Synthetic oligonucleotide
  Target: ATXN1; (-) strand; PAM type: YTN; PAM sequence: CTA
tcatctttttaatttaggca

SEQ ID NO: 170835 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccacgcc

SEQ ID NO: 170836 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 170837 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 170838 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 170839 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 170840 - DNA, 20 bp, Artificial Sequence
  Description of Artificial Sequence: Synthetic oligonucleotide
  Target: ATXN1; (-) strand; PAM type: YTN; PAM sequence: CTG
cccgccttggcctcccaaag

SEQ ID NO: 170841 - DNA, 20 bp, Artificial Sequence
  Description of Artificial Sequence: Synthetic oligonucleotide
  Target: ATXN1; (-) strand; PAM type: YTN; PAM sequence: CTC
gtgatctgcccgccttggcc

SEQ ID NO: 170842 - DNA, 20 bp, Artificial Sequence
  Description of Artificial Sequence: Synthetic oligonucleotide
  Target: ATXN1; (-) strand; PAM type: YTN; PAM sequence: CTC
acctcgtgatctgcccgcct

SEQ ID NO: 170843 - DNA, 20 bp, Artificial Sequence
  Description of Artificial Sequence: Synthetic oligonucleotide
  Target: ATXN1; (-) strand; PAM type: YTN; PAM sequence: CTC
ctcacctcgtgatctgcccg

SEQ ID NO: 170844 - DNA, 20 bp, Artificial Sequence
  Description of Artificial Sequence: Synthetic oligonucleotide
  Target: ATXN1; (-) strand; PAM type: YTN; PAM sequence: CTC
gaactcctcacctcgtgatc

SEQ ID NO: 170845 - DNA, 20 bp, Artificial Sequence
  Description of Artificial Sequence: Synthetic oligonucleotide
  Target: ATXN1; (-) strand; PAM type: YTN; PAM sequence: CTC
tcgaactcctcacctcgtga

SEQ ID NO: 170846 - DNA, 20 bp, Artificial Sequence
  Description of Artificial Sequence: Synthetic oligonucleotide
  Target: ATXN1; (-) strand; PAM type: YTN; PAM sequence: CTG
gtctctcgaactcctcacct

SEQ ID NO: 170847 - DNA, 20 bp, Artificial Sequence
  Description of Artificial Sequence: Synthetic oligonucleotide
  Target: ATXN1; (-) strand; PAM type: YTN; PAM sequence: TTG
gtcaggctggtctctcgaac

SEQ ID NO: 170848 - DNA, 20 bp, Artificial Sequence
  Description of Artificial Sequence: Synthetic oligonucleotide
  Target: ATXN1; (-) strand; PAM type: YTN; PAM sequence: TTC
accatgttggtcaggctggt

SEQ ID NO: 170849 - DNA, 20 bp, Artificial Sequence
  Description of Artificial Sequence: Synthetic oligonucleotide
  Target: ATXN1; (-) strand; PAM type: YTN; PAM sequence: TTT
caccatgttggtcaggctgg

SEQ ID NO: 170850 - DNA, 20 bp, Artificial Sequence
  Description of Artificial Sequence: Synthetic oligonucleotide
  Target: ATXN1; (-) strand; PAM type: YTN; PAM sequence: TTA
gtacagacgaggtttcacca

SEQ ID NO: 170851 - DNA, 20 bp, Artificial Sequence
  Description of Artificial Sequence: Synthetic oligonucleotide
  Target: ATXN1; (-) strand; PAM type: YTN; PAM sequence: TTT
agtacagacgaggtttcacc

SEQ ID NO: 170852 - DNA, 20 bp, Artificial Sequence
  Description of Artificial Sequence: Synthetic oligonucleotide
  Target: ATXN1; (-) strand; PAM type: YTN; PAM sequence: TTT
tagtacagacgaggtttcac

SEQ ID NO: 170853 - DNA, 20 bp, Artificial Sequence
  Description of Artificial Sequence: Synthetic oligonucleotide
  Target: ATXN1; (-) strand; PAM type: YTN; PAM sequence: CTT
ttagtacagacgaggtttca

SEQ ID NO: 170854 - DNA, 20 bp, Artificial Sequence
  Description of Artificial Sequence: Synthetic oligonucleotide
  Target: ATXN1; (-) strand; PAM type: YTN; PAM sequence: TTG
tacttttagtacagacgagg

SEQ ID NO: 170855 - DNA, 20 bp, Artificial Sequence
  Description of Artificial Sequence: Synthetic oligonucleotide
  Target: ATXN1; (-) strand; PAM type: YTN; PAM sequence: TTT
gtacttttagtacagacgag

SEQ ID NO: 170856 - DNA, 20 bp, Artificial Sequence
  Description of Artificial Sequence: Synthetic oligonucleotide
  Target: ATXN1; (-) strand; PAM type: YTN; PAM sequence: TTT
tgtacttttagtacagacga

SEQ ID NO: 170857 - DNA, 20 bp, Artificial Sequence
  Description of Artificial Sequence: Synthetic oligonucleotide
  Target: ATXN1; (-) strand; PAM type: YTN; PAM sequence: TTT
ttgtacttttagtacagacg

SEQ ID NO: 170858 - DNA, 20 bp, Artificial Sequence
  Description of Artificial Sequence: Synthetic oligonucleotide
  Target: ATXN1; (-) strand; PAM type: YTN; PAM sequence: CTA
atttttgtacttttagtaca

SEQ ID NO: 170859 - DNA, 20 bp, Artificial Sequence
  Description of Artificial Sequence: Synthetic oligonucleotide
  Target: ATXN1; (-) strand; PAM type: YTN; PAM sequence: CTG
agatgacaggcgcgtgccac

SEQ ID NO: 170860 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgagatgacag

SEQ ID NO: 170861 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctgaga

SEQ ID NO: 170862 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 170863 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgagta

SEQ ID NO: 170864 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccgag

SEQ ID NO: 170865 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgcctcag

SEQ ID NO: 170866 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagcgattctcc

SEQ ID NO: 170867 - DNA, 20 bp, Artificial Sequence
  Description of Artificial Sequence: Synthetic oligonucleotide
  Target: ATXN1; (-) strand; PAM type: YTN; PAM sequence: CTC
cgcctcccgggttcaagcga

SEQ ID NO: 170868 - DNA, 20 bp, Artificial Sequence
  Description of Artificial Sequence: Synthetic oligonucleotide
  Target: ATXN1; (-) strand; PAM type: YTN; PAM sequence: CTA
caacctccgcctcccgggtt

SEQ ID NO: 170869 - DNA, 20 bp, Artificial Sequence
  Description of Artificial Sequence: Synthetic oligonucleotide
  Target: ATXN1; (-) strand; PAM type: YTN; PAM sequence: CTC
actacaacctccgcctcccg

SEQ ID NO: 170870 - DNA, 20 bp, Artificial Sequence
  Description of Artificial Sequence: Synthetic oligonucleotide
  Target: ATXN1; (-) strand; PAM type: YTN; PAM sequence: CTC
cactcactacaacctccgcc

SEQ ID NO: 170871 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcgccatctc

SEQ ID NO: 170872 - DNA, 20 bp, Artificial Sequence
  Description of Artificial Sequence: Synthetic oligonucleotide
  Target: ATXN1; (-) strand; PAM type: YTN; PAM sequence: CTC
aggctggagtgcagtggcgc

SEQ ID NO: 170873 - DNA, 20 bp, Artificial Sequence
  Description of Artificial Sequence: Synthetic oligonucleotide
  Target: ATXN1; (-) strand; PAM type: YTN; PAM sequence: CTG
tcactcaggctggagtgcag

SEQ ID NO: 170874 - DNA, 20 bp, Artificial Sequence
  Description of Artificial Sequence: Synthetic oligonucleotide
  Target: ATXN1; (-) strand; PAM type: YTN; PAM sequence: CTC
tgtcactcaggctggagtgc

SEQ ID NO: 170875 - DNA, 20 bp, Artificial Sequence
  Description of Artificial Sequence: Synthetic oligonucleotide
  Target: ATXN1; (-) strand; PAM type: YTN; PAM sequence: CTC
gctctgtcactcaggctgga

SEQ ID NO: 170876 - DNA, 20 bp, Artificial Sequence
  Description of Artificial Sequence: Synthetic oligonucleotide
  Target: ATXN1; (-) strand; PAM type: YTN; PAM sequence: TTG
gagatggagtctcgctctgt

SEQ ID NO: 170877 - DNA, 20 bp, Artificial Sequence
  Description of Artificial Sequence: Synthetic oligonucleotide
  Target: ATXN1; (-) strand; PAM type: YTN; PAM sequence: TTT
ggagatggagtctcgctctg

SEQ ID NO: 170878 - DNA, 20 bp, Artificial Sequence
  Description of Artificial Sequence: Synthetic oligonucleotide
  Target: ATXN1; (-) strand; PAM type: YTN; PAM sequence: TTT
tggagatggagtctcgctct

SEQ ID NO: 170879 - DNA, 20 bp, Artificial Sequence
  Description of Artificial Sequence: Synthetic oligonucleotide
  Target: ATXN1; (-) strand; PAM type: YTN; PAM sequence: TTT
ttggagatggagtctcgctc

SEQ ID NO: 170880 - DNA, 20 bp, Artificial Sequence
  Description of Artificial Sequence: Synthetic oligonucleotide
  Target: ATXN1; (-) strand; PAM type: YTN; PAM sequence: TTT
tttggagatggagtctcgct

SEQ ID NO: 170881 - DNA, 20 bp, Artificial Sequence
  Description of Artificial Sequence: Synthetic oligonucleotide
  Target: ATXN1; (-) strand; PAM type: YTN; PAM sequence: TTT
ttttggagatggagtctcgc

SEQ ID NO: 170882 - DNA, 20 bp, Artificial Sequence
  Description of Artificial Sequence: Synthetic oligonucleotide
  Target: ATXN1; (-) strand; PAM type: YTN; PAM sequence: TTT
tttttggagatggagtctcg

SEQ ID NO: 170883 - DNA, 20 bp, Artificial Sequence
  Description of Artificial Sequence: Synthetic oligonucleotide
  Target: ATXN1; (-) strand; PAM type: YTN; PAM sequence: TTT
ttttttggagatggagtctc

SEQ ID NO: 170884 - DNA, 20 bp, Artificial Sequence
  Description of Artificial Sequence: Synthetic oligonucleotide
  Target: ATXN1; (-) strand; PAM type: YTN; PAM sequence: CTT
tttttttggagatggagtct

SEQ ID NO: 170885 - DNA, 20 bp, Artificial Sequence
  Description of Artificial Sequence: Synthetic oligonucleotide
  Target: ATXN1; (-) strand; PAM type: YTN; PAM sequence: TTC
tttttttttggagatggagt

SEQ ID NO: 170886 - DNA, 20 bp, Artificial Sequence
  Description of Artificial Sequence: Synthetic oligonucleotide
  Target: ATXN1; (-) strand; PAM type: YTN; PAM sequence: TTT
ctttttttttggagatggag

SEQ ID NO: 170887 - DNA, 20 bp, Artificial Sequence
  Description of Artificial Sequence: Synthetic oligonucleotide
  Target: ATXN1; (-) strand; PAM type: YTN; PAM sequence: TTT
tctttttttttggagatgga

SEQ ID NO: 170888 - DNA, 20 bp, Artificial Sequence
  Description of Artificial Sequence: Synthetic oligonucleotide
  Target: ATXN1; (-) strand; PAM type: YTN; PAM sequence: TTT
ttctttttttttggagatgg

SEQ ID NO: 170889 - DNA, 20 bp, Artificial Sequence
  Description of Artificial Sequence: Synthetic oligonucleotide
  Target: ATXN1; (-) strand; PAM type: YTN; PAM sequence: TTT
tttctttttttttggagatg

SEQ ID NO: 170890 - DNA, 20 bp, Artificial Sequence
  Description of Artificial Sequence: Synthetic oligonucleotide
  Target: ATXN1; (-) strand; PAM type: YTN; PAM sequence: TTT
ttttctttttttttggagat

SEQ ID NO: 170891 - DNA, 20 bp, Artificial Sequence
  Description of Artificial Sequence: Synthetic oligonucleotide
  Target: ATXN1; (-) strand; PAM type: YTN; PAM sequence: TTT
tttttctttttttttggaga

SEQ ID NO: 170892 - DNA, 20 bp, Artificial Sequence
  Description of Artificial Sequence: Synthetic oligonucleotide
  Target: ATXN1; (-) strand; PAM type: YTN; PAM sequence: TTT
ttttttctttttttttggag

SEQ ID NO: 170893 - DNA, 20 bp, Artificial Sequence
  Description of Artificial Sequence: Synthetic oligonucleotide
  Target: ATXN1; (-) strand; PAM type: YTN; PAM sequence: TTT
tttttttctttttttttgga

SEQ ID NO: 170894 - DNA, 20 bp, Artificial Sequence
  Description of Artificial Sequence: Synthetic oligonucleotide
  Target: ATXN1; (-) strand; PAM type: YTN; PAM sequence: TTT
ttttttttctttttttttgg

SEQ ID NO: 170895 - DNA, 20 bp, Artificial Sequence
  Description of Artificial Sequence: Synthetic oligonucleotide
  Target: ATXN1; (-) strand; PAM type: YTN; PAM sequence: TTT
tttttttttctttttttttg

SEQ ID NO: 170896 - DNA, 20 bp, Artificial Sequence
  Description of Artificial Sequence: Synthetic oligonucleotide
  Target: ATXN1; (-) strand; PAM type: YTN; PAM sequence: CTT
ttttttttttcttttttttt

SEQ ID NO: 170897 - DNA, 20 bp, Artificial Sequence
  Description of Artificial Sequence: Synthetic oligonucleotide
  Target: ATXN1; (-) strand; PAM type: YTN; PAM sequence: TTC
cttttttttttttctttttt

SEQ ID NO: 170898 - DNA, 20 bp, Artificial Sequence
  Description of Artificial Sequence: Synthetic oligonucleotide
  Target: ATXN1; (-) strand; PAM type: YTN; PAM sequence: TTT
ccttttttttttttcttttt

SEQ ID NO: 170899 - DNA, 20 bp, Artificial Sequence
  Description of Artificial Sequence: Synthetic oligonucleotide
  Target: ATXN1; (-) strand; PAM type: YTN; PAM sequence: CTT
tccttttttttttttctttt

SEQ ID NO: 170900 - DNA, 20 bp, Artificial Sequence
  Description of Artificial Sequence: Synthetic oligonucleotide
  Target: ATXN1; (-) strand; PAM type: YTN; PAM sequence: TTC
tttccttttttttttttctt

SEQ ID NO: 170901 - DNA, 20 bp, Artificial Sequence
  Description of Artificial Sequence: Synthetic oligonucleotide
  Target: ATXN1; (-) strand; PAM type: YTN; PAM sequence: TTT
ctttccttttttttttttct

SEQ ID NO: 170902 - DNA, 20 bp, Artificial Sequence
  Description of Artificial Sequence: Synthetic oligonucleotide
  Target: ATXN1; (-) strand; PAM type: YTN; PAM sequence: TTT
tctttccttttttttttttc

SEQ ID NO: 170903 - DNA, 20 bp, Artificial Sequence
  Description of Artificial Sequence: Synthetic oligonucleotide
  Target: ATXN1; (-) strand; PAM type: YTN; PAM sequence: TTT
ttctttcctttttttttttt

SEQ ID NO: 170904 - DNA, 20 bp, Artificial Sequence
  Description of Artificial Sequence: Synthetic oligonucleotide
  Target: ATXN1; (-) strand; PAM type: YTN; PAM sequence: CTT
tttctttccttttttttttt

SEQ ID NO: 170905 - DNA, 20 bp, Artificial Sequence
  Description of Artificial Sequence: Synthetic oligonucleotide
  Target: ATXN1; (-) strand; PAM type: YTN; PAM sequence: CTA
tcatctttttctttcctttt

SEQ ID NO: 170906 - DNA, 20 bp, Artificial Sequence
  Description of Artificial Sequence: Synthetic oligonucleotide
  Target: ATXN1; (-) strand; PAM type: YTN; PAM sequence: CTA
ccaagggatgctatcatctt

SEQ ID NO: 170907 - DNA, 20 bp, Artificial Sequence
  Description of Artificial Sequence: Synthetic oligonucleotide
  Target: ATXN1; (-) strand; PAM type: YTN; PAM sequence: TTG
ctaccaagggatgctatcat

SEQ ID NO: 170908 - DNA, 20 bp, Artificial Sequence
  Description of Artificial Sequence: Synthetic oligonucleotide
  Target: ATXN1; (-) strand; PAM type: YTN; PAM sequence: TTT
gctaccaagggatgctatca

SEQ ID NO: 170909 - DNA, 20 bp, Artificial Sequence
  Description of Artificial Sequence: Synthetic oligonucleotide
  Target: ATXN1; (-) strand; PAM type: YTN; PAM sequence: TTC
cgtgtatatttgctaccaag

SEQ ID NO: 170910 - DNA, 20 bp, Artificial Sequence
  Description of Artificial Sequence: Synthetic oligonucleotide
  Target: ATXN1; (-) strand; PAM type: YTN; PAM sequence: TTT
ccgtgtatatttgctaccaa

SEQ ID NO: 170911 - DNA, 20 bp, Artificial Sequence
  Description of Artificial Sequence: Synthetic oligonucleotide
  Target: ATXN1; (-) strand; PAM type: YTN; PAM sequence: TTT
tccgtgtatatttgctacca

SEQ ID NO: 170912 - DNA, 20 bp, Artificial Sequence
  Description of Artificial Sequence: Synthetic oligonucleotide
  Target: ATXN1; (-) strand; PAM type: YTN; PAM sequence: CTG
cataaaccacatggaaattt

SEQ ID NO: 170913 - DNA, 20 bp, Artificial Sequence
  Description of Artificial Sequence: Synthetic oligonucleotide
  Target: ATXN1; (-) strand; PAM type: YTN; PAM sequence: TTA
gaactgcataaaccacatgg

SEQ ID NO: 170914 - DNA, 20 bp, Artificial Sequence
  Description of Artificial Sequence: Synthetic oligonucleotide
  Target: ATXN1; (-) strand; PAM type: YTN; PAM sequence: TTT
agaactgcataaaccacatg

SEQ ID NO: 170915 - DNA, 20 bp, Artificial Sequence
  Description of Artificial Sequence: Synthetic oligonucleotide
  Target: ATXN1; (-) strand; PAM type: YTN; PAM sequence: TTT
tagaactgcataaaccacat

SEQ ID NO: 170916 - DNA, 20 bp, Artificial Sequence
  Description of Artificial Sequence: Synthetic oligonucleotide
  Target: ATXN1; (-) strand; PAM type: YTN; PAM sequence: CTT
ttagaactgcataaaccaca

SEQ ID NO: 170917 - DNA, 20 bp, Artificial Sequence
  Description of Artificial Sequence: Synthetic oligonucleotide
  Target: ATXN1; (-) strand; PAM type: YTN; PAM sequence: TTC
ttttagaactgcataaacca

SEQ ID NO: 170918 - DNA, 20 bp, Artificial Sequence
  Description of Artificial Sequence: Synthetic oligonucleotide
  Target: ATXN1; (-) strand; PAM type: YTN; PAM sequence: TTT
cttttagaactgcataaacc

SEQ ID NO: 170919 - DNA, 20 bp, Artificial Sequence
  Description of Artificial Sequence: Synthetic oligonucleotide
  Target: ATXN1; (-) strand; PAM type: YTN; PAM sequence: CTT
tcttttagaactgcataaac

SEQ ID NO: 170920 - DNA, 20 bp, Artificial Sequence
  Description of Artificial Sequence: Synthetic oligonucleotide
  Target: ATXN1; (-) strand; PAM type: YTN; PAM sequence: CTG
tcgctttcttttagaactgc

SEQ ID NO: 170921 - DNA, 20 bp, Artificial Sequence
  Description of Artificial Sequence: Synthetic oligonucleotide
  Target: ATXN1; (-) strand; PAM type: YTN; PAM sequence: CTA
cagtaaatgcaatatctgtc

SEQ ID NO: 170922 - DNA, 20 bp, Artificial Sequence
  Description of Artificial Sequence: Synthetic oligonucleotide
  Target: ATXN1; (-) strand; PAM type: YTN; PAM sequence: TTG
ggaagtgggtctacagtaaa

SEQ ID NO: 170923 - DNA, 20 bp, Artificial Sequence
  Description of Artificial Sequence: Synthetic oligonucleotide
  Target: ATXN1; (-) strand; PAM type: YTN; PAM sequence: CTC
aaggcaaaaggaagtcaaat

SEQ ID NO: 170924 - DNA, 20 bp, Artificial Sequence
  Description of Artificial Sequence: Synthetic oligonucleotide
  Target: ATXN1; (-) strand; PAM type: YTN; PAM sequence: CTC
tcaaggcaaaaggaagtcaa

SEQ ID NO: 170925 - DNA, 20 bp, Artificial Sequence
  Description of Artificial Sequence: Synthetic oligonucleotide
  Target: ATXN1; (-) strand; PAM type: YTN; PAM sequence: TTA
aggactctcaaggcaaaagg

SEQ ID NO: 170926 - DNA, 20 bp, Artificial Sequence
  Description of Artificial Sequence: Synthetic oligonucleotide
  Target: ATXN1; (-) strand; PAM type: YTN; PAM sequence: CTA
aagaagacaagaaaattaag

SEQ ID NO: 170927 - DNA, 20 bp, Artificial Sequence
  Description of Artificial Sequence: Synthetic oligonucleotide
  Target: ATXN1; (-) strand; PAM type: YTN; PAM sequence: TTA
cagcctaaagaagacaagaa

SEQ ID NO: 170928 - DNA, 20 bp, Artificial Sequence
  Description of Artificial Sequence: Synthetic oligonucleotide
  Target: ATXN1; (-) strand; PAM type: YTN; PAM sequence: CTT
acagcctaaagaagacaaga

SEQ ID NO: 170929 - DNA, 20 bp, Artificial Sequence
  Description of Artificial Sequence: Synthetic oligonucleotide
  Target: ATXN1; (-) strand; PAM type: YTN; PAM sequence: TTC
agtagtcttacagcctaaag

SEQ ID NO: 170930 - DNA, 20 bp, Artificial Sequence
  Description of Artificial Sequence: Synthetic oligonucleotide
  Target: ATXN1; (-) strand; PAM type: YTN; PAM sequence: TTC
attcagtagtcttacagcct

SEQ ID NO: 170931 - DNA, 20 bp, Artificial Sequence
  Description of Artificial Sequence: Synthetic oligonucleotide
  Target: ATXN1; (-) strand; PAM type: YTN; PAM sequence: TTC
attcattcagtagtcttaca

SEQ ID NO: 170932 - DNA, 20 bp, Artificial Sequence
  Description of Artificial Sequence: Synthetic oligonucleotide
  Target: ATXN1; (-) strand; PAM type: YTN; PAM sequence: CTT
cattcattcagtagtcttac

SEQ ID NO: 170933 - DNA, 20 bp, Artificial Sequence
  Description of Artificial Sequence: Synthetic oligonucleotide
  Target: ATXN1; (-) strand; PAM type: YTN; PAM sequence: CTC
cccttcattcattcagtagt

SEQ ID NO: 170934 - DNA, 20 bp, Artificial Sequence
  Description of Artificial Sequence: Synthetic oligonucleotide
  Target: ATXN1; (-) strand; PAM type: YTN; PAM sequence: CTG
cctccccttcattcattcag

SEQ ID NO: 170935 - DNA, 20 bp, Artificial Sequence
  Description of Artificial Sequence: Synthetic oligonucleotide
  Target: ATXN1; (-) strand; PAM type: YTN; PAM sequence: CTG
ctgcctccccttcattcatt

SEQ ID NO: 170936 - DNA, 20 bp, Artificial Sequence
  Description of Artificial Sequence: Synthetic oligonucleotide
  Target: ATXN1; (-) strand; PAM type: YTN; PAM sequence: CTA
ctgctgcctccccttcattc

SEQ ID NO: 170937 - DNA, 20 bp, Artificial Sequence
  Description of Artificial Sequence: Synthetic oligonucleotide
  Target: ATXN1; (-) strand; PAM type: YTN; PAM sequence: TTC
agaaaccaagactactgctg

SEQ ID NO: 170938 - DNA, 20 bp, Artificial Sequence
  Description of Artificial Sequence: Synthetic oligonucleotide
  Target: ATXN1; (-) strand; PAM type: YTN; PAM sequence: TTG
tcgataagttcagaaaccaa

SEQ ID NO: 170939 - DNA, 20 bp, Artificial Sequence
  Description of Artificial Sequence: Synthetic oligonucleotide
  Target: ATXN1; (-) strand; PAM type: YTN; PAM sequence: TTG
tagtgaaaggattgtcgata

SEQ ID NO: 170940 - DNA, 20 bp, Artificial Sequence
  Description of Artificial Sequence: Synthetic oligonucleotide
  Target: ATXN1; (-) strand; PAM type: YTN; PAM sequence: CTT
gtagtgaaaggattgtcgat

SEQ ID NO: 170941 - DNA, 20 bp, Artificial Sequence
  Description of Artificial Sequence: Synthetic oligonucleotide
  Target: ATXN1; (-) strand; PAM type: YTN; PAM sequence: TTC
ttgtagtgaaaggattgtcg

SEQ ID NO: 170942 - DNA, 20 bp, Artificial Sequence
  Description of Artificial Sequence: Synthetic oligonucleotide
  Target: ATXN1; (-) strand; PAM type: YTN; PAM sequence: CTG
cgtagttcttgtagtgaaag

SEQ ID NO: 170943 - DNA, 20 bp, Artificial Sequence
  Description of Artificial Sequence: Synthetic oligonucleotide
  Target: ATXN1; (-) strand; PAM type: YTN; PAM sequence: CTG
ctgcgtagttcttgtagtga

SEQ ID NO: 170944 - DNA, 20 bp, Artificial Sequence
  Description of Artificial Sequence: Synthetic oligonucleotide
  Target: ATXN1; (-) strand; PAM type: YTN; PAM sequence: TTA
tctgctgcgtagttcttgta

SEQ ID NO: 170945 - DNA, 20 bp, Artificial Sequence
  Description of Artificial Sequence: Synthetic oligonucleotide
  Target: ATXN1; (-) strand; PAM type: YTN; PAM sequence: TTT
atctgctgcgtagttcttgt

SEQ ID NO: 170946 - DNA, 20 bp, Artificial Sequence
  Description of Artificial Sequence: Synthetic oligonucleotide
  Target: ATXN1; (-) strand; PAM type: YTN; PAM sequence: TTT
tatctgctgcgtagttcttg

SEQ ID NO: 170947 - DNA, 20 bp, Artificial Sequence
  Description of Artificial Sequence: Synthetic oligonucleotide
  Target: ATXN1; (-) strand; PAM type: YTN; PAM sequence: TTT
ttatctgctgcgtagttctt

SEQ ID NO: 170948 - DNA, 20 bp, Artificial Sequence
  Description of Artificial Sequence: Synthetic oligonucleotide
  Target: ATXN1; (-) strand; PAM type: YTN; PAM sequence: CTT
tttatctgctgcgtagttct

SEQ ID NO: 170949 - DNA, 20 bp, Artificial Sequence
  Description of Artificial Sequence: Synthetic oligonucleotide
  Target: ATXN1; (-) strand; PAM type: YTN; PAM sequence: CTC
gctttttatctgctgcgtag

SEQ ID NO: 170950 - DNA, 20 bp, Artificial Sequence
  Description of Artificial Sequence: Synthetic oligonucleotide
  Target: ATXN1; (-) strand; PAM type: YTN; PAM sequence: CTC
cagaaggaaaatgagcagaa

SEQ ID NO: 170951 - DNA, 20 bp, Artificial Sequence
  Description of Artificial Sequence: Synthetic oligonucleotide
  Target: ATXN1; (-) strand; PAM type: YTN; PAM sequence: TTC
ctccagaaggaaaatgagca

SEQ ID NO: 170952 - DNA, 20 bp, Artificial Sequence
  Description of Artificial Sequence: Synthetic oligonucleotide
  Target: ATXN1; (-) strand; PAM type: YTN; PAM sequence: TTT
cctccagaaggaaaatgagc

SEQ ID NO: 170953 - DNA, 20 bp, Artificial Sequence
  Description of Artificial Sequence: Synthetic oligonucleotide
  Target: ATXN1; (-) strand; PAM type: YTN; PAM sequence: TTT
tcctccagaaggaaaatgag

SEQ ID NO: 170954 - DNA, 20 bp, Artificial Sequence
  Description of Artificial Sequence: Synthetic oligonucleotide
  Target: ATXN1; (-) strand; PAM type: YTN; PAM sequence: CTT
ttcctccagaaggaaaatga

SEQ ID NO: 170955 - DNA, 20 bp, Artificial Sequence
  Description of Artificial Sequence: Synthetic oligonucleotide
  Target: ATXN1; (-) strand; PAM type: YTN; PAM sequence: TTC
ttttcctccagaaggaaaat

SEQ ID NO: 170956 - DNA, 20 bp, Artificial Sequence
  Description of Artificial Sequence: Synthetic oligonucleotide
  Target: ATXN1; (-) strand; PAM type: YTN; PAM sequence: TTT
cttttcctccagaaggaaaa

SEQ ID NO: 170957 - DNA, 20 bp, Artificial Sequence
  Description of Artificial Sequence: Synthetic oligonucleotide
  Target: ATXN1; (-) strand; PAM type: YTN; PAM sequence: TTT
tcttttcctccagaaggaaa

SEQ ID NO: 170958 - DNA, 20 bp, Artificial Sequence
  Description of Artificial Sequence: Synthetic oligonucleotide
  Target: ATXN1; (-) strand; PAM type: YTN; PAM sequence: CTA
tgttttcttttcctccagaa

SEQ ID NO: 170959 - DNA, 20 bp, Artificial Sequence
  Description of Artificial Sequence: Synthetic oligonucleotide
  Target: ATXN1; (-) strand; PAM type: YTN; PAM sequence: TTC
tatgttttcttttcctccag

SEQ ID NO: 170960 - DNA, 20 bp, Artificial Sequence
  Description of Artificial Sequence: Synthetic oligonucleotide
  Target: ATXN1; (-) strand; PAM type: YTN; PAM sequence: CTT
ctatgttttcttttcctcca

SEQ ID NO: 170961 - DNA, 20 bp, Artificial Sequence
  Description of Artificial Sequence: Synthetic oligonucleotide
  Target: ATXN1; (-) strand; PAM type: YTN; PAM sequence: TTG
cttctatgttttcttttcct

SEQ ID NO: 170962 - DNA, 20 bp, Artificial Sequence
  Description of Artificial Sequence: Synthetic oligonucleotide
  Target: ATXN1; (-) strand; PAM type: YTN; PAM sequence: TTT
gcttctatgttttcttttcc

SEQ ID NO: 170963 - DNA, 20 bp, Artificial Sequence
  Description of Artificial Sequence: Synthetic oligonucleotide
  Target: ATXN1; (-) strand; PAM type: YTN; PAM sequence: TTT
tgcttctatgttttcttttc

SEQ ID NO: 170964 - DNA, 20 bp, Artificial Sequence
  Description of Artificial Sequence: Synthetic oligonucleotide
  Target: ATXN1; (-) strand; PAM type: YTN; PAM sequence: TTC
aattttgcttctatgttttc

SEQ ID NO: 170965 - DNA, 20 bp, Artificial Sequence
  Description of Artificial Sequence: Synthetic oligonucleotide
  Target: ATXN1; (-) strand; PAM type: YTN; PAM sequence: TTT
caattttgcttctatgtttt

SEQ ID NO: 170966 - DNA, 20 bp, Artificial Sequence
  Description of Artificial Sequence: Synthetic oligonucleotide
  Target: ATXN1; (-) strand; PAM type: YTN; PAM sequence: TTT
tcaattttgcttctatgttt

SEQ ID NO: 170967 - DNA, 20 bp, Artificial Sequence
  Description of Artificial Sequence: Synthetic oligonucleotide
  Target: ATXN1; (-) strand; PAM type: YTN; PAM sequence: CTT
ttcaattttgcttctatgtt

SEQ ID NO: 170968 - DNA, 20 bp, Artificial Sequence
  Description of Artificial Sequence: Synthetic oligonucleotide
  Target: ATXN1; (-) strand; PAM type: YTN; PAM sequence: TTA
acccttttcaattttgcttc

SEQ ID NO: 170969 - DNA, 20 bp, Artificial Sequence
  Description of Artificial Sequence: Synthetic oligonucleotide
  Target: ATXN1; (-) strand; PAM type: YTN; PAM sequence: TTC
cattaacccttttcaatttt

SEQ ID NO: 170970 - DNA, 20 bp, Artificial Sequence
  Description of Artificial Sequence: Synthetic oligonucleotide
  Target: ATXN1; (-) strand; PAM type: YTN; PAM sequence: TTT
ccattaacccttttcaattt

SEQ ID NO: 170971 - DNA, 20 bp, Artificial Sequence
  Description of Artificial Sequence: Synthetic oligonucleotide
  Target: ATXN1; (-) strand; PAM type: YTN; PAM sequence: CTT
tccattaacccttttcaatt

SEQ ID NO: 170972 - DNA, 20 bp, Artificial Sequence
  Description of Artificial Sequence: Synthetic oligonucleotide
  Target: ATXN1; (-) strand; PAM type: YTN; PAM sequence: TTA
gtgctttccattaacccttt

SEQ ID NO: 170973 - DNA, 20 bp, Artificial Sequence
  Description of Artificial Sequence: Synthetic oligonucleotide
  Target: ATXN1; (-) strand; PAM type: YTN; PAM sequence: TTA
gttagtgctttccattaacc

SEQ ID NO: 170974 - DNA, 20 bp, Artificial Sequence
  Description of Artificial Sequence: Synthetic oligonucleotide
  Target: ATXN1; (-) strand; PAM type: YTN; PAM sequence: TTT
agttagtgctttccattaac

SEQ ID NO: 170975 - DNA, 20 bp, Artificial Sequence
  Description of Artificial Sequence: Synthetic oligonucleotide
  Target: ATXN1; (-) strand; PAM type: YTN; PAM sequence: CTG
aatgtttagttagtgctttc

SEQ ID NO: 170976 - DNA, 20 bp, Artificial Sequence
  Description of Artificial Sequence: Synthetic oligonucleotide
  Target: ATXN1; (-) strand; PAM type: YTN; PAM sequence: CTA
tgtgagtcagggtacacctg

SEQ ID NO: 170977 - DNA, 20 bp, Artificial Sequence
  Description of Artificial Sequence: Synthetic oligonucleotide
  Target: ATXN1; (-) strand; PAM type: YTN; PAM sequence: TTG
cagtgcctatgtgagtcagg

SEQ ID NO: 170978 - DNA, 20 bp, Artificial Sequence
  Description of Artificial Sequence: Synthetic oligonucleotide
  Target: ATXN1; (-) strand; PAM type: YTN; PAM sequence: TTG
aaatagaacgattgcagtgc

SEQ ID NO: 170979 - DNA, 20 bp, Artificial Sequence
  Description of Artificial Sequence: Synthetic oligonucleotide
  Target: ATXN1; (-) strand; PAM type: YTN; PAM sequence: TTT
gaaatagaacgattgcagtg

SEQ ID NO: 170980 - DNA, 20 bp, Artificial Sequence
  Description of Artificial Sequence: Synthetic oligonucleotide
  Target: ATXN1; (-) strand; PAM type: YTN; PAM sequence: TTA
tttgaaatagaacgattgca

SEQ ID NO: 170981 - DNA, 20 bp, Artificial Sequence
  Description of Artificial Sequence: Synthetic oligonucleotide
  Target: ATXN1; (-) strand; PAM type: YTN; PAM sequence: CTT
atttgaaatagaacgattgc

SEQ ID NO: 170982 - DNA, 20 bp, Artificial Sequence
  Description of Artificial Sequence: Synthetic oligonucleotide
  Target: ATXN1; (-) strand; PAM type: YTN; PAM sequence: CTG
gtcccacttatttgaaatag

SEQ ID NO: 170983 - DNA, 20 bp, Artificial Sequence
  Description of Artificial Sequence: Synthetic oligonucleotide
  Target: ATXN1; (-) strand; PAM type: YTN; PAM sequence: CTG
tgggctggtcccacttattt

SEQ ID NO: 170984 - DNA, 20 bp, Artificial Sequence
  Description of Artificial Sequence: Synthetic oligonucleotide
  Target: ATXN1; (-) strand; PAM type: YTN; PAM sequence: CTG
tgagccctgtgggctggtcc

SEQ ID NO: 170985 - DNA, 20 bp, Artificial Sequence
  Description of Artificial Sequence: Synthetic oligonucleotide
  Target: ATXN1; (-) strand; PAM type: YTN; PAM sequence: TTG
tgtgcaatgaacctgtgagc

SEQ ID NO: 170986 - DNA, 20 bp, Artificial Sequence
  Description of Artificial Sequence: Synthetic oligonucleotide
  Target: ATXN1; (-) strand; PAM type: YTN; PAM sequence: TTA
gttgtgtgcaatgaacctgt

SEQ ID NO: 170987 - DNA, 20 bp, Artificial Sequence
  Description of Artificial Sequence: Synthetic oligonucleotide
  Target: ATXN1; (-) strand; PAM type: YTN; PAM sequence: TTT
agttgtgtgcaatgaacctg

SEQ ID NO: 170988 - DNA, 20 bp, Artificial Sequence
  Description of Artificial Sequence: Synthetic oligonucleotide
  Target: ATXN1; (-) strand; PAM type: YTN; PAM sequence: TTA
agcatttagttgtgtgcaat

SEQ ID NO: 170989 - DNA, 20 bp, Artificial Sequence
  Description of Artificial Sequence: Synthetic oligonucleotide
  Target: ATXN1; (-) strand; PAM type: YTN; PAM sequence: TTG
gaaggaacaggttaagcatt

SEQ ID NO: 170990 - DNA, 20 bp, Artificial Sequence
  Description of Artificial Sequence: Synthetic oligonucleotide
  Target: ATXN1; (-) strand; PAM type: YTN; PAM sequence: CTG
ttggaaggaacaggttaagc

SEQ ID NO: 170991 - DNA, 20 bp, Artificial Sequence
  Description of Artificial Sequence: Synthetic oligonucleotide
  Target: ATXN1; (-) strand; PAM type: YTN; PAM sequence: CTG
ctgttggaaggaacaggtta

SEQ ID NO: 170992 - DNA, 20 bp, Artificial Sequence
  Description of Artificial Sequence: Synthetic oligonucleotide
  Target: ATXN1; (-) strand; PAM type: YTN; PAM sequence: TTG
cacatgacacctgctgttgg

SEQ ID NO: 170993 - DNA, 20 bp, Artificial Sequence
  Description of Artificial Sequence: Synthetic oligonucleotide
  Target: ATXN1; (-) strand; PAM type: YTN; PAM sequence: CTA
gtcatgtcattgcacatgac

SEQ ID NO: 170994 - DNA, 20 bp, Artificial Sequence
  Description of Artificial Sequence: Synthetic oligonucleotide
  Target: ATXN1; (-) strand; PAM type: YTN; PAM sequence: CTG
ggctagtcatgtcattgcac

SEQ ID NO: 170995 - DNA, 20 bp, Artificial Sequence
  Description of Artificial Sequence: Synthetic oligonucleotide
  Target: ATXN1; (-) strand; PAM type: YTN; PAM sequence: CTG
atcctgggctagtcatgtca

SEQ ID NO: 170996 - DNA, 20 bp, Artificial Sequence
  Description of Artificial Sequence: Synthetic oligonucleotide
  Target: ATXN1; (-) strand; PAM type: YTN; PAM sequence: TTA
atactgatcctgggctagtc

SEQ ID NO: 170997 - DNA, 20 bp, Artificial Sequence
  Description of Artificial Sequence: Synthetic oligonucleotide
  Target: ATXN1; (-) strand; PAM type: YTN; PAM sequence: CTT
aatactgatcctgggctagt

SEQ ID NO: 170998 - DNA, 20 bp, Artificial Sequence
  Description of Artificial Sequence: Synthetic oligonucleotide
  Target: ATXN1; (-) strand; PAM type: YTN; PAM sequence: CTC
ttaatactgatcctgggcta

SEQ ID NO: 170999 - DNA, 20 bp, Artificial Sequence
  Description of Artificial Sequence: Synthetic oligonucleotide
  Target: ATXN1; (-) strand; PAM type: YTN; PAM sequence: TTA
caaaaggtgaacgtacacag

SEQ ID NO: 171000 - DNA, 20 bp, Artificial Sequence
  Description of Artificial Sequence: Synthetic oligonucleotide
  Target: ATXN1; (-) strand; PAM type: YTN; PAM sequence: TTT
acaaaaggtgaacgtacaca

SEQ ID NO: 171001 - DNA, 20 bp, Artificial Sequence
  Description of Artificial Sequence: Synthetic oligonucleotide
  Target: ATXN1; (-) strand; PAM type: YTN; PAM sequence: TTG
gtgcagtgagtcagtgagag

SEQ ID NO: 171002 - DNA, 20 bp, Artificial Sequence
  Description of Artificial Sequence: Synthetic oligonucleotide
  Target: ATXN1; (-) strand; PAM type: YTN; PAM sequence: CTT
ggtgcagtgagtcagtgaga

SEQ ID NO: 171003 - DNA, 20 bp, Artificial Sequence
  Description of Artificial Sequence: Synthetic oligonucleotide
  Target: ATXN1; (-) strand; PAM type: YTN; PAM sequence: TTG
ggaaatgaatagcaagaaca

SEQ ID NO: 171004 - DNA, 20 bp, Artificial Sequence
  Description of Artificial Sequence: Synthetic oligonucleotide
  Target: ATXN1; (-) strand; PAM type: YTN; PAM sequence: TTT
gggaaatgaatagcaagaac

SEQ ID NO: 171005 - DNA, 20 bp, Artificial Sequence
  Description of Artificial Sequence: Synthetic oligonucleotide
  Target: ATXN1; (-) strand; PAM type: YTN; PAM sequence: TTT
tgggaaatgaatagcaagaa

SEQ ID NO: 171006 - DNA, 20 bp, Artificial Sequence
  Description of Artificial Sequence: Synthetic oligonucleotide
  Target: ATXN1; (-) strand; PAM type: YTN; PAM sequence: CTA
attttgggaaatgaatagca

SEQ ID NO: 171007 - DNA, 20 bp, Artificial Sequence
  Description of Artificial Sequence: Synthetic oligonucleotide
  Target: ATXN1; (-) strand; PAM type: YTN; PAM sequence: TTG
cagtaaggaaatctaatttt

SEQ ID NO: 171008 - DNA, 20 bp, Artificial Sequence
  Description of Artificial Sequence: Synthetic oligonucleotide
  Target: ATXN1; (-) strand; PAM type: YTN; PAM sequence: CTT
gcagtaaggaaatctaattt

SEQ ID NO: 171009 - DNA, 20 bp, Artificial Sequence
  Description of Artificial Sequence: Synthetic oligonucleotide
  Target: ATXN1; (-) strand; PAM type: YTN; PAM sequence: TTC
ttgcagtaaggaaatctaat

SEQ ID NO: 171010 - DNA, 20 bp, Artificial Sequence
  Description of Artificial Sequence: Synthetic oligonucleotide
  Target: ATXN1; (-) strand; PAM type: YTN; PAM sequence: TTT
cttgcagtaaggaaatctaa

SEQ ID NO: 171011 - DNA, 20 bp, Artificial Sequence
  Description of Artificial Sequence: Synthetic oligonucleotide
  Target: ATXN1; (-) strand; PAM type: YTN; PAM sequence: CTG
tatgtatttcttgcagtaag

SEQ ID NO: 171012 - DNA, 20 bp, Artificial Sequence
  Description of Artificial Sequence: Synthetic oligonucleotide
  Target: ATXN1; (-) strand; PAM type: YTN; PAM sequence: TTA
ataatctgtatgtatttctt

SEQ ID NO: 171013 - DNA, 20 bp, Artificial Sequence
  Description of Artificial Sequence: Synthetic oligonucleotide
  Target: ATXN1; (-) strand; PAM type: YTN; PAM sequence: CTA
ttaataatctgtatgtattt

SEQ ID NO: 171014 - DNA, 20 bp, Artificial Sequence
  Description of Artificial Sequence: Synthetic oligonucleotide
  Target: ATXN1; (-) strand; PAM type: YTN; PAM sequence: TTA
aaataaggagtaggcctatt

SEQ ID NO: 171015 - DNA, 20 bp, Artificial Sequence
  Description of Artificial Sequence: Synthetic oligonucleotide
  Target: ATXN1; (-) strand; PAM type: YTN; PAM sequence: TTT
aaaataaggagtaggcctat

SEQ ID NO: 171016 - DNA, 20 bp, Artificial Sequence
  Description of Artificial Sequence: Synthetic oligonucleotide
  Target: ATXN1; (-) strand; PAM type: YTN; PAM sequence: TTA
tatttaaaataaggagtagg

SEQ ID NO: 171017 - DNA, 20 bp, Artificial Sequence
  Description of Artificial Sequence: Synthetic oligonucleotide
  Target: ATXN1; (-) strand; PAM type: YTN; PAM sequence: CTT
atatttaaaataaggagtag

SEQ ID NO: 171018 - DNA, 20 bp, Artificial Sequence
  Description of Artificial Sequence: Synthetic oligonucleotide
  Target: ATXN1; (-) strand; PAM type: YTN; PAM sequence: CTA
tccttatatttaaaataagg

SEQ ID NO: 171019 - DNA, 20 bp, Artificial Sequence
  Description of Artificial Sequence: Synthetic oligonucleotide
  Target: ATXN1; (-) strand; PAM type: YTN; PAM sequence: TTC
actatccttatatttaaaat

SEQ ID NO: 171020 - DNA, 20 bp, Artificial Sequence
  Description of Artificial Sequence: Synthetic oligonucleotide
  Target: ATXN1; (-) strand; PAM type: YTN; PAM sequence: CTT
cactatccttatatttaaaa

SEQ ID NO: 171021 - DNA, 20 bp, Artificial Sequence
  Description of Artificial Sequence: Synthetic oligonucleotide
  Target: ATXN1; (-) strand; PAM type: YTN; PAM sequence: TTG
aacaagcttcactatcctta

SEQ ID NO: 171022 - DNA, 20 bp, Artificial Sequence
  Description of Artificial Sequence: Synthetic oligonucleotide
  Target: ATXN1; (-) strand; PAM type: YTN; PAM sequence: CTT
gaacaagcttcactatcctt

SEQ ID NO: 171023 - DNA, 20 bp, Artificial Sequence
  Description of Artificial Sequence: Synthetic oligonucleotide
  Target: ATXN1; (-) strand; PAM type: YTN; PAM sequence: TTA
tgtcaccttgaacaagcttc

SEQ ID NO: 171024 - DNA, 20 bp, Artificial Sequence
  Description of Artificial Sequence: Synthetic oligonucleotide
  Target: ATXN1; (-) strand; PAM type: YTN; PAM sequence: TTT
atgtcaccttgaacaagctt

SEQ ID NO: 171025 - DNA, 20 bp, Artificial Sequence
  Description of Artificial Sequence: Synthetic oligonucleotide
  Target: ATXN1; (-) strand; PAM type: YTN; PAM sequence: TTT
tatgtcaccttgaacaagct

SEQ ID NO: 171026 - DNA, 20 bp, Artificial Sequence
  Description of Artificial Sequence: Synthetic oligonucleotide
  Target: ATXN1; (-) strand; PAM type: YTN; PAM sequence: TTT
ttatgtcaccttgaacaagc

SEQ ID NO: 171027 - DNA, 20 bp, Artificial Sequence
  Description of Artificial Sequence: Synthetic oligonucleotide
  Target: ATXN1; (-) strand; PAM type: YTN; PAM sequence: CTT
tttatgtcaccttgaacaag

SEQ ID NO: 171028 - DNA, 20 bp, Artificial Sequence
  Description of Artificial Sequence: Synthetic oligonucleotide
  Target: ATXN1; (-) strand; PAM type: YTN; PAM sequence: TTA
cagatactttttatgtcacc

SEQ ID NO: 171029 - DNA, 20 bp, Artificial Sequence
  Description of Artificial Sequence: Synthetic oligonucleotide
  Target: ATXN1; (-) strand; PAM type: YTN; PAM sequence: TTA
gccagacattacagatactt

SEQ ID NO: 171030 - DNA, 20 bp, Artificial Sequence
  Description of Artificial Sequence: Synthetic oligonucleotide
  Target: ATXN1; (-) strand; PAM type: YTN; PAM sequence: CTC
gtgttagccagacattacag

SEQ ID NO: 171031 - DNA, 20 bp, Artificial Sequence
  Description of Artificial Sequence: Synthetic oligonucleotide
  Target: ATXN1; (-) strand; PAM type: YTN; PAM sequence: CTG
ggaagctcgtgttagccaga

SEQ ID NO: 171032 - DNA, 20 bp, Artificial Sequence
  Description of Artificial Sequence: Synthetic oligonucleotide
  Target: ATXN1; (-) strand; PAM type: YTN; PAM sequence: TTA
aagcctgggaagctcgtgtt

SEQ ID NO: 171033 - DNA, 20 bp, Artificial Sequence
  Description of Artificial Sequence: Synthetic oligonucleotide
  Target: ATXN1; (-) strand; PAM type: YTN; PAM sequence: CTT
aaagcctgggaagctcgtgt

SEQ ID NO: 171034 - DNA, 20 bp, Artificial Sequence
  Description of Artificial Sequence: Synthetic oligonucleotide
  Target: ATXN1; (-) strand; PAM type: YTN; PAM sequence: CTA
acttaaagcctgggaagctc

SEQ ID NO: 171035 - DNA, 20 bp, Artificial Sequence
  Description of Artificial Sequence: Synthetic oligonucleotide
  Target: ATXN1; (-) strand; PAM type: YTN; PAM sequence: CTG
ctaacttaaagcctgggaag

SEQ ID NO: 171036 - DNA, 20 bp, Artificial Sequence
  Description of Artificial Sequence: Synthetic oligonucleotide
  Target: ATXN1; (-) strand; PAM type: YTN; PAM sequence: TTG
ggaccagctgctaacttaaa

SEQ ID NO: 171037 - DNA, 20 bp, Artificial Sequence
  Description of Artificial Sequence: Synthetic oligonucleotide
  Target: ATXN1; (-) strand; PAM type: YTN; PAM sequence: TTT
gggaccagctgctaacttaa

SEQ ID NO: 171038 - DNA, 20 bp, Artificial Sequence
  Description of Artificial Sequence: Synthetic oligonucleotide
  Target: ATXN1; (-) strand; PAM type: YTN; PAM sequence: CTG
tagtttgggaccagctgcta

SEQ ID NO: 171039 - DNA, 20 bp, Artificial Sequence
  Description of Artificial Sequence: Synthetic oligonucleotide
  Target: ATXN1; (-) strand; PAM type: YTN; PAM sequence: TTG
agtctgtagtttgggaccag

SEQ ID NO: 171040 - DNA, 20 bp, Artificial Sequence
  Description of Artificial Sequence: Synthetic oligonucleotide
  Target: ATXN1; (-) strand; PAM type: YTN; PAM sequence: CTT
gagtctgtagtttgggacca

SEQ ID NO: 171041 - DNA, 20 bp, Artificial Sequence
  Description of Artificial Sequence: Synthetic oligonucleotide
  Target: ATXN1; (-) strand; PAM type: YTN; PAM sequence: CTA
gtagcagtagggtggacttg

SEQ ID NO: 171042 - DNA, 20 bp, Artificial Sequence
  Description of Artificial Sequence: Synthetic oligonucleotide
  Target: ATXN1; (-) strand; PAM type: YTN; PAM sequence: TTA
gagtactagtagcagtaggg

SEQ ID NO: 171043 - DNA, 20 bp, Artificial Sequence
  Description of Artificial Sequence: Synthetic oligonucleotide
  Target: ATXN1; (-) strand; PAM type: YTN; PAM sequence: CTC
acagttagagtactagtagc

SEQ ID NO: 171044 - DNA, 20 bp, Artificial Sequence
  Description of Artificial Sequence: Synthetic oligonucleotide
  Target: ATXN1; (-) strand; PAM type: YTN; PAM sequence: CTA
tgggtcaaggatctcacagt

SEQ ID NO: 171045 - DNA, 20 bp, Artificial Sequence
  Description of Artificial Sequence: Synthetic oligonucleotide
  Target: ATXN1; (-) strand; PAM type: YTN; PAM sequence: TTG
ggaagtaaaacaagtacaga

SEQ ID NO: 171046 - DNA, 20 bp, Artificial Sequence
  Description of Artificial Sequence: Synthetic oligonucleotide
  Target: ATXN1; (-) strand; PAM type: YTN; PAM sequence: CTT
gggaagtaaaacaagtacag

SEQ ID NO: 171047 - DNA, 20 bp, Artificial Sequence
  Description of Artificial Sequence: Synthetic oligonucleotide
  Target: ATXN1; (-) strand; PAM type: YTN; PAM sequence: TTC
ttgggaagtaaaacaagtac

SEQ ID NO: 171048 - DNA, 20 bp, Artificial Sequence
  Description of Artificial Sequence: Synthetic oligonucleotide
  Target: ATXN1; (-) strand; PAM type: YTN; PAM sequence: TTG
ccagaagttcttgggaagta

SEQ ID NO: 171049 - DNA, 20 bp, Artificial Sequence
  Description of Artificial Sequence: Synthetic oligonucleotide
  Target: ATXN1; (-) strand; PAM type: YTN; PAM sequence: TTA
ccattgccagaagttcttgg

SEQ ID NO: 171050 - DNA, 20 bp, Artificial Sequence
  Description of Artificial Sequence: Synthetic oligonucleotide
  Target: ATXN1; (-) strand; PAM type: YTN; PAM sequence: TTC
agaggtgagaattaccattg

SEQ ID NO: 171051 - DNA, 20 bp, Artificial Sequence
  Description of Artificial Sequence: Synthetic oligonucleotide
  Target: ATXN1; (-) strand; PAM type: YTN; PAM sequence: CTG
aaaacatggcaatgaaaaaa

SEQ ID NO: 171052 - DNA, 20 bp, Artificial Sequence
  Description of Artificial Sequence: Synthetic oligonucleotide
  Target: ATXN1; (-) strand; PAM type: YTN; PAM sequence: TTA
gccaggaaggtgataggaca

SEQ ID NO: 171053 - DNA, 20 bp, Artificial Sequence
  Description of Artificial Sequence: Synthetic oligonucleotide
  Target: ATXN1; (-) strand; PAM type: YTN; PAM sequence: CTC
agtggggcccaagatgcagg

SEQ ID NO: 171054 - DNA, 20 bp, Artificial Sequence
  Description of Artificial Sequence: Synthetic oligonucleotide
  Target: ATXN1; (-) strand; PAM type: YTN; PAM sequence: CTC
tcagtggggcccaagatgca

SEQ ID NO: 171055 - DNA, 20 bp, Artificial Sequence
  Description of Artificial Sequence: Synthetic oligonucleotide
  Target: ATXN1; (-) strand; PAM type: YTN; PAM sequence: CTC
ccagcaaagctctcagtggg

SEQ ID NO: 171056 - DNA, 20 bp, Artificial Sequence
  Description of Artificial Sequence: Synthetic oligonucleotide
  Target: ATXN1; (-) strand; PAM type: YTN; PAM sequence: TTG
catgcatactcccagcaaag

SEQ ID NO: 171057 - DNA, 20 bp, Artificial Sequence
  Description of Artificial Sequence: Synthetic oligonucleotide
  Target: ATXN1; (-) strand; PAM type: YTN; PAM sequence: CTT
gcatgcatactcccagcaaa

SEQ ID NO: 171058 - DNA, 20 bp, Artificial Sequence
  Description of Artificial Sequence: Synthetic oligonucleotide
  Target: ATXN1; (-) strand; PAM type: YTN; PAM sequence: CTC
aggcatcccaaaggcagtgc

SEQ ID NO: 171059 - DNA, 20 bp, Artificial Sequence
  Description of Artificial Sequence: Synthetic oligonucleotide
  Target: ATXN1; (-) strand; PAM type: YTN; PAM sequence: TTA
tggaaatagtatgaactcag

SEQ ID NO: 171060 - DNA, 20 bp, Artificial Sequence
  Description of Artificial Sequence: Synthetic oligonucleotide
  Target: ATXN1; (-) strand; PAM type: YTN; PAM sequence: TTC
agggatgggcagttatggaa

SEQ ID NO: 171061 - DNA, 20 bp, Artificial Sequence
  Description of Artificial Sequence: Synthetic oligonucleotide
  Target: ATXN1; (-) strand; PAM type: YTN; PAM sequence: TTT
cagggatgggcagttatgga

SEQ ID NO: 171062 - DNA, 20 bp, Artificial Sequence
  Description of Artificial Sequence: Synthetic oligonucleotide
  Target: ATXN1; (-) strand; PAM type: YTN; PAM sequence: CTA
tttcagggatgggcagttat

SEQ ID NO: 171063 - DNA, 20 bp, Artificial Sequence
  Description of Artificial Sequence: Synthetic oligonucleotide
  Target: ATXN1; (-) strand; PAM type: YTN; PAM sequence: TTC
atctatttcagggatgggca

SEQ ID NO: 171064 - DNA, 20 bp, Artificial Sequence
  Description of Artificial Sequence: Synthetic oligonucleotide
  Target: ATXN1; (-) strand; PAM type: YTN; PAM sequence: CTG
ttcatctatttcagggatgg

SEQ ID NO: 171065 - DNA, 20 bp, Artificial Sequence
  Description of Artificial Sequence: Synthetic oligonucleotide
  Target: ATXN1; (-) strand; PAM type: YTN; PAM sequence: CTA
gagagaaggccactgttcat

SEQ ID NO: 171066 - DNA, 20 bp, Artificial Sequence
  Description of Artificial Sequence: Synthetic oligonucleotide
  Target: ATXN1; (-) strand; PAM type: YTN; PAM sequence: CTA
aactagagagaaggccactg

SEQ ID NO: 171067 - DNA, 20 bp, Artificial Sequence
  Description of Artificial Sequence: Synthetic oligonucleotide
  Target: ATXN1; (-) strand; PAM type: YTN; PAM sequence: TTC
taaactagagagaaggccac

SEQ ID NO: 171068 - DNA, 20 bp, Artificial Sequence
  Description of Artificial Sequence: Synthetic oligonucleotide
  Target: ATXN1; (-) strand; PAM type: YTN; PAM sequence: CTA
acaacccaagttctaaacta

SEQ ID NO: 171069 - DNA, 20 bp, Artificial Sequence
  Description of Artificial Sequence: Synthetic oligonucleotide
  Target: ATXN1; (-) strand; PAM type: YTN; PAM sequence: CTA
agatagacccaaggagtcta

SEQ ID NO: 171070 - DNA, 20 bp, Artificial Sequence
  Description of Artificial Sequence: Synthetic oligonucleotide
  Target: ATXN1; (-) strand; PAM type: YTN; PAM sequence: CTG
aaaacagggagagaagctaa

SEQ ID NO: 171071 - DNA, 20 bp, Artificial Sequence
  Description of Artificial Sequence: Synthetic oligonucleotide
  Target: ATXN1; (-) strand; PAM type: YTN; PAM sequence: CTA
gagatagataagccaaatgg

SEQ ID NO: 171072 - DNA, 20 bp, Artificial Sequence
  Description of Artificial Sequence: Synthetic oligonucleotide
  Target: ATXN1; (-) strand; PAM type: YTN; PAM sequence: CTA
ccacggatcatcagggagat

SEQ ID NO: 171073 - DNA, 20 bp, Artificial Sequence
  Description of Artificial Sequence: Synthetic oligonucleotide
  Target: ATXN1; (-) strand; PAM type: YTN; PAM sequence: TTA
acgccactaccacggatcat

SEQ ID NO: 171074 - DNA, 20 bp, Artificial Sequence
  Description of Artificial Sequence: Synthetic oligonucleotide
  Target: ATXN1; (-) strand; PAM type: YTN; PAM sequence: TTC
gtaaatggattaacgccact

SEQ ID NO: 171075 - DNA, 20 bp, Artificial Sequence
  Description of Artificial Sequence: Synthetic oligonucleotide
  Target: ATXN1; (-) strand; PAM type: YTN; PAM sequence: TTT
cgtaaatggattaacgccac

SEQ ID NO: 171076 - DNA, 20 bp, Artificial Sequence
  Description of Artificial Sequence: Synthetic oligonucleotide
  Target: ATXN1; (-) strand; PAM type: YTN; PAM sequence: TTT
tcgtaaatggattaacgcca

SEQ ID NO: 171077 - DNA, 20 bp, Artificial Sequence
  Description of Artificial Sequence: Synthetic oligonucleotide
  Target: ATXN1; (-) strand; PAM type: YTN; PAM sequence: TTT
ttcgtaaatggattaacgcc

SEQ ID NO: 171078 - DNA, 20 bp, Artificial Sequence
  Description of Artificial Sequence: Synthetic oligonucleotide
  Target: ATXN1; (-) strand; PAM type: YTN; PAM sequence: TTG
tttttcgtaaatggattaac

SEQ ID NO: 171079 - DNA, 20 bp, Artificial Sequence
  Description of Artificial Sequence: Synthetic oligonucleotide
  Target: ATXN1; (-) strand; PAM type: YTN; PAM sequence: CTT
gtttttcgtaaatggattaa

SEQ ID NO: 171080 - DNA, 20 bp, Artificial Sequence
  Description of Artificial Sequence: Synthetic oligonucleotide
  Target: ATXN1; (-) strand; PAM type: YTN; PAM sequence: TTG
tcttgtttttcgtaaatgga

SEQ ID NO: 171081 - DNA, 20 bp, Artificial Sequence
  Description of Artificial Sequence: Synthetic oligonucleotide
  Target: ATXN1; (-) strand; PAM type: YTN; PAM sequence: CTA
tgttgtcttgtttttcgtaa

SEQ ID NO: 171082 - DNA, 20 bp, Artificial Sequence
  Description of Artificial Sequence: Synthetic oligonucleotide
  Target: ATXN1; (-) strand; PAM type: YTN; PAM sequence: TTG
aatctatgttgtcttgtttt

SEQ ID NO: 171083 - DNA, 20 bp, Artificial Sequence
  Description of Artificial Sequence: Synthetic oligonucleotide
  Target: ATXN1; (-) strand; PAM type: YTN; PAM sequence: CTT
gaatctatgttgtcttgttt

SEQ ID NO: 171084 - DNA, 20 bp, Artificial Sequence
  Description of Artificial Sequence: Synthetic oligonucleotide
  Target: ATXN1; (-) strand; PAM type: YTN; PAM sequence: CTC
cttgaatctatgttgtcttg

SEQ ID NO: 171085 - DNA, 20 bp, Artificial Sequence
  Description of Artificial Sequence: Synthetic oligonucleotide
  Target: ATXN1; (-) strand; PAM type: YTN; PAM sequence: TTG
actccttgaatctatgttgt

SEQ ID NO: 171086 - DNA, 20 bp, Artificial Sequence
  Description of Artificial Sequence: Synthetic oligonucleotide
  Target: ATXN1; (-) strand; PAM type: YTN; PAM sequence: TTT
gactccttgaatctatgttg

SEQ ID NO: 171087 - DNA, 20 bp, Artificial Sequence
  Description of Artificial Sequence: Synthetic oligonucleotide
  Target: ATXN1; (-) strand; PAM type: YTN; PAM sequence: TTA
tttgactccttgaatctatg

SEQ ID NO: 171088 - DNA, 20 bp, Artificial Sequence
  Description of Artificial Sequence: Synthetic oligonucleotide
  Target: ATXN1; (-) strand; PAM type: YTN; PAM sequence: TTT
atttgactccttgaatctat

SEQ ID NO: 171089 - DNA, 20 bp, Artificial Sequence
  Description of Artificial Sequence: Synthetic oligonucleotide
  Target: ATXN1; (-) strand; PAM type: YTN; PAM sequence: TTG
tgtgcatgcgtgtgtgtgtg

SEQ ID NO: 171090 - DNA, 20 bp, Artificial Sequence
  Description of Artificial Sequence: Synthetic oligonucleotide
  Target: ATXN1; (-) strand; PAM type: YTN; PAM sequence: CTT
gtgtgcatgcgtgtgtgtgt

SEQ ID NO: 171091 - DNA, 20 bp, Artificial Sequence
  Description of Artificial Sequence: Synthetic oligonucleotide
  Target: ATXN1; (-) strand; PAM type: YTN; PAM sequence: TTG
cttgtgtgcatgcgtgtgtg

SEQ ID NO: 171092 - DNA, 20 bp, Artificial Sequence
  Description of Artificial Sequence: Synthetic oligonucleotide
  Target: ATXN1; (-) strand; PAM type: YTN; PAM sequence: TTC
attgcttgtgtgcatgcgtg

SEQ ID NO: 171093 - DNA, 20 bp, Artificial Sequence
  Description of Artificial Sequence: Synthetic oligonucleotide
  Target: ATXN1; (-) strand; PAM type: YTN; PAM sequence: CTT
cattgcttgtgtgcatgcgt

SEQ ID NO: 171094 - DNA, 20 bp, Artificial Sequence
  Description of Artificial Sequence: Synthetic oligonucleotide
  Target: ATXN1; (-) strand; PAM type: YTN; PAM sequence: TTC
catcttcattgcttgtgtgc

SEQ ID NO: 171095 - DNA, 20 bp, Artificial Sequence
  Description of Artificial Sequence: Synthetic oligonucleotide
  Target: ATXN1; (-) strand; PAM type: YTN; PAM sequence: CTG
ttccatcttcattgcttgtg

SEQ ID NO: 171096 - DNA, 20 bp, Artificial Sequence
  Description of Artificial Sequence: Synthetic oligonucleotide
  Target: ATXN1; (-) strand; PAM type: YTN; PAM sequence: CTG
ctgttccatcttcattgctt

SEQ ID NO: 171097 - DNA, 20 bp, Artificial Sequence
  Description of Artificial Sequence: Synthetic oligonucleotide
  Target: ATXN1; (-) strand; PAM type: YTN; PAM sequence: CTC
tgctgttccatcttcattgc

SEQ ID NO: 171098 - DNA, 20 bp, Artificial Sequence
  Description of Artificial Sequence: Synthetic oligonucleotide
  Target: ATXN1; (-) strand; PAM type: YTN; PAM sequence: CTC
tctgctgttccatcttcatt

SEQ ID NO: 171099 - DNA, 20 bp, Artificial Sequence
  Description of Artificial Sequence: Synthetic oligonucleotide
  Target: ATXN1; (-) strand; PAM type: YTN; PAM sequence: CTG
gtgtactctctgctgttcca

SEQ ID NO: 171100 - DNA, 20 bp, Artificial Sequence
  Description of Artificial Sequence: Synthetic oligonucleotide
  Target: ATXN1; (-) strand; PAM type: YTN; PAM sequence: TTG
tctggtgtactctctgctgt

SEQ ID NO: 171101 - DNA, 20 bp, Artificial Sequence
  Description of Artificial Sequence: Synthetic oligonucleotide
  Target: ATXN1; (-) strand; PAM type: YTN; PAM sequence: CTT
gtctggtgtactctctgctg

SEQ ID NO: 171102 - DNA, 20 bp, Artificial Sequence
  Description of Artificial Sequence: Synthetic oligonucleotide
  Target: ATXN1; (-) strand; PAM type: YTN; PAM sequence: TTC
ttgtctggtgtactctctgc

SEQ ID NO: 171103 - DNA, 20 bp, Artificial Sequence
  Description of Artificial Sequence: Synthetic oligonucleotide
  Target: ATXN1; (-) strand; PAM type: YTN; PAM sequence: CTT
cttgtctggtgtactctctg

SEQ ID NO: 171104 - DNA, 20 bp, Artificial Sequence
  Description of Artificial Sequence: Synthetic oligonucleotide
  Target: ATXN1; (-) strand; PAM type: YTN; PAM sequence: TTA
cggcttcttgtctggtgtac

SEQ ID NO: 171105 - DNA, 20 bp, Artificial Sequence
  Description of Artificial Sequence: Synthetic oligonucleotide
  Target: ATXN1; (-) strand; PAM type: YTN; PAM sequence: CTT
acggcttcttgtctggtgta

SEQ ID NO: 171106 - DNA, 20 bp, Artificial Sequence
  Description of Artificial Sequence: Synthetic oligonucleotide
  Target: ATXN1; (-) strand; PAM type: YTN; PAM sequence: CTA
gaaccgacacttacggcttc

SEQ ID NO: 171107 - DNA, 20 bp, Artificial Sequence
  Description of Artificial Sequence: Synthetic oligonucleotide
  Target: ATXN1; (-) strand; PAM type: YTN; PAM sequence: TTG
gaactagaaccgacacttac

SEQ ID NO: 171108 - DNA, 20 bp, Artificial Sequence
  Description of Artificial Sequence: Synthetic oligonucleotide
  Target: ATXN1; (-) strand; PAM type: YTN; PAM sequence: CTG
cagtggagaggaattggaac

SEQ ID NO: 171109 - DNA, 20 bp, Artificial Sequence
  Description of Artificial Sequence: Synthetic oligonucleotide
  Target: ATXN1; (-) strand; PAM type: YTN; PAM sequence: CTG
agatgctgcagtggagagga

SEQ ID NO: 171110 - DNA, 20 bp, Artificial Sequence
  Description of Artificial Sequence: Synthetic oligonucleotide
  Target: ATXN1; (-) strand; PAM type: YTN; PAM sequence: TTA
catctgagatgctgcagtgg

SEQ ID NO: 171111 - DNA, 20 bp, Artificial Sequence
  Description of Artificial Sequence: Synthetic oligonucleotide
  Target: ATXN1; (-) strand; PAM type: YTN; PAM sequence: TTT
acatctgagatgctgcagtg

SEQ ID NO: 171112 - DNA, 20 bp, Artificial Sequence
  Description of Artificial Sequence: Synthetic oligonucleotide
  Target: ATXN1; (-) strand; PAM type: YTN; PAM sequence: CTG
acgccagtttacatctgaga

SEQ ID NO: 171113 - DNA, 20 bp, Artificial Sequence
  Description of Artificial Sequence: Synthetic oligonucleotide
  Target: ATXN1; (-) strand; PAM type: YTN; PAM sequence: TTA
ctgacgccagtttacatctg

SEQ ID NO: 171114 - DNA, 20 bp, Artificial Sequence
  Description of Artificial Sequence: Synthetic oligonucleotide
  Target: ATXN1; (-) strand; PAM type: YTN; PAM sequence: CTG
ttactgacgccagtttacat

SEQ ID NO: 171115 - DNA, 20 bp, Artificial Sequence
  Description of Artificial Sequence: Synthetic oligonucleotide
  Target: ATXN1; (-) strand; PAM type: YTN; PAM sequence: CTG
ggaggtggatgacaggacct

SEQ ID NO: 171116 - DNA, 20 bp, Artificial Sequence
  Description of Artificial Sequence: Synthetic oligonucleotide
  Target: ATXN1; (-) strand; PAM type: YTN; PAM sequence: TTC
ctgggaggtggatgacagga

SEQ ID NO: 171117 - DNA, 20 bp, Artificial Sequence
  Description of Artificial Sequence: Synthetic oligonucleotide
  Target: ATXN1; (-) strand; PAM type: YTN; PAM sequence: TTT
cctgggaggtggatgacagg

SEQ ID NO: 171118 - DNA, 20 bp, Artificial Sequence
  Description of Artificial Sequence: Synthetic oligonucleotide
  Target: ATXN1; (-) strand; PAM type: YTN; PAM sequence: TTT
tcctgggaggtggatgacag

SEQ ID NO: 171119 - DNA, 20 bp, Artificial Sequence
  Description of Artificial Sequence: Synthetic oligonucleotide
  Target: ATXN1; (-) strand; PAM type: YTN; PAM sequence: TTG
acaattttcctgggaggtgg

SEQ ID NO: 171120 - DNA, 20 bp, Artificial Sequence
  Description of Artificial Sequence: Synthetic oligonucleotide
  Target: ATXN1; (-) strand; PAM type: YTN; PAM sequence: TTT
gacaattttcctgggaggtg

SEQ ID NO: 171121 - DNA, 20 bp, Artificial Sequence
  Description of Artificial Sequence: Synthetic oligonucleotide
  Target: ATXN1; (-) strand; PAM type: YTN; PAM sequence: CTT
tgacaattttcctgggaggt

SEQ ID NO: 171122 - DNA, 20 bp, Artificial Sequence
  Description of Artificial Sequence: Synthetic oligonucleotide
  Target: ATXN1; (-) strand; PAM type: YTN; PAM sequence: TTA
tctttgacaattttcctggg

SEQ ID NO: 171123 - DNA, 20 bp, Artificial Sequence
  Description of Artificial Sequence: Synthetic oligonucleotide
  Target: ATXN1; (-) strand; PAM type: YTN; PAM sequence: CTA
ttatctttgacaattttcct

SEQ ID NO: 171124 - DNA, 20 bp, Artificial Sequence
  Description of Artificial Sequence: Synthetic oligonucleotide
  Target: ATXN1; (-) strand; PAM type: YTN; PAM sequence: CTG
gccataactattatctttga

SEQ ID NO: 171125 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccacgcc

SEQ ID NO: 171126 - DNA, 20 bp, Artificial Sequence
  Description of Artificial Sequence: Synthetic oligonucleotide
  Target: ATXN1; (-) strand; PAM type: YTN; PAM sequence: CTC
ccaaagtggtgggattacag

SEQ ID NO: 171127 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtggtggga

SEQ ID NO: 171128 - DNA, 20 bp, Artificial Sequence
  Description of Artificial Sequence: Synthetic oligonucleotide
  Target: ATXN1; (-) strand; PAM type: YTN; PAM sequence: CTG
cctcggcctcccaaagtggt

SEQ ID NO: 171129 - DNA, 20 bp, Artificial Sequence
  Description of Artificial Sequence: Synthetic oligonucleotide
  Target: ATXN1; (-) strand; PAM type: YTN; PAM sequence: TTC
acctgcctcggcctcccaaa

SEQ ID NO: 171130 - DNA, 20 bp, Artificial Sequence
  Description of Artificial Sequence: Synthetic oligonucleotide
  Target: ATXN1; (-) strand; PAM type: YTN; PAM sequence: CTC
agatggttcacctgcctcgg

SEQ ID NO: 171131 - DNA, 20 bp, Artificial Sequence
  Description of Artificial Sequence: Synthetic oligonucleotide
  Target: ATXN1; (-) strand; PAM type: YTN; PAM sequence: CTC
ccaacctcagatggttcacc

SEQ ID NO: 171132 - DNA, 20 bp, Artificial Sequence
  Description of Artificial Sequence: Synthetic oligonucleotide
  Target: ATXN1; (-) strand; PAM type: YTN; PAM sequence: CTC
aaactcccaacctcagatgg

SEQ ID NO: 171133 - DNA, 20 bp, Artificial Sequence
  Description of Artificial Sequence: Synthetic oligonucleotide
  Target: ATXN1; (-) strand; PAM type: YTN; PAM sequence: CTG
atctcaaactcccaacctca

SEQ ID NO: 171134 - DNA, 20 bp, Artificial Sequence
  Description of Artificial Sequence: Synthetic oligonucleotide
  Target: ATXN1; (-) strand; PAM type: YTN; PAM sequence: TTG
tccaggctgatctcaaactc

SEQ ID NO: 171135 - DNA, 20 bp, Artificial Sequence
  Description of Artificial Sequence: Synthetic oligonucleotide
  Target: ATXN1; (-) strand; PAM type: YTN; PAM sequence: TTA
tccatgttgtccaggctgat

SEQ ID NO: 171136 - DNA, 20 bp, Artificial Sequence
  Description of Artificial Sequence: Synthetic oligonucleotide
  Target: ATXN1; (-) strand; PAM type: YTN; PAM sequence: TTT
atccatgttgtccaggctga

SEQ ID NO: 171137 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtttatcca

SEQ ID NO: 171138 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtttatcc

SEQ ID NO: 171139 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtttatc

SEQ ID NO: 171140 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtttat

SEQ ID NO: 171141 - DNA, 20 bp, Artificial Sequence
  Description of Artificial Sequence: Synthetic oligonucleotide
  Target: ATXN1; (-) strand; PAM type: YTN; PAM sequence: TTA
tatttttagtagagatgggg

SEQ ID NO: 171142 - DNA, 20 bp, Artificial Sequence
  Description of Artificial Sequence: Synthetic oligonucleotide
  Target: ATXN1; (-) strand; PAM type: YTN; PAM sequence: TTT
atatttttagtagagatggg

SEQ ID NO: 171143 - DNA, 20 bp, Artificial Sequence
  Description of Artificial Sequence: Synthetic oligonucleotide
  Target: ATXN1; (-) strand; PAM type: YTN; PAM sequence: TTT
tatatttttagtagagatgg

SEQ ID NO: 171144 - DNA, 20 bp, Artificial Sequence
  Description of Artificial Sequence: Synthetic oligonucleotide
  Target: ATXN1; (-) strand; PAM type: YTN; PAM sequence: TTT
ttatatttttagtagagatg

SEQ ID NO: 171145 - DNA, 20 bp, Artificial Sequence
  Description of Artificial Sequence: Synthetic oligonucleotide
  Target: ATXN1; (-) strand; PAM type: YTN; PAM sequence: TTT
tttatatttttagtagagat

SEQ ID NO: 171146 - DNA, 20 bp, Artificial Sequence
  Description of Artificial Sequence: Synthetic oligonucleotide
  Target: ATXN1; (-) strand; PAM type: YTN; PAM sequence: CTA
attttttatatttttagtag

SEQ ID NO: 171147 - DNA, 20 bp, Artificial Sequence
  Description of Artificial Sequence: Synthetic oligonucleotide
  Target: ATXN1; (-) strand; PAM type: YTN; PAM sequence: CTA
cgcccagctaattttttata

SEQ ID NO: 171148 - DNA, 20 bp, Artificial Sequence
  Description of Artificial Sequence: Synthetic oligonucleotide
  Target: ATXN1; (-) strand; PAM type: YTN; PAM sequence: CTC
ctacgcccagctaatttttt

SEQ ID NO: 171149 - DNA, 20 bp, Artificial Sequence
  Description of Artificial Sequence: Synthetic oligonucleotide
  Target: ATXN1; (-) strand; PAM type: YTN; PAM sequence: TTA
cagacgtgtgctcctacgcc

SEQ ID NO: 171150 - DNA, 20 bp, Artificial Sequence
  Description of Artificial Sequence: Synthetic oligonucleotide
  Target: ATXN1; (-) strand; PAM type: YTN; PAM sequence: CTG
ggattacagacgtgtgctcc

SEQ ID NO: 171151 - DNA, 20 bp, Artificial Sequence
  Description of Artificial Sequence: Synthetic oligonucleotide
  Target: ATXN1; (-) strand; PAM type: YTN; PAM sequence: TTA
gctgggattacagacgtgtg

SEQ ID NO: 171152 - DNA, 20 bp, Artificial Sequence
  Description of Artificial Sequence: Synthetic oligonucleotide
  Target: ATXN1; (-) strand; PAM type: YTN; PAM sequence: CTG
attagctgggattacagacg

SEQ ID NO: 171153 - DNA, 20 bp, Artificial Sequence
  Description of Artificial Sequence: Synthetic oligonucleotide
  Target: ATXN1; (-) strand; PAM type: YTN; PAM sequence: CTC
ctgattagctgggattacag

SEQ ID NO: 171154 - DNA, 20 bp, Artificial Sequence
  Description of Artificial Sequence: Synthetic oligonucleotide
  Target: ATXN1; (-) strand; PAM type: YTN; PAM sequence: CTC
agcctcctgattagctggga

SEQ ID NO: 171155 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcctgattagct

SEQ ID NO: 171156 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcctgatta

SEQ ID NO: 171157 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcctgat

SEQ ID NO: 171158 - DNA, 20 bp, Artificial Sequence
  Description of Artificial Sequence: Synthetic oligonucleotide
  Target: ATXN1; (-) strand; PAM type: YTN; PAM sequence: TTC
atgtgattctcctgcctcag

SEQ ID NO: 171159 - DNA, 20 bp, Artificial Sequence
  Description of Artificial Sequence: Synthetic oligonucleotide
  Target: ATXN1; (-) strand; PAM type: YTN; PAM sequence: CTC
ccaggttcatgtgattctcc

SEQ ID NO: 171160 - DNA, 20 bp, Artificial Sequence
  Description of Artificial Sequence: Synthetic oligonucleotide
  Target: ATXN1; (-) strand; PAM type: YTN; PAM sequence: CTC
cgcctcccaggttcatgtga

SEQ ID NO: 171161 - DNA, 20 bp, Artificial Sequence
  Description of Artificial Sequence: Synthetic oligonucleotide
  Target: ATXN1; (-) strand; PAM type: YTN; PAM sequence: CTG
caacctccgcctcccaggtt

SEQ ID NO: 171162 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccgcctccca

SEQ ID NO: 171163 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctccgcc

SEQ ID NO: 171164 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtgacgcaatctc

SEQ ID NO: 171165 - DNA, 20 bp, Artificial Sequence
  Description of Artificial Sequence: Synthetic oligonucleotide
  Target: ATXN1; (-) strand; PAM type: YTN; PAM sequence: CTG
tgtcacccaggctggagtgc

SEQ ID NO: 171166 - DNA, 20 bp, Artificial Sequence
  Description of Artificial Sequence: Synthetic oligonucleotide
  Target: ATXN1; (-) strand; PAM type: YTN; PAM sequence: TTG
ctgtgtcacccaggctggag

SEQ ID NO: 171167 - DNA, 20 bp, Artificial Sequence
  Description of Artificial Sequence: Synthetic oligonucleotide
  Target: ATXN1; (-) strand; PAM type: YTN; PAM sequence: CTT
gctgtgtcacccaggctgga

SEQ ID NO: 171168 - DNA, 20 bp, Artificial Sequence
  Description of Artificial Sequence: Synthetic oligonucleotide
  Target: ATXN1; (-) strand; PAM type: YTN; PAM sequence: TTG
agatggagtcttgctgtgtc

SEQ ID NO: 171169 - DNA, 20 bp, Artificial Sequence
  Description of Artificial Sequence: Synthetic oligonucleotide
  Target: ATXN1; (-) strand; PAM type: YTN; PAM sequence: TTT
gagatggagtcttgctgtgt

SEQ ID NO: 171170 - DNA, 20 bp, Artificial Sequence
  Description of Artificial Sequence: Synthetic oligonucleotide
  Target: ATXN1; (-) strand; PAM type: YTN; PAM sequence: TTT
tgagatggagtcttgctgtg

SEQ ID NO: 171171 - DNA, 20 bp, Artificial Sequence
  Description of Artificial Sequence: Synthetic oligonucleotide
  Target: ATXN1; (-) strand; PAM type: YTN; PAM sequence: TTT
ttgagatggagtcttgctgt

SEQ ID NO: 171172 - DNA, 20 bp, Artificial Sequence
  Description of Artificial Sequence: Synthetic oligonucleotide
  Target: ATXN1; (-) strand; PAM type: YTN; PAM sequence: TTT
tttgagatggagtcttgctg

SEQ ID NO: 171173 - DNA, 20 bp, Artificial Sequence
  Description of Artificial Sequence: Synthetic oligonucleotide
  Target: ATXN1; (-) strand; PAM type: YTN; PAM sequence: TTT
ttttgagatggagtcttgct

SEQ ID NO: 171174 - DNA, 20 bp, Artificial Sequence
  Description of Artificial Sequence: Synthetic oligonucleotide
  Target: ATXN1; (-) strand; PAM type: YTN; PAM sequence: TTT
tttttgagatggagtcttgc

SEQ ID NO: 171175 - DNA, 20 bp, Artificial Sequence
  Description of Artificial Sequence: Synthetic oligonucleotide
  Target: ATXN1; (-) strand; PAM type: YTN; PAM sequence: TTT
ttttttgagatggagtcttg

SEQ ID NO: 171176 - DNA, 20 bp, Artificial Sequence
  Description of Artificial Sequence: Synthetic oligonucleotide
  Target: ATXN1; (-) strand; PAM type: YTN; PAM sequence: TTT
tttttttgagatggagtctt

SEQ ID NO: 171177 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagatggagtct

SEQ ID NO: 171178 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagatggagtc

SEQ ID NO: 171179 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagatggagt

SEQ ID NO: 171180 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagatggag

SEQ ID NO: 171181 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagatgga

SEQ ID NO: 171182 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagatgg

SEQ ID NO: 171183 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagatg

SEQ ID NO: 171184 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgagat

SEQ ID NO: 171185 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgaga

SEQ ID NO: 171186 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgag

SEQ ID NO: 171187 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttga

SEQ ID NO: 171188 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttg

SEQ ID NO: 171189 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 171190 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttttttt

SEQ ID NO: 171191 - DNA, 20 bp, Artificial Sequence
  Description of Artificial Sequence: Synthetic oligonucleotide
  Target: ATXN1; (-) strand; PAM type: YTN; PAM sequence: TTC
ataacttttttttttttttt

SEQ ID NO: 171192 - DNA, 20 bp, Artificial Sequence
  Description of Artificial Sequence: Synthetic oligonucleotide
  Target: ATXN1; (-) strand; PAM type: YTN; PAM sequence: CTT
cataactttttttttttttt

SEQ ID NO: 171193 - DNA, 20 bp, Artificial Sequence
  Description of Artificial Sequence: Synthetic oligonucleotide
  Target: ATXN1; (-) strand; PAM type: YTN; PAM sequence: TTC
agaagaccttcataactttt

SEQ ID NO: 171194 - DNA, 20 bp, Artificial Sequence
  Description of Artificial Sequence: Synthetic oligonucleotide
  Target: ATXN1; (-) strand; PAM type: YTN; PAM sequence: TTT
cagaagaccttcataacttt

SEQ ID NO: 171195 - DNA, 20 bp, Artificial Sequence
  Description of Artificial Sequence: Synthetic oligonucleotide
  Target: ATXN1; (-) strand; PAM type: YTN; PAM sequence: TTT
tcagaagaccttcataactt

SEQ ID NO: 171196 - DNA, 20 bp, Artificial Sequence
  Description of Artificial Sequence: Synthetic oligonucleotide
  Target: ATXN1; (-) strand; PAM type: YTN; PAM sequence: TTG
ttttcagaagaccttcataa

SEQ ID NO: 171197 - DNA, 20 bp, Artificial Sequence
  Description of Artificial Sequence: Synthetic oligonucleotide
  Target: ATXN1; (-) strand; PAM type: YTN; PAM sequence: CTT
gttttcagaagaccttcata

SEQ ID NO: 171198 - DNA, 20 bp, Artificial Sequence
  Description of Artificial Sequence: Synthetic oligonucleotide
  Target: ATXN1; (-) strand; PAM type: YTN; PAM sequence: TTC
ttgttttcagaagaccttca

SEQ ID NO: 171199 - DNA, 20 bp, Artificial Sequence
  Description of Artificial Sequence: Synthetic oligonucleotide
  Target: ATXN1; (-) strand; PAM type: YTN; PAM sequence: TTT
cttgttttcagaagaccttc

SEQ ID NO: 171200 - DNA, 20 bp, Artificial Sequence
  Description of Artificial Sequence: Synthetic oligonucleotide
  Target: ATXN1; (-) strand; PAM type: YTN; PAM sequence: TTT
tcttgttttcagaagacctt

SEQ ID NO: 171201 - DNA, 20 bp, Artificial Sequence
  Description of Artificial Sequence: Synthetic oligonucleotide
  Target: ATXN1; (-) strand; PAM type: YTN; PAM sequence: CTG
aatagtgttttcttgttttc

SEQ ID NO: 171202 - DNA, 20 bp, Artificial Sequence
  Description of Artificial Sequence: Synthetic oligonucleotide
  Target: ATXN1; (-) strand; PAM type: YTN; PAM sequence: TTC
atctgaatagtgttttcttg

SEQ ID NO: 171203 - DNA, 20 bp, Artificial Sequence
  Description of Artificial Sequence: Synthetic oligonucleotide
  Target: ATXN1; (-) strand; PAM type: YTN; PAM sequence: TTT
catctgaatagtgttttctt

SEQ ID NO: 171204 - DNA, 20 bp, Artificial Sequence
  Description of Artificial Sequence: Synthetic oligonucleotide
  Target: ATXN1; (-) strand; PAM type: YTN; PAM sequence: TTT
tcatctgaatagtgttttct

SEQ ID NO: 171205 - DNA, 20 bp, Artificial Sequence
  Description of Artificial Sequence: Synthetic oligonucleotide
  Target: ATXN1; (-) strand; PAM type: YTN; PAM sequence: CTA
taaatataatagttttcatc

SEQ ID NO: 171206 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaatagtaatctata

SEQ ID NO: 171207 - DNA, 20 bp, Artificial Sequence
  Description of Artificial Sequence: Synthetic oligonucleotide
  Target: ATXN1; (-) strand; PAM type: YTN; PAM sequence: TTT
aaaaaaaaatagtaatctat

SEQ ID NO: 171208 - DNA, 20 bp, Artificial Sequence
  Description of Artificial Sequence: Synthetic oligonucleotide
  Target: ATXN1; (-) strand; PAM type: YTN; PAM sequence: TTT
taaaaaaaaatagtaatcta

SEQ ID NO: 171209 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaaaaatagtaatct

SEQ ID NO: 171210 - DNA, 20 bp, Artificial Sequence
  Description of Artificial Sequence: Synthetic oligonucleotide
  Target: ATXN1; (-) strand; PAM type: YTN; PAM sequence: TTT
tttaaaaaaaaatagtaatc

SEQ ID NO: 171211 - DNA, 20 bp, Artificial Sequence
  Description of Artificial Sequence: Synthetic oligonucleotide
  Target: ATXN1; (-) strand; PAM type: YTN; PAM sequence: TTT
ttttaaaaaaaaatagtaat

SEQ ID NO: 171212 - DNA, 20 bp, Artificial Sequence
  Description of Artificial Sequence: Synthetic oligonucleotide
  Target: ATXN1; (-) strand; PAM type: YTN; PAM sequence: TTT
tttttaaaaaaaaatagtaa

SEQ ID NO: 171213 - DNA, 20 bp, Artificial Sequence
  Description of Artificial Sequence: Synthetic oligonucleotide
  Target: ATXN1; (-) strand; PAM type: YTN; PAM sequence: CTT
ttttttaaaaaaaaatagta

SEQ ID NO: 171214 - DNA, 20 bp, Artificial Sequence
  Description of Artificial Sequence: Synthetic oligonucleotide
  Target: ATXN1; (-) strand; PAM type: YTN; PAM sequence: TTC
ttttttttaaaaaaaaatag

SEQ ID NO: 171215 - DNA, 20 bp, Artificial Sequence
  Description of Artificial Sequence: Synthetic oligonucleotide
  Target: ATXN1; (-) strand; PAM type: YTN; PAM sequence: CTT
cttttttttaaaaaaaaata

SEQ ID NO: 171216 - DNA, 20 bp, Artificial Sequence
  Description of Artificial Sequence: Synthetic oligonucleotide
  Target: ATXN1; (-) strand; PAM type: YTN; PAM sequence: TTC
aaagaagagcttcttttttt

SEQ ID NO: 171217 - DNA, 20 bp, Artificial Sequence
  Description of Artificial Sequence: Synthetic oligonucleotide
  Target: ATXN1; (-) strand; PAM type: YTN; PAM sequence: TTA
taggtaattcaaagaagagc

SEQ ID NO: 171218 - DNA, 20 bp, Artificial Sequence
  Description of Artificial Sequence: Synthetic oligonucleotide
  Target: ATXN1; (-) strand; PAM type: YTN; PAM sequence: TTG
cattataggtaattcaaaga

SEQ ID NO: 171219 - DNA, 20 bp, Artificial Sequence
  Description of Artificial Sequence: Synthetic oligonucleotide
  Target: ATXN1; (-) strand; PAM type: YTN; PAM sequence: CTG
ttgcattataggtaattcaa

SEQ ID NO: 171220 - DNA, 20 bp, Artificial Sequence
  Description of Artificial Sequence: Synthetic oligonucleotide
  Target: ATXN1; (-) strand; PAM type: YTN; PAM sequence: CTG
ctgttgcattataggtaatt

SEQ ID NO: 171221 - DNA, 20 bp, Artificial Sequence
  Description of Artificial Sequence: Synthetic oligonucleotide
  Target: ATXN1; (-) strand; PAM type: YTN; PAM sequence: TTG
atggtgctgctgttgcatta

SEQ ID NO: 171222 - DNA, 20 bp, Artificial Sequence
  Description of Artificial Sequence: Synthetic oligonucleotide
  Target: ATXN1; (-) strand; PAM type: YTN; PAM sequence: TTT
gatggtgctgctgttgcatt

SEQ ID NO: 171223 - DNA, 20 bp, Artificial Sequence
  Description of Artificial Sequence: Synthetic oligonucleotide
  Target: ATXN1; (-) strand; PAM type: YTN; PAM sequence: TTT
tgatggtgctgctgttgcat

SEQ ID NO: 171224 - DNA, 20 bp, Artificial Sequence
  Description of Artificial Sequence: Synthetic oligonucleotide
  Target: ATXN1; (-) strand; PAM type: YTN; PAM sequence: TTG
tgcacaattttgatggtgct

SEQ ID NO: 171225 - DNA, 20 bp, Artificial Sequence
  Description of Artificial Sequence: Synthetic oligonucleotide
  Target: ATXN1; (-) strand; PAM type: YTN; PAM sequence: TTG
aattgtgcacaattttgatg

SEQ ID NO: 171226 - DNA, 20 bp, Artificial Sequence
  Description of Artificial Sequence: Synthetic oligonucleotide
  Target: ATXN1; (-) strand; PAM type: YTN; PAM sequence: CTG
attgaattgtgcacaatttt

SEQ ID NO: 171227 - DNA, 20 bp, Artificial Sequence
  Description of Artificial Sequence: Synthetic oligonucleotide
  Target: ATXN1; (-) strand; PAM type: YTN; PAM sequence: CTC
tgattgaattgtgcacaatt

SEQ ID NO: 171228 - DNA, 20 bp, Artificial Sequence
  Description of Artificial Sequence: Synthetic oligonucleotide
  Target: ATXN1; (-) strand; PAM type: YTN; PAM sequence: TTG
agaacctctgattgaattgt

SEQ ID NO: 171229 - DNA, 20 bp, Artificial Sequence
  Description of Artificial Sequence: Synthetic oligonucleotide
  Target: ATXN1; (-) strand; PAM type: YTN; PAM sequence: TTT
gagaacctctgattgaattg

SEQ ID NO: 171230 - DNA, 20 bp, Artificial Sequence
  Description of Artificial Sequence: Synthetic oligonucleotide
  Target: ATXN1; (-) strand; PAM type: YTN; PAM sequence: CTG
atgggcagccatgtttgaga

SEQ ID NO: 171231 - DNA, 20 bp, Artificial Sequence
  Description of Artificial Sequence: Synthetic oligonucleotide
  Target: ATXN1; (-) strand; PAM type: YTN; PAM sequence: TTC
tgatgggcagccatgtttga

SEQ ID NO: 171232 - DNA, 20 bp, Artificial Sequence
  Description of Artificial Sequence: Synthetic oligonucleotide
  Target: ATXN1; (-) strand; PAM type: YTN; PAM sequence: CTA
aaaggcacaatggtgattct

SEQ ID NO: 171233 - DNA, 20 bp, Artificial Sequence
  Description of Artificial Sequence: Synthetic oligonucleotide
  Target: ATXN1; (-) strand; PAM type: YTN; PAM sequence: TTC
ctaaaaggcacaatggtgat

SEQ ID NO: 171234 - DNA, 20 bp, Artificial Sequence
  Description of Artificial Sequence: Synthetic oligonucleotide
  Target: ATXN1; (-) strand; PAM type: YTN; PAM sequence: TTT
cctaaaaggcacaatggtga

SEQ ID NO: 171235 - DNA, 20 bp, Artificial Sequence
  Description of Artificial Sequence: Synthetic oligonucleotide
  Target: ATXN1; (-) strand; PAM type: YTN; PAM sequence: CTG
tgtttcctaaaaggcacaat

SEQ ID NO: 171236 - DNA, 20 bp, Artificial Sequence
  Description of Artificial Sequence: Synthetic oligonucleotide
  Target: ATXN1; (-) strand; PAM type: YTN; PAM sequence: CTG
agaatctgtgtttcctaaaa

SEQ ID NO: 171237 - DNA, 20 bp, Artificial Sequence
  Description of Artificial Sequence: Synthetic oligonucleotide
  Target: ATXN1; (-) strand; PAM type: YTN; PAM sequence: CTG
caaatgtctgagaatctgtg

SEQ ID NO: 171238 - DNA, 20 bp, Artificial Sequence
  Description of Artificial Sequence: Synthetic oligonucleotide
  Target: ATXN1; (-) strand; PAM type: YTN; PAM sequence: TTA
gagactgcaaatgtctgaga

SEQ ID NO: 171239 - DNA, 20 bp, Artificial Sequence
  Description of Artificial Sequence: Synthetic oligonucleotide
  Target: ATXN1; (-) strand; PAM type: YTN; PAM sequence: CTG
gcccagaaaatccagggcca

SEQ ID NO: 171240 - DNA, 20 bp, Artificial Sequence
  Description of Artificial Sequence: Synthetic oligonucleotide
  Target: ATXN1; (-) strand; PAM type: YTN; PAM sequence: CTG
tgcactggcccagaaaatcc

SEQ ID NO: 171241 - DNA, 20 bp, Artificial Sequence
  Description of Artificial Sequence: Synthetic oligonucleotide
  Target: ATXN1; (-) strand; PAM type: YTN; PAM sequence: TTA
cctgtgcactggcccagaaa

SEQ ID NO: 171242 - DNA, 20 bp, Artificial Sequence
  Description of Artificial Sequence: Synthetic oligonucleotide
  Target: ATXN1; (-) strand; PAM type: YTN; PAM sequence: TTA
aaaaataccattacctgtgc

SEQ ID NO: 171243 - DNA, 20 bp, Artificial Sequence
  Description of Artificial Sequence: Synthetic oligonucleotide
  Target: ATXN1; (-) strand; PAM type: YTN; PAM sequence: TTT
aaaaaataccattacctgtg

SEQ ID NO: 171244 - DNA, 20 bp, Artificial Sequence
  Description of Artificial Sequence: Synthetic oligonucleotide
  Target: ATXN1; (-) strand; PAM type: YTN; PAM sequence: TTT
taaaaaataccattacctgt

SEQ ID NO: 171245 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaataccattacctg

SEQ ID NO: 171246 - DNA, 20 bp, Artificial Sequence
  Description of Artificial Sequence: Synthetic oligonucleotide
  Target: ATXN1; (-) strand; PAM type: YTN; PAM sequence: TTG
ggggaaatgtttttaaaaaa

SEQ ID NO: 171247 - DNA, 20 bp, Artificial Sequence
  Description of Artificial Sequence: Synthetic oligonucleotide
  Target: ATXN1; (-) strand; PAM type: YTN; PAM sequence: CTT
gggggaaatgtttttaaaaa

SEQ ID NO: 171248 - DNA, 20 bp, Artificial Sequence
  Description of Artificial Sequence: Synthetic oligonucleotide
  Target: ATXN1; (-) strand; PAM type: YTN; PAM sequence: CTG
atcagaatcccttgggggaa

SEQ ID NO: 171249 - DNA, 20 bp, Artificial Sequence
  Description of Artificial Sequence: Synthetic oligonucleotide
  Target: ATXN1; (-) strand; PAM type: YTN; PAM sequence: CTA
actgatcagaatcccttggg

SEQ ID NO: 171250 - DNA, 20 bp, Artificial Sequence
  Description of Artificial Sequence: Synthetic oligonucleotide
  Target: ATXN1; (-) strand; PAM type: YTN; PAM sequence: TTA
gaaagtggatcccaaaccta

SEQ ID NO: 171251 - DNA, 20 bp, Artificial Sequence
  Description of Artificial Sequence: Synthetic oligonucleotide
  Target: ATXN1; (-) strand; PAM type: YTN; PAM sequence: TTT
agaaagtggatcccaaacct

SEQ ID NO: 171252 - DNA, 20 bp, Artificial Sequence
  Description of Artificial Sequence: Synthetic oligonucleotide
  Target: ATXN1; (-) strand; PAM type: YTN; PAM sequence: TTT
tagaaagtggatcccaaacc

SEQ ID NO: 171253 - DNA, 20 bp, Artificial Sequence
  Description of Artificial Sequence: Synthetic oligonucleotide
  Target: ATXN1; (-) strand; PAM type: YTN; PAM sequence: TTT
ttagaaagtggatcccaaac

SEQ ID NO: 171254 - DNA, 20 bp, Artificial Sequence
  Description of Artificial Sequence: Synthetic oligonucleotide
  Target: ATXN1; (-) strand; PAM type: YTN; PAM sequence: TTA
tttttagaaagtggatccca

SEQ ID NO: 171255 - DNA, 20 bp, Artificial Sequence
  Description of Artificial Sequence: Synthetic oligonucleotide
  Target: ATXN1; (-) strand; PAM type: YTN; PAM sequence: CTC
cgtcacagagaaacatgtta

SEQ ID NO: 171256 - DNA, 20 bp, Artificial Sequence
  Description of Artificial Sequence: Synthetic oligonucleotide
  Target: ATXN1; (-) strand; PAM type: YTN; PAM sequence: TTC
ctccgtcacagagaaacatg

SEQ ID NO: 171257 - DNA, 20 bp, Artificial Sequence
  Description of Artificial Sequence: Synthetic oligonucleotide
  Target: ATXN1; (-) strand; PAM type: YTN; PAM sequence: TTT
cctccgtcacagagaaacat

SEQ ID NO: 171258 - DNA, 20 bp, Artificial Sequence
  Description of Artificial Sequence: Synthetic oligonucleotide
  Target: ATXN1; (-) strand; PAM type: YTN; PAM sequence: TTA
aatttcctccgtcacagaga

SEQ ID NO: 171259 - DNA, 20 bp, Artificial Sequence
  Description of Artificial Sequence: Synthetic oligonucleotide
  Target: ATXN1; (-) strand; PAM type: YTN; PAM sequence: CTT
aaatttcctccgtcacagag

SEQ ID NO: 171260 - DNA, 20 bp, Artificial Sequence
  Description of Artificial Sequence: Synthetic oligonucleotide
  Target: ATXN1; (-) strand; PAM type: YTN; PAM sequence: TTA
tacttaaatttcctccgtca

SEQ ID NO: 171261 - DNA, 20 bp, Artificial Sequence
  Description of Artificial Sequence: Synthetic oligonucleotide
  Target: ATXN1; (-) strand; PAM type: YTN; PAM sequence: TTC
atgaatcatagttatactta

SEQ ID NO: 171262 - DNA, 20 bp, Artificial Sequence
  Description of Artificial Sequence: Synthetic oligonucleotide
  Target: ATXN1; (-) strand; PAM type: YTN; PAM sequence: CTG
aagaaaaaaacagataacaa

SEQ ID NO: 171263 - DNA, 20 bp, Artificial Sequence
  Description of Artificial Sequence: Synthetic oligonucleotide
  Target: ATXN1; (-) strand; PAM type: YTN; PAM sequence: CTC
tgaagaaaaaaacagataac

SEQ ID NO: 171264 - DNA, 20 bp, Artificial Sequence
  Description of Artificial Sequence: Synthetic oligonucleotide
  Target: ATXN1; (-) strand; PAM type: YTN; PAM sequence: CTG
atatcctctgaagaaaaaaa

SEQ ID NO: 171265 - DNA, 20 bp, Artificial Sequence
  Description of Artificial Sequence: Synthetic oligonucleotide
  Target: ATXN1; (-) strand; PAM type: YTN; PAM sequence: TTA
aactgatatcctctgaagaa

SEQ ID NO: 171266 - DNA, 20 bp, Artificial Sequence
  Description of Artificial Sequence: Synthetic oligonucleotide
  Target: ATXN1; (-) strand; PAM type: YTN; PAM sequence: CTT
aaactgatatcctctgaaga

SEQ ID NO: 171267 - DNA, 20 bp, Artificial Sequence
  Description of Artificial Sequence: Synthetic oligonucleotide
  Target: ATXN1; (-) strand; PAM type: YTN; PAM sequence: TTA
aaaaccaacacttaaactga

SEQ ID NO: 171268 - DNA, 20 bp, Artificial Sequence
  Description of Artificial Sequence: Synthetic oligonucleotide
  Target: ATXN1; (-) strand; PAM type: YTN; PAM sequence: TTT
aaaaaccaacacttaaactg

SEQ ID NO: 171269 - DNA, 20 bp, Artificial Sequence
  Description of Artificial Sequence: Synthetic oligonucleotide
  Target: ATXN1; (-) strand; PAM type: YTN; PAM sequence: TTA
cagtttaaaaaccaacactt

SEQ ID NO: 171270 - DNA, 20 bp, Artificial Sequence
  Description of Artificial Sequence: Synthetic oligonucleotide
  Target: ATXN1; (-) strand; PAM type: YTN; PAM sequence: TTC
agagttacagtttaaaaacc

SEQ ID NO: 171271 - DNA, 20 bp, Artificial Sequence
  Description of Artificial Sequence: Synthetic oligonucleotide
  Target: ATXN1; (-) strand; PAM type: YTN; PAM sequence: CTT
cagagttacagtttaaaaac

SEQ ID NO: 171272 - DNA, 20 bp, Artificial Sequence
  Description of Artificial Sequence: Synthetic oligonucleotide
  Target: ATXN1; (-) strand; PAM type: YTN; PAM sequence: TTG
ccttcagagttacagtttaa

SEQ ID NO: 171273 - DNA, 20 bp, Artificial Sequence
  Description of Artificial Sequence: Synthetic oligonucleotide
  Target: ATXN1; (-) strand; PAM type: YTN; PAM sequence: TTT
gccttcagagttacagttta

SEQ ID NO: 171274 - DNA, 20 bp, Artificial Sequence
  Description of Artificial Sequence: Synthetic oligonucleotide
  Target: ATXN1; (-) strand; PAM type: YTN; PAM sequence: TTG
tttgccttcagagttacagt

SEQ ID NO: 171275 - DNA, 20 bp, Artificial Sequence
  Description of Artificial Sequence: Synthetic oligonucleotide
  Target: ATXN1; (-) strand; PAM type: YTN; PAM sequence: TTG
ccagttgtttgccttcagag

SEQ ID NO: 171276 - DNA, 20 bp, Artificial Sequence
  Description of Artificial Sequence: Synthetic oligonucleotide
  Target: ATXN1; (-) strand; PAM type: YTN; PAM sequence: CTT
gccagttgtttgccttcaga

SEQ ID NO: 171277 - DNA, 20 bp, Artificial Sequence
  Description of Artificial Sequence: Synthetic oligonucleotide
  Target: ATXN1; (-) strand; PAM type: YTN; PAM sequence: CTC
ttgccagttgtttgccttca

SEQ ID NO: 171278 - DNA, 20 bp, Artificial Sequence
  Description of Artificial Sequence: Synthetic oligonucleotide
  Target: ATXN1; (-) strand; PAM type: YTN; PAM sequence: CTC
tcttgccagttgtttgcctt

SEQ ID NO: 171279 - DNA, 20 bp, Artificial Sequence
  Description of Artificial Sequence: Synthetic oligonucleotide
  Target: ATXN1; (-) strand; PAM type: YTN; PAM sequence: CTC
tctcttgccagttgtttgcc

SEQ ID NO: 171280 - DNA, 20 bp, Artificial Sequence
  Description of Artificial Sequence: Synthetic oligonucleotide
  Target: ATXN1; (-) strand; PAM type: YTN; PAM sequence: CTG
aaaactctctcttgccagtt

SEQ ID NO: 171281 - DNA, 20 bp, Artificial Sequence
  Description of Artificial Sequence: Synthetic oligonucleotide
  Target: ATXN1; (-) strand; PAM type: YTN; PAM sequence: TTC
ctgaaaactctctcttgcca

SEQ ID NO: 171282 - DNA, 20 bp, Artificial Sequence
  Description of Artificial Sequence: Synthetic oligonucleotide
  Target: ATXN1; (-) strand; PAM type: YTN; PAM sequence: CTT
cctgaaaactctctcttgcc

SEQ ID NO: 171283 - DNA, 20 bp, Artificial Sequence
  Description of Artificial Sequence: Synthetic oligonucleotide
  Target: ATXN1; (-) strand; PAM type: YTN; PAM sequence: TTC
ttcctgaaaactctctcttg

SEQ ID NO: 171284 - DNA, 20 bp, Artificial Sequence
  Description of Artificial Sequence: Synthetic oligonucleotide
  Target: ATXN1; (-) strand; PAM type: YTN; PAM sequence: TTC
cagagccagcattcttcctg

SEQ ID NO: 171285 - DNA, 20 bp, Artificial Sequence
  Description of Artificial Sequence: Synthetic oligonucleotide
  Target: ATXN1; (-) strand; PAM type: YTN; PAM sequence: CTT
ccagagccagcattcttcct

SEQ ID NO: 171286 - DNA, 20 bp, Artificial Sequence
  Description of Artificial Sequence: Synthetic oligonucleotide
  Target: ATXN1; (-) strand; PAM type: YTN; PAM sequence: CTG
ccttccagagccagcattct

SEQ ID NO: 171287 - DNA, 20 bp, Artificial Sequence
  Description of Artificial Sequence: Synthetic oligonucleotide
  Target: ATXN1; (-) strand; PAM type: YTN; PAM sequence: TTC
cgctgccttccagagccagc

SEQ ID NO: 171288 - DNA, 20 bp, Artificial Sequence
  Description of Artificial Sequence: Synthetic oligonucleotide
  Target: ATXN1; (-) strand; PAM type: YTN; PAM sequence: CTT
ccgctgccttccagagccag

SEQ ID NO: 171289 - DNA, 20 bp, Artificial Sequence
  Description of Artificial Sequence: Synthetic oligonucleotide
  Target: ATXN1; (-) strand; PAM type: YTN; PAM sequence: TTC
cagaaccttccgctgccttc

SEQ ID NO: 171290 - DNA, 20 bp, Artificial Sequence
  Description of Artificial Sequence: Synthetic oligonucleotide
  Target: ATXN1; (-) strand; PAM type: YTN; PAM sequence: TTT
ccagaaccttccgctgcctt

SEQ ID NO: 171291 - DNA, 20 bp, Artificial Sequence
  Description of Artificial Sequence: Synthetic oligonucleotide
  Target: ATXN1; (-) strand; PAM type: YTN; PAM sequence: TTT
tccagaaccttccgctgcct

SEQ ID NO: 171292 - DNA, 20 bp, Artificial Sequence
  Description of Artificial Sequence: Synthetic oligonucleotide
  Target: ATXN1; (-) strand; PAM type: YTN; PAM sequence: CTT
ttccagaaccttccgctgcc

SEQ ID NO: 171293 - DNA, 20 bp, Artificial Sequence
  Description of Artificial Sequence: Synthetic oligonucleotide
  Target: ATXN1; (-) strand; PAM type: YTN; PAM sequence: TTG
cttttccagaaccttccgct

SEQ ID NO: 171294 - DNA, 20 bp, Artificial Sequence
  Description of Artificial Sequence: Synthetic oligonucleotide
  Target: ATXN1; (-) strand; PAM type: YTN; PAM sequence: TTC
ataggacacattgcttttcc

SEQ ID NO: 171295 - DNA, 20 bp, Artificial Sequence
  Description of Artificial Sequence: Synthetic oligonucleotide
  Target: ATXN1; (-) strand; PAM type: YTN; PAM sequence: CTA
gttcataggacacattgctt

SEQ ID NO: 171296 - DNA, 20 bp, Artificial Sequence
  Description of Artificial Sequence: Synthetic oligonucleotide
  Target: ATXN1; (-) strand; PAM type: YTN; PAM sequence: TTA
caggtgaaaagtctagttca

SEQ ID NO: 171297 - DNA, 20 bp, Artificial Sequence
  Description of Artificial Sequence: Synthetic oligonucleotide
  Target: ATXN1; (-) strand; PAM type: YTN; PAM sequence: CTT
acaggtgaaaagtctagttc

SEQ ID NO: 171298 - DNA, 20 bp, Artificial Sequence
  Description of Artificial Sequence: Synthetic oligonucleotide
  Target: ATXN1; (-) strand; PAM type: YTN; PAM sequence: CTG
ccatgcttacaggtgaaaag

SEQ ID NO: 171299 - DNA, 20 bp, Artificial Sequence
  Description of Artificial Sequence: Synthetic oligonucleotide
  Target: ATXN1; (-) strand; PAM type: YTN; PAM sequence: TTC
ctgccatgcttacaggtgaa

SEQ ID NO: 171300 - DNA, 20 bp, Artificial Sequence
  Description of Artificial Sequence: Synthetic oligonucleotide
  Target: ATXN1; (-) strand; PAM type: YTN; PAM sequence: CTT
cctgccatgcttacaggtga

SEQ ID NO: 171301 - DNA, 20 bp, Artificial Sequence
  Description of Artificial Sequence: Synthetic oligonucleotide
  Target: ATXN1; (-) strand; PAM type: YTN; PAM sequence: CTC
ttcctgccatgcttacaggt

SEQ ID NO: 171302 - DNA, 20 bp, Artificial Sequence
  Description of Artificial Sequence: Synthetic oligonucleotide
  Target: ATXN1; (-) strand; PAM type: YTN; PAM sequence: TTG
cacagcctcttcctgccatg

SEQ ID NO: 171303 - DNA, 20 bp, Artificial Sequence
  Description of Artificial Sequence: Synthetic oligonucleotide
  Target: ATXN1; (-) strand; PAM type: YTN; PAM sequence: CTT
gcacagcctcttcctgccat

SEQ ID NO: 171304 - DNA, 20 bp, Artificial Sequence
  Description of Artificial Sequence: Synthetic oligonucleotide
  Target: ATXN1; (-) strand; PAM type: YTN; PAM sequence: CTG
tagtcatccaccaccttgca

SEQ ID NO: 171305 - DNA, 20 bp, Artificial Sequence
  Description of Artificial Sequence: Synthetic oligonucleotide
  Target: ATXN1; (-) strand; PAM type: YTN; PAM sequence: CTG
gagtccacaacaaagccctg

SEQ ID NO: 171306 - DNA, 20 bp, Artificial Sequence
  Description of Artificial Sequence: Synthetic oligonucleotide
  Target: ATXN1; (-) strand; PAM type: YTN; PAM sequence: TTA
gaggcctggagtccacaaca

SEQ ID NO: 171307 - DNA, 20 bp, Artificial Sequence
  Description of Artificial Sequence: Synthetic oligonucleotide
  Target: ATXN1; (-) strand; PAM type: YTN; PAM sequence: CTG
aaagggattagaggcctgga

SEQ ID NO: 171308 - DNA, 20 bp, Artificial Sequence
  Description of Artificial Sequence: Synthetic oligonucleotide
  Target: ATXN1; (-) strand; PAM type: YTN; PAM sequence: TTG
agggcagagaaataaaaaga

SEQ ID NO: 171309 - DNA, 20 bp, Artificial Sequence
  Description of Artificial Sequence: Synthetic oligonucleotide
  Target: ATXN1; (-) strand; PAM type: YTN; PAM sequence: TTT
gagggcagagaaataaaaag

SEQ ID NO: 171310 - DNA, 20 bp, Artificial Sequence
  Description of Artificial Sequence: Synthetic oligonucleotide
  Target: ATXN1; (-) strand; PAM type: YTN; PAM sequence: CTT
tgagggcagagaaataaaaa

SEQ ID NO: 171311 - DNA, 20 bp, Artificial Sequence
  Description of Artificial Sequence: Synthetic oligonucleotide
  Target: ATXN1; (-) strand; PAM type: YTN; PAM sequence: CTG
ggctttgagggcagagaaat

SEQ ID NO: 171312 - DNA, 20 bp, Artificial Sequence
  Description of Artificial Sequence: Synthetic oligonucleotide
  Target: ATXN1; (-) strand; PAM type: YTN; PAM sequence: CTG
ctgggctttgagggcagaga

SEQ ID NO: 171313 - DNA, 20 bp, Artificial Sequence
  Description of Artificial Sequence: Synthetic oligonucleotide
  Target: ATXN1; (-) strand; PAM type: YTN; PAM sequence: CTC
caggctgctgggctttgagg

SEQ ID NO: 171314 - DNA, 20 bp, Artificial Sequence
  Description of Artificial Sequence: Synthetic oligonucleotide
  Target: ATXN1; (-) strand; PAM type: YTN; PAM sequence: CTC
ccctccaggctgctgggctt

SEQ ID NO: 171315 - DNA, 20 bp, Artificial Sequence
  Description of Artificial Sequence: Synthetic oligonucleotide
  Target: ATXN1; (-) strand; PAM type: YTN; PAM sequence: TTC
tcccctccaggctgctgggc

SEQ ID NO: 171316 - DNA, 20 bp, Artificial Sequence
  Description of Artificial Sequence: Synthetic oligonucleotide
  Target: ATXN1; (-) strand; PAM type: YTN; PAM sequence: CTT
ctcccctccaggctgctggg

SEQ ID NO: 171317 - DNA, 20 bp, Artificial Sequence
  Description of Artificial Sequence: Synthetic oligonucleotide
  Target: ATXN1; (-) strand; PAM type: YTN; PAM sequence: CTG
ccttctcccctccaggctgc

SEQ ID NO: 171318 - DNA, 20 bp, Artificial Sequence
  Description of Artificial Sequence: Synthetic oligonucleotide
  Target: ATXN1; (-) strand; PAM type: YTN; PAM sequence: CTG
cagtcaagggcactgccttc

SEQ ID NO: 171319 - DNA, 20 bp, Artificial Sequence
  Description of Artificial Sequence: Synthetic oligonucleotide
  Target: ATXN1; (-) strand; PAM type: YTN; PAM sequence: CTA
cagtaaaggagaccgtaggc

SEQ ID NO: 171320 - DNA, 20 bp, Artificial Sequence
  Description of Artificial Sequence: Synthetic oligonucleotide
  Target: ATXN1; (-) strand; PAM type: YTN; PAM sequence: CTC
cagaaacctacagtaaagga

SEQ ID NO: 171321 - DNA, 20 bp, Artificial Sequence
  Description of Artificial Sequence: Synthetic oligonucleotide
  Target: ATXN1; (-) strand; PAM type: YTN; PAM sequence: TTG
ctccagaaacctacagtaaa

SEQ ID NO: 171322 - DNA, 20 bp, Artificial Sequence
  Description of Artificial Sequence: Synthetic oligonucleotide
  Target: ATXN1; (-) strand; PAM type: YTN; PAM sequence: TTT
gctccagaaacctacagtaa

SEQ ID NO: 171323 - DNA, 20 bp, Artificial Sequence
  Description of Artificial Sequence: Synthetic oligonucleotide
  Target: ATXN1; (-) strand; PAM type: YTN; PAM sequence: TTT
tgctccagaaacctacagta

SEQ ID NO: 171324 - DNA, 20 bp, Artificial Sequence
  Description of Artificial Sequence: Synthetic oligonucleotide
  Target: ATXN1; (-) strand; PAM type: YTN; PAM sequence: TTT
ttgctccagaaacctacagt

SEQ ID NO: 171325 - DNA, 20 bp, Artificial Sequence
  Description of Artificial Sequence: Synthetic oligonucleotide
  Target: ATXN1; (-) strand; PAM type: YTN; PAM sequence: CTG
gatttttgctccagaaacct

SEQ ID NO: 171326 - DNA, 20 bp, Artificial Sequence
  Description of Artificial Sequence: Synthetic oligonucleotide
  Target: ATXN1; (-) strand; PAM type: YTN; PAM sequence: CTG
ctggatttttgctccagaaa

SEQ ID NO: 171327 - DNA, 20 bp, Artificial Sequence
  Description of Artificial Sequence: Synthetic oligonucleotide
  Target: ATXN1; (-) strand; PAM type: YTN; PAM sequence: CTG
actgctggatttttgctcca

SEQ ID NO: 171328 - DNA, 20 bp, Artificial Sequence
  Description of Artificial Sequence: Synthetic oligonucleotide
  Target: ATXN1; (-) strand; PAM type: YTN; PAM sequence: CTG
gtaacctgactgctggattt

SEQ ID NO: 171329 - DNA, 20 bp, Artificial Sequence
  Description of Artificial Sequence: Synthetic oligonucleotide
  Target: ATXN1; (-) strand; PAM type: YTN; PAM sequence: CTG
atcctggtaacctgactgct

SEQ ID NO: 171330 - DNA, 20 bp, Artificial Sequence
  Description of Artificial Sequence: Synthetic oligonucleotide
  Target: ATXN1; (-) strand; PAM type: YTN; PAM sequence: TTG
tcactgatcctggtaacctg

SEQ ID NO: 171331 - DNA, 20 bp, Artificial Sequence
  Description of Artificial Sequence: Synthetic oligonucleotide
  Target: ATXN1; (-) strand; PAM type: YTN; PAM sequence: TTG
catagttgtcactgatcctg

SEQ ID NO: 171332 - DNA, 20 bp, Artificial Sequence
  Description of Artificial Sequence: Synthetic oligonucleotide
  Target: ATXN1; (-) strand; PAM type: YTN; PAM sequence: TTA
ttgcatagttgtcactgatc

SEQ ID NO: 171333 - DNA, 20 bp, Artificial Sequence
  Description of Artificial Sequence: Synthetic oligonucleotide
  Target: ATXN1; (-) strand; PAM type: YTN; PAM sequence: CTA
attattgcatagttgtcact

SEQ ID NO: 171334 - DNA, 20 bp, Artificial Sequence
  Description of Artificial Sequence: Synthetic oligonucleotide
  Target: ATXN1; (-) strand; PAM type: YTN; PAM sequence: CTG
cccctaattattgcatagtt

SEQ ID NO: 171335 - DNA, 20 bp, Artificial Sequence
  Description of Artificial Sequence: Synthetic oligonucleotide
  Target: ATXN1; (-) strand; PAM type: YTN; PAM sequence: CTG
gtgcctgcccctaattattg

SEQ ID NO: 171336 - DNA, 20 bp, Artificial Sequence
  Description of Artificial Sequence: Synthetic oligonucleotide
  Target: ATXN1; (-) strand; PAM type: YTN; PAM sequence: CTC
ctggtgcctgcccctaatta

SEQ ID NO: 171337 - DNA, 20 bp, Artificial Sequence
  Description of Artificial Sequence: Synthetic oligonucleotide
  Target: ATXN1; (-) strand; PAM type: YTN; PAM sequence: CTG
cctcctggtgcctgccccta

SEQ ID NO: 171338 - DNA, 20 bp, Artificial Sequence
  Description of Artificial Sequence: Synthetic oligonucleotide
  Target: ATXN1; (-) strand; PAM type: YTN; PAM sequence: CTC
tgcctcctggtgcctgcccc

SEQ ID NO: 171339 - DNA, 20 bp, Artificial Sequence
  Description of Artificial Sequence: Synthetic oligonucleotide
  Target: ATXN1; (-) strand; PAM type: YTN; PAM sequence: TTC
tctgcctcctggtgcctgcc

SEQ ID NO: 171340 - DNA, 20 bp, Artificial Sequence
  Description of Artificial Sequence: Synthetic oligonucleotide
  Target: ATXN1; (-) strand; PAM type: YTN; PAM sequence: TTT
ctctgcctcctggtgcctgc

SEQ ID NO: 171341 - DNA, 20 bp, Artificial Sequence
  Description of Artificial Sequence: Synthetic oligonucleotide
  Target: ATXN1; (-) strand; PAM type: YTN; PAM sequence: CTG
tttctctgcctcctggtgcc

SEQ ID NO: 171342 - DNA, 20 bp, Artificial Sequence
  Description of Artificial Sequence: Synthetic oligonucleotide
  Target: ATXN1; (-) strand; PAM type: YTN; PAM sequence: CTC
tgtttctctgcctcctggtg

SEQ ID NO: 171343 - DNA, 20 bp, Artificial Sequence
  Description of Artificial Sequence: Synthetic oligonucleotide
  Target: ATXN1; (-) strand; PAM type: YTN; PAM sequence: CTG
ccacccagctctgtttctct

SEQ ID NO: 171344 - DNA, 20 bp, Artificial Sequence
  Description of Artificial Sequence: Synthetic oligonucleotide
  Target: ATXN1; (-) strand; PAM type: YTN; PAM sequence: TTC
tgccacccagctctgtttct

SEQ ID NO: 171345 - DNA, 20 bp, Artificial Sequence
  Description of Artificial Sequence: Synthetic oligonucleotide
  Target: ATXN1; (-) strand; PAM type: YTN; PAM sequence: TTT
ctgccacccagctctgtttc

SEQ ID NO: 171346 - DNA, 20 bp, Artificial Sequence
  Description of Artificial Sequence: Synthetic oligonucleotide
  Target: ATXN1; (-) strand; PAM type: YTN; PAM sequence: TTG
gggtatcatagagtttctgc

SEQ ID NO: 171347 - DNA, 20 bp, Artificial Sequence
  Description of Artificial Sequence: Synthetic oligonucleotide
  Target: ATXN1; (-) strand; PAM type: YTN; PAM sequence: TTT
ggggtatcatagagtttctg

SEQ ID NO: 171348 - DNA, 20 bp, Artificial Sequence
  Description of Artificial Sequence: Synthetic oligonucleotide
  Target: ATXN1; (-) strand; PAM type: YTN; PAM sequence: CTT
tggggtatcatagagtttct

SEQ ID NO: 171349 - DNA, 20 bp, Artificial Sequence
  Description of Artificial Sequence: Synthetic oligonucleotide
  Target: ATXN1; (-) strand; PAM type: YTN; PAM sequence: TTC
ctttggggtatcatagagtt

SEQ ID NO: 171350 - DNA, 20 bp, Artificial Sequence
  Description of Artificial Sequence: Synthetic oligonucleotide
  Target: ATXN1; (-) strand; PAM type: YTN; PAM sequence: TTT
cctttggggtatcatagagt

SEQ ID NO: 171351 - DNA, 20 bp, Artificial Sequence
  Description of Artificial Sequence: Synthetic oligonucleotide
  Target: ATXN1; (-) strand; PAM type: YTN; PAM sequence: TTG
atgtttcctttggggtatca

SEQ ID NO: 171352 - DNA, 20 bp, Artificial Sequence
  Description of Artificial Sequence: Synthetic oligonucleotide
  Target: ATXN1; (-) strand; PAM type: YTN; PAM sequence: CTG
agaagagttgatgtttcctt

SEQ ID NO: 171353 - DNA, 20 bp, Artificial Sequence
  Description of Artificial Sequence: Synthetic oligonucleotide
  Target: ATXN1; (-) strand; PAM type: YTN; PAM sequence: CTC
tgagaagagttgatgtttcc

SEQ ID NO: 171354 - DNA, 20 bp, Artificial Sequence
  Description of Artificial Sequence: Synthetic oligonucleotide
  Target: ATXN1; (-) strand; PAM type: YTN; PAM sequence: TTG
accacctctgagaagagttg

SEQ ID NO: 171355 - DNA, 20 bp, Artificial Sequence
  Description of Artificial Sequence: Synthetic oligonucleotide
  Target: ATXN1; (-) strand; PAM type: YTN; PAM sequence: CTT
gaccacctctgagaagagtt

SEQ ID NO: 171356 - DNA, 20 bp, Artificial Sequence
  Description of Artificial Sequence: Synthetic oligonucleotide
  Target: ATXN1; (-) strand; PAM type: YTN; PAM sequence: TTC
ttgaccacctctgagaagag

SEQ ID NO: 171357 - DNA, 20 bp, Artificial Sequence
  Description of Artificial Sequence: Synthetic oligonucleotide
  Target: ATXN1; (-) strand; PAM type: YTN; PAM sequence: CTG
gcatgttcttgaccacctct

SEQ ID NO: 171358 - DNA, 20 bp, Artificial Sequence
  Description of Artificial Sequence: Synthetic oligonucleotide
  Target: ATXN1; (-) strand; PAM type: YTN; PAM sequence: TTC
tggcatgttcttgaccacct

SEQ ID NO: 171359 - DNA, 20 bp, Artificial Sequence
  Description of Artificial Sequence: Synthetic oligonucleotide
  Target: ATXN1; (-) strand; PAM type: YTN; PAM sequence: CTT
ctggcatgttcttgaccacc

SEQ ID NO: 171360 - DNA, 20 bp, Artificial Sequence
  Description of Artificial Sequence: Synthetic oligonucleotide
  Target: ATXN1; (-) strand; PAM type: YTN; PAM sequence: CTG
ccaaccaggcaggcaaagct

SEQ ID NO: 171361 - DNA, 20 bp, Artificial Sequence
  Description of Artificial Sequence: Synthetic oligonucleotide
  Target: ATXN1; (-) strand; PAM type: YTN; PAM sequence: CTG
ctgccaaccaggcaggcaaa

SEQ ID NO: 171362 - DNA, 20 bp, Artificial Sequence
  Description of Artificial Sequence: Synthetic oligonucleotide
  Target: ATXN1; (-) strand; PAM type: YTN; PAM sequence: TTC
tgctgccaaccaggcaggca

SEQ ID NO: 171363 - DNA, 20 bp, Artificial Sequence
  Description of Artificial Sequence: Synthetic oligonucleotide
  Target: ATXN1; (-) strand; PAM type: YTN; PAM sequence: TTT
ctgctgccaaccaggcaggc

SEQ ID NO: 171364 - DNA, 20 bp, Artificial Sequence
  Description of Artificial Sequence: Synthetic oligonucleotide
  Target: ATXN1; (-) strand; PAM type: YTN; PAM sequence: CTA
gtgccatttctgctgccaac

SEQ ID NO: 171365 - DNA, 20 bp, Artificial Sequence
  Description of Artificial Sequence: Synthetic oligonucleotide
  Target: ATXN1; (-) strand; PAM type: YTN; PAM sequence: CTG
gctagtgccatttctgctgc

SEQ ID NO: 171366 - DNA, 20 bp, Artificial Sequence
  Description of Artificial Sequence: Synthetic oligonucleotide
  Target: ATXN1; (-) strand; PAM type: YTN; PAM sequence: TTA
cgagtgatcactggctagtg

SEQ ID NO: 171367 - DNA, 20 bp, Artificial Sequence
  Description of Artificial Sequence: Synthetic oligonucleotide
  Target: ATXN1; (-) strand; PAM type: YTN; PAM sequence: CTG
taaagaaggcagcaaggtta

SEQ ID NO: 171368 - DNA, 20 bp, Artificial Sequence
  Description of Artificial Sequence: Synthetic oligonucleotide
  Target: ATXN1; (-) strand; PAM type: YTN; PAM sequence: CTG
acagcagccatctgtaaaga

SEQ ID NO: 171369 - DNA, 20 bp, Artificial Sequence
  Description of Artificial Sequence: Synthetic oligonucleotide
  Target: ATXN1; (-) strand; PAM type: YTN; PAM sequence: TTA
aacagcctgacagcagccat

SEQ ID NO: 171370 - DNA, 20 bp, Artificial Sequence
  Description of Artificial Sequence: Synthetic oligonucleotide
  Target: ATXN1; (-) strand; PAM type: YTN; PAM sequence: CTC
caaattaaacagcctgacag

SEQ ID NO: 171371 - DNA, 20 bp, Artificial Sequence
  Description of Artificial Sequence: Synthetic oligonucleotide
  Target: ATXN1; (-) strand; PAM type: YTN; PAM sequence: TTC
ctccaaattaaacagcctga

SEQ ID NO: 171372 - DNA, 20 bp, Artificial Sequence
  Description of Artificial Sequence: Synthetic oligonucleotide
  Target: ATXN1; (-) strand; PAM type: YTN; PAM sequence: TTT
cctccaaattaaacagcctg

SEQ ID NO: 171373 - DNA, 20 bp, Artificial Sequence
  Description of Artificial Sequence: Synthetic oligonucleotide
  Target: ATXN1; (-) strand; PAM type: YTN; PAM sequence: TTG
gaatttcctccaaattaaac

SEQ ID NO: 171374 - DNA, 20 bp, Artificial Sequence
  Description of Artificial Sequence: Synthetic oligonucleotide
  Target: ATXN1; (-) strand; PAM type: YTN; PAM sequence: CTG
atgacattggaatttcctcc

SEQ ID NO: 171375 - DNA, 20 bp, Artificial Sequence
  Description of Artificial Sequence: Synthetic oligonucleotide
  Target: ATXN1; (-) strand; PAM type: YTN; PAM sequence: CTG
ctgatgacattggaatttcc

SEQ ID NO: 171376 - DNA, 20 bp, Artificial Sequence
  Description of Artificial Sequence: Synthetic oligonucleotide
  Target: ATXN1; (-) strand; PAM type: YTN; PAM sequence: CTC
tgctgatgacattggaattt

SEQ ID NO: 171377 - DNA, 20 bp, Artificial Sequence
  Description of Artificial Sequence: Synthetic oligonucleotide
  Target: ATXN1; (-) strand; PAM type: YTN; PAM sequence: CTC
cccaatgccatgtctctgct

SEQ ID NO: 171378 - DNA, 20 bp, Artificial Sequence
  Description of Artificial Sequence: Synthetic oligonucleotide
  Target: ATXN1; (-) strand; PAM type: YTN; PAM sequence: TTG
gcagccctccccaatgccat

SEQ ID NO: 171379 - DNA, 20 bp, Artificial Sequence
  Description of Artificial Sequence: Synthetic oligonucleotide
  Target: ATXN1; (-) strand; PAM type: YTN; PAM sequence: CTT
ggcagccctccccaatgcca

SEQ ID NO: 171380 - DNA, 20 bp, Artificial Sequence
  Description of Artificial Sequence: Synthetic oligonucleotide
  Target: ATXN1; (-) strand; PAM type: YTN; PAM sequence: TTG
tgcttggcagccctccccaa

SEQ ID NO: 171381 - DNA, 20 bp, Artificial Sequence
  Description of Artificial Sequence: Synthetic oligonucleotide
  Target: ATXN1; (-) strand; PAM type: YTN; PAM sequence: TTT
gtgcttggcagccctcccca

SEQ ID NO: 171382 - DNA, 20 bp, Artificial Sequence
  Description of Artificial Sequence: Synthetic oligonucleotide
  Target: ATXN1; (-) strand; PAM type: YTN; PAM sequence: CTT
tgtgcttggcagccctcccc

SEQ ID NO: 171383 - DNA, 20 bp, Artificial Sequence
  Description of Artificial Sequence: Synthetic oligonucleotide
  Target: ATXN1; (-) strand; PAM type: YTN; PAM sequence: CTG
tctttgtgcttggcagccct

SEQ ID NO: 171384 - DNA, 20 bp, Artificial Sequence
  Description of Artificial Sequence: Synthetic oligonucleotide
  Target: ATXN1; (-) strand; PAM type: YTN; PAM sequence: TTC
tgtctttgtgcttggcagcc

SEQ ID NO: 171385 - DNA, 20 bp, Artificial Sequence
  Description of Artificial Sequence: Synthetic oligonucleotide
  Target: ATXN1; (-) strand; PAM type: YTN; PAM sequence: CTG
gggaagccaagttctgtctt

SEQ ID NO: 171386 - DNA, 20 bp, Artificial Sequence
  Description of Artificial Sequence: Synthetic oligonucleotide
  Target: ATXN1; (-) strand; PAM type: YTN; PAM sequence: CTG
tatccatgggtatcagctgg

SEQ ID NO: 171387 - DNA, 20 bp, Artificial Sequence
  Description of Artificial Sequence: Synthetic oligonucleotide
  Target: ATXN1; (-) strand; PAM type: YTN; PAM sequence: TTC
tgtatccatgggtatcagct

SEQ ID NO: 171388 - DNA, 20 bp, Artificial Sequence
  Description of Artificial Sequence: Synthetic oligonucleotide
  Target: ATXN1; (-) strand; PAM type: YTN; PAM sequence: TTT
ctgtatccatgggtatcagc

SEQ ID NO: 171389 - DNA, 20 bp, Artificial Sequence
  Description of Artificial Sequence: Synthetic oligonucleotide
  Target: ATXN1; (-) strand; PAM type: YTN; PAM sequence: CTG
tttctgtatccatgggtatc

SEQ ID NO: 171390 - DNA, 20 bp, Artificial Sequence
  Description of Artificial Sequence: Synthetic oligonucleotide
  Target: ATXN1; (-) strand; PAM type: YTN; PAM sequence: CTA
gcctgtttctgtatccatgg

SEQ ID NO: 171391 - DNA, 20 bp, Artificial Sequence
  Description of Artificial Sequence: Synthetic oligonucleotide
  Target: ATXN1; (-) strand; PAM type: YTN; PAM sequence: TTA
agactagcctgtttctgtat

SEQ ID NO: 171392 - DNA, 20 bp, Artificial Sequence
  Description of Artificial Sequence: Synthetic oligonucleotide
  Target: ATXN1; (-) strand; PAM type: YTN; PAM sequence: TTG
ttaagactagcctgtttctg

SEQ ID NO: 171393 - DNA, 20 bp, Artificial Sequence
  Description of Artificial Sequence: Synthetic oligonucleotide
  Target: ATXN1; (-) strand; PAM type: YTN; PAM sequence: CTA
aaagattgttaagactagcc

SEQ ID NO: 171394 - DNA, 20 bp, Artificial Sequence
  Description of Artificial Sequence: Synthetic oligonucleotide
  Target: ATXN1; (-) strand; PAM type: YTN; PAM sequence: CTA
aggtcaggtctaaaagattg

SEQ ID NO: 171395 - DNA, 20 bp, Artificial Sequence
  Description of Artificial Sequence: Synthetic oligonucleotide
  Target: ATXN1; (-) strand; PAM type: YTN; PAM sequence: CTA
ctaaggtcaggtctaaaaga

SEQ ID NO: 171396 - DNA, 20 bp, Artificial Sequence
  Description of Artificial Sequence: Synthetic oligonucleotide
  Target: ATXN1; (-) strand; PAM type: YTN; PAM sequence: TTG
ctactaaggtcaggtctaaa

SEQ ID NO: 171397 - DNA, 20 bp, Artificial Sequence
  Description of Artificial Sequence: Synthetic oligonucleotide
  Target: ATXN1; (-) strand; PAM type: YTN; PAM sequence: TTT
gctactaaggtcaggtctaa

SEQ ID NO: 171398 - DNA, 20 bp, Artificial Sequence
  Description of Artificial Sequence: Synthetic oligonucleotide
  Target: ATXN1; (-) strand; PAM type: YTN; PAM sequence: TTA
tccagtttgctactaaggtc

SEQ ID NO: 171399 - DNA, 20 bp, Artificial Sequence
  Description of Artificial Sequence: Synthetic oligonucleotide
  Target: ATXN1; (-) strand; PAM type: YTN; PAM sequence: CTG
gcagttatccagtttgctac

SEQ ID NO: 171400 - DNA, 20 bp, Artificial Sequence
  Description of Artificial Sequence: Synthetic oligonucleotide
  Target: ATXN1; (-) strand; PAM type: YTN; PAM sequence: TTA
tgactggcagttatccagtt

SEQ ID NO: 171401 - DNA, 20 bp, Artificial Sequence
  Description of Artificial Sequence: Synthetic oligonucleotide
  Target: ATXN1; (-) strand; PAM type: YTN; PAM sequence: TTT
atgactggcagttatccagt

SEQ ID NO: 171402 - DNA, 20 bp, Artificial Sequence
  Description of Artificial Sequence: Synthetic oligonucleotide
  Target: ATXN1; (-) strand; PAM type: YTN; PAM sequence: TTT
tatgactggcagttatccag

SEQ ID NO: 171403 - DNA, 20 bp, Artificial Sequence
  Description of Artificial Sequence: Synthetic oligonucleotide
  Target: ATXN1; (-) strand; PAM type: YTN; PAM sequence: CTT
ttatgactggcagttatcca

SEQ ID NO: 171404 - DNA, 20 bp, Artificial Sequence
  Description of Artificial Sequence: Synthetic oligonucleotide
  Target: ATXN1; (-) strand; PAM type: YTN; PAM sequence: TTA
gaaacacttttatgactggc

SEQ ID NO: 171405 - DNA, 20 bp, Artificial Sequence
  Description of Artificial Sequence: Synthetic oligonucleotide
  Target: ATXN1; (-) strand; PAM type: YTN; PAM sequence: TTT
agaaacacttttatgactgg

SEQ ID NO: 171406 - DNA, 20 bp, Artificial Sequence
  Description of Artificial Sequence: Synthetic oligonucleotide
  Target: ATXN1; (-) strand; PAM type: YTN; PAM sequence: CTT
tagaaacacttttatgactg

SEQ ID NO: 171407 - DNA, 20 bp, Artificial Sequence
  Description of Artificial Sequence: Synthetic oligonucleotide
  Target: ATXN1; (-) strand; PAM type: YTN; PAM sequence: CTA
acaggaggggagaaaatcag

SEQ ID NO: 171408 - DNA, 20 bp, Artificial Sequence
  Description of Artificial Sequence: Synthetic oligonucleotide
  Target: ATXN1; (-) strand; PAM type: YTN; PAM sequence: TTA
caagcatccaggatcctaac

SEQ ID NO: 171409 - DNA, 20 bp, Artificial Sequence
  Description of Artificial Sequence: Synthetic oligonucleotide
  Target: ATXN1; (-) strand; PAM type: YTN; PAM sequence: TTG
ataaatagcattacaagcat

SEQ ID NO: 171410 - DNA, 20 bp, Artificial Sequence
  Description of Artificial Sequence: Synthetic oligonucleotide
  Target: ATXN1; (-) strand; PAM type: YTN; PAM sequence: CTG
cacatcagtaagcacaaaat

SEQ ID NO: 171411 - DNA, 20 bp, Artificial Sequence
  Description of Artificial Sequence: Synthetic oligonucleotide
  Target: ATXN1; (-) strand; PAM type: YTN; PAM sequence: TTG
gaaaaaatgtctgcacatca

SEQ ID NO: 171412 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaagaatgggt

SEQ ID NO: 171413 - DNA, 20 bp, Artificial Sequence
  Description of Artificial Sequence: Synthetic oligonucleotide
  Target: ATXN1; (-) strand; PAM type: YTN; PAM sequence: CTC
catctcaaaaaaaaaaaaga

SEQ ID NO: 171414 - DNA, 20 bp, Artificial Sequence
  Description of Artificial Sequence: Synthetic oligonucleotide
  Target: ATXN1; (-) strand; PAM type: YTN; PAM sequence: CTA
tagagcaaaactccatctca

SEQ ID NO: 171415 - DNA, 20 bp, Artificial Sequence
  Description of Artificial Sequence: Synthetic oligonucleotide
  Target: ATXN1; (-) strand; PAM type: YTN; PAM sequence: CTG
ggctatagagcaaaactcca

SEQ ID NO: 171416 - DNA, 20 bp, Artificial Sequence
  Description of Artificial Sequence: Synthetic oligonucleotide
  Target: ATXN1; (-) strand; PAM type: YTN; PAM sequence: CTC
caacctgggctatagagcaa

SEQ ID NO: 171417 - DNA, 20 bp, Artificial Sequence
  Description of Artificial Sequence: Synthetic oligonucleotide
  Target: ATXN1; (-) strand; PAM type: YTN; PAM sequence: TTC
actccaacctgggctataga

SEQ ID NO: 171418 - DNA, 20 bp, Artificial Sequence
  Description of Artificial Sequence: Synthetic oligonucleotide
  Target: ATXN1; (-) strand; PAM type: YTN; PAM sequence: CTT
cactccaacctgggctatag

SEQ ID NO: 171419 - DNA, 20 bp, Artificial Sequence
  Description of Artificial Sequence: Synthetic oligonucleotide
  Target: ATXN1; (-) strand; PAM type: YTN; PAM sequence: TTA
caccgcttcactccaacctg

SEQ ID NO: 171420 - DNA, 20 bp, Artificial Sequence
  Description of Artificial Sequence: Synthetic oligonucleotide
  Target: ATXN1; (-) strand; PAM type: YTN; PAM sequence: TTG
cagggagccaagattacacc

SEQ ID NO: 171421 - DNA, 20 bp, Artificial Sequence
  Description of Artificial Sequence: Synthetic oligonucleotide
  Target: ATXN1; (-) strand; PAM type: YTN; PAM sequence: CTA
gaaggcggaggttgcaggga

SEQ ID NO: 171422 - DNA, 20 bp, Artificial Sequence
  Description of Artificial Sequence: Synthetic oligonucleotide
  Target: ATXN1; (-) strand; PAM type: YTN; PAM sequence: TTG
aacctagaaggcggaggttg

SEQ ID NO: 171423 - DNA, 20 bp, Artificial Sequence
  Description of Artificial Sequence: Synthetic oligonucleotide
  Target: ATXN1; (-) strand; PAM type: YTN; PAM sequence: CTT
gaacctagaaggcggaggtt

SEQ ID NO: 171424 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcgcttgaa

SEQ ID NO: 171425 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggcaggagaa

SEQ ID NO: 171426 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgaggcagga

SEQ ID NO: 171427 - DNA, 20 bp, Artificial Sequence
  Description of Artificial Sequence: Synthetic oligonucleotide
  Target: ATXN1; (-) strand; PAM type: YTN; PAM sequence: CTG
taatcccagctactcaggag

SEQ ID NO: 171428 - DNA, 20 bp, Artificial Sequence
  Description of Artificial Sequence: Synthetic oligonucleotide
  Target: ATXN1; (-) strand; PAM type: YTN; PAM sequence: TTA
gccaggtgtggtggcgggcg

SEQ ID NO: 171429 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattagccag

SEQ ID NO: 171430 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaattagc

SEQ ID NO: 171431 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaatta

SEQ ID NO: 171432 - DNA, 20 bp, Artificial Sequence
  Description of Artificial Sequence: Synthetic oligonucleotide
  Target: ATXN1; (-) strand; PAM type: YTN; PAM sequence: CTG
tctctactaaaaatacaaaa

SEQ ID NO: 171433 - DNA, 20 bp, Artificial Sequence
  Description of Artificial Sequence: Synthetic oligonucleotide
  Target: ATXN1; (-) strand; PAM type: YTN; PAM sequence: CTA
acatgatgaaaccctgtctc

SEQ ID NO: 171434 - DNA, 20 bp, Artificial Sequence
  Description of Artificial Sequence: Synthetic oligonucleotide
  Target: ATXN1; (-) strand; PAM type: YTN; PAM sequence: CTG
cctaacatgatgaaaccctg

SEQ ID NO: 171435 - DNA, 20 bp, Artificial Sequence
  Description of Artificial Sequence: Synthetic oligonucleotide
  Target: ATXN1; (-) strand; PAM type: YTN; PAM sequence: TTC
gagaccagcctgcctaacat

SEQ ID NO: 171436 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttcgagacca

SEQ ID NO: 171437 - DNA, 20 bp, Artificial Sequence
  Description of Artificial Sequence: Synthetic oligonucleotide
  Target: ATXN1; (-) strand; PAM type: YTN; PAM sequence: TTG
ggaggccaaagcgggtggat

SEQ ID NO: 171438 - DNA, 20 bp, Artificial Sequence
  Description of Artificial Sequence: Synthetic oligonucleotide
  Target: ATXN1; (-) strand; PAM type: YTN; PAM sequence: TTT
gggaggccaaagcgggtgga

SEQ ID NO: 171439 - DNA, 20 bp, Artificial Sequence
  Description of Artificial Sequence: Synthetic oligonucleotide
  Target: ATXN1; (-) strand; PAM type: YTN; PAM sequence: CTT
tgggaggccaaagcgggtgg

SEQ ID NO: 171440 - DNA, 20 bp, Artificial Sequence
  Description of Artificial Sequence: Synthetic oligonucleotide
  Target: ATXN1; (-) strand; PAM type: YTN; PAM sequence: CTA
gcactttgggaggccaaagc

SEQ ID NO: 171441 - DNA, 20 bp, Artificial Sequence
  Description of Artificial Sequence: Synthetic oligonucleotide
  Target: ATXN1; (-) strand; PAM type: YTN; PAM sequence: CTA
gtcctagcactttgggaggc

SEQ ID NO: 171442 - DNA, 20 bp, Artificial Sequence
  Description of Artificial Sequence: Synthetic oligonucleotide
  Target: ATXN1; (-) strand; PAM type: YTN; PAM sequence: CTC
tagtcctagcactttgggag

SEQ ID NO: 171443 - DNA, 20 bp, Artificial Sequence
  Description of Artificial Sequence: Synthetic oligonucleotide
  Target: ATXN1; (-) strand; PAM type: YTN; PAM sequence: CTC
atgcctctagtcctagcact

SEQ ID NO: 171444 - DNA, 20 bp, Artificial Sequence
  Description of Artificial Sequence: Synthetic oligonucleotide
  Target: ATXN1; (-) strand; PAM type: YTN; PAM sequence: TTG
aggtcgtgtgcgatggctca

SEQ ID NO: 171445 - DNA, 20 bp, Artificial Sequence
  Description of Artificial Sequence: Synthetic oligonucleotide
  Target: ATXN1; (-) strand; PAM type: YTN; PAM sequence: TTA
gagataaagaatggttgagg

SEQ ID NO: 171446 - DNA, 20 bp, Artificial Sequence
  Description of Artificial Sequence: Synthetic oligonucleotide
  Target: ATXN1; (-) strand; PAM type: YTN; PAM sequence: TTT
agagataaagaatggttgag

SEQ ID NO: 171447 - DNA, 20 bp, Artificial Sequence
  Description of Artificial Sequence: Synthetic oligonucleotide
  Target: ATXN1; (-) strand; PAM type: YTN; PAM sequence: TTG
tgagtttagagataaagaat

SEQ ID NO: 171448 - DNA, 20 bp, Artificial Sequence
  Description of Artificial Sequence: Synthetic oligonucleotide
  Target: ATXN1; (-) strand; PAM type: YTN; PAM sequence: CTT
gtgagtttagagataaagaa

SEQ ID NO: 171449 - DNA, 20 bp, Artificial Sequence
  Description of Artificial Sequence: Synthetic oligonucleotide
  Target: ATXN1; (-) strand; PAM type: YTN; PAM sequence: CTG
tcttgtgagtttagagataa

SEQ ID NO: 171450 - DNA, 20 bp, Artificial Sequence
  Description of Artificial Sequence: Synthetic oligonucleotide
  Target: ATXN1; (-) strand; PAM type: YTN; PAM sequence: TTG
agaaccactgtcttgtgagt

SEQ ID NO: 171451 - DNA, 20 bp, Artificial Sequence
  Description of Artificial Sequence: Synthetic oligonucleotide
  Target: ATXN1; (-) strand; PAM type: YTN; PAM sequence: TTT
gagaaccactgtcttgtgag

SEQ ID NO: 171452 - DNA, 20 bp, Artificial Sequence
  Description of Artificial Sequence: Synthetic oligonucleotide
  Target: ATXN1; (-) strand; PAM type: YTN; PAM sequence: CTT
tgagaaccactgtcttgtga

SEQ ID NO: 171453 - DNA, 20 bp, Artificial Sequence
  Description of Artificial Sequence: Synthetic oligonucleotide
  Target: ATXN1; (-) strand; PAM type: YTN; PAM sequence: CTC
actttgagaaccactgtctt

SEQ ID NO: 171454 - DNA, 20 bp, Artificial Sequence
  Description of Artificial Sequence: Synthetic oligonucleotide
  Target: ATXN1; (-) strand; PAM type: YTN; PAM sequence: CTG
ggtgactcactttgagaacc

SEQ ID NO: 171455 - DNA, 20 bp, Artificial Sequence
  Description of Artificial Sequence: Synthetic oligonucleotide
  Target: ATXN1; (-) strand; PAM type: YTN; PAM sequence: TTC
cctgggtgactcactttgag

SEQ ID NO: 171456 - DNA, 20 bp, Artificial Sequence
  Description of Artificial Sequence: Synthetic oligonucleotide
  Target: ATXN1; (-) strand; PAM type: YTN; PAM sequence: TTT
ccctgggtgactcactttga

SEQ ID NO: 171457 - DNA, 20 bp, Artificial Sequence
  Description of Artificial Sequence: Synthetic oligonucleotide
  Target: ATXN1; (-) strand; PAM type: YTN; PAM sequence: CTT
tccctgggtgactcactttg

SEQ ID NO: 171458 - DNA, 20 bp, Artificial Sequence
  Description of Artificial Sequence: Synthetic oligonucleotide
  Target: ATXN1; (-) strand; PAM type: YTN; PAM sequence: TTA
caggtgatcatgatgccgct

SEQ ID NO: 171459 - DNA, 20 bp, Artificial Sequence
  Description of Artificial Sequence: Synthetic oligonucleotide
  Target: ATXN1; (-) strand; PAM type: YTN; PAM sequence: TTT
acaggtgatcatgatgccgc

SEQ ID NO: 171460 - DNA, 20 bp, Artificial Sequence
  Description of Artificial Sequence: Synthetic oligonucleotide
  Target: ATXN1; (-) strand; PAM type: YTN; PAM sequence: TTG
taacaagtttacaggtgatc

SEQ ID NO: 171461 - DNA, 20 bp, Artificial Sequence
  Description of Artificial Sequence: Synthetic oligonucleotide
  Target: ATXN1; (-) strand; PAM type: YTN; PAM sequence: TTT
gtaacaagtttacaggtgat

SEQ ID NO: 171462 - DNA, 20 bp, Artificial Sequence
  Description of Artificial Sequence: Synthetic oligonucleotide
  Target: ATXN1; (-) strand; PAM type: YTN; PAM sequence: TTG
catttgtaacaagtttacag

SEQ ID NO: 171463 - DNA, 20 bp, Artificial Sequence
  Description of Artificial Sequence: Synthetic oligonucleotide
  Target: ATXN1; (-) strand; PAM type: YTN; PAM sequence: TTT
gcatttgtaacaagtttaca

SEQ ID NO: 171464 - DNA, 20 bp, Artificial Sequence
  Description of Artificial Sequence: Synthetic oligonucleotide
  Target: ATXN1; (-) strand; PAM type: YTN; PAM sequence: CTG
gaaagcccaagaatttgcat

SEQ ID NO: 171465 - DNA, 20 bp, Artificial Sequence
  Description of Artificial Sequence: Synthetic oligonucleotide
  Target: ATXN1; (-) strand; PAM type: YTN; PAM sequence: TTG
ctggaaagcccaagaatttg

SEQ ID NO: 171466 - DNA, 20 bp, Artificial Sequence
  Description of Artificial Sequence: Synthetic oligonucleotide
  Target: ATXN1; (-) strand; PAM type: YTN; PAM sequence: TTC
aaacacagattgctggaaag

SEQ ID NO: 171467 - DNA, 20 bp, Artificial Sequence
  Description of Artificial Sequence: Synthetic oligonucleotide
  Target: ATXN1; (-) strand; PAM type: YTN; PAM sequence: TTG
ttcaaacacagattgctgga

SEQ ID NO: 171468 - DNA, 20 bp, Artificial Sequence
  Description of Artificial Sequence: Synthetic oligonucleotide
  Target: ATXN1; (-) strand; PAM type: YTN; PAM sequence: CTT
gttcaaacacagattgctgg

SEQ ID NO: 171469 - DNA, 20 bp, Artificial Sequence
  Description of Artificial Sequence: Synthetic oligonucleotide
  Target: ATXN1; (-) strand; PAM type: YTN; PAM sequence: CTG
gaggacttgttcaaacacag

SEQ ID NO: 171470 - DNA, 20 bp, Artificial Sequence
  Description of Artificial Sequence: Synthetic oligonucleotide
  Target: ATXN1; (-) strand; PAM type: YTN; PAM sequence: TTG
cctggaggacttgttcaaac

SEQ ID NO: 171471 - DNA, 20 bp, Artificial Sequence
  Description of Artificial Sequence: Synthetic oligonucleotide
  Target: ATXN1; (-) strand; PAM type: YTN; PAM sequence: TTC
aagtgcatgggcattgcctg

SEQ ID NO: 171472 - DNA, 20 bp, Artificial Sequence
  Description of Artificial Sequence: Synthetic oligonucleotide
  Target: ATXN1; (-) strand; PAM type: YTN; PAM sequence: TTT
caagtgcatgggcattgcct

SEQ ID NO: 171473 - DNA, 20 bp, Artificial Sequence
  Description of Artificial Sequence: Synthetic oligonucleotide
  Target: ATXN1; (-) strand; PAM type: YTN; PAM sequence: CTG
tcaaatttcaagtgcatggg

SEQ ID NO: 171474 - DNA, 20 bp, Artificial Sequence
  Description of Artificial Sequence: Synthetic oligonucleotide
  Target: ATXN1; (-) strand; PAM type: YTN; PAM sequence: TTA
ctgtcaaatttcaagtgcat

SEQ ID NO: 171475 - DNA, 20 bp, Artificial Sequence
  Description of Artificial Sequence: Synthetic oligonucleotide
  Target: ATXN1; (-) strand; PAM type: YTN; PAM sequence: TTA
tgagagttactgtcaaattt

SEQ ID NO: 171476 - DNA, 20 bp, Artificial Sequence
  Description of Artificial Sequence: Synthetic oligonucleotide
  Target: ATXN1; (-) strand; PAM type: YTN; PAM sequence: CTT
atgagagttactgtcaaatt

SEQ ID NO: 171477 - DNA, 20 bp, Artificial Sequence
  Description of Artificial Sequence: Synthetic oligonucleotide
  Target: ATXN1; (-) strand; PAM type: YTN; PAM sequence: CTC
ttatgagagttactgtcaaa

SEQ ID NO: 171478 - DNA, 20 bp, Artificial Sequence
  Description of Artificial Sequence: Synthetic oligonucleotide
  Target: ATXN1; (-) strand; PAM type: YTN; PAM sequence: TTA
aggggagccatgtgacctct

SEQ ID NO: 171479 - DNA, 20 bp, Artificial Sequence
  Description of Artificial Sequence: Synthetic oligonucleotide
  Target: ATXN1; (-) strand; PAM type: YTN; PAM sequence: TTA
cattaaggggagccatgtga

SEQ ID NO: 171480 - DNA, 20 bp, Artificial Sequence
  Description of Artificial Sequence: Synthetic oligonucleotide
  Target: ATXN1; (-) strand; PAM type: YTN; PAM sequence: TTT
acattaaggggagccatgtg

SEQ ID NO: 171481 - DNA, 20 bp, Artificial Sequence
  Description of Artificial Sequence: Synthetic oligonucleotide
  Target: ATXN1; (-) strand; PAM type: YTN; PAM sequence: TTG
gtgtgtttacattaagggga

SEQ ID NO: 171482 - DNA, 20 bp, Artificial Sequence
  Description of Artificial Sequence: Synthetic oligonucleotide
  Target: ATXN1; (-) strand; PAM type: YTN; PAM sequence: TTT
ggtgtgtttacattaagggg

SEQ ID NO: 171483 - DNA, 20 bp, Artificial Sequence
  Description of Artificial Sequence: Synthetic oligonucleotide
  Target: ATXN1; (-) strand; PAM type: YTN; PAM sequence: TTT
tggtgtgtttacattaaggg

SEQ ID NO: 171484 - DNA, 20 bp, Artificial Sequence
  Description of Artificial Sequence: Synthetic oligonucleotide
  Target: ATXN1; (-) strand; PAM type: YTN; PAM sequence: TTC
attttggtgtgtttacatta

SEQ ID NO: 171485 - DNA, 20 bp, Artificial Sequence
  Description of Artificial Sequence: Synthetic oligonucleotide
  Target: ATXN1; (-) strand; PAM type: YTN; PAM sequence: CTT
cattttggtgtgtttacatt

SEQ ID NO: 171486 - DNA, 20 bp, Artificial Sequence
  Description of Artificial Sequence: Synthetic oligonucleotide
  Target: ATXN1; (-) strand; PAM type: YTN; PAM sequence: TTA
cttcattttggtgtgtttac

SEQ ID NO: 171487 - DNA, 20 bp, Artificial Sequence
  Description of Artificial Sequence: Synthetic oligonucleotide
  Target: ATXN1; (-) strand; PAM type: YTN; PAM sequence: CTT
acttcattttggtgtgttta

SEQ ID NO: 171488 - DNA, 20 bp, Artificial Sequence
  Description of Artificial Sequence: Synthetic oligonucleotide
  Target: ATXN1; (-) strand; PAM type: YTN; PAM sequence: TTC
ttacttcattttggtgtgtt

SEQ ID NO: 171489 - DNA, 20 bp, Artificial Sequence
  Description of Artificial Sequence: Synthetic oligonucleotide
  Target: ATXN1; (-) strand; PAM type: YTN; PAM sequence: TTA
aaagaaaatggttcttactt

SEQ ID NO: 171490 - DNA, 20 bp, Artificial Sequence
  Description of Artificial Sequence: Synthetic oligonucleotide
  Target: ATXN1; (-) strand; PAM type: YTN; PAM sequence: CTT
aaaagaaaatggttcttact

SEQ ID NO: 171491 - DNA, 20 bp, Artificial Sequence
  Description of Artificial Sequence: Synthetic oligonucleotide
  Target: ATXN1; (-) strand; PAM type: YTN; PAM sequence: TTC
ttaaaagaaaatggttctta

SEQ ID NO: 171492 - DNA, 20 bp, Artificial Sequence
  Description of Artificial Sequence: Synthetic oligonucleotide
  Target: ATXN1; (-) strand; PAM type: YTN; PAM sequence: CTT
cttaaaagaaaatggttctt

SEQ ID NO: 171493 - DNA, 20 bp, Artificial Sequence
  Description of Artificial Sequence: Synthetic oligonucleotide
  Target: ATXN1; (-) strand; PAM type: YTN; PAM sequence: TTG
aaacttcttaaaagaaaatg

SEQ ID NO: 171494 - DNA, 20 bp, Artificial Sequence
  Description of Artificial Sequence: Synthetic oligonucleotide
  Target: ATXN1; (-) strand; PAM type: YTN; PAM sequence: CTT
gaaacttcttaaaagaaaat

SEQ ID NO: 171495 - DNA, 20 bp, Artificial Sequence
  Description of Artificial Sequence: Synthetic oligonucleotide
  Target: ATXN1; (-) strand; PAM type: YTN; PAM sequence: CTG
aaggtcttgaaacttcttaa

SEQ ID NO: 171496 - DNA, 20 bp, Artificial Sequence
  Description of Artificial Sequence: Synthetic oligonucleotide
  Target: ATXN1; (-) strand; PAM type: YTN; PAM sequence: CTC
gaataaaatgtctgaaggtc

SEQ ID NO: 171497 - DNA, 20 bp, Artificial Sequence
  Description of Artificial Sequence: Synthetic oligonucleotide
  Target: ATXN1; (-) strand; PAM type: YTN; PAM sequence: TTA
ctcgaataaaatgtctgaag

SEQ ID NO: 171498 - DNA, 20 bp, Artificial Sequence
  Description of Artificial Sequence: Synthetic oligonucleotide
  Target: ATXN1; (-) strand; PAM type: YTN; PAM sequence: TTT
actcgaataaaatgtctgaa

SEQ ID NO: 171499 - DNA, 20 bp, Artificial Sequence
  Description of Artificial Sequence: Synthetic oligonucleotide
  Target: ATXN1; (-) strand; PAM type: YTN; PAM sequence: TTA
tgaatttactcgaataaaat

SEQ ID NO: 171500 - DNA, 20 bp, Artificial Sequence
  Description of Artificial Sequence: Synthetic oligonucleotide
  Target: ATXN1; (-) strand; PAM type: YTN; PAM sequence: CTT
atgaatttactcgaataaaa

SEQ ID NO: 171501 - DNA, 20 bp, Artificial Sequence
  Description of Artificial Sequence: Synthetic oligonucleotide
  Target: ATXN1; (-) strand; PAM type: YTN; PAM sequence: TTG
cttatgaatttactcgaata

SEQ ID NO: 171502 - DNA, 20 bp, Artificial Sequence
  Description of Artificial Sequence: Synthetic oligonucleotide
  Target: ATXN1; (-) strand; PAM type: YTN; PAM sequence: TTT
gcttatgaatttactcgaat

SEQ ID NO: 171503 - DNA, 20 bp, Artificial Sequence
  Description of Artificial Sequence: Synthetic oligonucleotide
  Target: ATXN1; (-) strand; PAM type: YTN; PAM sequence: TTT
tgcttatgaatttactcgaa

SEQ ID NO: 171504 - DNA, 20 bp, Artificial Sequence
  Description of Artificial Sequence: Synthetic oligonucleotide
  Target: ATXN1; (-) strand; PAM type: YTN; PAM sequence: TTG
tgttttgcttatgaatttac

SEQ ID NO: 171505 - DNA, 20 bp, Artificial Sequence
  Description of Artificial Sequence: Synthetic oligonucleotide
  Target: ATXN1; (-) strand; PAM type: YTN; PAM sequence: CTT
gtgttttgcttatgaattta

SEQ ID NO: 171506 - DNA, 20 bp, Artificial Sequence
  Description of Artificial Sequence: Synthetic oligonucleotide
  Target: ATXN1; (-) strand; PAM type: YTN; PAM sequence: TTA
agcaaaaaagtcaatatgtg

SEQ ID NO: 171507 - DNA, 20 bp, Artificial Sequence
  Description of Artificial Sequence: Synthetic oligonucleotide
  Target: ATXN1; (-) strand; PAM type: YTN; PAM sequence: TTA
ttaagcaaaaaagtcaatat

SEQ ID NO: 171508 - DNA, 20 bp, Artificial Sequence
  Description of Artificial Sequence: Synthetic oligonucleotide
  Target: ATXN1; (-) strand; PAM type: YTN; PAM sequence: TTT
attaagcaaaaaagtcaata

SEQ ID NO: 171509 - DNA, 20 bp, Artificial Sequence
  Description of Artificial Sequence: Synthetic oligonucleotide
  Target: ATXN1; (-) strand; PAM type: YTN; PAM sequence: CTG
agaaaatcatatttattaag

SEQ ID NO: 171510 - DNA, 20 bp, Artificial Sequence
  Description of Artificial Sequence: Synthetic oligonucleotide
  Target: ATXN1; (-) strand; PAM type: YTN; PAM sequence: TTA
gtgggtctgagaaaatcata

SEQ ID NO: 171511 - DNA, 20 bp, Artificial Sequence
  Description of Artificial Sequence: Synthetic oligonucleotide
  Target: ATXN1; (-) strand; PAM type: YTN; PAM sequence: CTG
ttagtgggtctgagaaaatc

SEQ ID NO: 171512 - DNA, 20 bp, Artificial Sequence
  Description of Artificial Sequence: Synthetic oligonucleotide
  Target: ATXN1; (-) strand; PAM type: YTN; PAM sequence: TTG
tgtgggtgaaacatgtgatc

SEQ ID NO: 171513 - DNA, 20 bp, Artificial Sequence
  Description of Artificial Sequence: Synthetic oligonucleotide
  Target: ATXN1; (-) strand; PAM type: YTN; PAM sequence: TTT
gtgtgggtgaaacatgtgat

SEQ ID NO: 171514 - DNA, 20 bp, Artificial Sequence
  Description of Artificial Sequence: Synthetic oligonucleotide
  Target: ATXN1; (-) strand; PAM type: YTN; PAM sequence: TTT
tgtgtgggtgaaacatgtga

SEQ ID NO: 171515 - DNA, 20 bp, Artificial Sequence
  Description of Artificial Sequence: Synthetic oligonucleotide
  Target: ATXN1; (-) strand; PAM type: YTN; PAM sequence: CTA
ttttgtgtgggtgaaacatg

SEQ ID NO: 171516 - DNA, 20 bp, Artificial Sequence
  Description of Artificial Sequence: Synthetic oligonucleotide
  Target: ATXN1; (-) strand; PAM type: YTN; PAM sequence: TTC
gtaagtcatacactattttg

SEQ ID NO: 171517 - DNA, 20 bp, Artificial Sequence
  Description of Artificial Sequence: Synthetic oligonucleotide
  Target: ATXN1; (-) strand; PAM type: YTN; PAM sequence: CTG
tgatcattcgtaagtcatac

SEQ ID NO: 171518 - DNA, 20 bp, Artificial Sequence
  Description of Artificial Sequence: Synthetic oligonucleotide
  Target: ATXN1; (-) strand; PAM type: YTN; PAM sequence: CTC
tgtgatcattcgtaagtcat

SEQ ID NO: 171519 - DNA, 20 bp, Artificial Sequence
  Description of Artificial Sequence: Synthetic oligonucleotide
  Target: ATXN1; (-) strand; PAM type: YTN; PAM sequence: TTC
tctgtgatcattcgtaagtc

SEQ ID NO: 171520 - DNA, 20 bp, Artificial Sequence
  Description of Artificial Sequence: Synthetic oligonucleotide
  Target: ATXN1; (-) strand; PAM type: YTN; PAM sequence: CTT
ctctgtgatcattcgtaagt

SEQ ID NO: 171521 - DNA, 20 bp, Artificial Sequence
  Description of Artificial Sequence: Synthetic oligonucleotide
  Target: ATXN1; (-) strand; PAM type: YTN; PAM sequence: TTC
ttctctgtgatcattcgtaa

SEQ ID NO: 171522 - DNA, 20 bp, Artificial Sequence
  Description of Artificial Sequence: Synthetic oligonucleotide
  Target: ATXN1; (-) strand; PAM type: YTN; PAM sequence: CTG
tgattcttctctgtgatcat

SEQ ID NO: 171523 - DNA, 20 bp, Artificial Sequence
  Description of Artificial Sequence: Synthetic oligonucleotide
  Target: ATXN1; (-) strand; PAM type: YTN; PAM sequence: TTA
aaaagccactgtgattcttc

SEQ ID NO: 171524 - DNA, 20 bp, Artificial Sequence
  Description of Artificial Sequence: Synthetic oligonucleotide
  Target: ATXN1; (-) strand; PAM type: YTN; PAM sequence: TTT
aaaaagccactgtgattctt

SEQ ID NO: 171525 - DNA, 20 bp, Artificial Sequence
  Description of Artificial Sequence: Synthetic oligonucleotide
  Target: ATXN1; (-) strand; PAM type: YTN; PAM sequence: TTA
aaaatttaaaaagccactgt

SEQ ID NO: 171526 - DNA, 20 bp, Artificial Sequence
  Description of Artificial Sequence: Synthetic oligonucleotide
  Target: ATXN1; (-) strand; PAM type: YTN; PAM sequence: CTA
aaaaaaataaatatatacaa

SEQ ID NO: 171527 - DNA, 20 bp, Artificial Sequence
  Description of Artificial Sequence: Synthetic oligonucleotide
  Target: ATXN1; (-) strand; PAM type: YTN; PAM sequence: CTC
taaaaaaaataaatatatac

SEQ ID NO: 171528 - DNA, 20 bp, Artificial Sequence
  Description of Artificial Sequence: Synthetic oligonucleotide
  Target: ATXN1; (-) strand; PAM type: YTN; PAM sequence: CTG
tctctaaaaaaaataaatat

SEQ ID NO: 171529 - DNA, 20 bp, Artificial Sequence
  Description of Artificial Sequence: Synthetic oligonucleotide
  Target: ATXN1; (-) strand; PAM type: YTN; PAM sequence: CTA
tggatgtaacccagaaagac

SEQ ID NO: 171530 - DNA, 20 bp, Artificial Sequence
  Description of Artificial Sequence: Synthetic oligonucleotide
  Target: ATXN1; (-) strand; PAM type: YTN; PAM sequence: CTG
cagtgagctatggatgtaac

SEQ ID NO: 171531 - DNA, 20 bp, Artificial Sequence
  Description of Artificial Sequence: Synthetic oligonucleotide
  Target: ATXN1; (-) strand; PAM type: YTN; PAM sequence: TTG
aggctgcagtgagctatgga

SEQ ID NO: 171532 - DNA, 20 bp, Artificial Sequence
  Description of Artificial Sequence: Synthetic oligonucleotide
  Target: ATXN1; (-) strand; PAM type: YTN; PAM sequence: TTT
gaggctgcagtgagctatgg

SEQ ID NO: 171533 - DNA, 20 bp, Artificial Sequence
  Description of Artificial Sequence: Synthetic oligonucleotide
  Target: ATXN1; (-) strand; PAM type: YTN; PAM sequence: TTG
agcccaggagtttgaggctg

SEQ ID NO: 171534 - DNA, 20 bp, Artificial Sequence
  Description of Artificial Sequence: Synthetic oligonucleotide
  Target: ATXN1; (-) strand; PAM type: YTN; PAM sequence: CTT
gagcccaggagtttgaggct

SEQ ID NO: 171535 - DNA, 20 bp, Artificial Sequence
  Description of Artificial Sequence: Synthetic oligonucleotide
  Target: ATXN1; (-) strand; PAM type: YTN; PAM sequence: TTG
cttgagcccaggagtttgag

SEQ ID NO: 171536 - DNA, 20 bp, Artificial Sequence
  Description of Artificial Sequence: Synthetic oligonucleotide
  Target: ATXN1; (-) strand; PAM type: YTN; PAM sequence: CTG
atgtgggaggattgcttgag

SEQ ID NO: 171537 - DNA, 20 bp, Artificial Sequence
  Description of Artificial Sequence: Synthetic oligonucleotide
  Target: ATXN1; (-) strand; PAM type: YTN; PAM sequence: CTC
aggaggctgatgtgggagga

SEQ ID NO: 171538 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgatgtggga

SEQ ID NO: 171539 - DNA, 20 bp, Artificial Sequence
  Description of Artificial Sequence: Synthetic oligonucleotide
  Target: ATXN1; (-) strand; PAM type: YTN; PAM sequence: TTA
gctactcaggaggctgatgt

SEQ ID NO: 171540 - DNA, 20 bp, Artificial Sequence
  Description of Artificial Sequence: Synthetic oligonucleotide
  Target: ATXN1; (-) strand; PAM type: YTN; PAM sequence: CTT
agctactcaggaggctgatg

SEQ ID NO: 171541 - DNA, 20 bp, Artificial Sequence
  Description of Artificial Sequence: Synthetic oligonucleotide
  Target: ATXN1; (-) strand; PAM type: YTN; PAM sequence: CTG
tagtcttagctactcaggag

SEQ ID NO: 171542 - DNA, 20 bp, Artificial Sequence
  Description of Artificial Sequence: Synthetic oligonucleotide
  Target: ATXN1; (-) strand; PAM type: YTN; PAM sequence: CTC
tgtagtcttagctactcagg

SEQ ID NO: 171543 - DNA, 20 bp, Artificial Sequence
  Description of Artificial Sequence: Synthetic oligonucleotide
  Target: ATXN1; (-) strand; PAM type: YTN; PAM sequence: TTG
tacatctctgtagtcttagc

SEQ ID NO: 171544 - DNA, 20 bp, Artificial Sequence
  Description of Artificial Sequence: Synthetic oligonucleotide
  Target: ATXN1; (-) strand; PAM type: YTN; PAM sequence: TTA
gccgggtatggttgtacatc

SEQ ID NO: 171545 - DNA, 20 bp, Artificial Sequence
  Description of Artificial Sequence: Synthetic oligonucleotide
  Target: ATXN1; (-) strand; PAM type: YTN; PAM sequence: TTA
aaaattagccgggtatggtt

SEQ ID NO: 171546 - DNA, 20 bp, Artificial Sequence
  Description of Artificial Sequence: Synthetic oligonucleotide
  Target: ATXN1; (-) strand; PAM type: YTN; PAM sequence: TTT
aaaaattagccgggtatggt

SEQ ID NO: 171547 - DNA, 20 bp, Artificial Sequence
  Description of Artificial Sequence: Synthetic oligonucleotide
  Target: ATXN1; (-) strand; PAM type: YTN; PAM sequence: CTA
caaaaaaatttaaaaattag

SEQ ID NO: 171548 - DNA, 20 bp, Artificial Sequence
  Description of Artificial Sequence: Synthetic oligonucleotide
  Target: ATXN1; (-) strand; PAM type: YTN; PAM sequence: CTC
tacaaaaaaatttaaaaatt

SEQ ID NO: 171549 - DNA, 20 bp, Artificial Sequence
  Description of Artificial Sequence: Synthetic oligonucleotide
  Target: ATXN1; (-) strand; PAM type: YTN; PAM sequence: CTC
tctacaaaaaaatttaaaaa

SEQ ID NO: 171550 - DNA, 20 bp, Artificial Sequence
  Description of Artificial Sequence: Synthetic oligonucleotide
  Target: ATXN1; (-) strand; PAM type: YTN; PAM sequence: CTC
ctctctacaaaaaaatttaa

SEQ ID NO: 171551 - DNA, 20 bp, Artificial Sequence
  Description of Artificial Sequence: Synthetic oligonucleotide
  Target: ATXN1; (-) strand; PAM type: YTN; PAM sequence: CTG
ggcaaaaaagcaaaactcct

SEQ ID NO: 171552 - DNA, 20 bp, Artificial Sequence
  Description of Artificial Sequence: Synthetic oligonucleotide
  Target: ATXN1; (-) strand; PAM type: YTN; PAM sequence: TTC
aagaccggcctgggcaaaaa

SEQ ID NO: 171553 - DNA, 20 bp, Artificial Sequence
  Description of Artificial Sequence: Synthetic oligonucleotide
  Target: ATXN1; (-) strand; PAM type: YTN; PAM sequence: TTG
aggtcaggaattcaagaccg

SEQ ID NO: 171554 - DNA, 20 bp, Artificial Sequence
  Description of Artificial Sequence: Synthetic oligonucleotide
  Target: ATXN1; (-) strand; PAM type: YTN; PAM sequence: CTT
gaggtcaggaattcaagacc

SEQ ID NO: 171555 - DNA, 20 bp, Artificial Sequence
  Description of Artificial Sequence: Synthetic oligonucleotide
  Target: ATXN1; (-) strand; PAM type: YTN; PAM sequence: TTG
gaaggccaaggtaggaagat

SEQ ID NO: 171556 - DNA, 20 bp, Artificial Sequence
  Description of Artificial Sequence: Synthetic oligonucleotide
  Target: ATXN1; (-) strand; PAM type: YTN; PAM sequence: TTT
ggaaggccaaggtaggaaga

SEQ ID NO: 171557 - DNA, 20 bp, Artificial Sequence
  Description of Artificial Sequence: Synthetic oligonucleotide
  Target: ATXN1; (-) strand; PAM type: YTN; PAM sequence: CTT
tggaaggccaaggtaggaag

SEQ ID NO: 171558 - DNA, 20 bp, Artificial Sequence
  Description of Artificial Sequence: Synthetic oligonucleotide
  Target: ATXN1; (-) strand; PAM type: YTN; PAM sequence: TTC
caacactttggaaggccaag

SEQ ID NO: 171559 - DNA, 20 bp, Artificial Sequence
  Description of Artificial Sequence: Synthetic oligonucleotide
  Target: ATXN1; (-) strand; PAM type: YTN; PAM sequence: CTA
caattccaacactttggaag

SEQ ID NO: 171560 - DNA, 20 bp, Artificial Sequence
  Description of Artificial Sequence: Synthetic oligonucleotide
  Target: ATXN1; (-) strand; PAM type: YTN; PAM sequence: TTC
acacctacaattccaacact

SEQ ID NO: 171561 - DNA, 20 bp, Artificial Sequence
  Description of Artificial Sequence: Synthetic oligonucleotide
  Target: ATXN1; (-) strand; PAM type: YTN; PAM sequence: CTA
tgaaccatcatgatggttca

SEQ ID NO: 171562 - DNA, 20 bp, Artificial Sequence
  Description of Artificial Sequence: Synthetic oligonucleotide
  Target: ATXN1; (-) strand; PAM type: YTN; PAM sequence: CTC
actatgaaccatcatgatgg

SEQ ID NO: 171563 - DNA, 20 bp, Artificial Sequence
  Description of Artificial Sequence: Synthetic oligonucleotide
  Target: ATXN1; (-) strand; PAM type: YTN; PAM sequence: CTA
aacaactcactatgaaccat

SEQ ID NO: 171564 - DNA, 20 bp, Artificial Sequence
  Description of Artificial Sequence: Synthetic oligonucleotide
  Target: ATXN1; (-) strand; PAM type: YTN; PAM sequence: TTA
aactaaacaactcactatga

SEQ ID NO: 171565 - DNA, 20 bp, Artificial Sequence
  Description of Artificial Sequence: Synthetic oligonucleotide
  Target: ATXN1; (-) strand; PAM type: YTN; PAM sequence: TTT
aaactaaacaactcactatg

SEQ ID NO: 171566 - DNA, 20 bp, Artificial Sequence
  Description of Artificial Sequence: Synthetic oligonucleotide
  Target: ATXN1; (-) strand; PAM type: YTN; PAM sequence: TTT
taaactaaacaactcactat

SEQ ID NO: 171567 - DNA, 20 bp, Artificial Sequence
  Description of Artificial Sequence: Synthetic oligonucleotide
  Target: ATXN1; (-) strand; PAM type: YTN; PAM sequence: TTG
taggcaaataatgtagagat

SEQ ID NO: 171568 - DNA, 20 bp, Artificial Sequence
  Description of Artificial Sequence: Synthetic oligonucleotide
  Target: ATXN1; (-) strand; PAM type: YTN; PAM sequence: TTT
gtaggcaaataatgtagaga

SEQ ID NO: 171569 - DNA, 20 bp, Artificial Sequence
  Description of Artificial Sequence: Synthetic oligonucleotide
  Target: ATXN1; (-) strand; PAM type: YTN; PAM sequence: TTG
gtagacatatttgtaggcaa

SEQ ID NO: 171570 - DNA, 20 bp, Artificial Sequence
  Description of Artificial Sequence: Synthetic oligonucleotide
  Target: ATXN1; (-) strand; PAM type: YTN; PAM sequence: TTT
ggtagacatatttgtaggca

SEQ ID NO: 171571 - DNA, 20 bp, Artificial Sequence
  Description of Artificial Sequence: Synthetic oligonucleotide
  Target: ATXN1; (-) strand; PAM type: YTN; PAM sequence: CTG
gtcatatgtcatgaatttgg

SEQ ID NO: 171572 - DNA, 20 bp, Artificial Sequence
  Description of Artificial Sequence: Synthetic oligonucleotide
  Target: ATXN1; (-) strand; PAM type: YTN; PAM sequence: TTC
agacacactggtcatatgtc

SEQ ID NO: 171573 - DNA, 20 bp, Artificial Sequence
  Description of Artificial Sequence: Synthetic oligonucleotide
  Target: ATXN1; (-) strand; PAM type: YTN; PAM sequence: CTG
gtatgtattcagacacactg

SEQ ID NO: 171574 - DNA, 20 bp, Artificial Sequence
  Description of Artificial Sequence: Synthetic oligonucleotide
  Target: ATXN1; (-) strand; PAM type: YTN; PAM sequence: TTA
aaacgtcagtgccataaaca

SEQ ID NO: 171575 - DNA, 20 bp, Artificial Sequence
  Description of Artificial Sequence: Synthetic oligonucleotide
  Target: ATXN1; (-) strand; PAM type: YTN; PAM sequence: CTT
aaaacgtcagtgccataaac

SEQ ID NO: 171576 - DNA, 20 bp, Artificial Sequence
  Description of Artificial Sequence: Synthetic oligonucleotide
  Target: ATXN1; (-) strand; PAM type: YTN; PAM sequence: TTC
cgaacaggacttaaaacgtc

SEQ ID NO: 171577 - DNA, 20 bp, Artificial Sequence
  Description of Artificial Sequence: Synthetic oligonucleotide
  Target: ATXN1; (-) strand; PAM type: YTN; PAM sequence: TTT
ccgaacaggacttaaaacgt

SEQ ID NO: 171578 - DNA, 20 bp, Artificial Sequence
  Description of Artificial Sequence: Synthetic oligonucleotide
  Target: ATXN1; (-) strand; PAM type: YTN; PAM sequence: TTG
tgtttccgaacaggacttaa

SEQ ID NO: 171579 - DNA, 20 bp, Artificial Sequence
  Description of Artificial Sequence: Synthetic oligonucleotide
  Target: ATXN1; (-) strand; PAM type: YTN; PAM sequence: TTT
gtgtttccgaacaggactta

SEQ ID NO: 171580 - DNA, 20 bp, Artificial Sequence
  Description of Artificial Sequence: Synthetic oligonucleotide
  Target: ATXN1; (-) strand; PAM type: YTN; PAM sequence: TTT
tgtgtttccgaacaggactt

SEQ ID NO: 171581 - DNA, 20 bp, Artificial Sequence
  Description of Artificial Sequence: Synthetic oligonucleotide
  Target: ATXN1; (-) strand; PAM type: YTN; PAM sequence: CTA
agtagtgcattttgtgtttc

SEQ ID NO: 171582 - DNA, 20 bp, Artificial Sequence
  Description of Artificial Sequence: Synthetic oligonucleotide
  Target: ATXN1; (-) strand; PAM type: YTN; PAM sequence: TTA
gtcacatatggaagctaagt

SEQ ID NO: 171583 - DNA, 20 bp, Artificial Sequence
  Description of Artificial Sequence: Synthetic oligonucleotide
  Target: ATXN1; (-) strand; PAM type: YTN; PAM sequence: TTA
aaattagtcacatatggaag

SEQ ID NO: 171584 - DNA, 20 bp, Artificial Sequence
  Description of Artificial Sequence: Synthetic oligonucleotide
  Target: ATXN1; (-) strand; PAM type: YTN; PAM sequence: TTT
aaaattagtcacatatggaa

SEQ ID NO: 171585 - DNA, 20 bp, Artificial Sequence
  Description of Artificial Sequence: Synthetic oligonucleotide
  Target: ATXN1; (-) strand; PAM type: YTN; PAM sequence: TTT
taaaattagtcacatatgga

SEQ ID NO: 171586 - DNA, 20 bp, Artificial Sequence
  Description of Artificial Sequence: Synthetic oligonucleotide
  Target: ATXN1; (-) strand; PAM type: YTN; PAM sequence: CTA
aaaagcatattttaaaatta

SEQ ID NO: 171587 - DNA, 20 bp, Artificial Sequence
  Description of Artificial Sequence: Synthetic oligonucleotide
  Target: ATXN1; (-) strand; PAM type: YTN; PAM sequence: CTG
gcctaaaaagcatattttaa

SEQ ID NO: 171588 - DNA, 20 bp, Artificial Sequence
  Description of Artificial Sequence: Synthetic oligonucleotide
  Target: ATXN1; (-) strand; PAM type: YTN; PAM sequence: CTG
cgtctggcctaaaaagcata

SEQ ID NO: 171589 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccactgcgtc

SEQ ID NO: 171590 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgtgagccac

SEQ ID NO: 171591 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 171592 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 171593 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 171594 - DNA, 20 bp, Artificial Sequence
  Description of Artificial Sequence: Synthetic oligonucleotide
  Target: ATXN1; (-) strand; PAM type: YTN; PAM sequence: CTC
ccaccttggcctcccaaagt

SEQ ID NO: 171595 - DNA, 20 bp, Artificial Sequence
  Description of Artificial Sequence: Synthetic oligonucleotide
  Target: ATXN1; (-) strand; PAM type: YTN; PAM sequence: CTC
gtgatcctcccaccttggcc

SEQ ID NO: 171596 - DNA, 20 bp, Artificial Sequence
  Description of Artificial Sequence: Synthetic oligonucleotide
  Target: ATXN1; (-) strand; PAM type: YTN; PAM sequence: CTG
acctcgtgatcctcccacct

SEQ ID NO: 171597 - DNA, 20 bp, Artificial Sequence
  Description of Artificial Sequence: Synthetic oligonucleotide
  Target: ATXN1; (-) strand; PAM type: YTN; PAM sequence: CTC
ctgacctcgtgatcctccca

SEQ ID NO: 171598 - DNA, 20 bp, Artificial Sequence
  Description of Artificial Sequence: Synthetic oligonucleotide
  Target: ATXN1; (-) strand; PAM type: YTN; PAM sequence: TTG
aactcctgacctcgtgatcc

SEQ ID NO: 171599 - DNA, 20 bp, Artificial Sequence
  Description of Artificial Sequence: Synthetic oligonucleotide
  Target: ATXN1; (-) strand; PAM type: YTN; PAM sequence: CTT
gaactcctgacctcgtgatc

SEQ ID NO: 171600 - DNA, 20 bp, Artificial Sequence
  Description of Artificial Sequence: Synthetic oligonucleotide
  Target: ATXN1; (-) strand; PAM type: YTN; PAM sequence: CTG
gtcttgaactcctgacctcg

SEQ ID NO: 171601 - DNA, 20 bp, Artificial Sequence
  Description of Artificial Sequence: Synthetic oligonucleotide
  Target: ATXN1; (-) strand; PAM type: YTN; PAM sequence: TTG
gccagactggtcttgaactc

SEQ ID NO: 171602 - DNA, 20 bp, Artificial Sequence
  Description of Artificial Sequence: Synthetic oligonucleotide
  Target: ATXN1; (-) strand; PAM type: YTN; PAM sequence: CTG
tgttggccagactggtcttg

SEQ ID NO: 171603 - DNA, 20 bp, Artificial Sequence
  Description of Artificial Sequence: Synthetic oligonucleotide
  Target: ATXN1; (-) strand; PAM type: YTN; PAM sequence: TTC
actgtgttggccagactggt

SEQ ID NO: 171604 - DNA, 20 bp, Artificial Sequence
  Description of Artificial Sequence: Synthetic oligonucleotide
  Target: ATXN1; (-) strand; PAM type: YTN; PAM sequence: TTT
cactgtgttggccagactgg

SEQ ID NO: 171605 - DNA, 20 bp, Artificial Sequence
  Description of Artificial Sequence: Synthetic oligonucleotide
  Target: ATXN1; (-) strand; PAM type: YTN; PAM sequence: TTG
taatacagacaagatttcac

SEQ ID NO: 171606 - DNA, 20 bp, Artificial Sequence
  Description of Artificial Sequence: Synthetic oligonucleotide
  Target: ATXN1; (-) strand; PAM type: YTN; PAM sequence: TTA
ttgtaatacagacaagattt

SEQ ID NO: 171607 - DNA, 20 bp, Artificial Sequence
  Description of Artificial Sequence: Synthetic oligonucleotide
  Target: ATXN1; (-) strand; PAM type: YTN; PAM sequence: TTT
attgtaatacagacaagatt

SEQ ID NO: 171608 - DNA, 20 bp, Artificial Sequence
  Description of Artificial Sequence: Synthetic oligonucleotide
  Target: ATXN1; (-) strand; PAM type: YTN; PAM sequence: CTT
tattgtaatacagacaagat

SEQ ID NO: 171609 - DNA, 20 bp, Artificial Sequence
  Description of Artificial Sequence: Synthetic oligonucleotide
  Target: ATXN1; (-) strand; PAM type: YTN; PAM sequence: TTA
cactttattgtaatacagac

SEQ ID NO: 171610 - DNA, 20 bp, Artificial Sequence
  Description of Artificial Sequence: Synthetic oligonucleotide
  Target: ATXN1; (-) strand; PAM type: YTN; PAM sequence: TTG
aaaaggtattacactttatt

SEQ ID NO: 171611 - DNA, 20 bp, Artificial Sequence
  Description of Artificial Sequence: Synthetic oligonucleotide
  Target: ATXN1; (-) strand; PAM type: YTN; PAM sequence: TTA
gaatcccatgttgaaaaggt

SEQ ID NO: 171612 - DNA, 20 bp, Artificial Sequence
  Description of Artificial Sequence: Synthetic oligonucleotide
  Target: ATXN1; (-) strand; PAM type: YTN; PAM sequence: TTC
catgttagaatcccatgttg

SEQ ID NO: 171613 - DNA, 20 bp, Artificial Sequence
  Description of Artificial Sequence: Synthetic oligonucleotide
  Target: ATXN1; (-) strand; PAM type: YTN; PAM sequence: TTA
caaaaaaaaaaaaaaaaagg

SEQ ID NO: 171614 - DNA, 20 bp, Artificial Sequence
  Description of Artificial Sequence: Synthetic oligonucleotide
  Target: ATXN1; (-) strand; PAM type: YTN; PAM sequence: CTA
ggggagggaggcacgaatta

SEQ ID NO: 171615 - DNA, 20 bp, Artificial Sequence
  Description of Artificial Sequence: Synthetic oligonucleotide
  Target: ATXN1; (-) strand; PAM type: YTN; PAM sequence: TTA
aaactaggggagggaggcac

SEQ ID NO: 171616 - DNA, 20 bp, Artificial Sequence
  Description of Artificial Sequence: Synthetic oligonucleotide
  Target: ATXN1; (-) strand; PAM type: YTN; PAM sequence: TTG
gaccaagcataggttaaaac

SEQ ID NO: 171617 - DNA, 20 bp, Artificial Sequence
  Description of Artificial Sequence: Synthetic oligonucleotide
  Target: ATXN1; (-) strand; PAM type: YTN; PAM sequence: TTT
ggaccaagcataggttaaaa

SEQ ID NO: 171618 - DNA, 20 bp, Artificial Sequence
  Description of Artificial Sequence: Synthetic oligonucleotide
  Target: ATXN1; (-) strand; PAM type: YTN; PAM sequence: TTA
gaccacagaaacatagaccc

SEQ ID NO: 171619 - DNA, 20 bp, Artificial Sequence
  Description of Artificial Sequence: Synthetic oligonucleotide
  Target: ATXN1; (-) strand; PAM type: YTN; PAM sequence: CTT
agaccacagaaacatagacc

SEQ ID NO: 171620 - DNA, 20 bp, Artificial Sequence
  Description of Artificial Sequence: Synthetic oligonucleotide
  Target: ATXN1; (-) strand; PAM type: YTN; PAM sequence: TTA
aagaagtgtcttagaccaca

SEQ ID NO: 171621 - DNA, 20 bp, Artificial Sequence
  Description of Artificial Sequence: Synthetic oligonucleotide
  Target: ATXN1; (-) strand; PAM type: YTN; PAM sequence: CTT
aaagaagtgtcttagaccac

SEQ ID NO: 171622 - DNA, 20 bp, Artificial Sequence
  Description of Artificial Sequence: Synthetic oligonucleotide
  Target: ATXN1; (-) strand; PAM type: YTN; PAM sequence: TTA
tcttaaagaagtgtcttaga

SEQ ID NO: 171623 - DNA, 20 bp, Artificial Sequence
  Description of Artificial Sequence: Synthetic oligonucleotide
  Target: ATXN1; (-) strand; PAM type: YTN; PAM sequence: CTT
atcttaaagaagtgtcttag

SEQ ID NO: 171624 - DNA, 20 bp, Artificial Sequence
  Description of Artificial Sequence: Synthetic oligonucleotide
  Target: ATXN1; (-) strand; PAM type: YTN; PAM sequence: TTA
ggcatcgggcttatcttaaa

SEQ ID NO: 171625 - DNA, 20 bp, Artificial Sequence
  Description of Artificial Sequence: Synthetic oligonucleotide
  Target: ATXN1; (-) strand; PAM type: YTN; PAM sequence: CTA
gatgtgtgttaggcatcggg

SEQ ID NO: 171626 - DNA, 20 bp, Artificial Sequence
  Description of Artificial Sequence: Synthetic oligonucleotide
  Target: ATXN1; (-) strand; PAM type: YTN; PAM sequence: CTC
ctagatgtgtgttaggcatc

SEQ ID NO: 171627 - DNA, 20 bp, Artificial Sequence
  Description of Artificial Sequence: Synthetic oligonucleotide
  Target: ATXN1; (-) strand; PAM type: YTN; PAM sequence: TTA
ctcctagatgtgtgttaggc

SEQ ID NO: 171628 - DNA, 20 bp, Artificial Sequence
  Description of Artificial Sequence: Synthetic oligonucleotide
  Target: ATXN1; (-) strand; PAM type: YTN; PAM sequence: CTT
actcctagatgtgtgttagg

SEQ ID NO: 171629 - DNA, 20 bp, Artificial Sequence
  Description of Artificial Sequence: Synthetic oligonucleotide
  Target: ATXN1; (-) strand; PAM type: YTN; PAM sequence: TTA
acttactcctagatgtgtgt

SEQ ID NO: 171630 - DNA, 20 bp, Artificial Sequence
  Description of Artificial Sequence: Synthetic oligonucleotide
  Target: ATXN1; (-) strand; PAM type: YTN; PAM sequence: TTG
ttaacttactcctagatgtg

SEQ ID NO: 171631 - DNA, 20 bp, Artificial Sequence
  Description of Artificial Sequence: Synthetic oligonucleotide
  Target: ATXN1; (-) strand; PAM type: YTN; PAM sequence: TTC
agaattgttaacttactcct

SEQ ID NO: 171632 - DNA, 20 bp, Artificial Sequence
  Description of Artificial Sequence: Synthetic oligonucleotide
  Target: ATXN1; (-) strand; PAM type: YTN; PAM sequence: TTT
cagaattgttaacttactcc

SEQ ID NO: 171633 - DNA, 20 bp, Artificial Sequence
  Description of Artificial Sequence: Synthetic oligonucleotide
  Target: ATXN1; (-) strand; PAM type: YTN; PAM sequence: CTA
aaagccaaagaaaccagtat

SEQ ID NO: 171634 - DNA, 20 bp, Artificial Sequence
  Description of Artificial Sequence: Synthetic oligonucleotide
  Target: ATXN1; (-) strand; PAM type: YTN; PAM sequence: TTA
taaccaaaacaatcaacagg

SEQ ID NO: 171635 - DNA, 20 bp, Artificial Sequence
  Description of Artificial Sequence: Synthetic oligonucleotide
  Target: ATXN1; (-) strand; PAM type: YTN; PAM sequence: TTT
ataaccaaaacaatcaacag

SEQ ID NO: 171636 - DNA, 20 bp, Artificial Sequence
  Description of Artificial Sequence: Synthetic oligonucleotide
  Target: ATXN1; (-) strand; PAM type: YTN; PAM sequence: CTT
tataaccaaaacaatcaaca

SEQ ID NO: 171637 - DNA, 20 bp, Artificial Sequence
  Description of Artificial Sequence: Synthetic oligonucleotide
  Target: ATXN1; (-) strand; PAM type: YTN; PAM sequence: TTA
aaggcagacctttataacca

SEQ ID NO: 171638 - DNA, 20 bp, Artificial Sequence
  Description of Artificial Sequence: Synthetic oligonucleotide
  Target: ATXN1; (-) strand; PAM type: YTN; PAM sequence: TTA
ggaacacagaaggaaaaatg

SEQ ID NO: 171639 - DNA, 20 bp, Artificial Sequence
  Description of Artificial Sequence: Synthetic oligonucleotide
  Target: ATXN1; (-) strand; PAM type: YTN; PAM sequence: CTA
gttaggaacacagaaggaaa

SEQ ID NO: 171640 - DNA, 20 bp, Artificial Sequence
  Description of Artificial Sequence: Synthetic oligonucleotide
  Target: ATXN1; (-) strand; PAM type: YTN; PAM sequence: CTC
agaggcctagttaggaacac

SEQ ID NO: 171641 - DNA, 20 bp, Artificial Sequence
  Description of Artificial Sequence: Synthetic oligonucleotide
  Target: ATXN1; (-) strand; PAM type: YTN; PAM sequence: TTG
acagtggagactcagaggcc

SEQ ID NO: 171642 - DNA, 20 bp, Artificial Sequence
  Description of Artificial Sequence: Synthetic oligonucleotide
  Target: ATXN1; (-) strand; PAM type: YTN; PAM sequence: TTT
gacagtggagactcagaggc

SEQ ID NO: 171643 - DNA, 20 bp, Artificial Sequence
  Description of Artificial Sequence: Synthetic oligonucleotide
  Target: ATXN1; (-) strand; PAM type: YTN; PAM sequence: TTT
tgacagtggagactcagagg

SEQ ID NO: 171644 - DNA, 20 bp, Artificial Sequence
  Description of Artificial Sequence: Synthetic oligonucleotide
  Target: ATXN1; (-) strand; PAM type: YTN; PAM sequence: CTG
atcagccacattttgacagt

SEQ ID NO: 171645 - DNA, 20 bp, Artificial Sequence
  Description of Artificial Sequence: Synthetic oligonucleotide
  Target: ATXN1; (-) strand; PAM type: YTN; PAM sequence: CTA
aagtctgatcagccacattt

SEQ ID NO: 171646 - DNA, 20 bp, Artificial Sequence
  Description of Artificial Sequence: Synthetic oligonucleotide
  Target: ATXN1; (-) strand; PAM type: YTN; PAM sequence: TTG
cctaaagtctgatcagccac

SEQ ID NO: 171647 - DNA, 20 bp, Artificial Sequence
  Description of Artificial Sequence: Synthetic oligonucleotide
  Target: ATXN1; (-) strand; PAM type: YTN; PAM sequence: TTG
aggtgagggttgcctaaagt

SEQ ID NO: 171648 - DNA, 20 bp, Artificial Sequence
  Description of Artificial Sequence: Synthetic oligonucleotide
  Target: ATXN1; (-) strand; PAM type: YTN; PAM sequence: TTC
cataatcacaggttgaggtg

SEQ ID NO: 171649 - DNA, 20 bp, Artificial Sequence
  Description of Artificial Sequence: Synthetic oligonucleotide
  Target: ATXN1; (-) strand; PAM type: YTN; PAM sequence: CTT
ccataatcacaggttgaggt

SEQ ID NO: 171650 - DNA, 20 bp, Artificial Sequence
  Description of Artificial Sequence: Synthetic oligonucleotide
  Target: ATXN1; (-) strand; PAM type: YTN; PAM sequence: TTC
cttccataatcacaggttga

SEQ ID NO: 171651 - DNA, 20 bp, Artificial Sequence
  Description of Artificial Sequence: Synthetic oligonucleotide
  Target: ATXN1; (-) strand; PAM type: YTN; PAM sequence: CTT
ccttccataatcacaggttg

SEQ ID NO: 171652 - DNA, 20 bp, Artificial Sequence
  Description of Artificial Sequence: Synthetic oligonucleotide
  Target: ATXN1; (-) strand; PAM type: YTN; PAM sequence: CTG
tacttccttccataatcaca

SEQ ID NO: 171653 - DNA, 20 bp, Artificial Sequence
  Description of Artificial Sequence: Synthetic oligonucleotide
  Target: ATXN1; (-) strand; PAM type: YTN; PAM sequence: TTA
agatgtcctgtacttccttc

SEQ ID NO: 171654 - DNA, 20 bp, Artificial Sequence
  Description of Artificial Sequence: Synthetic oligonucleotide
  Target: ATXN1; (-) strand; PAM type: YTN; PAM sequence: TTC
atgatgcacgtgaccgggaa

SEQ ID NO: 171655 - DNA, 20 bp, Artificial Sequence
  Description of Artificial Sequence: Synthetic oligonucleotide
  Target: ATXN1; (-) strand; PAM type: YTN; PAM sequence: CTC
attcatgatgcacgtgaccg

SEQ ID NO: 171656 - DNA, 20 bp, Artificial Sequence
  Description of Artificial Sequence: Synthetic oligonucleotide
  Target: ATXN1; (-) strand; PAM type: YTN; PAM sequence: TTA
gctcattcatgatgcacgtg

SEQ ID NO: 171657 - DNA, 20 bp, Artificial Sequence
  Description of Artificial Sequence: Synthetic oligonucleotide
  Target: ATXN1; (-) strand; PAM type: YTN; PAM sequence: TTT
agctcattcatgatgcacgt

SEQ ID NO: 171658 - DNA, 20 bp, Artificial Sequence
  Description of Artificial Sequence: Synthetic oligonucleotide
  Target: ATXN1; (-) strand; PAM type: YTN; PAM sequence: TTT
tagctcattcatgatgcacg

SEQ ID NO: 171659 - DNA, 20 bp, Artificial Sequence
  Description of Artificial Sequence: Synthetic oligonucleotide
  Target: ATXN1; (-) strand; PAM type: YTN; PAM sequence: TTG
aaattttagctcattcatga

SEQ ID NO: 171660 - DNA, 20 bp, Artificial Sequence
  Description of Artificial Sequence: Synthetic oligonucleotide
  Target: ATXN1; (-) strand; PAM type: YTN; PAM sequence: TTC
gggaaaaaatggccggtgga

SEQ ID NO: 171661 - DNA, 20 bp, Artificial Sequence
  Description of Artificial Sequence: Synthetic oligonucleotide
  Target: ATXN1; (-) strand; PAM type: YTN; PAM sequence: TTA
agggttcgggaaaaaatggc

SEQ ID NO: 171662 - DNA, 20 bp, Artificial Sequence
  Description of Artificial Sequence: Synthetic oligonucleotide
  Target: ATXN1; (-) strand; PAM type: YTN; PAM sequence: CTT
aagggttcgggaaaaaatgg

SEQ ID NO: 171663 - DNA, 20 bp, Artificial Sequence
  Description of Artificial Sequence: Synthetic oligonucleotide
  Target: ATXN1; (-) strand; PAM type: YTN; PAM sequence: CTA
tccttaagggttcgggaaaa

SEQ ID NO: 171664 - DNA, 20 bp, Artificial Sequence
  Description of Artificial Sequence: Synthetic oligonucleotide
  Target: ATXN1; (-) strand; PAM type: YTN; PAM sequence: CTA
tctatccttaagggttcggg

SEQ ID NO: 171665 - DNA, 20 bp, Artificial Sequence
  Description of Artificial Sequence: Synthetic oligonucleotide
  Target: ATXN1; (-) strand; PAM type: YTN; PAM sequence: CTG
gctatctatccttaagggtt

SEQ ID NO: 171666 - DNA, 20 bp, Artificial Sequence
  Description of Artificial Sequence: Synthetic oligonucleotide
  Target: ATXN1; (-) strand; PAM type: YTN; PAM sequence: TTC
tggctatctatccttaaggg

SEQ ID NO: 171667 - DNA, 20 bp, Artificial Sequence
  Description of Artificial Sequence: Synthetic oligonucleotide
  Target: ATXN1; (-) strand; PAM type: YTN; PAM sequence: TTT
ctggctatctatccttaagg

SEQ ID NO: 171668 - DNA, 20 bp, Artificial Sequence
  Description of Artificial Sequence: Synthetic oligonucleotide
  Target: ATXN1; (-) strand; PAM type: YTN; PAM sequence: TTT
tctggctatctatccttaag

SEQ ID NO: 171669 - DNA, 20 bp, Artificial Sequence
  Description of Artificial Sequence: Synthetic oligonucleotide
  Target: ATXN1; (-) strand; PAM type: YTN; PAM sequence: TTT
ttctggctatctatccttaa

SEQ ID NO: 171670 - DNA, 20 bp, Artificial Sequence
  Description of Artificial Sequence: Synthetic oligonucleotide
  Target: ATXN1; (-) strand; PAM type: YTN; PAM sequence: TTA
tttttctggctatctatcct

SEQ ID NO: 171671 - DNA, 20 bp, Artificial Sequence
  Description of Artificial Sequence: Synthetic oligonucleotide
  Target: ATXN1; (-) strand; PAM type: YTN; PAM sequence: TTT
atttttctggctatctatcc

SEQ ID NO: 171672 - DNA, 20 bp, Artificial Sequence
  Description of Artificial Sequence: Synthetic oligonucleotide
  Target: ATXN1; (-) strand; PAM type: YTN; PAM sequence: TTA
tttatttttctggctatcta

SEQ ID NO: 171673 - DNA, 20 bp, Artificial Sequence
  Description of Artificial Sequence: Synthetic oligonucleotide
  Target: ATXN1; (-) strand; PAM type: YTN; PAM sequence: TTT
atttatttttctggctatct

SEQ ID NO: 171674 - DNA, 20 bp, Artificial Sequence
  Description of Artificial Sequence: Synthetic oligonucleotide
  Target: ATXN1; (-) strand; PAM type: YTN; PAM sequence: TTA
tttatttatttttctggcta

SEQ ID NO: 171675 - DNA, 20 bp, Artificial Sequence
  Description of Artificial Sequence: Synthetic oligonucleotide
  Target: ATXN1; (-) strand; PAM type: YTN; PAM sequence: TTT
atttatttatttttctggct

SEQ ID NO: 171676 - DNA, 20 bp, Artificial Sequence
  Description of Artificial Sequence: Synthetic oligonucleotide
  Target: ATXN1; (-) strand; PAM type: YTN; PAM sequence: TTC
ccaagaagagatttatttat

SEQ ID NO: 171677 - DNA, 20 bp, Artificial Sequence
  Description of Artificial Sequence: Synthetic oligonucleotide
  Target: ATXN1; (-) strand; PAM type: YTN; PAM sequence: CTA
gaaaatattcccaagaagag

SEQ ID NO: 171678 - DNA, 20 bp, Artificial Sequence
  Description of Artificial Sequence: Synthetic oligonucleotide
  Target: ATXN1; (-) strand; PAM type: YTN; PAM sequence: TTC
tagaaaatattcccaagaag

SEQ ID NO: 171679 - DNA, 20 bp, Artificial Sequence
  Description of Artificial Sequence: Synthetic oligonucleotide
  Target: ATXN1; (-) strand; PAM type: YTN; PAM sequence: TTA
aaatgaaaacattctagaaa

SEQ ID NO: 171680 - DNA, 20 bp, Artificial Sequence
  Description of Artificial Sequence: Synthetic oligonucleotide
  Target: ATXN1; (-) strand; PAM type: YTN; PAM sequence: TTT
aaaatgaaaacattctagaa

SEQ ID NO: 171681 - DNA, 20 bp, Artificial Sequence
  Description of Artificial Sequence: Synthetic oligonucleotide
  Target: ATXN1; (-) strand; PAM type: YTN; PAM sequence: TTT
taaaatgaaaacattctaga

SEQ ID NO: 171682 - DNA, 20 bp, Artificial Sequence
  Description of Artificial Sequence: Synthetic oligonucleotide
  Target: ATXN1; (-) strand; PAM type: YTN; PAM sequence: TTA
aattttaaaatgaaaacatt

SEQ ID NO: 171683 - DNA, 20 bp, Artificial Sequence
  Description of Artificial Sequence: Synthetic oligonucleotide
  Target: ATXN1; (-) strand; PAM type: YTN; PAM sequence: TTA
acaatggaataaaatgaaat

SEQ ID NO: 171684 - DNA, 20 bp, Artificial Sequence
  Description of Artificial Sequence: Synthetic oligonucleotide
  Target: ATXN1; (-) strand; PAM type: YTN; PAM sequence: TTA
tcagatgtcaattaacaatg

SEQ ID NO: 171685 - DNA, 20 bp, Artificial Sequence
  Description of Artificial Sequence: Synthetic oligonucleotide
  Target: ATXN1; (-) strand; PAM type: YTN; PAM sequence: CTA
gcccataaatataagaaatt

SEQ ID NO: 171686 - DNA, 20 bp, Artificial Sequence
  Description of Artificial Sequence: Synthetic oligonucleotide
  Target: ATXN1; (-) strand; PAM type: YTN; PAM sequence: CTC
tagcccataaatataagaaa

SEQ ID NO: 171687 - DNA, 20 bp, Artificial Sequence
  Description of Artificial Sequence: Synthetic oligonucleotide
  Target: ATXN1; (-) strand; PAM type: YTN; PAM sequence: TTG
aaacatcatactctagccca

SEQ ID NO: 171688 - DNA, 20 bp, Artificial Sequence
  Description of Artificial Sequence: Synthetic oligonucleotide
  Target: ATXN1; (-) strand; PAM type: YTN; PAM sequence: TTA
cacaatatatacatgtattg

SEQ ID NO: 171689 - DNA, 20 bp, Artificial Sequence
  Description of Artificial Sequence: Synthetic oligonucleotide
  Target: ATXN1; (-) strand; PAM type: YTN; PAM sequence: TTG
atcattacacaatatataca

SEQ ID NO: 171690 - DNA, 20 bp, Artificial Sequence
  Description of Artificial Sequence: Synthetic oligonucleotide
  Target: ATXN1; (-) strand; PAM type: YTN; PAM sequence: TTA
ccgtgaattgatcattacac

SEQ ID NO: 171691 - DNA, 20 bp, Artificial Sequence
  Description of Artificial Sequence: Synthetic oligonucleotide
  Target: ATXN1; (-) strand; PAM type: YTN; PAM sequence: CTA
attaccgtgaattgatcatt

SEQ ID NO: 171692 - DNA, 20 bp, Artificial Sequence
  Description of Artificial Sequence: Synthetic oligonucleotide
  Target: ATXN1; (-) strand; PAM type: YTN; PAM sequence: TTG
aagtgaaaaatatgctaatt

SEQ ID NO: 171693 - DNA, 20 bp, Artificial Sequence
  Description of Artificial Sequence: Synthetic oligonucleotide
  Target: ATXN1; (-) strand; PAM type: YTN; PAM sequence: TTT
gaagtgaaaaatatgctaat

SEQ ID NO: 171694 - DNA, 20 bp, Artificial Sequence
  Description of Artificial Sequence: Synthetic oligonucleotide
  Target: ATXN1; (-) strand; PAM type: YTN; PAM sequence: CTG
ataaaggtttgaagtgaaaa

SEQ ID NO: 171695 - DNA, 20 bp, Artificial Sequence
  Description of Artificial Sequence: Synthetic oligonucleotide
  Target: ATXN1; (-) strand; PAM type: YTN; PAM sequence: CTC
ataacaaagaactgataaag

SEQ ID NO: 171696 - DNA, 20 bp, Artificial Sequence
  Description of Artificial Sequence: Synthetic oligonucleotide
  Target: ATXN1; (-) strand; PAM type: YTN; PAM sequence: TTC
tcataacaaagaactgataa

SEQ ID NO: 171697 - DNA, 20 bp, Artificial Sequence
  Description of Artificial Sequence: Synthetic oligonucleotide
  Target: ATXN1; (-) strand; PAM type: YTN; PAM sequence: TTG
aatgttctcataacaaagaa

SEQ ID NO: 171698 - DNA, 20 bp, Artificial Sequence
  Description of Artificial Sequence: Synthetic oligonucleotide
  Target: ATXN1; (-) strand; PAM type: YTN; PAM sequence: TTT
gaatgttctcataacaaaga

SEQ ID NO: 171699 - DNA, 20 bp, Artificial Sequence
  Description of Artificial Sequence: Synthetic oligonucleotide
  Target: ATXN1; (-) strand; PAM type: YTN; PAM sequence: CTA
gacaagaggaatttgaatgt

SEQ ID NO: 171700 - DNA, 20 bp, Artificial Sequence
  Description of Artificial Sequence: Synthetic oligonucleotide
  Target: ATXN1; (-) strand; PAM type: YTN; PAM sequence: CTG
cagaaaactagacaagagga

SEQ ID NO: 171701 - DNA, 20 bp, Artificial Sequence
  Description of Artificial Sequence: Synthetic oligonucleotide
  Target: ATXN1; (-) strand; PAM type: YTN; PAM sequence: TTA
agagaagactgcagaaaact

SEQ ID NO: 171702 - DNA, 20 bp, Artificial Sequence
  Description of Artificial Sequence: Synthetic oligonucleotide
  Target: ATXN1; (-) strand; PAM type: YTN; PAM sequence: CTT
aagagaagactgcagaaaac

SEQ ID NO: 171703 - DNA, 20 bp, Artificial Sequence
  Description of Artificial Sequence: Synthetic oligonucleotide
  Target: ATXN1; (-) strand; PAM type: YTN; PAM sequence: TTG
gtccttaagagaagactgca

SEQ ID NO: 171704 - DNA, 20 bp, Artificial Sequence
  Description of Artificial Sequence: Synthetic oligonucleotide
  Target: ATXN1; (-) strand; PAM type: YTN; PAM sequence: TTT
ggtccttaagagaagactgc

SEQ ID NO: 171705 - DNA, 20 bp, Artificial Sequence
  Description of Artificial Sequence: Synthetic oligonucleotide
  Target: ATXN1; (-) strand; PAM type: YTN; PAM sequence: CTT
tggtccttaagagaagactg

SEQ ID NO: 171706 - DNA, 20 bp, Artificial Sequence
  Description of Artificial Sequence: Synthetic oligonucleotide
  Target: ATXN1; (-) strand; PAM type: YTN; PAM sequence: TTC
tttggtccttaagagaagac

SEQ ID NO: 171707 - DNA, 20 bp, Artificial Sequence
  Description of Artificial Sequence: Synthetic oligonucleotide
  Target: ATXN1; (-) strand; PAM type: YTN; PAM sequence: CTT
ctttggtccttaagagaaga

SEQ ID NO: 171708 - DNA, 20 bp, Artificial Sequence
  Description of Artificial Sequence: Synthetic oligonucleotide
  Target: ATXN1; (-) strand; PAM type: YTN; PAM sequence: TTC
ttctttggtccttaagagaa

SEQ ID NO: 171709 - DNA, 20 bp, Artificial Sequence
  Description of Artificial Sequence: Synthetic oligonucleotide
  Target: ATXN1; (-) strand; PAM type: YTN; PAM sequence: TTT
cttctttggtccttaagaga

SEQ ID NO: 171710 - DNA, 20 bp, Artificial Sequence
  Description of Artificial Sequence: Synthetic oligonucleotide
  Target: ATXN1; (-) strand; PAM type: YTN; PAM sequence: TTT
tcttctttggtccttaagag

SEQ ID NO: 171711 - DNA, 20 bp, Artificial Sequence
  Description of Artificial Sequence: Synthetic oligonucleotide
  Target: ATXN1; (-) strand; PAM type: YTN; PAM sequence: TTA
ttttcttctttggtccttaa

SEQ ID NO: 171712 - DNA, 20 bp, Artificial Sequence
  Description of Artificial Sequence: Synthetic oligonucleotide
  Target: ATXN1; (-) strand; PAM type: YTN; PAM sequence: TTT
attttcttctttggtcctta

SEQ ID NO: 171713 - DNA, 20 bp, Artificial Sequence
  Description of Artificial Sequence: Synthetic oligonucleotide
  Target: ATXN1; (-) strand; PAM type: YTN; PAM sequence: TTT
tattttcttctttggtcctt

SEQ ID NO: 171714 - DNA, 20 bp, Artificial Sequence
  Description of Artificial Sequence: Synthetic oligonucleotide
  Target: ATXN1; (-) strand; PAM type: YTN; PAM sequence: CTT
ttattttcttctttggtcct

SEQ ID NO: 171715 - DNA, 20 bp, Artificial Sequence
  Description of Artificial Sequence: Synthetic oligonucleotide
  Target: ATXN1; (-) strand; PAM type: YTN; PAM sequence: TTA
tagggtcttttattttcttc

SEQ ID NO: 171716 - DNA, 20 bp, Artificial Sequence
  Description of Artificial Sequence: Synthetic oligonucleotide
  Target: ATXN1; (-) strand; PAM type: YTN; PAM sequence: TTT
atagggtcttttattttctt

SEQ ID NO: 171717 - DNA, 20 bp, Artificial Sequence
  Description of Artificial Sequence: Synthetic oligonucleotide
  Target: ATXN1; (-) strand; PAM type: YTN; PAM sequence: TTT
tatagggtcttttattttct

SEQ ID NO: 171718 - DNA, 20 bp, Artificial Sequence
  Description of Artificial Sequence: Synthetic oligonucleotide
  Target: ATXN1; (-) strand; PAM type: YTN; PAM sequence: CTG
aattttatagggtcttttat

SEQ ID NO: 171719 - DNA, 20 bp, Artificial Sequence
  Description of Artificial Sequence: Synthetic oligonucleotide
  Target: ATXN1; (-) strand; PAM type: YTN; PAM sequence: TTA
aacagagctgaattttatag

SEQ ID NO: 171720 - DNA, 20 bp, Artificial Sequence
  Description of Artificial Sequence: Synthetic oligonucleotide
  Target: ATXN1; (-) strand; PAM type: YTN; PAM sequence: CTT
aaacagagctgaattttata

SEQ ID NO: 171721 - DNA, 20 bp, Artificial Sequence
  Description of Artificial Sequence: Synthetic oligonucleotide
  Target: ATXN1; (-) strand; PAM type: YTN; PAM sequence: TTA
aaagataggacttaaacaga

SEQ ID NO: 171722 - DNA, 20 bp, Artificial Sequence
  Description of Artificial Sequence: Synthetic oligonucleotide
  Target: ATXN1; (-) strand; PAM type: YTN; PAM sequence: CTT
aaaagataggacttaaacag

SEQ ID NO: 171723 - DNA, 20 bp, Artificial Sequence
  Description of Artificial Sequence: Synthetic oligonucleotide
  Target: ATXN1; (-) strand; PAM type: YTN; PAM sequence: TTA
cttaaaagataggacttaaa

SEQ ID NO: 171724 - DNA, 20 bp, Artificial Sequence
  Description of Artificial Sequence: Synthetic oligonucleotide
  Target: ATXN1; (-) strand; PAM type: YTN; PAM sequence: TTA
gttacttaaaagataggact

SEQ ID NO: 171725 - DNA, 20 bp, Artificial Sequence
  Description of Artificial Sequence: Synthetic oligonucleotide
  Target: ATXN1; (-) strand; PAM type: YTN; PAM sequence: TTT
agttacttaaaagataggac

SEQ ID NO: 171726 - DNA, 20 bp, Artificial Sequence
  Description of Artificial Sequence: Synthetic oligonucleotide
  Target: ATXN1; (-) strand; PAM type: YTN; PAM sequence: TTT
tagttacttaaaagatagga

SEQ ID NO: 171727 - DNA, 20 bp, Artificial Sequence
  Description of Artificial Sequence: Synthetic oligonucleotide
  Target: ATXN1; (-) strand; PAM type: YTN; PAM sequence: TTT
ttagttacttaaaagatagg

SEQ ID NO: 171728 - DNA, 20 bp, Artificial Sequence
  Description of Artificial Sequence: Synthetic oligonucleotide
  Target: ATXN1; (-) strand; PAM type: YTN; PAM sequence: CTT
tttagttacttaaaagatag

SEQ ID NO: 171729 - DNA, 20 bp, Artificial Sequence
  Description of Artificial Sequence: Synthetic oligonucleotide
  Target: ATXN1; (-) strand; PAM type: YTN; PAM sequence: TTC
aactttttagttacttaaaa

SEQ ID NO: 171730 - DNA, 20 bp, Artificial Sequence
  Description of Artificial Sequence: Synthetic oligonucleotide
  Target: ATXN1; (-) strand; PAM type: YTN; PAM sequence: CTA
gtattcaactttttagttac

SEQ ID NO: 171731 - DNA, 20 bp, Artificial Sequence
  Description of Artificial Sequence: Synthetic oligonucleotide
  Target: ATXN1; (-) strand; PAM type: YTN; PAM sequence: TTG
gagctagtattcaacttttt

SEQ ID NO: 171732 - DNA, 20 bp, Artificial Sequence
  Description of Artificial Sequence: Synthetic oligonucleotide
  Target: ATXN1; (-) strand; PAM type: YTN; PAM sequence: TTA
ttggagctagtattcaactt

SEQ ID NO: 171733 - DNA, 20 bp, Artificial Sequence
  Description of Artificial Sequence: Synthetic oligonucleotide
  Target: ATXN1; (-) strand; PAM type: YTN; PAM sequence: CTA
gttattggagctagtattca

SEQ ID NO: 171734 - DNA, 20 bp, Artificial Sequence
  Description of Artificial Sequence: Synthetic oligonucleotide
  Target: ATXN1; (-) strand; PAM type: YTN; PAM sequence: TTA
tggatctagttattggagct

SEQ ID NO: 171735 - DNA, 20 bp, Artificial Sequence
  Description of Artificial Sequence: Synthetic oligonucleotide
  Target: ATXN1; (-) strand; PAM type: YTN; PAM sequence: TTT
atggatctagttattggagc

SEQ ID NO: 171736 - DNA, 20 bp, Artificial Sequence
  Description of Artificial Sequence: Synthetic oligonucleotide
  Target: ATXN1; (-) strand; PAM type: YTN; PAM sequence: TTG
aaaaatggtttatggatcta

SEQ ID NO: 171737 - DNA, 20 bp, Artificial Sequence
  Description of Artificial Sequence: Synthetic oligonucleotide
  Target: ATXN1; (-) strand; PAM type: YTN; PAM sequence: TTA
gtattgaaaaatggtttatg

SEQ ID NO: 171738 - DNA, 20 bp, Artificial Sequence
  Description of Artificial Sequence: Synthetic oligonucleotide
  Target: ATXN1; (-) strand; PAM type: YTN; PAM sequence: CTA
agaaaattagtattgaaaaa

SEQ ID NO: 171739 - DNA, 20 bp, Artificial Sequence
  Description of Artificial Sequence: Synthetic oligonucleotide
  Target: ATXN1; (-) strand; PAM type: YTN; PAM sequence: TTG
gctaagaaaattagtattga

SEQ ID NO: 171740 - DNA, 20 bp, Artificial Sequence
  Description of Artificial Sequence: Synthetic oligonucleotide
  Target: ATXN1; (-) strand; PAM type: YTN; PAM sequence: TTT
ggctaagaaaattagtattg

SEQ ID NO: 171741 - DNA, 20 bp, Artificial Sequence
  Description of Artificial Sequence: Synthetic oligonucleotide
  Target: ATXN1; (-) strand; PAM type: YTN; PAM sequence: CTT
tggctaagaaaattagtatt

SEQ ID NO: 171742 - DNA, 20 bp, Artificial Sequence
  Description of Artificial Sequence: Synthetic oligonucleotide
  Target: ATXN1; (-) strand; PAM type: YTN; PAM sequence: CTC
tttggctaagaaaattagta

SEQ ID NO: 171743 - DNA, 20 bp, Artificial Sequence
  Description of Artificial Sequence: Synthetic oligonucleotide
  Target: ATXN1; (-) strand; PAM type: YTN; PAM sequence: CTG
catatctctttggctaagaa

SEQ ID NO: 171744 - DNA, 20 bp, Artificial Sequence
  Description of Artificial Sequence: Synthetic oligonucleotide
  Target: ATXN1; (-) strand; PAM type: YTN; PAM sequence: CTA
ctgcatatctctttggctaa

SEQ ID NO: 171745 - DNA, 20 bp, Artificial Sequence
  Description of Artificial Sequence: Synthetic oligonucleotide
  Target: ATXN1; (-) strand; PAM type: YTN; PAM sequence: CTC
tactgcatatctctttggct

SEQ ID NO: 171746 - DNA, 20 bp, Artificial Sequence
  Description of Artificial Sequence: Synthetic oligonucleotide
  Target: ATXN1; (-) strand; PAM type: YTN; PAM sequence: TTC
tctactgcatatctctttgg

SEQ ID NO: 171747 - DNA, 20 bp, Artificial Sequence
  Description of Artificial Sequence: Synthetic oligonucleotide
  Target: ATXN1; (-) strand; PAM type: YTN; PAM sequence: CTC
acattctctactgcatatct

SEQ ID NO: 171748 - DNA, 20 bp, Artificial Sequence
  Description of Artificial Sequence: Synthetic oligonucleotide
  Target: ATXN1; (-) strand; PAM type: YTN; PAM sequence: TTG
gtctcacattctctactgca

SEQ ID NO: 171749 - DNA, 20 bp, Artificial Sequence
  Description of Artificial Sequence: Synthetic oligonucleotide
  Target: ATXN1; (-) strand; PAM type: YTN; PAM sequence: CTT
ggtctcacattctctactgc

SEQ ID NO: 171750 - DNA, 20 bp, Artificial Sequence
  Description of Artificial Sequence: Synthetic oligonucleotide
  Target: ATXN1; (-) strand; PAM type: YTN; PAM sequence: CTC
ttggtctcacattctctact

SEQ ID NO: 171751 - DNA, 20 bp, Artificial Sequence
  Description of Artificial Sequence: Synthetic oligonucleotide
  Target: ATXN1; (-) strand; PAM type: YTN; PAM sequence: CTA
ctcttggtctcacattctct

SEQ ID NO: 171752 - DNA, 20 bp, Artificial Sequence
  Description of Artificial Sequence: Synthetic oligonucleotide
  Target: ATXN1; (-) strand; PAM type: YTN; PAM sequence: CTG
tctactcttggtctcacatt

SEQ ID NO: 171753 - DNA, 20 bp, Artificial Sequence
  Description of Artificial Sequence: Synthetic oligonucleotide
  Target: ATXN1; (-) strand; PAM type: YTN; PAM sequence: CTG
gctgtctactcttggtctca

SEQ ID NO: 171754 - DNA, 20 bp, Artificial Sequence
  Description of Artificial Sequence: Synthetic oligonucleotide
  Target: ATXN1; (-) strand; PAM type: YTN; PAM sequence: TTG
gactggctgtctactcttgg

SEQ ID NO: 171755 - DNA, 20 bp, Artificial Sequence
  Description of Artificial Sequence: Synthetic oligonucleotide
  Target: ATXN1; (-) strand; PAM type: YTN; PAM sequence: TTT
ggactggctgtctactcttg

SEQ ID NO: 171756 - DNA, 20 bp, Artificial Sequence
  Description of Artificial Sequence: Synthetic oligonucleotide
  Target: ATXN1; (-) strand; PAM type: YTN; PAM sequence: CTT
tggactggctgtctactctt

SEQ ID NO: 171757 - DNA, 20 bp, Artificial Sequence
  Description of Artificial Sequence: Synthetic oligonucleotide
  Target: ATXN1; (-) strand; PAM type: YTN; PAM sequence: CTG
tggactttggactggctgtc

SEQ ID NO: 171758 - DNA, 20 bp, Artificial Sequence
  Description of Artificial Sequence: Synthetic oligonucleotide
  Target: ATXN1; (-) strand; PAM type: YTN; PAM sequence: TTC
tgtggactttggactggctg

SEQ ID NO: 171759 - DNA, 20 bp, Artificial Sequence
  Description of Artificial Sequence: Synthetic oligonucleotide
  Target: ATXN1; (-) strand; PAM type: YTN; PAM sequence: TTT
ctgtggactttggactggct

SEQ ID NO: 171760 - DNA, 20 bp, Artificial Sequence
  Description of Artificial Sequence: Synthetic oligonucleotide
  Target: ATXN1; (-) strand; PAM type: YTN; PAM sequence: TTA
tttctgtggactttggactg

SEQ ID NO: 171761 - DNA, 20 bp, Artificial Sequence
  Description of Artificial Sequence: Synthetic oligonucleotide
  Target: ATXN1; (-) strand; PAM type: YTN; PAM sequence: TTT
atttctgtggactttggact

SEQ ID NO: 171762 - DNA, 20 bp, Artificial Sequence
  Description of Artificial Sequence: Synthetic oligonucleotide
  Target: ATXN1; (-) strand; PAM type: YTN; PAM sequence: TTT
tatttctgtggactttggac

SEQ ID NO: 171763 - DNA, 20 bp, Artificial Sequence
  Description of Artificial Sequence: Synthetic oligonucleotide
  Target: ATXN1; (-) strand; PAM type: YTN; PAM sequence: TTT
ttatttctgtggactttgga

SEQ ID NO: 171764 - DNA, 20 bp, Artificial Sequence
  Description of Artificial Sequence: Synthetic oligonucleotide
  Target: ATXN1; (-) strand; PAM type: YTN; PAM sequence: CTG
gaaagccagcgtggaaaatg

SEQ ID NO: 171765 - DNA, 20 bp, Artificial Sequence
  Description of Artificial Sequence: Synthetic oligonucleotide
  Target: ATXN1; (-) strand; PAM type: YTN; PAM sequence: TTC
aggaccatcctggaaagcca

SEQ ID NO: 171766 - DNA, 20 bp, Artificial Sequence
  Description of Artificial Sequence: Synthetic oligonucleotide
  Target: ATXN1; (-) strand; PAM type: YTN; PAM sequence: TTA
gcaagttcaggaccatcctg

SEQ ID NO: 171767 - DNA, 20 bp, Artificial Sequence
  Description of Artificial Sequence: Synthetic oligonucleotide
  Target: ATXN1; (-) strand; PAM type: YTN; PAM sequence: TTA
taccatgaattagcaagttc

SEQ ID NO: 171768 - DNA, 20 bp, Artificial Sequence
  Description of Artificial Sequence: Synthetic oligonucleotide
  Target: ATXN1; (-) strand; PAM type: YTN; PAM sequence: TTA
cagtacaaagttataccatg

SEQ ID NO: 171769 - DNA, 20 bp, Artificial Sequence
  Description of Artificial Sequence: Synthetic oligonucleotide
  Target: ATXN1; (-) strand; PAM type: YTN; PAM sequence: CTG
tgttacagtacaaagttata

SEQ ID NO: 171770 - DNA, 20 bp, Artificial Sequence
  Description of Artificial Sequence: Synthetic oligonucleotide
  Target: ATXN1; (-) strand; PAM type: YTN; PAM sequence: TTG
gctgtgttacagtacaaagt

SEQ ID NO: 171771 - DNA, 20 bp, Artificial Sequence
  Description of Artificial Sequence: Synthetic oligonucleotide
  Target: ATXN1; (-) strand; PAM type: YTN; PAM sequence: CTT
ggctgtgttacagtacaaag

SEQ ID NO: 171772 - DNA, 20 bp, Artificial Sequence
  Description of Artificial Sequence: Synthetic oligonucleotide
  Target: ATXN1; (-) strand; PAM type: YTN; PAM sequence: CTC
cttggctgtgttacagtaca

SEQ ID NO: 171773 - DNA, 20 bp, Artificial Sequence
  Description of Artificial Sequence: Synthetic oligonucleotide
  Target: ATXN1; (-) strand; PAM type: YTN; PAM sequence: TTC
tccttggctgtgttacagta

SEQ ID NO: 171774 - DNA, 20 bp, Artificial Sequence
  Description of Artificial Sequence: Synthetic oligonucleotide
  Target: ATXN1; (-) strand; PAM type: YTN; PAM sequence: TTT
ctccttggctgtgttacagt

SEQ ID NO: 171775 - DNA, 20 bp, Artificial Sequence
  Description of Artificial Sequence: Synthetic oligonucleotide
  Target: ATXN1; (-) strand; PAM type: YTN; PAM sequence: CTG
tttctccttggctgtgttac

SEQ ID NO: 171776 - DNA, 20 bp, Artificial Sequence
  Description of Artificial Sequence: Synthetic oligonucleotide
  Target: ATXN1; (-) strand; PAM type: YTN; PAM sequence: CTA
ctgtttctccttggctgtgt

SEQ ID NO: 171777 - DNA, 20 bp, Artificial Sequence
  Description of Artificial Sequence: Synthetic oligonucleotide
  Target: ATXN1; (-) strand; PAM type: YTN; PAM sequence: CTC
caacatgctactgtttctcc

SEQ ID NO: 171778 - DNA, 20 bp, Artificial Sequence
  Description of Artificial Sequence: Synthetic oligonucleotide
  Target: ATXN1; (-) strand; PAM type: YTN; PAM sequence: CTG
gctccaacatgctactgttt

SEQ ID NO: 171779 - DNA, 20 bp, Artificial Sequence
  Description of Artificial Sequence: Synthetic oligonucleotide
  Target: ATXN1; (-) strand; PAM type: YTN; PAM sequence: CTC
acagacctggctccaacatg

SEQ ID NO: 171780 - DNA, 20 bp, Artificial Sequence
  Description of Artificial Sequence: Synthetic oligonucleotide
  Target: ATXN1; (-) strand; PAM type: YTN; PAM sequence: CTC
tcacagacctggctccaaca

SEQ ID NO: 171781 - DNA, 20 bp, Artificial Sequence
  Description of Artificial Sequence: Synthetic oligonucleotide
  Target: ATXN1; (-) strand; PAM type: YTN; PAM sequence: TTA
gctctcacagacctggctcc

SEQ ID NO: 171782 - DNA, 20 bp, Artificial Sequence
  Description of Artificial Sequence: Synthetic oligonucleotide
  Target: ATXN1; (-) strand; PAM type: YTN; PAM sequence: CTG
ttagctctcacagacctggc

SEQ ID NO: 171783 - DNA, 20 bp, Artificial Sequence
  Description of Artificial Sequence: Synthetic oligonucleotide
  Target: ATXN1; (-) strand; PAM type: YTN; PAM sequence: TTA
actgttagctctcacagacc

SEQ ID NO: 171784 - DNA, 20 bp, Artificial Sequence
  Description of Artificial Sequence: Synthetic oligonucleotide
  Target: ATXN1; (-) strand; PAM type: YTN; PAM sequence: CTT
aactgttagctctcacagac

SEQ ID NO: 171785 - DNA, 20 bp, Artificial Sequence
  Description of Artificial Sequence: Synthetic oligonucleotide
  Target: ATXN1; (-) strand; PAM type: YTN; PAM sequence: CTG
tcaagcttaactgttagctc

SEQ ID NO: 171786 - DNA, 20 bp, Artificial Sequence
  Description of Artificial Sequence: Synthetic oligonucleotide
  Target: ATXN1; (-) strand; PAM type: YTN; PAM sequence: TTG
gctgtcaagcttaactgtta

SEQ ID NO: 171787 - DNA, 20 bp, Artificial Sequence
  Description of Artificial Sequence: Synthetic oligonucleotide
  Target: ATXN1; (-) strand; PAM type: YTN; PAM sequence: CTT
ggctgtcaagcttaactgtt

SEQ ID NO: 171788 - DNA, 20 bp, Artificial Sequence
  Description of Artificial Sequence: Synthetic oligonucleotide
  Target: ATXN1; (-) strand; PAM type: YTN; PAM sequence: TTG
aacgcttggctgtcaagctt

SEQ ID NO: 171789 - DNA, 20 bp, Artificial Sequence
  Description of Artificial Sequence: Synthetic oligonucleotide
  Target: ATXN1; (-) strand; PAM type: YTN; PAM sequence: CTA
tgttgaacgcttggctgtca

SEQ ID NO: 171790 - DNA, 20 bp, Artificial Sequence
  Description of Artificial Sequence: Synthetic oligonucleotide
  Target: ATXN1; (-) strand; PAM type: YTN; PAM sequence: TTG
gctatgttgaacgcttggct

SEQ ID NO: 171791 - DNA, 20 bp, Artificial Sequence
  Description of Artificial Sequence: Synthetic oligonucleotide
  Target: ATXN1; (-) strand; PAM type: YTN; PAM sequence: TTA
acattggctatgttgaacgc

SEQ ID NO: 171792 - DNA, 20 bp, Artificial Sequence
  Description of Artificial Sequence: Synthetic oligonucleotide
  Target: ATXN1; (-) strand; PAM type: YTN; PAM sequence: TTT
aacattggctatgttgaacg

SEQ ID NO: 171793 - DNA, 20 bp, Artificial Sequence
  Description of Artificial Sequence: Synthetic oligonucleotide
  Target: ATXN1; (-) strand; PAM type: YTN; PAM sequence: TTT
taacattggctatgttgaac

SEQ ID NO: 171794 - DNA, 20 bp, Artificial Sequence
  Description of Artificial Sequence: Synthetic oligonucleotide
  Target: ATXN1; (-) strand; PAM type: YTN; PAM sequence: TTT
ttaacattggctatgttgaa

SEQ ID NO: 171795 - DNA, 20 bp, Artificial Sequence
  Description of Artificial Sequence: Synthetic oligonucleotide
  Target: ATXN1; (-) strand; PAM type: YTN; PAM sequence: TTA
atttttaacattggctatgt

SEQ ID NO: 171796 - DNA, 20 bp, Artificial Sequence
  Description of Artificial Sequence: Synthetic oligonucleotide
  Target: ATXN1; (-) strand; PAM type: YTN; PAM sequence: TTA
tataagttaatttttaacat

SEQ ID NO: 171797 - DNA, 20 bp, Artificial Sequence
  Description of Artificial Sequence: Synthetic oligonucleotide
  Target: ATXN1; (-) strand; PAM type: YTN; PAM sequence: TTT
atataagttaatttttaaca

SEQ ID NO: 171798 - DNA, 20 bp, Artificial Sequence
  Description of Artificial Sequence: Synthetic oligonucleotide
  Target: ATXN1; (-) strand; PAM type: YTN; PAM sequence: TTA
aaccataagtttatataagt

SEQ ID NO: 171799 - DNA, 20 bp, Artificial Sequence
  Description of Artificial Sequence: Synthetic oligonucleotide
  Target: ATXN1; (-) strand; PAM type: YTN; PAM sequence: TTA
ttaaaccataagtttatata

SEQ ID NO: 171800 - DNA, 20 bp, Artificial Sequence
  Description of Artificial Sequence: Synthetic oligonucleotide
  Target: ATXN1; (-) strand; PAM type: YTN; PAM sequence: TTT
attaaaccataagtttatat

SEQ ID NO: 171801 - DNA, 20 bp, Artificial Sequence
  Description of Artificial Sequence: Synthetic oligonucleotide
  Target: ATXN1; (-) strand; PAM type: YTN; PAM sequence: TTA
atataatttattaaaccata

SEQ ID NO: 171802 - DNA, 20 bp, Artificial Sequence
  Description of Artificial Sequence: Synthetic oligonucleotide
  Target: ATXN1; (-) strand; PAM type: YTN; PAM sequence: TTT
aatataatttattaaaccat

SEQ ID NO: 171803 - DNA, 20 bp, Artificial Sequence
  Description of Artificial Sequence: Synthetic oligonucleotide
  Target: ATXN1; (-) strand; PAM type: YTN; PAM sequence: TTT
taatataatttattaaacca

SEQ ID NO: 171804 - DNA, 20 bp, Artificial Sequence
  Description of Artificial Sequence: Synthetic oligonucleotide
  Target: ATXN1; (-) strand; PAM type: YTN; PAM sequence: TTT
ttaatataatttattaaacc

SEQ ID NO: 171805 - DNA, 20 bp, Artificial Sequence
  Description of Artificial Sequence: Synthetic oligonucleotide
  Target: ATXN1; (-) strand; PAM type: YTN; PAM sequence: CTC
aggagtttttaatataattt

SEQ ID NO: 171806 - DNA, 20 bp, Artificial Sequence
  Description of Artificial Sequence: Synthetic oligonucleotide
  Target: ATXN1; (-) strand; PAM type: YTN; PAM sequence: CTC
gcctcaggagtttttaatat

SEQ ID NO: 171807 - DNA, 20 bp, Artificial Sequence
  Description of Artificial Sequence: Synthetic oligonucleotide
  Target: ATXN1; (-) strand; PAM type: YTN; PAM sequence: CTC
gggtgatccgcctcgcctca

SEQ ID NO: 171808 - DNA, 20 bp, Artificial Sequence
  Description of Artificial Sequence: Synthetic oligonucleotide
  Target: ATXN1; (-) strand; PAM type: YTN; PAM sequence: CTC
cccgatctcgggtgatccgc

SEQ ID NO: 171809 - DNA, 20 bp, Artificial Sequence
  Description of Artificial Sequence: Synthetic oligonucleotide
  Target: ATXN1; (-) strand; PAM type: YTN; PAM sequence: CTC
gaactccccgatctcgggtg

SEQ ID NO: 171810 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactccccgatctc

SEQ ID NO: 171811 - DNA, 20 bp, Artificial Sequence
  Description of Artificial Sequence: Synthetic oligonucleotide
  Target: ATXN1; (-) strand; PAM type: YTN; PAM sequence: TTG
gtccgactggtctcgaactc

SEQ ID NO: 171812 - DNA, 20 bp, Artificial Sequence
  Description of Artificial Sequence: Synthetic oligonucleotide
  Target: ATXN1; (-) strand; PAM type: YTN; PAM sequence: CTC
catgttggtccgactggtct

SEQ ID NO: 171813 - DNA, 20 bp, Artificial Sequence
  Description of Artificial Sequence: Synthetic oligonucleotide
  Target: ATXN1; (-) strand; PAM type: YTN; PAM sequence: TTC
tccatgttggtccgactggt

SEQ ID NO: 171814 - DNA, 20 bp, Artificial Sequence
  Description of Artificial Sequence: Synthetic oligonucleotide
  Target: ATXN1; (-) strand; PAM type: YTN; PAM sequence: TTT
ctccatgttggtccgactgg

SEQ ID NO: 171815 - DNA, 20 bp, Artificial Sequence
  Description of Artificial Sequence: Synthetic oligonucleotide
  Target: ATXN1; (-) strand; PAM type: YTN; PAM sequence: TTA
gtagagacgggatttctcca

SEQ ID NO: 171816 - DNA, 20 bp, Artificial Sequence
  Description of Artificial Sequence: Synthetic oligonucleotide
  Target: ATXN1; (-) strand; PAM type: YTN; PAM sequence: TTT
agtagagacgggatttctcc

SEQ ID NO: 171817 - DNA, 20 bp, Artificial Sequence
  Description of Artificial Sequence: Synthetic oligonucleotide
  Target: ATXN1; (-) strand; PAM type: YTN; PAM sequence: TTT
tagtagagacgggatttctc

SEQ ID NO: 171818 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacgggatttct

SEQ ID NO: 171819 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacggga

SEQ ID NO: 171820 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacggg

SEQ ID NO: 171821 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 171822 - DNA, 20 bp, Artificial Sequence
  Description of Artificial Sequence: Synthetic oligonucleotide
  Target: ATXN1; (-) strand; PAM type: YTN; PAM sequence: CTA
attttgtatttttagtagag

SEQ ID NO: 171823 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccatgcc

SEQ ID NO: 171824 - DNA, 20 bp, Artificial Sequence
  Description of Artificial Sequence: Synthetic oligonucleotide
  Target: ATXN1; (-) strand; PAM type: YTN; PAM sequence: CTG
agtagtgtgattacaggcat

SEQ ID NO: 171825 - DNA, 20 bp, Artificial Sequence
  Description of Artificial Sequence: Synthetic oligonucleotide
  Target: ATXN1; (-) strand; PAM type: YTN; PAM sequence: CTC
ctgagtagtgtgattacagg

SEQ ID NO: 171826 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagtgtgat

SEQ ID NO: 171827 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcctgagtagtg

SEQ ID NO: 171828 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcctgagta

SEQ ID NO: 171829 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcctgag

SEQ ID NO: 171830 - DNA, 20 bp, Artificial Sequence
  Description of Artificial Sequence: Synthetic oligonucleotide
  Target: ATXN1; (-) strand; PAM type: YTN; PAM sequence: TTC
aagtgattctcctgcctcag

SEQ ID NO: 171831 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagtgattctcc

SEQ ID NO: 171832 - DNA, 20 bp, Artificial Sequence
  Description of Artificial Sequence: Synthetic oligonucleotide
  Target: ATXN1; (-) strand; PAM type: YTN; PAM sequence: CTC
cacctcccgggttcaagtga

SEQ ID NO: 171833 - DNA, 20 bp, Artificial Sequence
  Description of Artificial Sequence: Synthetic oligonucleotide
  Target: ATXN1; (-) strand; PAM type: YTN; PAM sequence: CTC
accgcaacctccacctcccg

SEQ ID NO: 171834 - DNA, 20 bp, Artificial Sequence
  Description of Artificial Sequence: Synthetic oligonucleotide
  Target: ATXN1; (-) strand; PAM type: YTN; PAM sequence: TTG
gctcaccgcaacctccacct

SEQ ID NO: 171835 - DNA, 20 bp, Artificial Sequence
  Description of Artificial Sequence: Synthetic oligonucleotide
  Target: ATXN1; (-) strand; PAM type: YTN; PAM sequence: CTT
ggctcaccgcaacctccacc

SEQ ID NO: 171836 - DNA, 20 bp, Artificial Sequence
  Description of Artificial Sequence: Synthetic oligonucleotide
  Target: ATXN1; (-) strand; PAM type: YTN; PAM sequence: CTG
gaatgcaatggcgcaatctt

SEQ ID NO: 171837 - DNA, 20 bp, Artificial Sequence
  Description of Artificial Sequence: Synthetic oligonucleotide
  Target: ATXN1; (-) strand; PAM type: YTN; PAM sequence: TTG
gccaggctggaatgcaatgg

SEQ ID NO: 171838 - DNA, 20 bp, Artificial Sequence
  Description of Artificial Sequence: Synthetic oligonucleotide
  Target: ATXN1; (-) strand; PAM type: YTN; PAM sequence: TTG
ttggccaggctggaatgcaa

SEQ ID NO: 171839 - DNA, 20 bp, Artificial Sequence
  Description of Artificial Sequence: Synthetic oligonucleotide
  Target: ATXN1; (-) strand; PAM type: YTN; PAM sequence: CTT
gttggccaggctggaatgca

SEQ ID NO: 171840 - DNA, 20 bp, Artificial Sequence
  Description of Artificial Sequence: Synthetic oligonucleotide
  Target: ATXN1; (-) strand; PAM type: YTN; PAM sequence: CTC
ttgttggccaggctggaatg

SEQ ID NO: 171841 - DNA, 20 bp, Artificial Sequence
  Description of Artificial Sequence: Synthetic oligonucleotide
  Target: ATXN1; (-) strand; PAM type: YTN; PAM sequence: TTC
gctcttgttggccaggctgg

SEQ ID NO: 171842 - DNA, 20 bp, Artificial Sequence
  Description of Artificial Sequence: Synthetic oligonucleotide
  Target: ATXN1; (-) strand; PAM type: YTN; PAM sequence: TTT
cgctcttgttggccaggctg

SEQ ID NO: 171843 - DNA, 20 bp, Artificial Sequence
  Description of Artificial Sequence: Synthetic oligonucleotide
  Target: ATXN1; (-) strand; PAM type: YTN; PAM sequence: TTG
agacggagtttcgctcttgt

SEQ ID NO: 171844 - DNA, 20 bp, Artificial Sequence
  Description of Artificial Sequence: Synthetic oligonucleotide
  Target: ATXN1; (-) strand; PAM type: YTN; PAM sequence: TTT
gagacggagtttcgctcttg

SEQ ID NO: 171845 - DNA, 20 bp, Artificial Sequence
  Description of Artificial Sequence: Synthetic oligonucleotide
  Target: ATXN1; (-) strand; PAM type: YTN; PAM sequence: TTT
tgagacggagtttcgctctt

SEQ ID NO: 171846 - DNA, 20 bp, Artificial Sequence
  Description of Artificial Sequence: Synthetic oligonucleotide
  Target: ATXN1; (-) strand; PAM type: YTN; PAM sequence: TTT
ttgagacggagtttcgctct

SEQ ID NO: 171847 - DNA, 20 bp, Artificial Sequence
  Description of Artificial Sequence: Synthetic oligonucleotide
  Target: ATXN1; (-) strand; PAM type: YTN; PAM sequence: TTT
tttgagacggagtttcgctc

SEQ ID NO: 171848 - DNA, 20 bp, Artificial Sequence
  Description of Artificial Sequence: Synthetic oligonucleotide
  Target: ATXN1; (-) strand; PAM type: YTN; PAM sequence: TTT
ttttgagacggagtttcgct

SEQ ID NO: 171849 - DNA, 20 bp, Artificial Sequence
  Description of Artificial Sequence: Synthetic oligonucleotide
  Target: ATXN1; (-) strand; PAM type: YTN; PAM sequence: TTT
tttttgagacggagtttcgc

SEQ ID NO: 171850 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacggagtttcg

SEQ ID NO: 171851 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacggagtttc

SEQ ID NO: 171852 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacggagttt

SEQ ID NO: 171853 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacggagtt

SEQ ID NO: 171854 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacggagt

SEQ ID NO: 171855 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacggag

SEQ ID NO: 171856 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacgga

SEQ ID NO: 171857 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacgg

SEQ ID NO: 171858 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagacg

SEQ ID NO: 171859 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgagac

SEQ ID NO: 171860 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgaga

SEQ ID NO: 171861 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgag

SEQ ID NO: 171862 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttga

SEQ ID NO: 171863 - DNA, 20 bp, Artificial Sequence
  Description of Artificial Sequence: Synthetic oligonucleotide
  Target: ATXN1; (-) strand; PAM type: YTN; PAM sequence: TTG
tttttttttttttttttttt

SEQ ID NO: 171864 - DNA, 20 bp, Artificial Sequence
  Description of Artificial Sequence: Synthetic oligonucleotide
  Target: ATXN1; (-) strand; PAM type: YTN; PAM sequence: CTT
gttttttttttttttttttt

SEQ ID NO: 171865 - DNA, 20 bp, Artificial Sequence
  Description of Artificial Sequence: Synthetic oligonucleotide
  Target: ATXN1; (-) strand; PAM type: YTN; PAM sequence: TTC
ttgttttttttttttttttt

SEQ ID NO: 171866 - DNA, 20 bp, Artificial Sequence
  Description of Artificial Sequence: Synthetic oligonucleotide
  Target: ATXN1; (-) strand; PAM type: YTN; PAM sequence: TTG
ttcttgtttttttttttttt

SEQ ID NO: 171867 - DNA, 20 bp, Artificial Sequence
  Description of Artificial Sequence: Synthetic oligonucleotide
  Target: ATXN1; (-) strand; PAM type: YTN; PAM sequence: TTT
gttcttgttttttttttttt

SEQ ID NO: 171868 - DNA, 20 bp, Artificial Sequence
  Description of Artificial Sequence: Synthetic oligonucleotide
  Target: ATXN1; (-) strand; PAM type: YTN; PAM sequence: TTT
tgttcttgtttttttttttt

SEQ ID NO: 171869 - DNA, 20 bp, Artificial Sequence
  Description of Artificial Sequence: Synthetic oligonucleotide
  Target: ATXN1; (-) strand; PAM type: YTN; PAM sequence: TTT
ttgttcttgttttttttttt

SEQ ID NO: 171870 - DNA, 20 bp, Artificial Sequence
  Description of Artificial Sequence: Synthetic oligonucleotide
  Target: ATXN1; (-) strand; PAM type: YTN; PAM sequence: TTG
tttttgttcttgtttttttt

SEQ ID NO: 171871 - DNA, 20 bp, Artificial Sequence
  Description of Artificial Sequence: Synthetic oligonucleotide
  Target: ATXN1; (-) strand; PAM type: YTN; PAM sequence: TTT
gtttttgttcttgttttttt

SEQ ID NO: 171872 - DNA, 20 bp, Artificial Sequence
  Description of Artificial Sequence: Synthetic oligonucleotide
  Target: ATXN1; (-) strand; PAM type: YTN; PAM sequence: TTT
tgtttttgttcttgtttttt

SEQ ID NO: 171873 - DNA, 20 bp, Artificial Sequence
  Description of Artificial Sequence: Synthetic oligonucleotide
  Target: ATXN1; (-) strand; PAM type: YTN; PAM sequence: TTT
ttgtttttgttcttgttttt

SEQ ID NO: 171874 - DNA, 20 bp, Artificial Sequence
  Description of Artificial Sequence: Synthetic oligonucleotide
  Target: ATXN1; (-) strand; PAM type: YTN; PAM sequence: CTC
agtcatacagataatagtaa

SEQ ID NO: 171875 - DNA, 20 bp, Artificial Sequence
  Description of Artificial Sequence: Synthetic oligonucleotide
  Target: ATXN1; (-) strand; PAM type: YTN; PAM sequence: TTA
acctcagtcatacagataat

SEQ ID NO: 171876 - DNA, 20 bp, Artificial Sequence
  Description of Artificial Sequence: Synthetic oligonucleotide
  Target: ATXN1; (-) strand; PAM type: YTN; PAM sequence: CTA
tacaagtagatgtaattaac

SEQ ID NO: 171877 - DNA, 20 bp, Artificial Sequence
  Description of Artificial Sequence: Synthetic oligonucleotide
  Target: ATXN1; (-) strand; PAM type: YTN; PAM sequence: TTA
tatccactatacaagtagat

SEQ ID NO: 171878 - DNA, 20 bp, Artificial Sequence
  Description of Artificial Sequence: Synthetic oligonucleotide
  Target: ATXN1; (-) strand; PAM type: YTN; PAM sequence: TTT
atatccactatacaagtaga

SEQ ID NO: 171879 - DNA, 20 bp, Artificial Sequence
  Description of Artificial Sequence: Synthetic oligonucleotide
  Target: ATXN1; (-) strand; PAM type: YTN; PAM sequence: CTT
tatatccactatacaagtag

SEQ ID NO: 171880 - DNA, 20 bp, Artificial Sequence
  Description of Artificial Sequence: Synthetic oligonucleotide
  Target: ATXN1; (-) strand; PAM type: YTN; PAM sequence: TTA
tgtggtgcatgactttatat

SEQ ID NO: 171881 - DNA, 20 bp, Artificial Sequence
  Description of Artificial Sequence: Synthetic oligonucleotide
  Target: ATXN1; (-) strand; PAM type: YTN; PAM sequence: TTG
ttatgtggtgcatgacttta

SEQ ID NO: 171882 - DNA, 20 bp, Artificial Sequence
  Description of Artificial Sequence: Synthetic oligonucleotide
  Target: ATXN1; (-) strand; PAM type: YTN; PAM sequence: CTG
acccaaatgttgttatgtgg

SEQ ID NO: 171883 - DNA, 20 bp, Artificial Sequence
  Description of Artificial Sequence: Synthetic oligonucleotide
  Target: ATXN1; (-) strand; PAM type: YTN; PAM sequence: CTG
tcacatatgcaatccgcggc

SEQ ID NO: 171884 - DNA, 20 bp, Artificial Sequence
  Description of Artificial Sequence: Synthetic oligonucleotide
  Target: ATXN1; (-) strand; PAM type: YTN; PAM sequence: TTA
tgtgaccgctgtcacatatg

SEQ ID NO: 171885 - DNA, 20 bp, Artificial Sequence
  Description of Artificial Sequence: Synthetic oligonucleotide
  Target: ATXN1; (-) strand; PAM type: YTN; PAM sequence: CTT
atgtgaccgctgtcacatat

SEQ ID NO: 171886 - DNA, 20 bp, Artificial Sequence
  Description of Artificial Sequence: Synthetic oligonucleotide
  Target: ATXN1; (-) strand; PAM type: YTN; PAM sequence: TTA
taatcttatgtgaccgctgt

SEQ ID NO: 171887 - DNA, 20 bp, Artificial Sequence
  Description of Artificial Sequence: Synthetic oligonucleotide
  Target: ATXN1; (-) strand; PAM type: YTN; PAM sequence: CTC
cattataatcttatgtgacc

SEQ ID NO: 171888 - DNA, 20 bp, Artificial Sequence
  Description of Artificial Sequence: Synthetic oligonucleotide
  Target: ATXN1; (-) strand; PAM type: YTN; PAM sequence: TTC
agctccattataatcttatg

SEQ ID NO: 171889 - DNA, 20 bp, Artificial Sequence
  Description of Artificial Sequence: Synthetic oligonucleotide
  Target: ATXN1; (-) strand; PAM type: YTN; PAM sequence: TTT
cagctccattataatcttat

SEQ ID NO: 171890 - DNA, 20 bp, Artificial Sequence
  Description of Artificial Sequence: Synthetic oligonucleotide
  Target: ATXN1; (-) strand; PAM type: YTN; PAM sequence: TTT
tcagctccattataatctta

SEQ ID NO: 171891 - DNA, 20 bp, Artificial Sequence
  Description of Artificial Sequence: Synthetic oligonucleotide
  Target: ATXN1; (-) strand; PAM type: YTN; PAM sequence: CTA
cagcatcagtaggcagtaga

SEQ ID NO: 171892 - DNA, 20 bp, Artificial Sequence
  Description of Artificial Sequence: Synthetic oligonucleotide
  Target: ATXN1; (-) strand; PAM type: YTN; PAM sequence: TTG
gacagctacagcatcagtag

SEQ ID NO: 171893 - DNA, 20 bp, Artificial Sequence
  Description of Artificial Sequence: Synthetic oligonucleotide
  Target: ATXN1; (-) strand; PAM type: YTN; PAM sequence: TTA
cattggacagctacagcatc

SEQ ID NO: 171894 - DNA, 20 bp, Artificial Sequence
  Description of Artificial Sequence: Synthetic oligonucleotide
  Target: ATXN1; (-) strand; PAM type: YTN; PAM sequence: CTA
ttacattggacagctacagc

SEQ ID NO: 171895 - DNA, 20 bp, Artificial Sequence
  Description of Artificial Sequence: Synthetic oligonucleotide
  Target: ATXN1; (-) strand; PAM type: YTN; PAM sequence: TTA
cactattacattggacagct

SEQ ID NO: 171896 - DNA, 20 bp, Artificial Sequence
  Description of Artificial Sequence: Synthetic oligonucleotide
  Target: ATXN1; (-) strand; PAM type: YTN; PAM sequence: TTA
tatataccagcatcaccaca

SEQ ID NO: 171897 - DNA, 20 bp, Artificial Sequence
  Description of Artificial Sequence: Synthetic oligonucleotide
  Target: ATXN1; (-) strand; PAM type: YTN; PAM sequence: TTT
atatataccagcatcaccac

SEQ ID NO: 171898 - DNA, 20 bp, Artificial Sequence
  Description of Artificial Sequence: Synthetic oligonucleotide
  Target: ATXN1; (-) strand; PAM type: YTN; PAM sequence: CTG
caggacgtttatatatacca

SEQ ID NO: 171899 - DNA, 20 bp, Artificial Sequence
  Description of Artificial Sequence: Synthetic oligonucleotide
  Target: ATXN1; (-) strand; PAM type: YTN; PAM sequence: CTG
gcactgcaggacgtttatat

SEQ ID NO: 171900 - DNA, 20 bp, Artificial Sequence
  Description of Artificial Sequence: Synthetic oligonucleotide
  Target: ATXN1; (-) strand; PAM type: YTN; PAM sequence: TTA
taggactggcactgcaggac

SEQ ID NO: 171901 - DNA, 20 bp, Artificial Sequence
  Description of Artificial Sequence: Synthetic oligonucleotide
  Target: ATXN1; (-) strand; PAM type: YTN; PAM sequence: TTT
ataggactggcactgcagga

SEQ ID NO: 171902 - DNA, 20 bp, Artificial Sequence
  Description of Artificial Sequence: Synthetic oligonucleotide
  Target: ATXN1; (-) strand; PAM type: YTN; PAM sequence: TTT
tataggactggcactgcagg

SEQ ID NO: 171903 - DNA, 20 bp, Artificial Sequence
  Description of Artificial Sequence: Synthetic oligonucleotide
  Target: ATXN1; (-) strand; PAM type: YTN; PAM sequence: CTT
ttataggactggcactgcag

SEQ ID NO: 171904 - DNA, 20 bp, Artificial Sequence
  Description of Artificial Sequence: Synthetic oligonucleotide
  Target: ATXN1; (-) strand; PAM type: YTN; PAM sequence: CTA
tacttttataggactggcac

SEQ ID NO: 171905 - DNA, 20 bp, Artificial Sequence
  Description of Artificial Sequence: Synthetic oligonucleotide
  Target: ATXN1; (-) strand; PAM type: YTN; PAM sequence: TTG
catgtgctatacttttatag

SEQ ID NO: 171906 - DNA, 20 bp, Artificial Sequence
  Description of Artificial Sequence: Synthetic oligonucleotide
  Target: ATXN1; (-) strand; PAM type: YTN; PAM sequence: CTG
tgcgtaattgcatgtgctat

SEQ ID NO: 171907 - DNA, 20 bp, Artificial Sequence
  Description of Artificial Sequence: Synthetic oligonucleotide
  Target: ATXN1; (-) strand; PAM type: YTN; PAM sequence: TTA
tgtactgtgcgtaattgcat

SEQ ID NO: 171908 - DNA, 20 bp, Artificial Sequence
  Description of Artificial Sequence: Synthetic oligonucleotide
  Target: ATXN1; (-) strand; PAM type: YTN; PAM sequence: CTA
ttatgtactgtgcgtaattg

SEQ ID NO: 171909 - DNA, 20 bp, Artificial Sequence
  Description of Artificial Sequence: Synthetic oligonucleotide
  Target: ATXN1; (-) strand; PAM type: YTN; PAM sequence: CTA
tcaactattatgtactgtgc

SEQ ID NO: 171910 - DNA, 20 bp, Artificial Sequence
  Description of Artificial Sequence: Synthetic oligonucleotide
  Target: ATXN1; (-) strand; PAM type: YTN; PAM sequence: TTC
actatcaactattatgtact

SEQ ID NO: 171911 - DNA, 20 bp, Artificial Sequence
  Description of Artificial Sequence: Synthetic oligonucleotide
  Target: ATXN1; (-) strand; PAM type: YTN; PAM sequence: TTT
cactatcaactattatgtac

SEQ ID NO: 171912 - DNA, 20 bp, Artificial Sequence
  Description of Artificial Sequence: Synthetic oligonucleotide
  Target: ATXN1; (-) strand; PAM type: YTN; PAM sequence: TTT
tcactatcaactattatgta

SEQ ID NO: 171913 - DNA, 20 bp, Artificial Sequence
  Description of Artificial Sequence: Synthetic oligonucleotide
  Target: ATXN1; (-) strand; PAM type: YTN; PAM sequence: TTA
ttttcactatcaactattat

SEQ ID NO: 171914 - DNA, 20 bp, Artificial Sequence
  Description of Artificial Sequence: Synthetic oligonucleotide
  Target: ATXN1; (-) strand; PAM type: YTN; PAM sequence: TTT
attttcactatcaactatta

SEQ ID NO: 171915 - DNA, 20 bp, Artificial Sequence
  Description of Artificial Sequence: Synthetic oligonucleotide
  Target: ATXN1; (-) strand; PAM type: YTN; PAM sequence: CTC
aaataacaataaaaagtata

SEQ ID NO: 171916 - DNA, 20 bp, Artificial Sequence
  Description of Artificial Sequence: Synthetic oligonucleotide
  Target: ATXN1; (-) strand; PAM type: YTN; PAM sequence: CTC
tcaaataacaataaaaagta

SEQ ID NO: 171917 - DNA, 20 bp, Artificial Sequence
  Description of Artificial Sequence: Synthetic oligonucleotide
  Target: ATXN1; (-) strand; PAM type: YTN; PAM sequence: TTA
taggtagaaagagtccactc

SEQ ID NO: 171918 - DNA, 20 bp, Artificial Sequence
  Description of Artificial Sequence: Synthetic oligonucleotide
  Target: ATXN1; (-) strand; PAM type: YTN; PAM sequence: CTT
ataggtagaaagagtccact

SEQ ID NO: 171919 - DNA, 20 bp, Artificial Sequence
  Description of Artificial Sequence: Synthetic oligonucleotide
  Target: ATXN1; (-) strand; PAM type: YTN; PAM sequence: TTC
ttataggtagaaagagtcca

SEQ ID NO: 171920 - DNA, 20 bp, Artificial Sequence
  Description of Artificial Sequence: Synthetic oligonucleotide
  Target: ATXN1; (-) strand; PAM type: YTN; PAM sequence: TTT
cttataggtagaaagagtcc

SEQ ID NO: 171921 - DNA, 20 bp, Artificial Sequence
  Description of Artificial Sequence: Synthetic oligonucleotide
  Target: ATXN1; (-) strand; PAM type: YTN; PAM sequence: TTA
atttcttataggtagaaaga

SEQ ID NO: 171922 - DNA, 20 bp, Artificial Sequence
  Description of Artificial Sequence: Synthetic oligonucleotide
  Target: ATXN1; (-) strand; PAM type: YTN; PAM sequence: CTA
cagttaatttcttataggta

SEQ ID NO: 171923 - DNA, 20 bp, Artificial Sequence
  Description of Artificial Sequence: Synthetic oligonucleotide
  Target: ATXN1; (-) strand; PAM type: YTN; PAM sequence: CTG
cgcccggcctacagttaatt

SEQ ID NO: 171924 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccactgcgcc

SEQ ID NO: 171925 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccac

SEQ ID NO: 171926 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 171927 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 171928 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 171929 - DNA, 20 bp, Artificial Sequence
  Description of Artificial Sequence: Synthetic oligonucleotide
  Target: ATXN1; (-) strand; PAM type: YTN; PAM sequence: CTG
cccaccttggcctcccaaag

SEQ ID NO: 171930 - DNA, 20 bp, Artificial Sequence
  Description of Artificial Sequence: Synthetic oligonucleotide
  Target: ATXN1; (-) strand; PAM type: YTN; PAM sequence: CTC
gtgatctgcccaccttggcc

SEQ ID NO: 171931 - DNA, 20 bp, Artificial Sequence
  Description of Artificial Sequence: Synthetic oligonucleotide
  Target: ATXN1; (-) strand; PAM type: YTN; PAM sequence: CTG
acctcgtgatctgcccacct

SEQ ID NO: 171932 - DNA, 20 bp, Artificial Sequence
  Description of Artificial Sequence: Synthetic oligonucleotide
  Target: ATXN1; (-) strand; PAM type: YTN; PAM sequence: CTC
ctgacctcgtgatctgccca

SEQ ID NO: 171933 - DNA, 20 bp, Artificial Sequence
  Description of Artificial Sequence: Synthetic oligonucleotide
  Target: ATXN1; (-) strand; PAM type: YTN; PAM sequence: CTC
gatctcctgacctcgtgatc

SEQ ID NO: 171934 - DNA, 20 bp, Artificial Sequence
  Description of Artificial Sequence: Synthetic oligonucleotide
  Target: ATXN1; (-) strand; PAM type: YTN; PAM sequence: TTG
gccaggatggtctcgatctc

SEQ ID NO: 171935 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggatggt

SEQ ID NO: 171936 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggatgg

SEQ ID NO: 171937 - DNA, 20 bp, Artificial Sequence
  Description of Artificial Sequence: Synthetic oligonucleotide
  Target: ATXN1; (-) strand; PAM type: YTN; PAM sequence: TTA
gtagagatgggtttcaccat

SEQ ID NO: 171938 - DNA, 20 bp, Artificial Sequence
  Description of Artificial Sequence: Synthetic oligonucleotide
  Target: ATXN1; (-) strand; PAM type: YTN; PAM sequence: TTT
agtagagatgggtttcacca

SEQ ID NO: 171939 - DNA, 20 bp, Artificial Sequence
  Description of Artificial Sequence: Synthetic oligonucleotide
  Target: ATXN1; (-) strand; PAM type: YTN; PAM sequence: TTT
tagtagagatgggtttcacc

SEQ ID NO: 171940 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatgggtttcac

SEQ ID NO: 171941 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggt

SEQ ID NO: 171942 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 171943 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 171944 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagatg

SEQ ID NO: 171945 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 171946 - DNA, 20 bp, Artificial Sequence
  Description of Artificial Sequence: Synthetic oligonucleotide
  Target: ATXN1; (-) strand; PAM type: YTN; PAM sequence: CTA
tgcccagctaatttttgtat

SEQ ID NO: 171947 - DNA, 20 bp, Artificial Sequence
  Description of Artificial Sequence: Synthetic oligonucleotide
  Target: ATXN1; (-) strand; PAM type: YTN; PAM sequence: TTA
caggcacgtgccactatgcc

SEQ ID NO: 171948 - DNA, 20 bp, Artificial Sequence
  Description of Artificial Sequence: Synthetic oligonucleotide
  Target: ATXN1; (-) strand; PAM type: YTN; PAM sequence: CTG
agattacaggcacgtgccac

SEQ ID NO: 171949 - DNA, 20 bp, Artificial Sequence
  Description of Artificial Sequence: Synthetic oligonucleotide
  Target: ATXN1; (-) strand; PAM type: YTN; PAM sequence: CTC
agccacccgaagagctgaga

SEQ ID NO: 171950 - DNA, 20 bp, Artificial Sequence
  Description of Artificial Sequence: Synthetic oligonucleotide
  Target: ATXN1; (-) strand; PAM type: YTN; PAM sequence: CTG
cctcagccacccgaagagct

SEQ ID NO: 171951 - DNA, 20 bp, Artificial Sequence
  Description of Artificial Sequence: Synthetic oligonucleotide
  Target: ATXN1; (-) strand; PAM type: YTN; PAM sequence: TTC
tgcctcagccacccgaagag

SEQ ID NO: 171952 - DNA, 20 bp, Artificial Sequence
  Description of Artificial Sequence: Synthetic oligonucleotide
  Target: ATXN1; (-) strand; PAM type: YTN; PAM sequence: CTT
ctgcctcagccacccgaaga

SEQ ID NO: 171953 - DNA, 20 bp, Artificial Sequence
  Description of Artificial Sequence: Synthetic oligonucleotide
  Target: ATXN1; (-) strand; PAM type: YTN; PAM sequence: TTC
ttctgcctcagccacccgaa

SEQ ID NO: 171954 - DNA, 20 bp, Artificial Sequence
  Description of Artificial Sequence: Synthetic oligonucleotide
  Target: ATXN1; (-) strand; PAM type: YTN; PAM sequence: TTC
aagtgattcttctgcctcag

SEQ ID NO: 171955 - DNA, 20 bp, Artificial Sequence
  Description of Artificial Sequence: Synthetic oligonucleotide
  Target: ATXN1; (-) strand; PAM type: YTN; PAM sequence: CTG
gttcaagtgattcttctgcc

SEQ ID NO: 171956 - DNA, 20 bp, Artificial Sequence
  Description of Artificial Sequence: Synthetic oligonucleotide
  Target: ATXN1; (-) strand; PAM type: YTN; PAM sequence: CTC
cctggttcaagtgattcttc

SEQ ID NO: 171957 - DNA, 20 bp, Artificial Sequence
  Description of Artificial Sequence: Synthetic oligonucleotide
  Target: ATXN1; (-) strand; PAM type: YTN; PAM sequence: CTC
cgactccctggttcaagtga

SEQ ID NO: 171958 - DNA, 20 bp, Artificial Sequence
  Description of Artificial Sequence: Synthetic oligonucleotide
  Target: ATXN1; (-) strand; PAM type: YTN; PAM sequence: CTG
caacctccgactccctggtt

SEQ ID NO: 171959 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccgactccct

SEQ ID NO: 171960 - DNA, 20 bp, Artificial Sequence
  Description of Artificial Sequence: Synthetic oligonucleotide
  Target: ATXN1; (-) strand; PAM type: YTN; PAM sequence: CTC
agctcactgcaacctccgac

SEQ ID NO: 171961 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcacaatctc

SEQ ID NO: 171962 - DNA, 20 bp, Artificial Sequence
  Description of Artificial Sequence: Synthetic oligonucleotide
  Target: ATXN1; (-) strand; PAM type: YTN; PAM sequence: CTG
tcaccaggctggagtgcagt

SEQ ID NO: 171963 - DNA, 20 bp, Artificial Sequence
  Description of Artificial Sequence: Synthetic oligonucleotide
  Target: ATXN1; (-) strand; PAM type: YTN; PAM sequence: CTC
tgtcaccaggctggagtgca

SEQ ID NO: 171964 - DNA, 20 bp, Artificial Sequence
  Description of Artificial Sequence: Synthetic oligonucleotide
  Target: ATXN1; (-) strand; PAM type: YTN; PAM sequence: CTC
gctctgtcaccaggctggag

SEQ ID NO: 171965 - DNA, 20 bp, Artificial Sequence
  Description of Artificial Sequence: Synthetic oligonucleotide
  Target: ATXN1; (-) strand; PAM type: YTN; PAM sequence: TTG
agacggagtctcgctctgtc

SEQ ID NO: 171966 - DNA, 20 bp, Artificial Sequence
  Description of Artificial Sequence: Synthetic oligonucleotide
  Target: ATXN1; (-) strand; PAM type: YTN; PAM sequence: TTT
gagacggagtctcgctctgt

SEQ ID NO: 171967 - DNA, 20 bp, Artificial Sequence
  Description of Artificial Sequence: Synthetic oligonucleotide
  Target: ATXN1; (-) strand; PAM type: YTN; PAM sequence: TTT
tgagacggagtctcgctctg

SEQ ID NO: 171968 - DNA, 20 bp, Artificial Sequence
  Description of Artificial Sequence: Synthetic oligonucleotide
  Target: ATXN1; (-) strand; PAM type: YTN; PAM sequence: TTT
ttgagacggagtctcgctct

SEQ ID NO: 171969 - DNA, 20 bp, Artificial Sequence
  Description of Artificial Sequence: Synthetic oligonucleotide
  Target: ATXN1; (-) strand; PAM type: YTN; PAM sequence: TTT
tttgagacggagtctcgctc

SEQ ID NO: 171970 - DNA, 20 bp, Artificial Sequence
  Description of Artificial Sequence: Synthetic oligonucleotide
  Target: ATXN1; (-) strand; PAM type: YTN; PAM sequence: TTT
ttttgagacggagtctcgct

SEQ ID NO: 171971 - DNA, 20 bp, Artificial Sequence
  Description of Artificial Sequence: Synthetic oligonucleotide
  Target: ATXN1; (-) strand; PAM type: YTN; PAM sequence: TTT
tttttgagacggagtctcgc

SEQ ID NO: 171972 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacggagtctcg

SEQ ID NO: 171973 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacggagtctc

SEQ ID NO: 171974 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacggagtct

SEQ ID NO: 171975 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacggagtc

SEQ ID NO: 171976 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacggagt

SEQ ID NO: 171977 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacggag

SEQ ID NO: 171978 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacgga

SEQ ID NO: 171979 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacgg

SEQ ID NO: 171980 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagacg

SEQ ID NO: 171981 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgagac

SEQ ID NO: 171982 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgaga

SEQ ID NO: 171983 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgag

SEQ ID NO: 171984 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttga

SEQ ID NO: 171985 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttg

SEQ ID NO: 171986 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 171987 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 171988 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 171989 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttttt

SEQ ID NO: 171990 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttttttt

SEQ ID NO: 171991 - DNA, 20 bp, Artificial Sequence
  Description of Artificial Sequence: Synthetic oligonucleotide
  Target: ATXN1; (-) strand; PAM type: YTN; PAM sequence: TTG
gctttttttttttttttttt

SEQ ID NO: 171992 - DNA, 20 bp, Artificial Sequence
  Description of Artificial Sequence: Synthetic oligonucleotide
  Target: ATXN1; (-) strand; PAM type: YTN; PAM sequence: TTA
attggctttttttttttttt

SEQ ID NO: 171993 - DNA, 20 bp, Artificial Sequence
  Description of Artificial Sequence: Synthetic oligonucleotide
  Target: ATXN1; (-) strand; PAM type: YTN; PAM sequence: TTA
cagttaattggctttttttt

SEQ ID NO: 171994 - DNA, 20 bp, Artificial Sequence
  Description of Artificial Sequence: Synthetic oligonucleotide
  Target: ATXN1; (-) strand; PAM type: YTN; PAM sequence: TTT
acagttaattggcttttttt

SEQ ID NO: 171995 - DNA, 20 bp, Artificial Sequence
  Description of Artificial Sequence: Synthetic oligonucleotide
  Target: ATXN1; (-) strand; PAM type: YTN; PAM sequence: CTG
tttacagttaattggctttt

SEQ ID NO: 171996 - DNA, 20 bp, Artificial Sequence
  Description of Artificial Sequence: Synthetic oligonucleotide
  Target: ATXN1; (-) strand; PAM type: YTN; PAM sequence: CTG
aggctgtttacagttaattg

SEQ ID NO: 171997 - DNA, 20 bp, Artificial Sequence
  Description of Artificial Sequence: Synthetic oligonucleotide
  Target: ATXN1; (-) strand; PAM type: YTN; PAM sequence: CTG
cctgaggctgtttacagtta

SEQ ID NO: 171998 - DNA, 20 bp, Artificial Sequence
  Description of Artificial Sequence: Synthetic oligonucleotide
  Target: ATXN1; (-) strand; PAM type: YTN; PAM sequence: CTC
cagagggacctgcctgaggc

SEQ ID NO: 171999 - DNA, 20 bp, Artificial Sequence
  Description of Artificial Sequence: Synthetic oligonucleotide
  Target: ATXN1; (-) strand; PAM type: YTN; PAM sequence: TTG
aacacctccagagggacctg

SEQ ID NO: 172000 - DNA, 20 bp, Artificial Sequence
  Description of Artificial Sequence: Synthetic oligonucleotide
  Target: ATXN1; (-) strand; PAM type: YTN; PAM sequence: CTT
gaacacctccagagggacct

SEQ ID NO: 172001 - DNA, 20 bp, Artificial Sequence
  Description of Artificial Sequence: Synthetic oligonucleotide
  Target: ATXN1; (-) strand; PAM type: YTN; PAM sequence: TTC
ttgaacacctccagagggac

SEQ ID NO: 172002 - DNA, 20 bp, Artificial Sequence
  Description of Artificial Sequence: Synthetic oligonucleotide
  Target: ATXN1; (-) strand; PAM type: YTN; PAM sequence: CTT
cttgaacacctccagaggga

SEQ ID NO: 172003 - DNA, 20 bp, Artificial Sequence
  Description of Artificial Sequence: Synthetic oligonucleotide
  Target: ATXN1; (-) strand; PAM type: YTN; PAM sequence: TTC
ttcttgaacacctccagagg

SEQ ID NO: 172004 - DNA, 20 bp, Artificial Sequence
  Description of Artificial Sequence: Synthetic oligonucleotide
  Target: ATXN1; (-) strand; PAM type: YTN; PAM sequence: CTT
cttcttgaacacctccagag

SEQ ID NO: 172005 - DNA, 20 bp, Artificial Sequence
  Description of Artificial Sequence: Synthetic oligonucleotide
  Target: ATXN1; (-) strand; PAM type: YTN; PAM sequence: CTG
cgatgataacaatgccttct

SEQ ID NO: 172006 - DNA, 20 bp, Artificial Sequence
  Description of Artificial Sequence: Synthetic oligonucleotide
  Target: ATXN1; (-) strand; PAM type: YTN; PAM sequence: TTC
agaggcaataccatgaatgg

SEQ ID NO: 172007 - DNA, 20 bp, Artificial Sequence
  Description of Artificial Sequence: Synthetic oligonucleotide
  Target: ATXN1; (-) strand; PAM type: YTN; PAM sequence: CTT
cagaggcaataccatgaatg

SEQ ID NO: 172008 - DNA, 20 bp, Artificial Sequence
  Description of Artificial Sequence: Synthetic oligonucleotide
  Target: ATXN1; (-) strand; PAM type: YTN; PAM sequence: CTG
taaggtcttcagaggcaata

SEQ ID NO: 172009 - DNA, 20 bp, Artificial Sequence
  Description of Artificial Sequence: Synthetic oligonucleotide
  Target: ATXN1; (-) strand; PAM type: YTN; PAM sequence: TTC
catctgtaaggtcttcagag

SEQ ID NO: 172010 - DNA, 20 bp, Artificial Sequence
  Description of Artificial Sequence: Synthetic oligonucleotide
  Target: ATXN1; (-) strand; PAM type: YTN; PAM sequence: TTT
ccatctgtaaggtcttcaga

SEQ ID NO: 172011 - DNA, 20 bp, Artificial Sequence
  Description of Artificial Sequence: Synthetic oligonucleotide
  Target: ATXN1; (-) strand; PAM type: YTN; PAM sequence: TTT
tccatctgtaaggtcttcag

SEQ ID NO: 172012 - DNA, 20 bp, Artificial Sequence
  Description of Artificial Sequence: Synthetic oligonucleotide
  Target: ATXN1; (-) strand; PAM type: YTN; PAM sequence: CTT
ttccatctgtaaggtcttca

SEQ ID NO: 172013 - DNA, 20 bp, Artificial Sequence
  Description of Artificial Sequence: Synthetic oligonucleotide
  Target: ATXN1; (-) strand; PAM type: YTN; PAM sequence: TTA
tcttttccatctgtaaggtc

SEQ ID NO: 172014 - DNA, 20 bp, Artificial Sequence
  Description of Artificial Sequence: Synthetic oligonucleotide
  Target: ATXN1; (-) strand; PAM type: YTN; PAM sequence: CTT
atcttttccatctgtaaggt

SEQ ID NO: 172015 - DNA, 20 bp, Artificial Sequence
  Description of Artificial Sequence: Synthetic oligonucleotide
  Target: ATXN1; (-) strand; PAM type: YTN; PAM sequence: CTC
cttatcttttccatctgtaa

SEQ ID NO: 172016 - DNA, 20 bp, Artificial Sequence
  Description of Artificial Sequence: Synthetic oligonucleotide
  Target: ATXN1; (-) strand; PAM type: YTN; PAM sequence: CTA
cctccttatcttttccatct

SEQ ID NO: 172017 - DNA, 20 bp, Artificial Sequence
  Description of Artificial Sequence: Synthetic oligonucleotide
  Target: ATXN1; (-) strand; PAM type: YTN; PAM sequence: TTC
tacctccttatcttttccat

SEQ ID NO: 172018 - DNA, 20 bp, Artificial Sequence
  Description of Artificial Sequence: Synthetic oligonucleotide
  Target: ATXN1; (-) strand; PAM type: YTN; PAM sequence: CTT
ctacctccttatcttttcca

SEQ ID NO: 172019 - DNA, 20 bp, Artificial Sequence
  Description of Artificial Sequence: Synthetic oligonucleotide
  Target: ATXN1; (-) strand; PAM type: YTN; PAM sequence: CTG
tcttctacctccttatcttt

SEQ ID NO: 172020 - DNA, 20 bp, Artificial Sequence
  Description of Artificial Sequence: Synthetic oligonucleotide
  Target: ATXN1; (-) strand; PAM type: YTN; PAM sequence: CTA
gccccacacagggtcatgat

SEQ ID NO: 172021 - DNA, 20 bp, Artificial Sequence
  Description of Artificial Sequence: Synthetic oligonucleotide
  Target: ATXN1; (-) strand; PAM type: YTN; PAM sequence: TTA
gcctagccccacacagggtc

SEQ ID NO: 172022 - DNA, 20 bp, Artificial Sequence
  Description of Artificial Sequence: Synthetic oligonucleotide
  Target: ATXN1; (-) strand; PAM type: YTN; PAM sequence: CTA
agacacaaacacatacatta

SEQ ID NO: 172023 - DNA, 20 bp, Artificial Sequence
  Description of Artificial Sequence: Synthetic oligonucleotide
  Target: ATXN1; (-) strand; PAM type: YTN; PAM sequence: TTA
aaaactaagacacaaacaca

SEQ ID NO: 172024 - DNA, 20 bp, Artificial Sequence
  Description of Artificial Sequence: Synthetic oligonucleotide
  Target: ATXN1; (-) strand; PAM type: YTN; PAM sequence: CTG
ttaaaaactaagacacaaac

SEQ ID NO: 172025 - DNA, 20 bp, Artificial Sequence
  Description of Artificial Sequence: Synthetic oligonucleotide
  Target: ATXN1; (-) strand; PAM type: YTN; PAM sequence: TTC
tgttaaaaactaagacacaa

SEQ ID NO: 172026 - DNA, 20 bp, Artificial Sequence
  Description of Artificial Sequence: Synthetic oligonucleotide
  Target: ATXN1; (-) strand; PAM type: YTN; PAM sequence: TTT
ctgttaaaaactaagacaca

SEQ ID NO: 172027 - DNA, 20 bp, Artificial Sequence
  Description of Artificial Sequence: Synthetic oligonucleotide
  Target: ATXN1; (-) strand; PAM type: YTN; PAM sequence: TTT
tctgttaaaaactaagacac

SEQ ID NO: 172028 - DNA, 20 bp, Artificial Sequence
  Description of Artificial Sequence: Synthetic oligonucleotide
  Target: ATXN1; (-) strand; PAM type: YTN; PAM sequence: TTA
agttttctgttaaaaactaa

SEQ ID NO: 172029 - DNA, 20 bp, Artificial Sequence
  Description of Artificial Sequence: Synthetic oligonucleotide
  Target: ATXN1; (-) strand; PAM type: YTN; PAM sequence: TTT
aagttttctgttaaaaacta

SEQ ID NO: 172030 - DNA, 20 bp, Artificial Sequence
  Description of Artificial Sequence: Synthetic oligonucleotide
  Target: ATXN1; (-) strand; PAM type: YTN; PAM sequence: TTT
taagttttctgttaaaaact

SEQ ID NO: 172031 - DNA, 20 bp, Artificial Sequence
  Description of Artificial Sequence: Synthetic oligonucleotide
  Target: ATXN1; (-) strand; PAM type: YTN; PAM sequence: TTT
ttaagttttctgttaaaaac

SEQ ID NO: 172032 - DNA, 20 bp, Artificial Sequence
  Description of Artificial Sequence: Synthetic oligonucleotide
  Target: ATXN1; (-) strand; PAM type: YTN; PAM sequence: TTT
tttaagttttctgttaaaaa

SEQ ID NO: 172033 - DNA, 20 bp, Artificial Sequence
  Description of Artificial Sequence: Synthetic oligonucleotide
  Target: ATXN1; (-) strand; PAM type: YTN; PAM sequence: TTT
ttttaagttttctgttaaaa

SEQ ID NO: 172034 - DNA, 20 bp, Artificial Sequence
  Description of Artificial Sequence: Synthetic oligonucleotide
  Target: ATXN1; (-) strand; PAM type: YTN; PAM sequence: TTT
tttttaagttttctgttaaa

SEQ ID NO: 172035 - DNA, 20 bp, Artificial Sequence
  Description of Artificial Sequence: Synthetic oligonucleotide
  Target: ATXN1; (-) strand; PAM type: YTN; PAM sequence: TTT
ttttttaagttttctgttaa

SEQ ID NO: 172036 - DNA, 20 bp, Artificial Sequence
  Description of Artificial Sequence: Synthetic oligonucleotide
  Target: ATXN1; (-) strand; PAM type: YTN; PAM sequence: TTT
tttttttaagttttctgtta

SEQ ID NO: 172037 - DNA, 20 bp, Artificial Sequence
  Description of Artificial Sequence: Synthetic oligonucleotide
  Target: ATXN1; (-) strand; PAM type: YTN; PAM sequence: TTT
ttttttttaagttttctgtt

SEQ ID NO: 172038 - DNA, 20 bp, Artificial Sequence
  Description of Artificial Sequence: Synthetic oligonucleotide
  Target: ATXN1; (-) strand; PAM type: YTN; PAM sequence: TTT
tttttttttaagttttctgt

SEQ ID NO: 172039 - DNA, 20 bp, Artificial Sequence
  Description of Artificial Sequence: Synthetic oligonucleotide
  Target: ATXN1; (-) strand; PAM type: YTN; PAM sequence: TTA
aaaaaagtttttttttttta

SEQ ID NO: 172040 - DNA, 20 bp, Artificial Sequence
  Description of Artificial Sequence: Synthetic oligonucleotide
  Target: ATXN1; (-) strand; PAM type: YTN; PAM sequence: TTA
ttaaaaaaagtttttttttt

SEQ ID NO: 172041 - DNA, 20 bp, Artificial Sequence
  Description of Artificial Sequence: Synthetic oligonucleotide
  Target: ATXN1; (-) strand; PAM type: YTN; PAM sequence: CTT
attaaaaaaagttttttttt

SEQ ID NO: 172042 - DNA, 20 bp, Artificial Sequence
  Description of Artificial Sequence: Synthetic oligonucleotide
  Target: ATXN1; (-) strand; PAM type: YTN; PAM sequence: TTC
ttattaaaaaaagttttttt

SEQ ID NO: 172043 - DNA, 20 bp, Artificial Sequence
  Description of Artificial Sequence: Synthetic oligonucleotide
  Target: ATXN1; (-) strand; PAM type: YTN; PAM sequence: TTT
cttattaaaaaaagtttttt

SEQ ID NO: 172044 - DNA, 20 bp, Artificial Sequence
  Description of Artificial Sequence: Synthetic oligonucleotide
  Target: ATXN1; (-) strand; PAM type: YTN; PAM sequence: TTT
tcttattaaaaaaagttttt

SEQ ID NO: 172045 - DNA, 20 bp, Artificial Sequence
  Description of Artificial Sequence: Synthetic oligonucleotide
  Target: ATXN1; (-) strand; PAM type: YTN; PAM sequence: TTT
ttcttattaaaaaaagtttt

SEQ ID NO: 172046 - DNA, 20 bp, Artificial Sequence
  Description of Artificial Sequence: Synthetic oligonucleotide
  Target: ATXN1; (-) strand; PAM type: YTN; PAM sequence: CTT
tttcttattaaaaaaagttt

SEQ ID NO: 172047 - DNA, 20 bp, Artificial Sequence
  Description of Artificial Sequence: Synthetic oligonucleotide
  Target: ATXN1; (-) strand; PAM type: YTN; PAM sequence: TTA
taagctttttcttattaaaa

SEQ ID NO: 172048 - DNA, 20 bp, Artificial Sequence
  Description of Artificial Sequence: Synthetic oligonucleotide
  Target: ATXN1; (-) strand; PAM type: YTN; PAM sequence: TTT
ataagctttttcttattaaa

SEQ ID NO: 172049 - DNA, 20 bp, Artificial Sequence
  Description of Artificial Sequence: Synthetic oligonucleotide
  Target: ATXN1; (-) strand; PAM type: YTN; PAM sequence: TTA
caggtgtacaccaccacatc

SEQ ID NO: 172050 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgtacaccac

SEQ ID NO: 172051 - DNA, 20 bp, Artificial Sequence
  Description of Artificial Sequence: Synthetic oligonucleotide
  Target: ATXN1; (-) strand; PAM type: YTN; PAM sequence: CTC
ccaaaatgctgggattacag

SEQ ID NO: 172052 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaaatgctggga

SEQ ID NO: 172053 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaaaatgct

SEQ ID NO: 172054 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccaaaat

SEQ ID NO: 172055 - DNA, 20 bp, Artificial Sequence
  Description of Artificial Sequence: Synthetic oligonucleotide
  Target: ATXN1; (-) strand; PAM type: YTN; PAM sequence: CTC
aagccatcctcctgcctcag

SEQ ID NO: 172056 - DNA, 20 bp, Artificial Sequence
  Description of Artificial Sequence: Synthetic oligonucleotide
  Target: ATXN1; (-) strand; PAM type: YTN; PAM sequence: TTC
gcgcacccgggctcaagcca

SEQ ID NO: 172057 - DNA, 20 bp, Artificial Sequence
  Description of Artificial Sequence: Synthetic oligonucleotide
  Target: ATXN1; (-) strand; PAM type: YTN; PAM sequence: TTT
cgcgcacccgggctcaagcc

SEQ ID NO: 172058 - DNA, 20 bp, Artificial Sequence
  Description of Artificial Sequence: Synthetic oligonucleotide
  Target: ATXN1; (-) strand; PAM type: YTN; PAM sequence: CTG
gtttcgcgcacccgggctca

SEQ ID NO: 172059 - DNA, 20 bp, Artificial Sequence
  Description of Artificial Sequence: Synthetic oligonucleotide
  Target: ATXN1; (-) strand; PAM type: YTN; PAM sequence: TTG
cccaggctggtttcgcgcac

SEQ ID NO: 172060 - DNA, 20 bp, Artificial Sequence
  Description of Artificial Sequence: Synthetic oligonucleotide
  Target: ATXN1; (-) strand; PAM type: YTN; PAM sequence: CTA
tgttgcccaggctggtttcg

SEQ ID NO: 172061 - DNA, 20 bp, Artificial Sequence
  Description of Artificial Sequence: Synthetic oligonucleotide
  Target: ATXN1; (-) strand; PAM type: YTN; PAM sequence: CTC
actatgttgcccaggctggt

SEQ ID NO: 172062 - DNA, 20 bp, Artificial Sequence
  Description of Artificial Sequence: Synthetic oligonucleotide
  Target: ATXN1; (-) strand; PAM type: YTN; PAM sequence: CTA
agtctcactatgttgcccag

SEQ ID NO: 172063 - DNA, 20 bp, Artificial Sequence
  Description of Artificial Sequence: Synthetic oligonucleotide
  Target: ATXN1; (-) strand; PAM type: YTN; PAM sequence: TTG
tagaaactaagtctcactat

SEQ ID NO: 172064 - DNA, 20 bp, Artificial Sequence
  Description of Artificial Sequence: Synthetic oligonucleotide
  Target: ATXN1; (-) strand; PAM type: YTN; PAM sequence: TTT
gtagaaactaagtctcacta

SEQ ID NO: 172065 - DNA, 20 bp, Artificial Sequence
  Description of Artificial Sequence: Synthetic oligonucleotide
  Target: ATXN1; (-) strand; PAM type: YTN; PAM sequence: TTT
tgtagaaactaagtctcact

SEQ ID NO: 172066 - DNA, 20 bp, Artificial Sequence
  Description of Artificial Sequence: Synthetic oligonucleotide
  Target: ATXN1; (-) strand; PAM type: YTN; PAM sequence: TTT
ttgtagaaactaagtctcac

SEQ ID NO: 172067 - DNA, 20 bp, Artificial Sequence
  Description of Artificial Sequence: Synthetic oligonucleotide
  Target: ATXN1; (-) strand; PAM type: YTN; PAM sequence: TTG
tttttgtagaaactaagtct

SEQ ID NO: 172068 - DNA, 20 bp, Artificial Sequence
  Description of Artificial Sequence: Synthetic oligonucleotide
  Target: ATXN1; (-) strand; PAM type: YTN; PAM sequence: CTT
gtttttgtagaaactaagtc

SEQ ID NO: 172069 - DNA, 20 bp, Artificial Sequence
  Description of Artificial Sequence: Synthetic oligonucleotide
  Target: ATXN1; (-) strand; PAM type: YTN; PAM sequence: CTA
taagcttgtttttgtagaaa

SEQ ID NO: 172070 - DNA, 20 bp, Artificial Sequence
  Description of Artificial Sequence: Synthetic oligonucleotide
  Target: ATXN1; (-) strand; PAM type: YTN; PAM sequence: TTC
tataagcttgtttttgtaga

SEQ ID NO: 172071 - DNA, 20 bp, Artificial Sequence
  Description of Artificial Sequence: Synthetic oligonucleotide
  Target: ATXN1; (-) strand; PAM type: YTN; PAM sequence: TTA
ttctataagcttgtttttgt

SEQ ID NO: 172072 - DNA, 20 bp, Artificial Sequence
  Description of Artificial Sequence: Synthetic oligonucleotide
  Target: ATXN1; (-) strand; PAM type: YTN; PAM sequence: TTT
attctataagcttgtttttg

SEQ ID NO: 172073 - DNA, 20 bp, Artificial Sequence
  Description of Artificial Sequence: Synthetic oligonucleotide
  Target: ATXN1; (-) strand; PAM type: YTN; PAM sequence: CTT
tattctataagcttgttttt

SEQ ID NO: 172074 - DNA, 20 bp, Artificial Sequence
  Description of Artificial Sequence: Synthetic oligonucleotide
  Target: ATXN1; (-) strand; PAM type: YTN; PAM sequence: TTA
tatctttattctataagctt

SEQ ID NO: 172075 - DNA, 20 bp, Artificial Sequence
  Description of Artificial Sequence: Synthetic oligonucleotide
  Target: ATXN1; (-) strand; PAM type: YTN; PAM sequence: TTT
atatctttattctataagct

SEQ ID NO: 172076 - DNA, 20 bp, Artificial Sequence
  Description of Artificial Sequence: Synthetic oligonucleotide
  Target: ATXN1; (-) strand; PAM type: YTN; PAM sequence: CTT
tatatctttattctataagc

SEQ ID NO: 172077 - DNA, 20 bp, Artificial Sequence
  Description of Artificial Sequence: Synthetic oligonucleotide
  Target: ATXN1; (-) strand; PAM type: YTN; PAM sequence: TTC
tttatatctttattctataa

SEQ ID NO: 172078 - DNA, 20 bp, Artificial Sequence
  Description of Artificial Sequence: Synthetic oligonucleotide
  Target: ATXN1; (-) strand; PAM type: YTN; PAM sequence: TTT
ctttatatctttattctata

SEQ ID NO: 172079 - DNA, 20 bp, Artificial Sequence
  Description of Artificial Sequence: Synthetic oligonucleotide
  Target: ATXN1; (-) strand; PAM type: YTN; PAM sequence: CTT
tctttatatctttattctat

SEQ ID NO: 172080 - DNA, 20 bp, Artificial Sequence
  Description of Artificial Sequence: Synthetic oligonucleotide
  Target: ATXN1; (-) strand; PAM type: YTN; PAM sequence: TTC
tttctttatatctttattct

SEQ ID NO: 172081 - DNA, 20 bp, Artificial Sequence
  Description of Artificial Sequence: Synthetic oligonucleotide
  Target: ATXN1; (-) strand; PAM type: YTN; PAM sequence: TTT
ctttctttatatctttattc

SEQ ID NO: 172082 - DNA, 20 bp, Artificial Sequence
  Description of Artificial Sequence: Synthetic oligonucleotide
  Target: ATXN1; (-) strand; PAM type: YTN; PAM sequence: TTT
tctttctttatatctttatt

SEQ ID NO: 172083 - DNA, 20 bp, Artificial Sequence
  Description of Artificial Sequence: Synthetic oligonucleotide
  Target: ATXN1; (-) strand; PAM type: YTN; PAM sequence: CTG
tacaagaatattttctttct

SEQ ID NO: 172084 - DNA, 20 bp, Artificial Sequence
  Description of Artificial Sequence: Synthetic oligonucleotide
  Target: ATXN1; (-) strand; PAM type: YTN; PAM sequence: TTA
cagctgtacaagaatatttt

SEQ ID NO: 172085 - DNA, 20 bp, Artificial Sequence
  Description of Artificial Sequence: Synthetic oligonucleotide
  Target: ATXN1; (-) strand; PAM type: YTN; PAM sequence: TTT
acagctgtacaagaatattt

SEQ ID NO: 172086 - DNA, 20 bp, Artificial Sequence
  Description of Artificial Sequence: Synthetic oligonucleotide
  Target: ATXN1; (-) strand; PAM type: YTN; PAM sequence: TTT
tacagctgtacaagaatatt

SEQ ID NO: 172087 - DNA, 20 bp, Artificial Sequence
  Description of Artificial Sequence: Synthetic oligonucleotide
  Target: ATXN1; (-) strand; PAM type: YTN; PAM sequence: TTA
aaatacaaacacattttaca

SEQ ID NO: 172088 - DNA, 20 bp, Artificial Sequence
  Description of Artificial Sequence: Synthetic oligonucleotide
  Target: ATXN1; (-) strand; PAM type: YTN; PAM sequence: TTT
aaaatacaaacacattttac

SEQ ID NO: 172089 - DNA, 20 bp, Artificial Sequence
  Description of Artificial Sequence: Synthetic oligonucleotide
  Target: ATXN1; (-) strand; PAM type: YTN; PAM sequence: CTC
agtttaaaatacaaacacat

SEQ ID NO: 172090 - DNA, 20 bp, Artificial Sequence
  Description of Artificial Sequence: Synthetic oligonucleotide
  Target: ATXN1; (-) strand; PAM type: YTN; PAM sequence: TTC
ataatagcactcagtttaaa

SEQ ID NO: 172091 - DNA, 20 bp, Artificial Sequence
  Description of Artificial Sequence: Synthetic oligonucleotide
  Target: ATXN1; (-) strand; PAM type: YTN; PAM sequence: TTT
cataatagcactcagtttaa

SEQ ID NO: 172092 - DNA, 20 bp, Artificial Sequence
  Description of Artificial Sequence: Synthetic oligonucleotide
  Target: ATXN1; (-) strand; PAM type: YTN; PAM sequence: CTT
tcataatagcactcagttta

SEQ ID NO: 172093 - DNA, 20 bp, Artificial Sequence
  Description of Artificial Sequence: Synthetic oligonucleotide
  Target: ATXN1; (-) strand; PAM type: YTN; PAM sequence: TTG
ataactttcataatagcact

SEQ ID NO: 172094 - DNA, 20 bp, Artificial Sequence
  Description of Artificial Sequence: Synthetic oligonucleotide
  Target: ATXN1; (-) strand; PAM type: YTN; PAM sequence: TTT
gataactttcataatagcac

SEQ ID NO: 172095 - DNA, 20 bp, Artificial Sequence
  Description of Artificial Sequence: Synthetic oligonucleotide
  Target: ATXN1; (-) strand; PAM type: YTN; PAM sequence: TTT
tgataactttcataatagca

SEQ ID NO: 172096 - DNA, 20 bp, Artificial Sequence
  Description of Artificial Sequence: Synthetic oligonucleotide
  Target: ATXN1; (-) strand; PAM type: YTN; PAM sequence: TTT
ttgataactttcataatagc

SEQ ID NO: 172097 - DNA, 20 bp, Artificial Sequence
  Description of Artificial Sequence: Synthetic oligonucleotide
  Target: ATXN1; (-) strand; PAM type: YTN; PAM sequence: CTT
tttgataactttcataatag

SEQ ID NO: 172098 - DNA, 20 bp, Artificial Sequence
  Description of Artificial Sequence: Synthetic oligonucleotide
  Target: ATXN1; (-) strand; PAM type: YTN; PAM sequence: TTA
aaaactttttgataactttc

SEQ ID NO: 172099 - DNA, 20 bp, Artificial Sequence
  Description of Artificial Sequence: Synthetic oligonucleotide
  Target: ATXN1; (-) strand; PAM type: YTN; PAM sequence: TTT
aaaaactttttgataacttt

SEQ ID NO: 172100 - DNA, 20 bp, Artificial Sequence
  Description of Artificial Sequence: Synthetic oligonucleotide
  Target: ATXN1; (-) strand; PAM type: YTN; PAM sequence: TTT
taaaaactttttgataactt

SEQ ID NO: 172101 - DNA, 20 bp, Artificial Sequence
  Description of Artificial Sequence: Synthetic oligonucleotide
  Target: ATXN1; (-) strand; PAM type: YTN; PAM sequence: TTT
ttaaaaactttttgataact

SEQ ID NO: 172102 - DNA, 20 bp, Artificial Sequence
  Description of Artificial Sequence: Synthetic oligonucleotide
  Target: ATXN1; (-) strand; PAM type: YTN; PAM sequence: TTA
atttttaaaaactttttgat

SEQ ID NO: 172103 - DNA, 20 bp, Artificial Sequence
  Description of Artificial Sequence: Synthetic oligonucleotide
  Target: ATXN1; (-) strand; PAM type: YTN; PAM sequence: TTT
aatttttaaaaactttttga

SEQ ID NO: 172104 - DNA, 20 bp, Artificial Sequence
  Description of Artificial Sequence: Synthetic oligonucleotide
  Target: ATXN1; (-) strand; PAM type: YTN; PAM sequence: TTT
taatttttaaaaactttttg

SEQ ID NO: 172105 - DNA, 20 bp, Artificial Sequence
  Description of Artificial Sequence: Synthetic oligonucleotide
  Target: ATXN1; (-) strand; PAM type: YTN; PAM sequence: TTT
ttaatttttaaaaacttttt

SEQ ID NO: 172106 - DNA, 20 bp, Artificial Sequence
  Description of Artificial Sequence: Synthetic oligonucleotide
  Target: ATXN1; (-) strand; PAM type: YTN; PAM sequence: CTT
tttaatttttaaaaactttt

SEQ ID NO: 172107 - DNA, 20 bp, Artificial Sequence
  Description of Artificial Sequence: Synthetic oligonucleotide
  Target: ATXN1; (-) strand; PAM type: YTN; PAM sequence: TTA
taaactttttaatttttaaa

SEQ ID NO: 172108 - DNA, 20 bp, Artificial Sequence
  Description of Artificial Sequence: Synthetic oligonucleotide
  Target: ATXN1; (-) strand; PAM type: YTN; PAM sequence: TTT
ataaactttttaatttttaa

SEQ ID NO: 172109 - DNA, 20 bp, Artificial Sequence
  Description of Artificial Sequence: Synthetic oligonucleotide
  Target: ATXN1; (-) strand; PAM type: YTN; PAM sequence: CTT
tataaactttttaattttta

SEQ ID NO: 172110 - DNA, 20 bp, Artificial Sequence
  Description of Artificial Sequence: Synthetic oligonucleotide
  Target: ATXN1; (-) strand; PAM type: YTN; PAM sequence: TTA
ctttataaactttttaattt

SEQ ID NO: 172111 - DNA, 20 bp, Artificial Sequence
  Description of Artificial Sequence: Synthetic oligonucleotide
  Target: ATXN1; (-) strand; PAM type: YTN; PAM sequence: TTT
actttataaactttttaatt

SEQ ID NO: 172112 - DNA, 20 bp, Artificial Sequence
  Description of Artificial Sequence: Synthetic oligonucleotide
  Target: ATXN1; (-) strand; PAM type: YTN; PAM sequence: TTT
tactttataaactttttaat

SEQ ID NO: 172113 - DNA, 20 bp, Artificial Sequence
  Description of Artificial Sequence: Synthetic oligonucleotide
  Target: ATXN1; (-) strand; PAM type: YTN; PAM sequence: TTT
ttactttataaactttttaa

SEQ ID NO: 172114 - DNA, 20 bp, Artificial Sequence
  Description of Artificial Sequence: Synthetic oligonucleotide
  Target: ATXN1; (-) strand; PAM type: YTN; PAM sequence: TTT
tttactttataaacttttta

SEQ ID NO: 172115 - DNA, 20 bp, Artificial Sequence
  Description of Artificial Sequence: Synthetic oligonucleotide
  Target: ATXN1; (-) strand; PAM type: YTN; PAM sequence: CTT
ttttactttataaacttttt

SEQ ID NO: 172116 - DNA, 20 bp, Artificial Sequence
  Description of Artificial Sequence: Synthetic oligonucleotide
  Target: ATXN1; (-) strand; PAM type: YTN; PAM sequence: TTA
cttttttactttataaactt

SEQ ID NO: 172117 - DNA, 20 bp, Artificial Sequence
  Description of Artificial Sequence: Synthetic oligonucleotide
  Target: ATXN1; (-) strand; PAM type: YTN; PAM sequence: CTT
acttttttactttataaact

SEQ ID NO: 172118 - DNA, 20 bp, Artificial Sequence
  Description of Artificial Sequence: Synthetic oligonucleotide
  Target: ATXN1; (-) strand; PAM type: YTN; PAM sequence: CTC
agcttacttttttactttat

SEQ ID NO: 172119 - DNA, 20 bp, Artificial Sequence
  Description of Artificial Sequence: Synthetic oligonucleotide
  Target: ATXN1; (-) strand; PAM type: YTN; PAM sequence: TTA
accacgctcagcttactttt

SEQ ID NO: 172120 - DNA, 20 bp, Artificial Sequence
  Description of Artificial Sequence: Synthetic oligonucleotide
  Target: ATXN1; (-) strand; PAM type: YTN; PAM sequence: TTG
ataataaattaaccacgctc

SEQ ID NO: 172121 - DNA, 20 bp, Artificial Sequence
  Description of Artificial Sequence: Synthetic oligonucleotide
  Target: ATXN1; (-) strand; PAM type: YTN; PAM sequence: TTT
gataataaattaaccacgct

SEQ ID NO: 172122 - DNA, 20 bp, Artificial Sequence
  Description of Artificial Sequence: Synthetic oligonucleotide
  Target: ATXN1; (-) strand; PAM type: YTN; PAM sequence: CTT
tgataataaattaaccacgc

SEQ ID NO: 172123 - DNA, 20 bp, Artificial Sequence
  Description of Artificial Sequence: Synthetic oligonucleotide
  Target: ATXN1; (-) strand; PAM type: YTN; PAM sequence: TTC
tttgataataaattaaccac

SEQ ID NO: 172124 - DNA, 20 bp, Artificial Sequence
  Description of Artificial Sequence: Synthetic oligonucleotide
  Target: ATXN1; (-) strand; PAM type: YTN; PAM sequence: TTT
ctttgataataaattaacca

SEQ ID NO: 172125 - DNA, 20 bp, Artificial Sequence
  Description of Artificial Sequence: Synthetic oligonucleotide
  Target: ATXN1; (-) strand; PAM type: YTN; PAM sequence: CTT
tctttgataataaattaacc

SEQ ID NO: 172126 - DNA, 20 bp, Artificial Sequence
  Description of Artificial Sequence: Synthetic oligonucleotide
  Target: ATXN1; (-) strand; PAM type: YTN; PAM sequence: TTC
tttctttgataataaattaa

SEQ ID NO: 172127 - DNA, 20 bp, Artificial Sequence
  Description of Artificial Sequence: Synthetic oligonucleotide
  Target: ATXN1; (-) strand; PAM type: YTN; PAM sequence: TTG
ttctttctttgataataaat

SEQ ID NO: 172128 - DNA, 20 bp, Artificial Sequence
  Description of Artificial Sequence: Synthetic oligonucleotide
  Target: ATXN1; (-) strand; PAM type: YTN; PAM sequence: TTA
aattgttctttctttgataa

SEQ ID NO: 172129 - DNA, 20 bp, Artificial Sequence
  Description of Artificial Sequence: Synthetic oligonucleotide
  Target: ATXN1; (-) strand; PAM type: YTN; PAM sequence: TTT
aaattgttctttctttgata

SEQ ID NO: 172130 - DNA, 20 bp, Artificial Sequence
  Description of Artificial Sequence: Synthetic oligonucleotide
  Target: ATXN1; (-) strand; PAM type: YTN; PAM sequence: TTT
taaattgttctttctttgat

SEQ ID NO: 172131 - DNA, 20 bp, Artificial Sequence
  Description of Artificial Sequence: Synthetic oligonucleotide
  Target: ATXN1; (-) strand; PAM type: YTN; PAM sequence: TTT
ttaaattgttctttctttga

SEQ ID NO: 172132 - DNA, 20 bp, Artificial Sequence
  Description of Artificial Sequence: Synthetic oligonucleotide
  Target: ATXN1; (-) strand; PAM type: YTN; PAM sequence: TTT
tttaaattgttctttctttg

SEQ ID NO: 172133 - DNA, 20 bp, Artificial Sequence
  Description of Artificial Sequence: Synthetic oligonucleotide
  Target: ATXN1; (-) strand; PAM type: YTN; PAM sequence: TTG
ttttttaaattgttctttct

SEQ ID NO: 172134 - DNA, 20 bp, Artificial Sequence
  Description of Artificial Sequence: Synthetic oligonucleotide
  Target: ATXN1; (-) strand; PAM type: YTN; PAM sequence: TTT
gttttttaaattgttctttc

SEQ ID NO: 172135 - DNA, 20 bp, Artificial Sequence
  Description of Artificial Sequence: Synthetic oligonucleotide
  Target: ATXN1; (-) strand; PAM type: YTN; PAM sequence: CTA
agtttgttttttaaattgtt

SEQ ID NO: 172136 - DNA, 20 bp, Artificial Sequence
  Description of Artificial Sequence: Synthetic oligonucleotide
  Target: ATXN1; (-) strand; PAM type: YTN; PAM sequence: CTA
cactaagtttgttttttaaa

SEQ ID NO: 172137 - DNA, 20 bp, Artificial Sequence
  Description of Artificial Sequence: Synthetic oligonucleotide
  Target: ATXN1; (-) strand; PAM type: YTN; PAM sequence: TTA
ggctacactaagtttgtttt

SEQ ID NO: 172138 - DNA, 20 bp, Artificial Sequence
  Description of Artificial Sequence: Synthetic oligonucleotide
  Target: ATXN1; (-) strand; PAM type: YTN; PAM sequence: CTT
aggctacactaagtttgttt

SEQ ID NO: 172139 - DNA, 20 bp, Artificial Sequence
  Description of Artificial Sequence: Synthetic oligonucleotide
  Target: ATXN1; (-) strand; PAM type: YTN; PAM sequence: CTG
tacacttaggctacactaag

SEQ ID NO: 172140 - DNA, 20 bp, Artificial Sequence
  Description of Artificial Sequence: Synthetic oligonucleotide
  Target: ATXN1; (-) strand; PAM type: YTN; PAM sequence: TTA
taaggactgtacacttaggc

SEQ ID NO: 172141 - DNA, 20 bp, Artificial Sequence
  Description of Artificial Sequence: Synthetic oligonucleotide
  Target: ATXN1; (-) strand; PAM type: YTN; PAM sequence: TTT
ataaggactgtacacttagg

SEQ ID NO: 172142 - DNA, 20 bp, Artificial Sequence
  Description of Artificial Sequence: Synthetic oligonucleotide
  Target: ATXN1; (-) strand; PAM type: YTN; PAM sequence: CTT
tataaggactgtacacttag

SEQ ID NO: 172143 - DNA, 20 bp, Artificial Sequence
  Description of Artificial Sequence: Synthetic oligonucleotide
  Target: ATXN1; (-) strand; PAM type: YTN; PAM sequence: CTG
tagactttataaggactgta

SEQ ID NO: 172144 - DNA, 20 bp, Artificial Sequence
  Description of Artificial Sequence: Synthetic oligonucleotide
  Target: ATXN1; (-) strand; PAM type: YTN; PAM sequence: CTG
taccccactgtagactttat

SEQ ID NO: 172145 - DNA, 20 bp, Artificial Sequence
  Description of Artificial Sequence: Synthetic oligonucleotide
  Target: ATXN1; (-) strand; PAM type: YTN; PAM sequence: CTG
tatcactgtaccccactgta

SEQ ID NO: 172146 - DNA, 20 bp, Artificial Sequence
  Description of Artificial Sequence: Synthetic oligonucleotide
  Target: ATXN1; (-) strand; PAM type: YTN; PAM sequence: CTA
ggacatcactgtatcactgt

SEQ ID NO: 172147 - DNA, 20 bp, Artificial Sequence
  Description of Artificial Sequence: Synthetic oligonucleotide
  Target: ATXN1; (-) strand; PAM type: YTN; PAM sequence: CTG
ggtgagtcagtgagtgggtg

SEQ ID NO: 172148 - DNA, 20 bp, Artificial Sequence
  Description of Artificial Sequence: Synthetic oligonucleotide
  Target: ATXN1; (-) strand; PAM type: YTN; PAM sequence: CTC
tgggtgagtcagtgagtggg

SEQ ID NO: 172149 - DNA, 20 bp, Artificial Sequence
  Description of Artificial Sequence: Synthetic oligonucleotide
  Target: ATXN1; (-) strand; PAM type: YTN; PAM sequence: TTG
ctctgggtgagtcagtgagt

SEQ ID NO: 172150 - DNA, 20 bp, Artificial Sequence
  Description of Artificial Sequence: Synthetic oligonucleotide
  Target: ATXN1; (-) strand; PAM type: YTN; PAM sequence: CTG
gaagttgctctgggtgagtc

SEQ ID NO: 172151 - DNA, 20 bp, Artificial Sequence
  Description of Artificial Sequence: Synthetic oligonucleotide
  Target: ATXN1; (-) strand; PAM type: YTN; PAM sequence: TTG
caggactggaagttgctctg

SEQ ID NO: 172152 - DNA, 20 bp, Artificial Sequence
  Description of Artificial Sequence: Synthetic oligonucleotide
  Target: ATXN1; (-) strand; PAM type: YTN; PAM sequence: CTT
gcaggactggaagttgctct

SEQ ID NO: 172153 - DNA, 20 bp, Artificial Sequence
  Description of Artificial Sequence: Synthetic oligonucleotide
  Target: ATXN1; (-) strand; PAM type: YTN; PAM sequence: TTA
ccatgaatggagcttgcagg

SEQ ID NO: 172154 - DNA, 20 bp, Artificial Sequence
  Description of Artificial Sequence: Synthetic oligonucleotide
  Target: ATXN1; (-) strand; PAM type: YTN; PAM sequence: CTT
accatgaatggagcttgcag

SEQ ID NO: 172155 - DNA, 20 bp, Artificial Sequence
  Description of Artificial Sequence: Synthetic oligonucleotide
  Target: ATXN1; (-) strand; PAM type: YTN; PAM sequence: CTA
tatagggcacttaccatgaa

SEQ ID NO: 172156 - DNA, 20 bp, Artificial Sequence
  Description of Artificial Sequence: Synthetic oligonucleotide
  Target: ATXN1; (-) strand; PAM type: YTN; PAM sequence: TTA
aaagggcacacctatatagg

SEQ ID NO: 172157 - DNA, 20 bp, Artificial Sequence
  Description of Artificial Sequence: Synthetic oligonucleotide
  Target: ATXN1; (-) strand; PAM type: YTN; PAM sequence: TTT
aaaagggcacacctatatag

SEQ ID NO: 172158 - DNA, 20 bp, Artificial Sequence
  Description of Artificial Sequence: Synthetic oligonucleotide
  Target: ATXN1; (-) strand; PAM type: YTN; PAM sequence: TTT
taaaagggcacacctatata

SEQ ID NO: 172159 - DNA, 20 bp, Artificial Sequence
  Description of Artificial Sequence: Synthetic oligonucleotide
  Target: ATXN1; (-) strand; PAM type: YTN; PAM sequence: CTA
gacatagaataggtacagta

SEQ ID NO: 172160 - DNA, 20 bp, Artificial Sequence
  Description of Artificial Sequence: Synthetic oligonucleotide
  Target: ATXN1; (-) strand; PAM type: YTN; PAM sequence: TTG
tgcatctagacatagaatag

SEQ ID NO: 172161 - DNA, 20 bp, Artificial Sequence
  Description of Artificial Sequence: Synthetic oligonucleotide
  Target: ATXN1; (-) strand; PAM type: YTN; PAM sequence: TTT
gtgcatctagacatagaata

SEQ ID NO: 172162 - DNA, 20 bp, Artificial Sequence
  Description of Artificial Sequence: Synthetic oligonucleotide
  Target: ATXN1; (-) strand; PAM type: YTN; PAM sequence: TTT
tgtgcatctagacatagaat

SEQ ID NO: 172163 - DNA, 20 bp, Artificial Sequence
  Description of Artificial Sequence: Synthetic oligonucleotide
  Target: ATXN1; (-) strand; PAM type: YTN; PAM sequence: TTT
ttgtgcatctagacatagaa

SEQ ID NO: 172164 - DNA, 20 bp, Artificial Sequence
  Description of Artificial Sequence: Synthetic oligonucleotide
  Target: ATXN1; (-) strand; PAM type: YTN; PAM sequence: CTA
aacatagtttttgtgcatct

SEQ ID NO: 172165 - DNA, 20 bp, Artificial Sequence
  Description of Artificial Sequence: Synthetic oligonucleotide
  Target: ATXN1; (-) strand; PAM type: YTN; PAM sequence: TTC
ctaaacatagtttttgtgca

SEQ ID NO: 172166 - DNA, 20 bp, Artificial Sequence
  Description of Artificial Sequence: Synthetic oligonucleotide
  Target: ATXN1; (-) strand; PAM type: YTN; PAM sequence: TTG
taacacaatgttcctaaaca

SEQ ID NO: 172167 - DNA, 20 bp, Artificial Sequence
  Description of Artificial Sequence: Synthetic oligonucleotide
  Target: ATXN1; (-) strand; PAM type: YTN; PAM sequence: CTT
gtaacacaatgttcctaaac

SEQ ID NO: 172168 - DNA, 20 bp, Artificial Sequence
  Description of Artificial Sequence: Synthetic oligonucleotide
  Target: ATXN1; (-) strand; PAM type: YTN; PAM sequence: CTG
taggcacttgtaacacaatg

SEQ ID NO: 172169 - DNA, 20 bp, Artificial Sequence
  Description of Artificial Sequence: Synthetic oligonucleotide
  Target: ATXN1; (-) strand; PAM type: YTN; PAM sequence: CTG
aatactgtaggcacttgtaa

SEQ ID NO: 172170 - DNA, 20 bp, Artificial Sequence
  Description of Artificial Sequence: Synthetic oligonucleotide
  Target: ATXN1; (-) strand; PAM type: YTN; PAM sequence: CTG
tactgaatactgtaggcact

SEQ ID NO: 172171 - DNA, 20 bp, Artificial Sequence
  Description of Artificial Sequence: Synthetic oligonucleotide
  Target: ATXN1; (-) strand; PAM type: YTN; PAM sequence: TTA
ctgtactgaatactgtaggc

SEQ ID NO: 172172 - DNA, 20 bp, Artificial Sequence
  Description of Artificial Sequence: Synthetic oligonucleotide
  Target: ATXN1; (-) strand; PAM type: YTN; PAM sequence: CTT
actgtactgaatactgtagg

SEQ ID NO: 172173 - DNA, 20 bp, Artificial Sequence
  Description of Artificial Sequence: Synthetic oligonucleotide
  Target: ATXN1; (-) strand; PAM type: YTN; PAM sequence: CTC
agcaccttactgtactgaat

SEQ ID NO: 172174 - DNA, 20 bp, Artificial Sequence
  Description of Artificial Sequence: Synthetic oligonucleotide
  Target: ATXN1; (-) strand; PAM type: YTN; PAM sequence: CTA
cagcactcagcaccttactg

SEQ ID NO: 172175 - DNA, 20 bp, Artificial Sequence
  Description of Artificial Sequence: Synthetic oligonucleotide
  Target: ATXN1; (-) strand; PAM type: YTN; PAM sequence: TTG
cctacagcactcagcacctt

SEQ ID NO: 172176 - DNA, 20 bp, Artificial Sequence
  Description of Artificial Sequence: Synthetic oligonucleotide
  Target: ATXN1; (-) strand; PAM type: YTN; PAM sequence: TTA
cgattgcctacagcactcag

SEQ ID NO: 172177 - DNA, 20 bp, Artificial Sequence
  Description of Artificial Sequence: Synthetic oligonucleotide
  Target: ATXN1; (-) strand; PAM type: YTN; PAM sequence: TTG
gacatagggttacgattgcc

SEQ ID NO: 172178 - DNA, 20 bp, Artificial Sequence
  Description of Artificial Sequence: Synthetic oligonucleotide
  Target: ATXN1; (-) strand; PAM type: YTN; PAM sequence: CTT
ggacatagggttacgattgc

SEQ ID NO: 172179 - DNA, 20 bp, Artificial Sequence
  Description of Artificial Sequence: Synthetic oligonucleotide
  Target: ATXN1; (-) strand; PAM type: YTN; PAM sequence: CTA
ggatacaaacttggacatag

SEQ ID NO: 172180 - DNA, 20 bp, Artificial Sequence
  Description of Artificial Sequence: Synthetic oligonucleotide
  Target: ATXN1; (-) strand; PAM type: YTN; PAM sequence: CTC
ctaggatacaaacttggaca

SEQ ID NO: 172181 - DNA, 20 bp, Artificial Sequence
  Description of Artificial Sequence: Synthetic oligonucleotide
  Target: ATXN1; (-) strand; PAM type: YTN; PAM sequence: TTG
ctcctaggatacaaacttgg

SEQ ID NO: 172182 - DNA, 20 bp, Artificial Sequence
  Description of Artificial Sequence: Synthetic oligonucleotide
  Target: ATXN1; (-) strand; PAM type: YTN; PAM sequence: CTG
ttgctcctaggatacaaact

SEQ ID NO: 172183 - DNA, 20 bp, Artificial Sequence
  Description of Artificial Sequence: Synthetic oligonucleotide
  Target: ATXN1; (-) strand; PAM type: YTN; PAM sequence: CTA
tataatgcagcctgttgctc

SEQ ID NO: 172184 - DNA, 20 bp, Artificial Sequence
  Description of Artificial Sequence: Synthetic oligonucleotide
  Target: ATXN1; (-) strand; PAM type: YTN; PAM sequence: CTA
agctatataatgcagcctgt

SEQ ID NO: 172185 - DNA, 20 bp, Artificial Sequence
  Description of Artificial Sequence: Synthetic oligonucleotide
  Target: ATXN1; (-) strand; PAM type: YTN; PAM sequence: CTA
cacatctaagctatataatg

SEQ ID NO: 172186 - DNA, 20 bp, Artificial Sequence
  Description of Artificial Sequence: Synthetic oligonucleotide
  Target: ATXN1; (-) strand; PAM type: YTN; PAM sequence: CTG
ctacacatctaagctatata

SEQ ID NO: 172187 - DNA, 20 bp, Artificial Sequence
  Description of Artificial Sequence: Synthetic oligonucleotide
  Target: ATXN1; (-) strand; PAM type: YTN; PAM sequence: CTA
gatggtacagcctgctacac

SEQ ID NO: 172188 - DNA, 20 bp, Artificial Sequence
  Description of Artificial Sequence: Synthetic oligonucleotide
  Target: ATXN1; (-) strand; PAM type: YTN; PAM sequence: TTC
acccaagcctagatggtaca

SEQ ID NO: 172189 - DNA, 20 bp, Artificial Sequence
  Description of Artificial Sequence: Synthetic oligonucleotide
  Target: ATXN1; (-) strand; PAM type: YTN; PAM sequence: CTG
caaatatcataaagtgtgtt

SEQ ID NO: 172190 - DNA, 20 bp, Artificial Sequence
  Description of Artificial Sequence: Synthetic oligonucleotide
  Target: ATXN1; (-) strand; PAM type: YTN; PAM sequence: TTC
tgcaaatatcataaagtgtg

SEQ ID NO: 172191 - DNA, 20 bp, Artificial Sequence
  Description of Artificial Sequence: Synthetic oligonucleotide
  Target: ATXN1; (-) strand; PAM type: YTN; PAM sequence: CTT
ctgcaaatatcataaagtgt

SEQ ID NO: 172192 - DNA, 20 bp, Artificial Sequence
  Description of Artificial Sequence: Synthetic oligonucleotide
  Target: ATXN1; (-) strand; PAM type: YTN; PAM sequence: TTA
catcgtccttctgcaaatat

SEQ ID NO: 172193 - DNA, 20 bp, Artificial Sequence
  Description of Artificial Sequence: Synthetic oligonucleotide
  Target: ATXN1; (-) strand; PAM type: YTN; PAM sequence: CTT
acatcgtccttctgcaaata

SEQ ID NO: 172194 - DNA, 20 bp, Artificial Sequence
  Description of Artificial Sequence: Synthetic oligonucleotide
  Target: ATXN1; (-) strand; PAM type: YTN; PAM sequence: CTG
agaaatgcatccttacatcg

SEQ ID NO: 172195 - DNA, 20 bp, Artificial Sequence
  Description of Artificial Sequence: Synthetic oligonucleotide
  Target: ATXN1; (-) strand; PAM type: YTN; PAM sequence: TTC
tgagaaatgcatccttacat

SEQ ID NO: 172196 - DNA, 20 bp, Artificial Sequence
  Description of Artificial Sequence: Synthetic oligonucleotide
  Target: ATXN1; (-) strand; PAM type: YTN; PAM sequence: TTA
ataatgggaatgcattctga

SEQ ID NO: 172197 - DNA, 20 bp, Artificial Sequence
  Description of Artificial Sequence: Synthetic oligonucleotide
  Target: ATXN1; (-) strand; PAM type: YTN; PAM sequence: CTT
aataatgggaatgcattctg

SEQ ID NO: 172198 - DNA, 20 bp, Artificial Sequence
  Description of Artificial Sequence: Synthetic oligonucleotide
  Target: ATXN1; (-) strand; PAM type: YTN; PAM sequence: TTG
taaagagatgcacagtagca

SEQ ID NO: 172199 - DNA, 20 bp, Artificial Sequence
  Description of Artificial Sequence: Synthetic oligonucleotide
  Target: ATXN1; (-) strand; PAM type: YTN; PAM sequence: TTA
ccaaccatgagattgtaaag

SEQ ID NO: 172200 - DNA, 20 bp, Artificial Sequence
  Description of Artificial Sequence: Synthetic oligonucleotide
  Target: ATXN1; (-) strand; PAM type: YTN; PAM sequence: CTA
ccaatgtgacattaccaacc

SEQ ID NO: 172201 - DNA, 20 bp, Artificial Sequence
  Description of Artificial Sequence: Synthetic oligonucleotide
  Target: ATXN1; (-) strand; PAM type: YTN; PAM sequence: TTC
aaactaccaatgtgacatta

SEQ ID NO: 172202 - DNA, 20 bp, Artificial Sequence
  Description of Artificial Sequence: Synthetic oligonucleotide
  Target: ATXN1; (-) strand; PAM type: YTN; PAM sequence: TTT
caaactaccaatgtgacatt

SEQ ID NO: 172203 - DNA, 20 bp, Artificial Sequence
  Description of Artificial Sequence: Synthetic oligonucleotide
  Target: ATXN1; (-) strand; PAM type: YTN; PAM sequence: CTA
atttcaaactaccaatgtga

SEQ ID NO: 172204 - DNA, 20 bp, Artificial Sequence
  Description of Artificial Sequence: Synthetic oligonucleotide
  Target: ATXN1; (-) strand; PAM type: YTN; PAM sequence: CTG
tgactaatttcaaactacca

SEQ ID NO: 172205 - DNA, 20 bp, Artificial Sequence
  Description of Artificial Sequence: Synthetic oligonucleotide
  Target: ATXN1; (-) strand; PAM type: YTN; PAM sequence: CTC
actgtgactaatttcaaact

SEQ ID NO: 172206 - DNA, 20 bp, Artificial Sequence
  Description of Artificial Sequence: Synthetic oligonucleotide
  Target: ATXN1; (-) strand; PAM type: YTN; PAM sequence: CTC
tcactgtgactaatttcaaa

SEQ ID NO: 172207 - DNA, 20 bp, Artificial Sequence
  Description of Artificial Sequence: Synthetic oligonucleotide
  Target: ATXN1; (-) strand; PAM type: YTN; PAM sequence: CTG
taatataaatactctcactg

SEQ ID NO: 172208 - DNA, 20 bp, Artificial Sequence
  Description of Artificial Sequence: Synthetic oligonucleotide
  Target: ATXN1; (-) strand; PAM type: YTN; PAM sequence: TTC
tgtaatataaatactctcac

SEQ ID NO: 172209 - DNA, 20 bp, Artificial Sequence
  Description of Artificial Sequence: Synthetic oligonucleotide
  Target: ATXN1; (-) strand; PAM type: YTN; PAM sequence: TTT
ctgtaatataaatactctca

SEQ ID NO: 172210 - DNA, 20 bp, Artificial Sequence
  Description of Artificial Sequence: Synthetic oligonucleotide
  Target: ATXN1; (-) strand; PAM type: YTN; PAM sequence: CTG
atttctgtaatataaatact

SEQ ID NO: 172211 - DNA, 20 bp, Artificial Sequence
  Description of Artificial Sequence: Synthetic oligonucleotide
  Target: ATXN1; (-) strand; PAM type: YTN; PAM sequence: TTA
ctgatttctgtaatataaat

SEQ ID NO: 172212 - DNA, 20 bp, Artificial Sequence
  Description of Artificial Sequence: Synthetic oligonucleotide
  Target: ATXN1; (-) strand; PAM type: YTN; PAM sequence: TTT
actgatttctgtaatataaa

SEQ ID NO: 172213 - DNA, 20 bp, Artificial Sequence
  Description of Artificial Sequence: Synthetic oligonucleotide
  Target: ATXN1; (-) strand; PAM type: YTN; PAM sequence: TTG
tagcatttactgatttctgt

SEQ ID NO: 172214 - DNA, 20 bp, Artificial Sequence
  Description of Artificial Sequence: Synthetic oligonucleotide
  Target: ATXN1; (-) strand; PAM type: YTN; PAM sequence: TTT
gtagcatttactgatttctg

SEQ ID NO: 172215 - DNA, 20 bp, Artificial Sequence
  Description of Artificial Sequence: Synthetic oligonucleotide
  Target: ATXN1; (-) strand; PAM type: YTN; PAM sequence: TTG
atttgtagcatttactgatt

SEQ ID NO: 172216 - DNA, 20 bp, Artificial Sequence
  Description of Artificial Sequence: Synthetic oligonucleotide
  Target: ATXN1; (-) strand; PAM type: YTN; PAM sequence: TTT
gatttgtagcatttactgat

SEQ ID NO: 172217 - DNA, 20 bp, Artificial Sequence
  Description of Artificial Sequence: Synthetic oligonucleotide
  Target: ATXN1; (-) strand; PAM type: YTN; PAM sequence: CTC
gggaataacaggacgtttga

SEQ ID NO: 172218 - DNA, 20 bp, Artificial Sequence
  Description of Artificial Sequence: Synthetic oligonucleotide
  Target: ATXN1; (-) strand; PAM type: YTN; PAM sequence: CTG
gctcgggaataacaggacgt

SEQ ID NO: 172219 - DNA, 20 bp, Artificial Sequence
  Description of Artificial Sequence: Synthetic oligonucleotide
  Target: ATXN1; (-) strand; PAM type: YTN; PAM sequence: CTA
ctggctcgggaataacagga

SEQ ID NO: 172220 - DNA, 20 bp, Artificial Sequence
  Description of Artificial Sequence: Synthetic oligonucleotide
  Target: ATXN1; (-) strand; PAM type: YTN; PAM sequence: TTA
gctactggctcgggaataac

SEQ ID NO: 172221 - DNA, 20 bp, Artificial Sequence
  Description of Artificial Sequence: Synthetic oligonucleotide
  Target: ATXN1; (-) strand; PAM type: YTN; PAM sequence: TTT
agctactggctcgggaataa

SEQ ID NO: 172222 - DNA, 20 bp, Artificial Sequence
  Description of Artificial Sequence: Synthetic oligonucleotide
  Target: ATXN1; (-) strand; PAM type: YTN; PAM sequence: CTC
aaaaaaacaaaaaacaaaaa

SEQ ID NO: 172223 - DNA, 20 bp, Artificial Sequence
  Description of Artificial Sequence: Synthetic oligonucleotide
  Target: ATXN1; (-) strand; PAM type: YTN; PAM sequence: TTC
atctcaaaaaaacaaaaaac

SEQ ID NO: 172224 - DNA, 20 bp, Artificial Sequence
  Description of Artificial Sequence: Synthetic oligonucleotide
  Target: ATXN1; (-) strand; PAM type: YTN; PAM sequence: CTT
catctcaaaaaaacaaaaaa

SEQ ID NO: 172225 - DNA, 20 bp, Artificial Sequence
  Description of Artificial Sequence: Synthetic oligonucleotide
  Target: ATXN1; (-) strand; PAM type: YTN; PAM sequence: CTG
gatgacagaacgagacttca

SEQ ID NO: 172226 - DNA, 20 bp, Artificial Sequence
  Description of Artificial Sequence: Synthetic oligonucleotide
  Target: ATXN1; (-) strand; PAM type: YTN; PAM sequence: CTC
cagcctggatgacagaacga

SEQ ID NO: 172227 - DNA, 20 bp, Artificial Sequence
  Description of Artificial Sequence: Synthetic oligonucleotide
  Target: ATXN1; (-) strand; PAM type: YTN; PAM sequence: TTG
cactccagcctggatgacag

SEQ ID NO: 172228 - DNA, 20 bp, Artificial Sequence
  Description of Artificial Sequence: Synthetic oligonucleotide
  Target: ATXN1; (-) strand; PAM type: YTN; PAM sequence: TTG
cagtgagccaagatcgtgcc

SEQ ID NO: 172229 - DNA, 20 bp, Artificial Sequence
  Description of Artificial Sequence: Synthetic oligonucleotide
  Target: ATXN1; (-) strand; PAM type: YTN; PAM sequence: TTG
gaggtggaggttgcagtgag

SEQ ID NO: 172230 - DNA, 20 bp, Artificial Sequence
  Description of Artificial Sequence: Synthetic oligonucleotide
  Target: ATXN1; (-) strand; PAM type: YTN; PAM sequence: CTT
ggaggtggaggttgcagtga

SEQ ID NO: 172231 - DNA, 20 bp, Artificial Sequence
  Description of Artificial Sequence: Synthetic oligonucleotide
  Target: ATXN1; (-) strand; PAM type: YTN; PAM sequence: CTG
aagcaggagaatcacttgga

SEQ ID NO: 172232 - DNA, 20 bp, Artificial Sequence
  Description of Artificial Sequence: Synthetic oligonucleotide
  Target: ATXN1; (-) strand; PAM type: YTN; PAM sequence: CTC
gggaggctgaagcaggagaa

SEQ ID NO: 172233 - DNA, 20 bp, Artificial Sequence
  Description of Artificial Sequence: Synthetic oligonucleotide
  Target: ATXN1; (-) strand; PAM type: YTN; PAM sequence: CTA
ctcgggaggctgaagcagga

SEQ ID NO: 172234 - DNA, 20 bp, Artificial Sequence
  Description of Artificial Sequence: Synthetic oligonucleotide
  Target: ATXN1; (-) strand; PAM type: YTN; PAM sequence: TTC
cagctactcgggaggctgaa

SEQ ID NO: 172235 - DNA, 20 bp, Artificial Sequence
  Description of Artificial Sequence: Synthetic oligonucleotide
  Target: ATXN1; (-) strand; PAM type: YTN; PAM sequence: CTG
taattccagctactcgggag

SEQ ID NO: 172236 - DNA, 20 bp, Artificial Sequence
  Description of Artificial Sequence: Synthetic oligonucleotide
  Target: ATXN1; (-) strand; PAM type: YTN; PAM sequence: CTA
gccgggcatggtggtgggca

SEQ ID NO: 172237 - DNA, 20 bp, Artificial Sequence
  Description of Artificial Sequence: Synthetic oligonucleotide
  Target: ATXN1; (-) strand; PAM type: YTN; PAM sequence: CTA
aaaatataaatactagccgg

SEQ ID NO: 172238 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatataaatactagc

SEQ ID NO: 172239 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatataaatacta

SEQ ID NO: 172240 - DNA, 20 bp, Artificial Sequence
  Description of Artificial Sequence: Synthetic oligonucleotide
  Target: ATXN1; (-) strand; PAM type: YTN; PAM sequence: CTG
gccaacatagtgaaacccca

SEQ ID NO: 172241 - DNA, 20 bp, Artificial Sequence
  Description of Artificial Sequence: Synthetic oligonucleotide
  Target: ATXN1; (-) strand; PAM type: YTN; PAM sequence: TTG
agaccagcctggccaacata

SEQ ID NO: 172242 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctggccaacat

SEQ ID NO: 172243 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagtttgagacca

SEQ ID NO: 172244 - DNA, 20 bp, Artificial Sequence
  Description of Artificial Sequence: Synthetic oligonucleotide
  Target: ATXN1; (-) strand; PAM type: YTN; PAM sequence: CTG
aggcaggcagatcacctgag

SEQ ID NO: 172245 - DNA, 20 bp, Artificial Sequence
  Description of Artificial Sequence: Synthetic oligonucleotide
  Target: ATXN1; (-) strand; PAM type: YTN; PAM sequence: TTG
agaggctgaggcaggcagat

SEQ ID NO: 172246 - DNA, 20 bp, Artificial Sequence
  Description of Artificial Sequence: Synthetic oligonucleotide
  Target: ATXN1; (-) strand; PAM type: YTN; PAM sequence: TTT
gagaggctgaggcaggcaga

SEQ ID NO: 172247 - DNA, 20 bp, Artificial Sequence
  Description of Artificial Sequence: Synthetic oligonucleotide
  Target: ATXN1; (-) strand; PAM type: YTN; PAM sequence: CTT
tgagaggctgaggcaggcag

SEQ ID NO: 172248 - DNA, 20 bp, Artificial Sequence
  Description of Artificial Sequence: Synthetic oligonucleotide
  Target: ATXN1; (-) strand; PAM type: YTN; PAM sequence: CTG
gcggccgggcacagtggcac

SEQ ID NO: 172249 - DNA, 20 bp, Artificial Sequence
  Description of Artificial Sequence: Synthetic oligonucleotide
  Target: ATXN1; (-) strand; PAM type: YTN; PAM sequence: CTA
ctggcggccgggcacagtgg

SEQ ID NO: 172250 - DNA, 20 bp, Artificial Sequence
  Description of Artificial Sequence: Synthetic oligonucleotide
  Target: ATXN1; (-) strand; PAM type: YTN; PAM sequence: CTA
ctactggcggccgggcacag

SEQ ID NO: 172251 - DNA, 20 bp, Artificial Sequence
  Description of Artificial Sequence: Synthetic oligonucleotide
  Target: ATXN1; (-) strand; PAM type: YTN; PAM sequence: TTA
gctactactggcggccgggc

SEQ ID NO: 172252 - DNA, 20 bp, Artificial Sequence
  Description of Artificial Sequence: Synthetic oligonucleotide
  Target: ATXN1; (-) strand; PAM type: YTN; PAM sequence: TTT
agctactactggcggccggg

SEQ ID NO: 172253 - DNA, 20 bp, Artificial Sequence
  Description of Artificial Sequence: Synthetic oligonucleotide
  Target: ATXN1; (-) strand; PAM type: YTN; PAM sequence: CTG
ataaaagtttagctactact

SEQ ID NO: 172254 - DNA, 20 bp, Artificial Sequence
  Description of Artificial Sequence: Synthetic oligonucleotide
  Target: ATXN1; (-) strand; PAM type: YTN; PAM sequence: TTG
gaatggataccagcagtgtg

SEQ ID NO: 172255 - DNA, 20 bp, Artificial Sequence
  Description of Artificial Sequence: Synthetic oligonucleotide
  Target: ATXN1; (-) strand; PAM type: YTN; PAM sequence: TTA
agaaaaagttggaatggata

SEQ ID NO: 172256 - DNA, 20 bp, Artificial Sequence
  Description of Artificial Sequence: Synthetic oligonucleotide
  Target: ATXN1; (-) strand; PAM type: YTN; PAM sequence: CTT
aagaaaaagttggaatggat

SEQ ID NO: 172257 - DNA, 20 bp, Artificial Sequence
  Description of Artificial Sequence: Synthetic oligonucleotide
  Target: ATXN1; (-) strand; PAM type: YTN; PAM sequence: TTC
acttaagaaaaagttggaat

SEQ ID NO: 172258 - DNA, 20 bp, Artificial Sequence
  Description of Artificial Sequence: Synthetic oligonucleotide
  Target: ATXN1; (-) strand; PAM type: YTN; PAM sequence: TTT
cacttaagaaaaagttggaa

SEQ ID NO: 172259 - DNA, 20 bp, Artificial Sequence
  Description of Artificial Sequence: Synthetic oligonucleotide
  Target: ATXN1; (-) strand; PAM type: YTN; PAM sequence: CTA
tttcacttaagaaaaagttg

SEQ ID NO: 172260 - DNA, 20 bp, Artificial Sequence
  Description of Artificial Sequence: Synthetic oligonucleotide
  Target: ATXN1; (-) strand; PAM type: YTN; PAM sequence: TTC
tatttcacttaagaaaaagt

SEQ ID NO: 172261 - DNA, 20 bp, Artificial Sequence
  Description of Artificial Sequence: Synthetic oligonucleotide
  Target: ATXN1; (-) strand; PAM type: YTN; PAM sequence: CTA
gttctatttcacttaagaaa

SEQ ID NO: 172262 - DNA, 20 bp, Artificial Sequence
  Description of Artificial Sequence: Synthetic oligonucleotide
  Target: ATXN1; (-) strand; PAM type: YTN; PAM sequence: CTC
ccctagttctatttcactta

SEQ ID NO: 172263 - DNA, 20 bp, Artificial Sequence
  Description of Artificial Sequence: Synthetic oligonucleotide
  Target: ATXN1; (-) strand; PAM type: YTN; PAM sequence: TTC
tcccctagttctatttcact

SEQ ID NO: 172264 - DNA, 20 bp, Artificial Sequence
  Description of Artificial Sequence: Synthetic oligonucleotide
  Target: ATXN1; (-) strand; PAM type: YTN; PAM sequence: CTG
ttctcccctagttctatttc

SEQ ID NO: 172265 - DNA, 20 bp, Artificial Sequence
  Description of Artificial Sequence: Synthetic oligonucleotide
  Target: ATXN1; (-) strand; PAM type: YTN; PAM sequence: CTA
ctgttctcccctagttctat

SEQ ID NO: 172266 - DNA, 20 bp, Artificial Sequence
  Description of Artificial Sequence: Synthetic oligonucleotide
  Target: ATXN1; (-) strand; PAM type: YTN; PAM sequence: TTC
ctactgttctcccctagttc

SEQ ID NO: 172267 - DNA, 20 bp, Artificial Sequence
  Description of Artificial Sequence: Synthetic oligonucleotide
  Target: ATXN1; (-) strand; PAM type: YTN; PAM sequence: CTA
ttcctactgttctcccctag

SEQ ID NO: 172268 - DNA, 20 bp, Artificial Sequence
  Description of Artificial Sequence: Synthetic oligonucleotide
  Target: ATXN1; (-) strand; PAM type: YTN; PAM sequence: TTG
actattcctactgttctccc

SEQ ID NO: 172269 - DNA, 20 bp, Artificial Sequence
  Description of Artificial Sequence: Synthetic oligonucleotide
  Target: ATXN1; (-) strand; PAM type: YTN; PAM sequence: CTG
cacatgtaatcatggaaagt

SEQ ID NO: 172270 - DNA, 20 bp, Artificial Sequence
  Description of Artificial Sequence: Synthetic oligonucleotide
  Target: ATXN1; (-) strand; PAM type: YTN; PAM sequence: TTG
gtggtatgtacctgcacatg

SEQ ID NO: 172271 - DNA, 20 bp, Artificial Sequence
  Description of Artificial Sequence: Synthetic oligonucleotide
  Target: ATXN1; (-) strand; PAM type: YTN; PAM sequence: CTT
ggtggtatgtacctgcacat

SEQ ID NO: 172272 - DNA, 20 bp, Artificial Sequence
  Description of Artificial Sequence: Synthetic oligonucleotide
  Target: ATXN1; (-) strand; PAM type: YTN; PAM sequence: TTG
gtggcatatggcttggtggt

SEQ ID NO: 172273 - DNA, 20 bp, Artificial Sequence
  Description of Artificial Sequence: Synthetic oligonucleotide
  Target: ATXN1; (-) strand; PAM type: YTN; PAM sequence: TTT
ggtggcatatggcttggtgg

SEQ ID NO: 172274 - DNA, 20 bp, Artificial Sequence
  Description of Artificial Sequence: Synthetic oligonucleotide
  Target: ATXN1; (-) strand; PAM type: YTN; PAM sequence: CTG
gacagcaatgatttggtggc

SEQ ID NO: 172275 - DNA, 20 bp, Artificial Sequence
  Description of Artificial Sequence: Synthetic oligonucleotide
  Target: ATXN1; (-) strand; PAM type: YTN; PAM sequence: CTC
tggacagcaatgatttggtg

SEQ ID NO: 172276 - DNA, 20 bp, Artificial Sequence
  Description of Artificial Sequence: Synthetic oligonucleotide
  Target: ATXN1; (-) strand; PAM type: YTN; PAM sequence: TTG
gaaactctggacagcaatga

SEQ ID NO: 172277 - DNA, 20 bp, Artificial Sequence
  Description of Artificial Sequence: Synthetic oligonucleotide
  Target: ATXN1; (-) strand; PAM type: YTN; PAM sequence: TTA
gttggaaactctggacagca

SEQ ID NO: 172278 - DNA, 20 bp, Artificial Sequence
  Description of Artificial Sequence: Synthetic oligonucleotide
  Target: ATXN1; (-) strand; PAM type: YTN; PAM sequence: TTC
agtagcagataaacagaggg

SEQ ID NO: 172279 - DNA, 20 bp, Artificial Sequence
  Description of Artificial Sequence: Synthetic oligonucleotide
  Target: ATXN1; (-) strand; PAM type: YTN; PAM sequence: TTT
cagtagcagataaacagagg

SEQ ID NO: 172280 - DNA, 20 bp, Artificial Sequence
  Description of Artificial Sequence: Synthetic oligonucleotide
  Target: ATXN1; (-) strand; PAM type: YTN; PAM sequence: CTG
atttcagtagcagataaaca

SEQ ID NO: 172281 - DNA, 20 bp, Artificial Sequence
  Description of Artificial Sequence: Synthetic oligonucleotide
  Target: ATXN1; (-) strand; PAM type: YTN; PAM sequence: CTG
agtcagactgatttcagtag

SEQ ID NO: 172282 - DNA, 20 bp, Artificial Sequence
  Description of Artificial Sequence: Synthetic oligonucleotide
  Target: ATXN1; (-) strand; PAM type: YTN; PAM sequence: TTC
tgagtcagactgatttcagt

SEQ ID NO: 172283 - DNA, 20 bp, Artificial Sequence
  Description of Artificial Sequence: Synthetic oligonucleotide
  Target: ATXN1; (-) strand; PAM type: YTN; PAM sequence: TTT
ctgagtcagactgatttcag

SEQ ID NO: 172284 - DNA, 20 bp, Artificial Sequence
  Description of Artificial Sequence: Synthetic oligonucleotide
  Target: ATXN1; (-) strand; PAM type: YTN; PAM sequence: TTA
catttctgagtcagactgat

SEQ ID NO: 172285 - DNA, 20 bp, Artificial Sequence
  Description of Artificial Sequence: Synthetic oligonucleotide
  Target: ATXN1; (-) strand; PAM type: YTN; PAM sequence: TTG
ccaacacacatacaattaca

SEQ ID NO: 172286 - DNA, 20 bp, Artificial Sequence
  Description of Artificial Sequence: Synthetic oligonucleotide
  Target: ATXN1; (-) strand; PAM type: YTN; PAM sequence: CTT
gccaacacacatacaattac

SEQ ID NO: 172287 - DNA, 20 bp, Artificial Sequence
  Description of Artificial Sequence: Synthetic oligonucleotide
  Target: ATXN1; (-) strand; PAM type: YTN; PAM sequence: TTC
ttgccaacacacatacaatt

SEQ ID NO: 172288 - DNA, 20 bp, Artificial Sequence
  Description of Artificial Sequence: Synthetic oligonucleotide
  Target: ATXN1; (-) strand; PAM type: YTN; PAM sequence: TTG
tgtgagttcttgccaacaca

SEQ ID NO: 172289 - DNA, 20 bp, Artificial Sequence
  Description of Artificial Sequence: Synthetic oligonucleotide
  Target: ATXN1; (-) strand; PAM type: YTN; PAM sequence: CTT
gtgtgagttcttgccaacac

SEQ ID NO: 172290 - DNA, 20 bp, Artificial Sequence
  Description of Artificial Sequence: Synthetic oligonucleotide
  Target: ATXN1; (-) strand; PAM type: YTN; PAM sequence: TTC
ttgtgtgagttcttgccaac

SEQ ID NO: 172291 - DNA, 20 bp, Artificial Sequence
  Description of Artificial Sequence: Synthetic oligonucleotide
  Target: ATXN1; (-) strand; PAM type: YTN; PAM sequence: TTG
aagatagtattcttgtgtga

SEQ ID NO: 172292 - DNA, 20 bp, Artificial Sequence
  Description of Artificial Sequence: Synthetic oligonucleotide
  Target: ATXN1; (-) strand; PAM type: YTN; PAM sequence: CTT
gaagatagtattcttgtgtg

SEQ ID NO: 172293 - DNA, 20 bp, Artificial Sequence
  Description of Artificial Sequence: Synthetic oligonucleotide
  Target: ATXN1; (-) strand; PAM type: YTN; PAM sequence: TTC
ttgaagatagtattcttgtg

SEQ ID NO: 172294 - DNA, 20 bp, Artificial Sequence
  Description of Artificial Sequence: Synthetic oligonucleotide
  Target: ATXN1; (-) strand; PAM type: YTN; PAM sequence: TTG
ttcttgaagatagtattctt

SEQ ID NO: 172295 - DNA, 20 bp, Artificial Sequence
  Description of Artificial Sequence: Synthetic oligonucleotide
  Target: ATXN1; (-) strand; PAM type: YTN; PAM sequence: TTT
gttcttgaagatagtattct

SEQ ID NO: 172296 - DNA, 20 bp, Artificial Sequence
  Description of Artificial Sequence: Synthetic oligonucleotide
  Target: ATXN1; (-) strand; PAM type: YTN; PAM sequence: TTT
tgttcttgaagatagtattc

SEQ ID NO: 172297 - DNA, 20 bp, Artificial Sequence
  Description of Artificial Sequence: Synthetic oligonucleotide
  Target: ATXN1; (-) strand; PAM type: YTN; PAM sequence: TTT
ttgttcttgaagatagtatt

SEQ ID NO: 172298 - DNA, 20 bp, Artificial Sequence
  Description of Artificial Sequence: Synthetic oligonucleotide
  Target: ATXN1; (-) strand; PAM type: YTN; PAM sequence: CTG
tggccgtggtgaaggatgat

SEQ ID NO: 172299 - DNA, 20 bp, Artificial Sequence
  Description of Artificial Sequence: Synthetic oligonucleotide
  Target: ATXN1; (-) strand; PAM type: YTN; PAM sequence: TTC
tgtggccgtggtgaaggatg

SEQ ID NO: 172300 - DNA, 20 bp, Artificial Sequence
  Description of Artificial Sequence: Synthetic oligonucleotide
  Target: ATXN1; (-) strand; PAM type: YTN; PAM sequence: TTA
atgaggtaatccgtcaaatt

SEQ ID NO: 172301 - DNA, 20 bp, Artificial Sequence
  Description of Artificial Sequence: Synthetic oligonucleotide
  Target: ATXN1; (-) strand; PAM type: YTN; PAM sequence: TTG
cgaggagttaatgaggtaat

SEQ ID NO: 172302 - DNA, 20 bp, Artificial Sequence
  Description of Artificial Sequence: Synthetic oligonucleotide
  Target: ATXN1; (-) strand; PAM type: YTN; PAM sequence: CTC
aacatagcaatggttgcgag

SEQ ID NO: 172303 - DNA, 20 bp, Artificial Sequence
  Description of Artificial Sequence: Synthetic oligonucleotide
  Target: ATXN1; (-) strand; PAM type: YTN; PAM sequence: CTG
tcaaacagggacaatgaaac

SEQ ID NO: 172304 - DNA, 20 bp, Artificial Sequence
  Description of Artificial Sequence: Synthetic oligonucleotide
  Target: ATXN1; (-) strand; PAM type: YTN; PAM sequence: CTC
acctgtcaaacagggacaat

SEQ ID NO: 172305 - DNA, 20 bp, Artificial Sequence
  Description of Artificial Sequence: Synthetic oligonucleotide
  Target: ATXN1; (-) strand; PAM type: YTN; PAM sequence: CTA
atctcacctgtcaaacaggg

SEQ ID NO: 172306 - DNA, 20 bp, Artificial Sequence
  Description of Artificial Sequence: Synthetic oligonucleotide
  Target: ATXN1; (-) strand; PAM type: YTN; PAM sequence: TTG
gacagatcacctaatctcac

SEQ ID NO: 172307 - DNA, 20 bp, Artificial Sequence
  Description of Artificial Sequence: Synthetic oligonucleotide
  Target: ATXN1; (-) strand; PAM type: YTN; PAM sequence: CTT
ggacagatcacctaatctca

SEQ ID NO: 172308 - DNA, 20 bp, Artificial Sequence
  Description of Artificial Sequence: Synthetic oligonucleotide
  Target: ATXN1; (-) strand; PAM type: YTN; PAM sequence: CTA
gatatgtggccttggacaga

SEQ ID NO: 172309 - DNA, 20 bp, Artificial Sequence
  Description of Artificial Sequence: Synthetic oligonucleotide
  Target: ATXN1; (-) strand; PAM type: YTN; PAM sequence: TTA
ctagatatgtggccttggac

SEQ ID NO: 172310 - DNA, 20 bp, Artificial Sequence
  Description of Artificial Sequence: Synthetic oligonucleotide
  Target: ATXN1; (-) strand; PAM type: YTN; PAM sequence: CTT
actagatatgtggccttgga

SEQ ID NO: 172311 - DNA, 20 bp, Artificial Sequence
  Description of Artificial Sequence: Synthetic oligonucleotide
  Target: ATXN1; (-) strand; PAM type: YTN; PAM sequence: CTA
tgcaacttactagatatgtg

SEQ ID NO: 172312 - DNA, 20 bp, Artificial Sequence
  Description of Artificial Sequence: Synthetic oligonucleotide
  Target: ATXN1; (-) strand; PAM type: YTN; PAM sequence: CTG
tctatgcaacttactagata

SEQ ID NO: 172313 - DNA, 20 bp, Artificial Sequence
  Description of Artificial Sequence: Synthetic oligonucleotide
  Target: ATXN1; (-) strand; PAM type: YTN; PAM sequence: TTG
agtcctgtctatgcaactta

SEQ ID NO: 172314 - DNA, 20 bp, Artificial Sequence
  Description of Artificial Sequence: Synthetic oligonucleotide
  Target: ATXN1; (-) strand; PAM type: YTN; PAM sequence: TTT
gagtcctgtctatgcaactt

SEQ ID NO: 172315 - DNA, 20 bp, Artificial Sequence
  Description of Artificial Sequence: Synthetic oligonucleotide
  Target: ATXN1; (-) strand; PAM type: YTN; PAM sequence: CTG
gatttgagtcctgtctatgc

SEQ ID NO: 172316 - DNA, 20 bp, Artificial Sequence
  Description of Artificial Sequence: Synthetic oligonucleotide
  Target: ATXN1; (-) strand; PAM type: YTN; PAM sequence: TTC
tggatttgagtcctgtctat

SEQ ID NO: 172317 - DNA, 20 bp, Artificial Sequence
  Description of Artificial Sequence: Synthetic oligonucleotide
  Target: ATXN1; (-) strand; PAM type: YTN; PAM sequence: TTT
ctggatttgagtcctgtcta

SEQ ID NO: 172318 - DNA, 20 bp, Artificial Sequence
  Description of Artificial Sequence: Synthetic oligonucleotide
  Target: ATXN1; (-) strand; PAM type: YTN; PAM sequence: TTG
gatttctggatttgagtcct

SEQ ID NO: 172319 - DNA, 20 bp, Artificial Sequence
  Description of Artificial Sequence: Synthetic oligonucleotide
  Target: ATXN1; (-) strand; PAM type: YTN; PAM sequence: TTT
ggatttctggatttgagtcc

SEQ ID NO: 172320 - DNA, 20 bp, Artificial Sequence
  Description of Artificial Sequence: Synthetic oligonucleotide
  Target: ATXN1; (-) strand; PAM type: YTN; PAM sequence: CTA
aagaatacaagatttggatt

SEQ ID NO: 172321 - DNA, 20 bp, Artificial Sequence
  Description of Artificial Sequence: Synthetic oligonucleotide
  Target: ATXN1; (-) strand; PAM type: YTN; PAM sequence: CTG
tggtaaagtctaaagaatac

SEQ ID NO: 172322 - DNA, 20 bp, Artificial Sequence
  Description of Artificial Sequence: Synthetic oligonucleotide
  Target: ATXN1; (-) strand; PAM type: YTN; PAM sequence: TTG
gcataaaagcaataacctgt

SEQ ID NO: 172323 - DNA, 20 bp, Artificial Sequence
  Description of Artificial Sequence: Synthetic oligonucleotide
  Target: ATXN1; (-) strand; PAM type: YTN; PAM sequence: TTC
atgacagattggcataaaag

SEQ ID NO: 172324 - DNA, 20 bp, Artificial Sequence
  Description of Artificial Sequence: Synthetic oligonucleotide
  Target: ATXN1; (-) strand; PAM type: YTN; PAM sequence: TTT
catgacagattggcataaaa

SEQ ID NO: 172325 - DNA, 20 bp, Artificial Sequence
  Description of Artificial Sequence: Synthetic oligonucleotide
  Target: ATXN1; (-) strand; PAM type: YTN; PAM sequence: TTT
tcatgacagattggcataaa

SEQ ID NO: 172326 - DNA, 20 bp, Artificial Sequence
  Description of Artificial Sequence: Synthetic oligonucleotide
  Target: ATXN1; (-) strand; PAM type: YTN; PAM sequence: TTG
aaaaaaaagtcccattttca

SEQ ID NO: 172327 - DNA, 20 bp, Artificial Sequence
  Description of Artificial Sequence: Synthetic oligonucleotide
  Target: ATXN1; (-) strand; PAM type: YTN; PAM sequence: TTT
gaaaaaaaagtcccattttc

SEQ ID NO: 172328 - DNA, 20 bp, Artificial Sequence
  Description of Artificial Sequence: Synthetic oligonucleotide
  Target: ATXN1; (-) strand; PAM type: YTN; PAM sequence: TTT
tgaaaaaaaagtcccatttt

SEQ ID NO: 172329 - DNA, 20 bp, Artificial Sequence
  Description of Artificial Sequence: Synthetic oligonucleotide
  Target: ATXN1; (-) strand; PAM type: YTN; PAM sequence: CTT
ttgaaaaaaaagtcccattt

SEQ ID NO: 172330 - DNA, 20 bp, Artificial Sequence
  Description of Artificial Sequence: Synthetic oligonucleotide
  Target: ATXN1; (-) strand; PAM type: YTN; PAM sequence: TTG
accttttgaaaaaaaagtcc

SEQ ID NO: 172331 - DNA, 20 bp, Artificial Sequence
  Description of Artificial Sequence: Synthetic oligonucleotide
  Target: ATXN1; (-) strand; PAM type: YTN; PAM sequence: CTA
aaggaaggagagaagtgagc

SEQ ID NO: 172332 - DNA, 20 bp, Artificial Sequence
  Description of Artificial Sequence: Synthetic oligonucleotide
  Target: ATXN1; (-) strand; PAM type: YTN; PAM sequence: CTA
actaaaggaaggagagaagt

SEQ ID NO: 172333 - DNA, 20 bp, Artificial Sequence
  Description of Artificial Sequence: Synthetic oligonucleotide
  Target: ATXN1; (-) strand; PAM type: YTN; PAM sequence: TTG
ctaactaaaggaaggagaga

SEQ ID NO: 172334 - DNA, 20 bp, Artificial Sequence
  Description of Artificial Sequence: Synthetic oligonucleotide
  Target: ATXN1; (-) strand; PAM type: YTN; PAM sequence: CTG
cgttgctaactaaaggaagg

SEQ ID NO: 172335 - DNA, 20 bp, Artificial Sequence
  Description of Artificial Sequence: Synthetic oligonucleotide
  Target: ATXN1; (-) strand; PAM type: YTN; PAM sequence: TTG
gctgcgttgctaactaaagg

SEQ ID NO: 172336 - DNA, 20 bp, Artificial Sequence
  Description of Artificial Sequence: Synthetic oligonucleotide
  Target: ATXN1; (-) strand; PAM type: YTN; PAM sequence: CTC
aaagttggctgcgttgctaa

SEQ ID NO: 172337 - DNA, 20 bp, Artificial Sequence
  Description of Artificial Sequence: Synthetic oligonucleotide
  Target: ATXN1; (-) strand; PAM type: YTN; PAM sequence: TTG
taaacgtagatgtgggtgcc

SEQ ID NO: 172338 - DNA, 20 bp, Artificial Sequence
  Description of Artificial Sequence: Synthetic oligonucleotide
  Target: ATXN1; (-) strand; PAM type: YTN; PAM sequence: TTT
gtaaacgtagatgtgggtgc

SEQ ID NO: 172339 - DNA, 20 bp, Artificial Sequence
  Description of Artificial Sequence: Synthetic oligonucleotide
  Target: ATXN1; (-) strand; PAM type: YTN; PAM sequence: TTC
gtatttgtaaacgtagatgt

SEQ ID NO: 172340 - DNA, 20 bp, Artificial Sequence
  Description of Artificial Sequence: Synthetic oligonucleotide
  Target: ATXN1; (-) strand; PAM type: YTN; PAM sequence: TTA
gatggtggagttcgtatttg

SEQ ID NO: 172341 - DNA, 20 bp, Artificial Sequence
  Description of Artificial Sequence: Synthetic oligonucleotide
  Target: ATXN1; (-) strand; PAM type: YTN; PAM sequence: CTT
agatggtggagttcgtattt

SEQ ID NO: 172342 - DNA, 20 bp, Artificial Sequence
  Description of Artificial Sequence: Synthetic oligonucleotide
  Target: ATXN1; (-) strand; PAM type: YTN; PAM sequence: TTG
ggcaggaagggagcttagat

SEQ ID NO: 172343 - DNA, 20 bp, Artificial Sequence
  Description of Artificial Sequence: Synthetic oligonucleotide
  Target: ATXN1; (-) strand; PAM type: YTN; PAM sequence: TTT
gggcaggaagggagcttaga

SEQ ID NO: 172344 - DNA, 20 bp, Artificial Sequence
  Description of Artificial Sequence: Synthetic oligonucleotide
  Target: ATXN1; (-) strand; PAM type: YTN; PAM sequence: CTT
tgggcaggaagggagcttag

SEQ ID NO: 172345 - DNA, 20 bp, Artificial Sequence
  Description of Artificial Sequence: Synthetic oligonucleotide
  Target: ATXN1; (-) strand; PAM type: YTN; PAM sequence: CTG
cctttgggcaggaagggagc

SEQ ID NO: 172346 - DNA, 20 bp, Artificial Sequence
  Description of Artificial Sequence: Synthetic oligonucleotide
  Target: ATXN1; (-) strand; PAM type: YTN; PAM sequence: TTC
tgcctttgggcaggaaggga

SEQ ID NO: 172347 - DNA, 20 bp, Artificial Sequence
  Description of Artificial Sequence: Synthetic oligonucleotide
  Target: ATXN1; (-) strand; PAM type: YTN; PAM sequence: TTT
ctgcctttgggcaggaaggg

SEQ ID NO: 172348 - DNA, 20 bp, Artificial Sequence
  Description of Artificial Sequence: Synthetic oligonucleotide
  Target: ATXN1; (-) strand; PAM type: YTN; PAM sequence: TTG
cagcagtggggatgtaattt

SEQ ID NO: 172349 - DNA, 20 bp, Artificial Sequence
  Description of Artificial Sequence: Synthetic oligonucleotide
  Target: ATXN1; (-) strand; PAM type: YTN; PAM sequence: CTA
agacgttgcagcagtgggga

SEQ ID NO: 172350 - DNA, 20 bp, Artificial Sequence
  Description of Artificial Sequence: Synthetic oligonucleotide
  Target: ATXN1; (-) strand; PAM type: YTN; PAM sequence: TTA
tctaagacgttgcagcagtg

SEQ ID NO: 172351 - DNA, 20 bp, Artificial Sequence
  Description of Artificial Sequence: Synthetic oligonucleotide
  Target: ATXN1; (-) strand; PAM type: YTN; PAM sequence: TTT
atctaagacgttgcagcagt

SEQ ID NO: 172352 - DNA, 20 bp, Artificial Sequence
  Description of Artificial Sequence: Synthetic oligonucleotide
  Target: ATXN1; (-) strand; PAM type: YTN; PAM sequence: TTG
atttatctaagacgttgcag

SEQ ID NO: 172353 - DNA, 20 bp, Artificial Sequence
  Description of Artificial Sequence: Synthetic oligonucleotide
  Target: ATXN1; (-) strand; PAM type: YTN; PAM sequence: TTT
gatttatctaagacgttgca

SEQ ID NO: 172354 - DNA, 20 bp, Artificial Sequence
  Description of Artificial Sequence: Synthetic oligonucleotide
  Target: ATXN1; (-) strand; PAM type: YTN; PAM sequence: TTG
catttgatttatctaagacg

SEQ ID NO: 172355 - DNA, 20 bp, Artificial Sequence
  Description of Artificial Sequence: Synthetic oligonucleotide
  Target: ATXN1; (-) strand; PAM type: YTN; PAM sequence: TTT
gcatttgatttatctaagac

SEQ ID NO: 172356 - DNA, 20 bp, Artificial Sequence
  Description of Artificial Sequence: Synthetic oligonucleotide
  Target: ATXN1; (-) strand; PAM type: YTN; PAM sequence: TTC
aggtggaagtgtgtttgcat

SEQ ID NO: 172357 - DNA, 20 bp, Artificial Sequence
  Description of Artificial Sequence: Synthetic oligonucleotide
  Target: ATXN1; (-) strand; PAM type: YTN; PAM sequence: TTA
ggaattcaggtggaagtgtg

SEQ ID NO: 172358 - DNA, 20 bp, Artificial Sequence
  Description of Artificial Sequence: Synthetic oligonucleotide
  Target: ATXN1; (-) strand; PAM type: YTN; PAM sequence: TTT
aggaattcaggtggaagtgt

SEQ ID NO: 172359 - DNA, 20 bp, Artificial Sequence
  Description of Artificial Sequence: Synthetic oligonucleotide
  Target: ATXN1; (-) strand; PAM type: YTN; PAM sequence: CTT
taggaattcaggtggaagtg

SEQ ID NO: 172360 - DNA, 20 bp, Artificial Sequence
  Description of Artificial Sequence: Synthetic oligonucleotide
  Target: ATXN1; (-) strand; PAM type: YTN; PAM sequence: CTA
ggacatctttaggaattcag

SEQ ID NO: 172361 - DNA, 20 bp, Artificial Sequence
  Description of Artificial Sequence: Synthetic oligonucleotide
  Target: ATXN1; (-) strand; PAM type: YTN; PAM sequence: CTG
cctaggacatctttaggaat

SEQ ID NO: 172362 - DNA, 20 bp, Artificial Sequence
  Description of Artificial Sequence: Synthetic oligonucleotide
  Target: ATXN1; (-) strand; PAM type: YTN; PAM sequence: CTA
atgatgcccacctgcctagg

SEQ ID NO: 172363 - DNA, 20 bp, Artificial Sequence
  Description of Artificial Sequence: Synthetic oligonucleotide
  Target: ATXN1; (-) strand; PAM type: YTN; PAM sequence: TTC
ctaatgatgcccacctgcct

SEQ ID NO: 172364 - DNA, 20 bp, Artificial Sequence
  Description of Artificial Sequence: Synthetic oligonucleotide
  Target: ATXN1; (-) strand; PAM type: YTN; PAM sequence: CTT
cctaatgatgcccacctgcc

SEQ ID NO: 172365 - DNA, 20 bp, Artificial Sequence
  Description of Artificial Sequence: Synthetic oligonucleotide
  Target: ATXN1; (-) strand; PAM type: YTN; PAM sequence: TTA
gacacaaagtataaaacact

SEQ ID NO: 172366 - DNA, 20 bp, Artificial Sequence
  Description of Artificial Sequence: Synthetic oligonucleotide
  Target: ATXN1; (-) strand; PAM type: YTN; PAM sequence: CTT
agacacaaagtataaaacac

SEQ ID NO: 172367 - DNA, 20 bp, Artificial Sequence
  Description of Artificial Sequence: Synthetic oligonucleotide
  Target: ATXN1; (-) strand; PAM type: YTN; PAM sequence: TTG
aataacttagacacaaagta

SEQ ID NO: 172368 - DNA, 20 bp, Artificial Sequence
  Description of Artificial Sequence: Synthetic oligonucleotide
  Target: ATXN1; (-) strand; PAM type: YTN; PAM sequence: TTT
gaataacttagacacaaagt

SEQ ID NO: 172369 - DNA, 20 bp, Artificial Sequence
  Description of Artificial Sequence: Synthetic oligonucleotide
  Target: ATXN1; (-) strand; PAM type: YTN; PAM sequence: TTG
ggtttgaataacttagacac

SEQ ID NO: 172370 - DNA, 20 bp, Artificial Sequence
  Description of Artificial Sequence: Synthetic oligonucleotide
  Target: ATXN1; (-) strand; PAM type: YTN; PAM sequence: TTT
gggtttgaataacttagaca

SEQ ID NO: 172371 - DNA, 20 bp, Artificial Sequence
  Description of Artificial Sequence: Synthetic oligonucleotide
  Target: ATXN1; (-) strand; PAM type: YTN; PAM sequence: CTT
tgggtttgaataacttagac

SEQ ID NO: 172372 - DNA, 20 bp, Artificial Sequence
  Description of Artificial Sequence: Synthetic oligonucleotide
  Target: ATXN1; (-) strand; PAM type: YTN; PAM sequence: CTC
tttgggtttgaataacttag

SEQ ID NO: 172373 - DNA, 20 bp, Artificial Sequence
  Description of Artificial Sequence: Synthetic oligonucleotide
  Target: ATXN1; (-) strand; PAM type: YTN; PAM sequence: TTC
tctttgggtttgaataactt

SEQ ID NO: 172374 - DNA, 20 bp, Artificial Sequence
  Description of Artificial Sequence: Synthetic oligonucleotide
  Target: ATXN1; (-) strand; PAM type: YTN; PAM sequence: CTT
ctctttgggtttgaataact

SEQ ID NO: 172375 - DNA, 20 bp, Artificial Sequence
  Description of Artificial Sequence: Synthetic oligonucleotide
  Target: ATXN1; (-) strand; PAM type: YTN; PAM sequence: TTA
ggcttctctttgggtttgaa

SEQ ID NO: 172376 - DNA, 20 bp, Artificial Sequence
  Description of Artificial Sequence: Synthetic oligonucleotide
  Target: ATXN1; (-) strand; PAM type: YTN; PAM sequence: CTT
aggcttctctttgggtttga

SEQ ID NO: 172377 - DNA, 20 bp, Artificial Sequence
  Description of Artificial Sequence: Synthetic oligonucleotide
  Target: ATXN1; (-) strand; PAM type: YTN; PAM sequence: TTA
gatgccttaggcttctcttt

SEQ ID NO: 172378 - DNA, 20 bp, Artificial Sequence
  Description of Artificial Sequence: Synthetic oligonucleotide
  Target: ATXN1; (-) strand; PAM type: YTN; PAM sequence: TTA
aattagatgccttaggcttc

SEQ ID NO: 172379 - DNA, 20 bp, Artificial Sequence
  Description of Artificial Sequence: Synthetic oligonucleotide
  Target: ATXN1; (-) strand; PAM type: YTN; PAM sequence: TTT
aaattagatgccttaggctt

SEQ ID NO: 172380 - DNA, 20 bp, Artificial Sequence
  Description of Artificial Sequence: Synthetic oligonucleotide
  Target: ATXN1; (-) strand; PAM type: YTN; PAM sequence: TTG
aatttaaattagatgcctta

SEQ ID NO: 172381 - DNA, 20 bp, Artificial Sequence
  Description of Artificial Sequence: Synthetic oligonucleotide
  Target: ATXN1; (-) strand; PAM type: YTN; PAM sequence: TTT
gaatttaaattagatgcctt

SEQ ID NO: 172382 - DNA, 20 bp, Artificial Sequence
  Description of Artificial Sequence: Synthetic oligonucleotide
  Target: ATXN1; (-) strand; PAM type: YTN; PAM sequence: CTA
tttgaatttaaattagatgc

SEQ ID NO: 172383 - DNA, 20 bp, Artificial Sequence
  Description of Artificial Sequence: Synthetic oligonucleotide
  Target: ATXN1; (-) strand; PAM type: YTN; PAM sequence: TTC
tatttgaatttaaattagat

SEQ ID NO: 172384 - DNA, 20 bp, Artificial Sequence
  Description of Artificial Sequence: Synthetic oligonucleotide
  Target: ATXN1; (-) strand; PAM type: YTN; PAM sequence: CTT
ctatttgaatttaaattaga

SEQ ID NO: 172385 - DNA, 20 bp, Artificial Sequence
  Description of Artificial Sequence: Synthetic oligonucleotide
  Target: ATXN1; (-) strand; PAM type: YTN; PAM sequence: TTA
cttctatttgaatttaaatt

SEQ ID NO: 172386 - DNA, 20 bp, Artificial Sequence
  Description of Artificial Sequence: Synthetic oligonucleotide
  Target: ATXN1; (-) strand; PAM type: YTN; PAM sequence: TTC
acgattacttctatttgaat

SEQ ID NO: 172387 - DNA, 20 bp, Artificial Sequence
  Description of Artificial Sequence: Synthetic oligonucleotide
  Target: ATXN1; (-) strand; PAM type: YTN; PAM sequence: TTA
ttcacgattacttctatttg

SEQ ID NO: 172388 - DNA, 20 bp, Artificial Sequence
  Description of Artificial Sequence: Synthetic oligonucleotide
  Target: ATXN1; (-) strand; PAM type: YTN; PAM sequence: TTT
attcacgattacttctattt

SEQ ID NO: 172389 - DNA, 20 bp, Artificial Sequence
  Description of Artificial Sequence: Synthetic oligonucleotide
  Target: ATXN1; (-) strand; PAM type: YTN; PAM sequence: CTT
tattcacgattacttctatt

SEQ ID NO: 172390 - DNA, 20 bp, Artificial Sequence
  Description of Artificial Sequence: Synthetic oligonucleotide
  Target: ATXN1; (-) strand; PAM type: YTN; PAM sequence: TTC
tttattcacgattacttcta

SEQ ID NO: 172391 - DNA, 20 bp, Artificial Sequence
  Description of Artificial Sequence: Synthetic oligonucleotide
  Target: ATXN1; (-) strand; PAM type: YTN; PAM sequence: TTG
gattctttattcacgattac

SEQ ID NO: 172392 - DNA, 20 bp, Artificial Sequence
  Description of Artificial Sequence: Synthetic oligonucleotide
  Target: ATXN1; (-) strand; PAM type: YTN; PAM sequence: CTT
ggattctttattcacgatta

SEQ ID NO: 172393 - DNA, 20 bp, Artificial Sequence
  Description of Artificial Sequence: Synthetic oligonucleotide
  Target: ATXN1; (-) strand; PAM type: YTN; PAM sequence: TTA
agtgcaagaacttggattct

SEQ ID NO: 172394 - DNA, 20 bp, Artificial Sequence
  Description of Artificial Sequence: Synthetic oligonucleotide
  Target: ATXN1; (-) strand; PAM type: YTN; PAM sequence: TTC
accattaagtgcaagaactt

SEQ ID NO: 172395 - DNA, 20 bp, Artificial Sequence
  Description of Artificial Sequence: Synthetic oligonucleotide
  Target: ATXN1; (-) strand; PAM type: YTN; PAM sequence: TTT
caccattaagtgcaagaact

SEQ ID NO: 172396 - DNA, 20 bp, Artificial Sequence
  Description of Artificial Sequence: Synthetic oligonucleotide
  Target: ATXN1; (-) strand; PAM type: YTN; PAM sequence: TTT
tcaccattaagtgcaagaac

SEQ ID NO: 172397 - DNA, 20 bp, Artificial Sequence
  Description of Artificial Sequence: Synthetic oligonucleotide
  Target: ATXN1; (-) strand; PAM type: YTN; PAM sequence: TTA
ttttcaccattaagtgcaag

SEQ ID NO: 172398 - DNA, 20 bp, Artificial Sequence
  Description of Artificial Sequence: Synthetic oligonucleotide
  Target: ATXN1; (-) strand; PAM type: YTN; PAM sequence: CTA
tacacatatacatatatatt

SEQ ID NO: 172399 - DNA, 20 bp, Artificial Sequence
  Description of Artificial Sequence: Synthetic oligonucleotide
  Target: ATXN1; (-) strand; PAM type: YTN; PAM sequence: CTC
tatacacatatacatatata

SEQ ID NO: 172400 - DNA, 20 bp, Artificial Sequence
  Description of Artificial Sequence: Synthetic oligonucleotide
  Target: ATXN1; (-) strand; PAM type: YTN; PAM sequence: CTC
atgaaatgtgtgtgtgtgta

SEQ ID NO: 172401 - DNA, 20 bp, Artificial Sequence
  Description of Artificial Sequence: Synthetic oligonucleotide
  Target: ATXN1; (-) strand; PAM type: YTN; PAM sequence: TTC
cccctcatgaaatgtgtgtg

SEQ ID NO: 172402 - DNA, 20 bp, Artificial Sequence
  Description of Artificial Sequence: Synthetic oligonucleotide
  Target: ATXN1; (-) strand; PAM type: YTN; PAM sequence: TTT
ccccctcatgaaatgtgtgt

SEQ ID NO: 172403 - DNA, 20 bp, Artificial Sequence
  Description of Artificial Sequence: Synthetic oligonucleotide
  Target: ATXN1; (-) strand; PAM type: YTN; PAM sequence: TTT
tccccctcatgaaatgtgtg

SEQ ID NO: 172404 - DNA, 20 bp, Artificial Sequence
  Description of Artificial Sequence: Synthetic oligonucleotide
  Target: ATXN1; (-) strand; PAM type: YTN; PAM sequence: TTG
ttttccccctcatgaaatgt

SEQ ID NO: 172405 - DNA, 20 bp, Artificial Sequence
  Description of Artificial Sequence: Synthetic oligonucleotide
  Target: ATXN1; (-) strand; PAM type: YTN; PAM sequence: TTT
gttttccccctcatgaaatg

SEQ ID NO: 172406 - DNA, 20 bp, Artificial Sequence
  Description of Artificial Sequence: Synthetic oligonucleotide
  Target: ATXN1; (-) strand; PAM type: YTN; PAM sequence: TTC
atatatatacgtgtatatgt

SEQ ID NO: 172407 - DNA, 20 bp, Artificial Sequence
  Description of Artificial Sequence: Synthetic oligonucleotide
  Target: ATXN1; (-) strand; PAM type: YTN; PAM sequence: TTG
tgcatatgtatgtgtatata

SEQ ID NO: 172408 - DNA, 20 bp, Artificial Sequence
  Description of Artificial Sequence: Synthetic oligonucleotide
  Target: ATXN1; (-) strand; PAM type: YTN; PAM sequence: TTT
gtgcatatgtatgtgtatat

SEQ ID NO: 172409 - DNA, 20 bp, Artificial Sequence
  Description of Artificial Sequence: Synthetic oligonucleotide
  Target: ATXN1; (-) strand; PAM type: YTN; PAM sequence: CTC
acaaaacacacgtatttgtg

SEQ ID NO: 172410 - DNA, 20 bp, Artificial Sequence
  Description of Artificial Sequence: Synthetic oligonucleotide
  Target: ATXN1; (-) strand; PAM type: YTN; PAM sequence: CTA
gacacacacatacacactca

SEQ ID NO: 172411 - DNA, 20 bp, Artificial Sequence
  Description of Artificial Sequence: Synthetic oligonucleotide
  Target: ATXN1; (-) strand; PAM type: YTN; PAM sequence: CTG
gaggaggcgaaaaacaaact

SEQ ID NO: 172412 - DNA, 20 bp, Artificial Sequence
  Description of Artificial Sequence: Synthetic oligonucleotide
  Target: ATXN1; (-) strand; PAM type: YTN; PAM sequence: CTC
ctggaggaggcgaaaaacaa

SEQ ID NO: 172413 - DNA, 20 bp, Artificial Sequence
  Description of Artificial Sequence: Synthetic oligonucleotide
  Target: ATXN1; (-) strand; PAM type: YTN; PAM sequence: CTG
tataactcctggaggaggcg

SEQ ID NO: 172414 - DNA, 20 bp, Artificial Sequence
  Description of Artificial Sequence: Synthetic oligonucleotide
  Target: ATXN1; (-) strand; PAM type: YTN; PAM sequence: TTG
ctgtataactcctggaggag

SEQ ID NO: 172415 - DNA, 20 bp, Artificial Sequence
  Description of Artificial Sequence: Synthetic oligonucleotide
  Target: ATXN1; (-) strand; PAM type: YTN; PAM sequence: TTT
gctgtataactcctggagga

SEQ ID NO: 172416 - DNA, 20 bp, Artificial Sequence
  Description of Artificial Sequence: Synthetic oligonucleotide
  Target: ATXN1; (-) strand; PAM type: YTN; PAM sequence: TTT
tgctgtataactcctggagg

SEQ ID NO: 172417 - DNA, 20 bp, Artificial Sequence
  Description of Artificial Sequence: Synthetic oligonucleotide
  Target: ATXN1; (-) strand; PAM type: YTN; PAM sequence: TTT
ttgctgtataactcctggag

SEQ ID NO: 172418 - DNA, 20 bp, Artificial Sequence
  Description of Artificial Sequence: Synthetic oligonucleotide
  Target: ATXN1; (-) strand; PAM type: YTN; PAM sequence: TTT
tttgctgtataactcctgga

SEQ ID NO: 172419 - DNA, 20 bp, Artificial Sequence
  Description of Artificial Sequence: Synthetic oligonucleotide
  Target: ATXN1; (-) strand; PAM type: YTN; PAM sequence: CTT
ttttgctgtataactcctgg

SEQ ID NO: 172420 - DNA, 20 bp, Artificial Sequence
  Description of Artificial Sequence: Synthetic oligonucleotide
  Target: ATXN1; (-) strand; PAM type: YTN; PAM sequence: TTC
ttttttgctgtataactcct

SEQ ID NO: 172421 - DNA, 20 bp, Artificial Sequence
  Description of Artificial Sequence: Synthetic oligonucleotide
  Target: ATXN1; (-) strand; PAM type: YTN; PAM sequence: CTT
cttttttgctgtataactcc

SEQ ID NO: 172422 - DNA, 20 bp, Artificial Sequence
  Description of Artificial Sequence: Synthetic oligonucleotide
  Target: ATXN1; (-) strand; PAM type: YTN; PAM sequence: TTC
ttcttttttgctgtataact

SEQ ID NO: 172423 - DNA, 20 bp, Artificial Sequence
  Description of Artificial Sequence: Synthetic oligonucleotide
  Target: ATXN1; (-) strand; PAM type: YTN; PAM sequence: TTT
cttcttttttgctgtataac

SEQ ID NO: 172424 - DNA, 20 bp, Artificial Sequence
  Description of Artificial Sequence: Synthetic oligonucleotide
  Target: ATXN1; (-) strand; PAM type: YTN; PAM sequence: TTT
tcttcttttttgctgtataa

SEQ ID NO: 172425 - DNA, 20 bp, Artificial Sequence
  Description of Artificial Sequence: Synthetic oligonucleotide
  Target: ATXN1; (-) strand; PAM type: YTN; PAM sequence: TTT
ttcttcttttttgctgtata

SEQ ID NO: 172426 - DNA, 20 bp, Artificial Sequence
  Description of Artificial Sequence: Synthetic oligonucleotide
  Target: ATXN1; (-) strand; PAM type: YTN; PAM sequence: TTT
tttcttcttttttgctgtat

SEQ ID NO: 172427 - DNA, 20 bp, Artificial Sequence
  Description of Artificial Sequence: Synthetic oligonucleotide
  Target: ATXN1; (-) strand; PAM type: YTN; PAM sequence: TTT
ttttcttcttttttgctgta

SEQ ID NO: 172428 - DNA, 20 bp, Artificial Sequence
  Description of Artificial Sequence: Synthetic oligonucleotide
  Target: ATXN1; (-) strand; PAM type: YTN; PAM sequence: CTG
ataaaaggcagggatttttt

SEQ ID NO: 172429 - DNA, 20 bp, Artificial Sequence
  Description of Artificial Sequence: Synthetic oligonucleotide
  Target: ATXN1; (-) strand; PAM type: YTN; PAM sequence: TTG
caaggataaaatgtgtacat

SEQ ID NO: 172430 - DNA, 20 bp, Artificial Sequence
  Description of Artificial Sequence: Synthetic oligonucleotide
  Target: ATXN1; (-) strand; PAM type: YTN; PAM sequence: TTA
gacatattgcaaggataaaa

SEQ ID NO: 172431 - DNA, 20 bp, Artificial Sequence
  Description of Artificial Sequence: Synthetic oligonucleotide
  Target: ATXN1; (-) strand; PAM type: YTN; PAM sequence: TTT
agacatattgcaaggataaa

SEQ ID NO: 172432 - DNA, 20 bp, Artificial Sequence
  Description of Artificial Sequence: Synthetic oligonucleotide
  Target: ATXN1; (-) strand; PAM type: YTN; PAM sequence: TTT
tagacatattgcaaggataa

SEQ ID NO: 172433 - DNA, 20 bp, Artificial Sequence
  Description of Artificial Sequence: Synthetic oligonucleotide
  Target: ATXN1; (-) strand; PAM type: YTN; PAM sequence: TTA
gtcataaaatcattttagac

SEQ ID NO: 172434 - DNA, 20 bp, Artificial Sequence
  Description of Artificial Sequence: Synthetic oligonucleotide
  Target: ATXN1; (-) strand; PAM type: YTN; PAM sequence: TTT
agtcataaaatcattttaga

SEQ ID NO: 172435 - DNA, 20 bp, Artificial Sequence
  Description of Artificial Sequence: Synthetic oligonucleotide
  Target: ATXN1; (-) strand; PAM type: YTN; PAM sequence: TTC
ccaggatttagtcataaaat

SEQ ID NO: 172436 - DNA, 20 bp, Artificial Sequence
  Description of Artificial Sequence: Synthetic oligonucleotide
  Target: ATXN1; (-) strand; PAM type: YTN; PAM sequence: TTT
cccaggatttagtcataaaa

SEQ ID NO: 172437 - DNA, 20 bp, Artificial Sequence
  Description of Artificial Sequence: Synthetic oligonucleotide
  Target: ATXN1; (-) strand; PAM type: YTN; PAM sequence: TTT
tcccaggatttagtcataaa

SEQ ID NO: 172438 - DNA, 20 bp, Artificial Sequence
  Description of Artificial Sequence: Synthetic oligonucleotide
  Target: ATXN1; (-) strand; PAM type: YTN; PAM sequence: TTT
ttcccaggatttagtcataa

SEQ ID NO: 172439 - DNA, 20 bp, Artificial Sequence
  Description of Artificial Sequence: Synthetic oligonucleotide
  Target: ATXN1; (-) strand; PAM type: YTN; PAM sequence: TTC
acatttttcccaggatttag

SEQ ID NO: 172440 - DNA, 20 bp, Artificial Sequence
  Description of Artificial Sequence: Synthetic oligonucleotide
  Target: ATXN1; (-) strand; PAM type: YTN; PAM sequence: CTT
cacatttttcccaggattta

SEQ ID NO: 172441 - DNA, 20 bp, Artificial Sequence
  Description of Artificial Sequence: Synthetic oligonucleotide
  Target: ATXN1; (-) strand; PAM type: YTN; PAM sequence: TTC
ttcacatttttcccaggatt

SEQ ID NO: 172442 - DNA, 20 bp, Artificial Sequence
  Description of Artificial Sequence: Synthetic oligonucleotide
  Target: ATXN1; (-) strand; PAM type: YTN; PAM sequence: CTA
gccaagcattcttcacattt

SEQ ID NO: 172443 - DNA, 20 bp, Artificial Sequence
  Description of Artificial Sequence: Synthetic oligonucleotide
  Target: ATXN1; (-) strand; PAM type: YTN; PAM sequence: TTG
ccatctagccaagcattctt

SEQ ID NO: 172444 - DNA, 20 bp, Artificial Sequence
  Description of Artificial Sequence: Synthetic oligonucleotide
  Target: ATXN1; (-) strand; PAM type: YTN; PAM sequence: CTT
gccatctagccaagcattct

SEQ ID NO: 172445 - DNA, 20 bp, Artificial Sequence
  Description of Artificial Sequence: Synthetic oligonucleotide
  Target: ATXN1; (-) strand; PAM type: YTN; PAM sequence: CTG
gaaaagcttgccatctagcc

SEQ ID NO: 172446 - DNA, 20 bp, Artificial Sequence
  Description of Artificial Sequence: Synthetic oligonucleotide
  Target: ATXN1; (-) strand; PAM type: YTN; PAM sequence: TTA
ctggaaaagcttgccatcta

SEQ ID NO: 172447 - DNA, 20 bp, Artificial Sequence
  Description of Artificial Sequence: Synthetic oligonucleotide
  Target: ATXN1; (-) strand; PAM type: YTN; PAM sequence: TTT
actggaaaagcttgccatct

SEQ ID NO: 172448 - DNA, 20 bp, Artificial Sequence
  Description of Artificial Sequence: Synthetic oligonucleotide
  Target: ATXN1; (-) strand; PAM type: YTN; PAM sequence: TTT
tactggaaaagcttgccatc

SEQ ID NO: 172449 - DNA, 20 bp, Artificial Sequence
  Description of Artificial Sequence: Synthetic oligonucleotide
  Target: ATXN1; (-) strand; PAM type: YTN; PAM sequence: TTT
ttactggaaaagcttgccat

SEQ ID NO: 172450 - DNA, 20 bp, Artificial Sequence
  Description of Artificial Sequence: Synthetic oligonucleotide
  Target: ATXN1; (-) strand; PAM type: YTN; PAM sequence: TTG
tgtttttactggaaaagctt

SEQ ID NO: 172451 - DNA, 20 bp, Artificial Sequence
  Description of Artificial Sequence: Synthetic oligonucleotide
  Target: ATXN1; (-) strand; PAM type: YTN; PAM sequence: TTC
ataagcagtgttgtgttttt

SEQ ID NO: 172452 - DNA, 20 bp, Artificial Sequence
  Description of Artificial Sequence: Synthetic oligonucleotide
  Target: ATXN1; (-) strand; PAM type: YTN; PAM sequence: CTA
caattcataagcagtgttgt

SEQ ID NO: 172453 - DNA, 20 bp, Artificial Sequence
  Description of Artificial Sequence: Synthetic oligonucleotide
  Target: ATXN1; (-) strand; PAM type: YTN; PAM sequence: CTC
caagtgctacaattcataag

SEQ ID NO: 172454 - DNA, 20 bp, Artificial Sequence
  Description of Artificial Sequence: Synthetic oligonucleotide
  Target: ATXN1; (-) strand; PAM type: YTN; PAM sequence: TTC
tccaagtgctacaattcata

SEQ ID NO: 172455 - DNA, 20 bp, Artificial Sequence
  Description of Artificial Sequence: Synthetic oligonucleotide
  Target: ATXN1; (-) strand; PAM type: YTN; PAM sequence: CTT
ctccaagtgctacaattcat

SEQ ID NO: 172456 - DNA, 20 bp, Artificial Sequence
  Description of Artificial Sequence: Synthetic oligonucleotide
  Target: ATXN1; (-) strand; PAM type: YTN; PAM sequence: TTG
aaaagtcttctccaagtgct

SEQ ID NO: 172457 - DNA, 20 bp, Artificial Sequence
  Description of Artificial Sequence: Synthetic oligonucleotide
  Target: ATXN1; (-) strand; PAM type: YTN; PAM sequence: CTA
gagcaaaaatgtacatcatg

SEQ ID NO: 172458 - DNA, 20 bp, Artificial Sequence
  Description of Artificial Sequence: Synthetic oligonucleotide
  Target: ATXN1; (-) strand; PAM type: YTN; PAM sequence: CTC
aagctagagcaaaaatgtac

SEQ ID NO: 172459 - DNA, 20 bp, Artificial Sequence
  Description of Artificial Sequence: Synthetic oligonucleotide
  Target: ATXN1; (-) strand; PAM type: YTN; PAM sequence: TTA
gtctcaagctagagcaaaaa

SEQ ID NO: 172460 - DNA, 20 bp, Artificial Sequence
  Description of Artificial Sequence: Synthetic oligonucleotide
  Target: ATXN1; (-) strand; PAM type: YTN; PAM sequence: TTT
agtctcaagctagagcaaaa

SEQ ID NO: 172461 - DNA, 20 bp, Artificial Sequence
  Description of Artificial Sequence: Synthetic oligonucleotide
  Target: ATXN1; (-) strand; PAM type: YTN; PAM sequence: CTC
caaacaggatttagtctcaa

SEQ ID NO: 172462 - DNA, 20 bp, Artificial Sequence
  Description of Artificial Sequence: Synthetic oligonucleotide
  Target: ATXN1; (-) strand; PAM type: YTN; PAM sequence: CTA
cctccaaacaggatttagtc

SEQ ID NO: 172463 - DNA, 20 bp, Artificial Sequence
  Description of Artificial Sequence: Synthetic oligonucleotide
  Target: ATXN1; (-) strand; PAM type: YTN; PAM sequence: CTG
aaagccaaagaaaacctacc

SEQ ID NO: 172464 - DNA, 20 bp, Artificial Sequence
  Description of Artificial Sequence: Synthetic oligonucleotide
  Target: ATXN1; (-) strand; PAM type: YTN; PAM sequence: TTC
tgaaagccaaagaaaaccta

SEQ ID NO: 172465 - DNA, 20 bp, Artificial Sequence
  Description of Artificial Sequence: Synthetic oligonucleotide
  Target: ATXN1; (-) strand; PAM type: YTN; PAM sequence: TTT
ctgaaagccaaagaaaacct

SEQ ID NO: 172466 - DNA, 20 bp, Artificial Sequence
  Description of Artificial Sequence: Synthetic oligonucleotide
  Target: ATXN1; (-) strand; PAM type: YTN; PAM sequence: TTT
tctgaaagccaaagaaaacc

SEQ ID NO: 172467 - DNA, 20 bp, Artificial Sequence
  Description of Artificial Sequence: Synthetic oligonucleotide
  Target: ATXN1; (-) strand; PAM type: YTN; PAM sequence: TTT
ttctgaaagccaaagaaaac

SEQ ID NO: 172468 - DNA, 20 bp, Artificial Sequence
  Description of Artificial Sequence: Synthetic oligonucleotide
  Target: ATXN1; (-) strand; PAM type: YTN; PAM sequence: CTT
tttctgaaagccaaagaaaa

SEQ ID NO: 172469 - DNA, 20 bp, Artificial Sequence
  Description of Artificial Sequence: Synthetic oligonucleotide
  Target: ATXN1; (-) strand; PAM type: YTN; PAM sequence: TTC
aactttttctgaaagccaaa

SEQ ID NO: 172470 - DNA, 20 bp, Artificial Sequence
  Description of Artificial Sequence: Synthetic oligonucleotide
  Target: ATXN1; (-) strand; PAM type: YTN; PAM sequence: TTG
tacaatcggttcaacttttt

SEQ ID NO: 172471 - DNA, 20 bp, Artificial Sequence
  Description of Artificial Sequence: Synthetic oligonucleotide
  Target: ATXN1; (-) strand; PAM type: YTN; PAM sequence: TTG
gagggcccaaagacccatgt

SEQ ID NO: 172472 - DNA, 20 bp, Artificial Sequence
  Description of Artificial Sequence: Synthetic oligonucleotide
  Target: ATXN1; (-) strand; PAM type: YTN; PAM sequence: CTC
atggtgagtccacgttggag

SEQ ID NO: 172473 - DNA, 20 bp, Artificial Sequence
  Description of Artificial Sequence: Synthetic oligonucleotide
  Target: ATXN1; (-) strand; PAM type: YTN; PAM sequence: CTC
tcatggtgagtccacgttgg

SEQ ID NO: 172474 - DNA, 20 bp, Artificial Sequence
  Description of Artificial Sequence: Synthetic oligonucleotide
  Target: ATXN1; (-) strand; PAM type: YTN; PAM sequence: TTA
atggaatagcacacgatcgt

SEQ ID NO: 172475 - DNA, 20 bp, Artificial Sequence
  Description of Artificial Sequence: Synthetic oligonucleotide
  Target: ATXN1; (-) strand; PAM type: YTN; PAM sequence: TTT
aatggaatagcacacgatcg

SEQ ID NO: 172476 - DNA, 20 bp, Artificial Sequence
  Description of Artificial Sequence: Synthetic oligonucleotide
  Target: ATXN1; (-) strand; PAM type: YTN; PAM sequence: CTG
gagtcgtgagacggaggcat

SEQ ID NO: 172477 - DNA, 20 bp, Artificial Sequence
  Description of Artificial Sequence: Synthetic oligonucleotide
  Target: ATXN1; (-) strand; PAM type: YTN; PAM sequence: CTG
gctggagtcgtgagacggag

SEQ ID NO: 172478 - DNA, 20 bp, Artificial Sequence
  Description of Artificial Sequence: Synthetic oligonucleotide
  Target: ATXN1; (-) strand; PAM type: YTN; PAM sequence: TTA
accctggctggagtcgtgag

SEQ ID NO: 172479 - DNA, 20 bp, Artificial Sequence
  Description of Artificial Sequence: Synthetic oligonucleotide
  Target: ATXN1; (-) strand; PAM type: YTN; PAM sequence: TTT
aaccctggctggagtcgtga

SEQ ID NO: 172480 - DNA, 20 bp, Artificial Sequence
  Description of Artificial Sequence: Synthetic oligonucleotide
  Target: ATXN1; (-) strand; PAM type: YTN; PAM sequence: TTT
taaccctggctggagtcgtg

SEQ ID NO: 172481 - DNA, 20 bp, Artificial Sequence
  Description of Artificial Sequence: Synthetic oligonucleotide
  Target: ATXN1; (-) strand; PAM type: YTN; PAM sequence: CTG
aaggttttaaccctggctgg

SEQ ID NO: 172482 - DNA, 20 bp, Artificial Sequence
  Description of Artificial Sequence: Synthetic oligonucleotide
  Target: ATXN1; (-) strand; PAM type: YTN; PAM sequence: TTG
agaaaacatctgaaggtttt

SEQ ID NO: 172483 - DNA, 20 bp, Artificial Sequence
  Description of Artificial Sequence: Synthetic oligonucleotide
  Target: ATXN1; (-) strand; PAM type: YTN; PAM sequence: TTA
atgtgttgagaaaacatctg

SEQ ID NO: 172484 - DNA, 20 bp, Artificial Sequence
  Description of Artificial Sequence: Synthetic oligonucleotide
  Target: ATXN1; (-) strand; PAM type: YTN; PAM sequence: CTT
aatgtgttgagaaaacatct

SEQ ID NO: 172485 - DNA, 20 bp, Artificial Sequence
  Description of Artificial Sequence: Synthetic oligonucleotide
  Target: ATXN1; (-) strand; PAM type: YTN; PAM sequence: CTG
cttaatgtgttgagaaaaca

SEQ ID NO: 172486 - DNA, 20 bp, Artificial Sequence
  Description of Artificial Sequence: Synthetic oligonucleotide
  Target: ATXN1; (-) strand; PAM type: YTN; PAM sequence: TTC
tgcttaatgtgttgagaaaa

SEQ ID NO: 172487 - DNA, 20 bp, Artificial Sequence
  Description of Artificial Sequence: Synthetic oligonucleotide
  Target: ATXN1; (-) strand; PAM type: YTN; PAM sequence: TTA
gttctgcttaatgtgttgag

SEQ ID NO: 172488 - DNA, 20 bp, Artificial Sequence
  Description of Artificial Sequence: Synthetic oligonucleotide
  Target: ATXN1; (-) strand; PAM type: YTN; PAM sequence: TTG
tgatggttagttctgcttaa

SEQ ID NO: 172489 - DNA, 20 bp, Artificial Sequence
  Description of Artificial Sequence: Synthetic oligonucleotide
  Target: ATXN1; (-) strand; PAM type: YTN; PAM sequence: TTT
gtgatggttagttctgctta

SEQ ID NO: 172490 - DNA, 20 bp, Artificial Sequence
  Description of Artificial Sequence: Synthetic oligonucleotide
  Target: ATXN1; (-) strand; PAM type: YTN; PAM sequence: CTT
tgtgatggttagttctgctt

SEQ ID NO: 172491 - DNA, 20 bp, Artificial Sequence
  Description of Artificial Sequence: Synthetic oligonucleotide
  Target: ATXN1; (-) strand; PAM type: YTN; PAM sequence: TTG
cctttgtgatggttagttct

SEQ ID NO: 172492 - DNA, 20 bp, Artificial Sequence
  Description of Artificial Sequence: Synthetic oligonucleotide
  Target: ATXN1; (-) strand; PAM type: YTN; PAM sequence: TTT
gcctttgtgatggttagttc

SEQ ID NO: 172493 - DNA, 20 bp, Artificial Sequence
  Description of Artificial Sequence: Synthetic oligonucleotide
  Target: ATXN1; (-) strand; PAM type: YTN; PAM sequence: TTT
tgcctttgtgatggttagtt

SEQ ID NO: 172494 - DNA, 20 bp, Artificial Sequence
  Description of Artificial Sequence: Synthetic oligonucleotide
  Target: ATXN1; (-) strand; PAM type: YTN; PAM sequence: TTT
ttgcctttgtgatggttagt

SEQ ID NO: 172495 - DNA, 20 bp, Artificial Sequence
  Description of Artificial Sequence: Synthetic oligonucleotide
  Target: ATXN1; (-) strand; PAM type: YTN; PAM sequence: TTA
gtttttgcctttgtgatggt

SEQ ID NO: 172496 - DNA, 20 bp, Artificial Sequence
  Description of Artificial Sequence: Synthetic oligonucleotide
  Target: ATXN1; (-) strand; PAM type: YTN; PAM sequence: TTT
agtttttgcctttgtgatgg

SEQ ID NO: 172497 - DNA, 20 bp, Artificial Sequence
  Description of Artificial Sequence: Synthetic oligonucleotide
  Target: ATXN1; (-) strand; PAM type: YTN; PAM sequence: CTG
acaaggggacagatgggttt

SEQ ID NO: 172498 - DNA, 20 bp, Artificial Sequence
  Description of Artificial Sequence: Synthetic oligonucleotide
  Target: ATXN1; (-) strand; PAM type: YTN; PAM sequence: CTC
aaaaatcctgacaaggggac

SEQ ID NO: 172499 - DNA, 20 bp, Artificial Sequence
  Description of Artificial Sequence: Synthetic oligonucleotide
  Target: ATXN1; (-) strand; PAM type: YTN; PAM sequence: TTG
acaatctcaaaaatcctgac

SEQ ID NO: 172500 - DNA, 20 bp, Artificial Sequence
  Description of Artificial Sequence: Synthetic oligonucleotide
  Target: ATXN1; (-) strand; PAM type: YTN; PAM sequence: TTC
cagccacaaggtcagtccat

SEQ ID NO: 172501 - DNA, 20 bp, Artificial Sequence
  Description of Artificial Sequence: Synthetic oligonucleotide
  Target: ATXN1; (-) strand; PAM type: YTN; PAM sequence: TTT
ccagccacaaggtcagtcca

SEQ ID NO: 172502 - DNA, 20 bp, Artificial Sequence
  Description of Artificial Sequence: Synthetic oligonucleotide
  Target: ATXN1; (-) strand; PAM type: YTN; PAM sequence: TTT
tccagccacaaggtcagtcc

SEQ ID NO: 172503 - DNA, 20 bp, Artificial Sequence
  Description of Artificial Sequence: Synthetic oligonucleotide
  Target: ATXN1; (-) strand; PAM type: YTN; PAM sequence: CTC
caaaatgttttccagccaca

SEQ ID NO: 172504 - DNA, 20 bp, Artificial Sequence
  Description of Artificial Sequence: Synthetic oligonucleotide
  Target: ATXN1; (-) strand; PAM type: YTN; PAM sequence: TTA
cacggcctccaaaatgtttt

SEQ ID NO: 172505 - DNA, 20 bp, Artificial Sequence
  Description of Artificial Sequence: Synthetic oligonucleotide
  Target: ATXN1; (-) strand; PAM type: YTN; PAM sequence: TTG
ttacacggcctccaaaatgt

SEQ ID NO: 172506 - DNA, 20 bp, Artificial Sequence
  Description of Artificial Sequence: Synthetic oligonucleotide
  Target: ATXN1; (-) strand; PAM type: YTN; PAM sequence: TTT
gttacacggcctccaaaatg

SEQ ID NO: 172507 - DNA, 20 bp, Artificial Sequence
  Description of Artificial Sequence: Synthetic oligonucleotide
  Target: ATXN1; (-) strand; PAM type: YTN; PAM sequence: TTT
tgttacacggcctccaaaat

SEQ ID NO: 172508 - DNA, 20 bp, Artificial Sequence
  Description of Artificial Sequence: Synthetic oligonucleotide
  Target: ATXN1; (-) strand; PAM type: YTN; PAM sequence: CTT
ttgttacacggcctccaaaa

SEQ ID NO: 172509 - DNA, 20 bp, Artificial Sequence
  Description of Artificial Sequence: Synthetic oligonucleotide
  Target: ATXN1; (-) strand; PAM type: YTN; PAM sequence: TTA
acttttgttacacggcctcc

SEQ ID NO: 172510 - DNA, 20 bp, Artificial Sequence
  Description of Artificial Sequence: Synthetic oligonucleotide
  Target: ATXN1; (-) strand; PAM type: YTN; PAM sequence: TTT
aacttttgttacacggcctc

SEQ ID NO: 172511 - DNA, 20 bp, Artificial Sequence
  Description of Artificial Sequence: Synthetic oligonucleotide
  Target: ATXN1; (-) strand; PAM type: YTN; PAM sequence: CTG
ccacatttaacttttgttac

SEQ ID NO: 172512 - DNA, 20 bp, Artificial Sequence
  Description of Artificial Sequence: Synthetic oligonucleotide
  Target: ATXN1; (-) strand; PAM type: YTN; PAM sequence: TTC
actgccacatttaacttttg

SEQ ID NO: 172513 - DNA, 20 bp, Artificial Sequence
  Description of Artificial Sequence: Synthetic oligonucleotide
  Target: ATXN1; (-) strand; PAM type: YTN; PAM sequence: CTG
tgcattcactgccacattta

SEQ ID NO: 172514 - DNA, 20 bp, Artificial Sequence
  Description of Artificial Sequence: Synthetic oligonucleotide
  Target: ATXN1; (-) strand; PAM type: YTN; PAM sequence: CTC
tgtgcattcactgccacatt

SEQ ID NO: 172515 - DNA, 20 bp, Artificial Sequence
  Description of Artificial Sequence: Synthetic oligonucleotide
  Target: ATXN1; (-) strand; PAM type: YTN; PAM sequence: TTC
tctgtgcattcactgccaca

SEQ ID NO: 172516 - DNA, 20 bp, Artificial Sequence
  Description of Artificial Sequence: Synthetic oligonucleotide
  Target: ATXN1; (-) strand; PAM type: YTN; PAM sequence: TTT
ctctgtgcattcactgccac

SEQ ID NO: 172517 - DNA, 20 bp, Artificial Sequence
  Description of Artificial Sequence: Synthetic oligonucleotide
  Target: ATXN1; (-) strand; PAM type: YTN; PAM sequence: CTA
agaatttctctgtgcattca

SEQ ID NO: 172518 - DNA, 20 bp, Artificial Sequence
  Description of Artificial Sequence: Synthetic oligonucleotide
  Target: ATXN1; (-) strand; PAM type: YTN; PAM sequence: CTC
taagaatttctctgtgcatt

SEQ ID NO: 172519 - DNA, 20 bp, Artificial Sequence
  Description of Artificial Sequence: Synthetic oligonucleotide
  Target: ATXN1; (-) strand; PAM type: YTN; PAM sequence: CTA
gtgacctctaagaatttctc

SEQ ID NO: 172520 - DNA, 20 bp, Artificial Sequence
  Description of Artificial Sequence: Synthetic oligonucleotide
  Target: ATXN1; (-) strand; PAM type: YTN; PAM sequence: TTC
actagtgacctctaagaatt

SEQ ID NO: 172521 - DNA, 20 bp, Artificial Sequence
  Description of Artificial Sequence: Synthetic oligonucleotide
  Target: ATXN1; (-) strand; PAM type: YTN; PAM sequence: TTA
gtaattcactagtgacctct

SEQ ID NO: 172522 - DNA, 20 bp, Artificial Sequence
  Description of Artificial Sequence: Synthetic oligonucleotide
  Target: ATXN1; (-) strand; PAM type: YTN; PAM sequence: TTG
ccagggtaatggtgttagta

SEQ ID NO: 172523 - DNA, 20 bp, Artificial Sequence
  Description of Artificial Sequence: Synthetic oligonucleotide
  Target: ATXN1; (-) strand; PAM type: YTN; PAM sequence: CTT
gccagggtaatggtgttagt

SEQ ID NO: 172524 - DNA, 20 bp, Artificial Sequence
  Description of Artificial Sequence: Synthetic oligonucleotide
  Target: ATXN1; (-) strand; PAM type: YTN; PAM sequence: CTC
ttgccagggtaatggtgtta

SEQ ID NO: 172525 - DNA, 20 bp, Artificial Sequence
  Description of Artificial Sequence: Synthetic oligonucleotide
  Target: ATXN1; (-) strand; PAM type: YTN; PAM sequence: CTC
catcatctcttgccagggta

SEQ ID NO: 172526 - DNA, 20 bp, Artificial Sequence
  Description of Artificial Sequence: Synthetic oligonucleotide
  Target: ATXN1; (-) strand; PAM type: YTN; PAM sequence: CTG
agataaaatggaaactccat

SEQ ID NO: 172527 - DNA, 20 bp, Artificial Sequence
  Description of Artificial Sequence: Synthetic oligonucleotide
  Target: ATXN1; (-) strand; PAM type: YTN; PAM sequence: CTC
tgagataaaatggaaactcc

SEQ ID NO: 172528 - DNA, 20 bp, Artificial Sequence
  Description of Artificial Sequence: Synthetic oligonucleotide
  Target: ATXN1; (-) strand; PAM type: YTN; PAM sequence: TTA
agtcatcaccatacacccac

SEQ ID NO: 172529 - DNA, 20 bp, Artificial Sequence
  Description of Artificial Sequence: Synthetic oligonucleotide
  Target: ATXN1; (-) strand; PAM type: YTN; PAM sequence: TTT
aagtcatcaccatacaccca

SEQ ID NO: 172530 - DNA, 20 bp, Artificial Sequence
  Description of Artificial Sequence: Synthetic oligonucleotide
  Target: ATXN1; (-) strand; PAM type: YTN; PAM sequence: TTT
taagtcatcaccatacaccc

SEQ ID NO: 172531 - DNA, 20 bp, Artificial Sequence
  Description of Artificial Sequence: Synthetic oligonucleotide
  Target: ATXN1; (-) strand; PAM type: YTN; PAM sequence: CTA
acgtcattttaagtcatcac

SEQ ID NO: 172532 - DNA, 20 bp, Artificial Sequence
  Description of Artificial Sequence: Synthetic oligonucleotide
  Target: ATXN1; (-) strand; PAM type: YTN; PAM sequence: CTA
cgtagcctaacgtcatttta

SEQ ID NO: 172533 - DNA, 20 bp, Artificial Sequence
  Description of Artificial Sequence: Synthetic oligonucleotide
  Target: ATXN1; (-) strand; PAM type: YTN; PAM sequence: TTG
gctacgtagcctaacgtcat

SEQ ID NO: 172534 - DNA, 20 bp, Artificial Sequence
  Description of Artificial Sequence: Synthetic oligonucleotide
  Target: ATXN1; (-) strand; PAM type: YTN; PAM sequence: TTC
caagaaagtgttggctacgt

SEQ ID NO: 172535 - DNA, 20 bp, Artificial Sequence
  Description of Artificial Sequence: Synthetic oligonucleotide
  Target: ATXN1; (-) strand; PAM type: YTN; PAM sequence: TTT
ccaagaaagtgttggctacg

SEQ ID NO: 172536 - DNA, 20 bp, Artificial Sequence
  Description of Artificial Sequence: Synthetic oligonucleotide
  Target: ATXN1; (-) strand; PAM type: YTN; PAM sequence: CTT
tccaagaaagtgttggctac

SEQ ID NO: 172537 - DNA, 20 bp, Artificial Sequence
  Description of Artificial Sequence: Synthetic oligonucleotide
  Target: ATXN1; (-) strand; PAM type: YTN; PAM sequence: TTA
atagaacagcagggaaagtc

SEQ ID NO: 172538 - DNA, 20 bp, Artificial Sequence
  Description of Artificial Sequence: Synthetic oligonucleotide
  Target: ATXN1; (-) strand; PAM type: YTN; PAM sequence: TTT
aatagaacagcagggaaagt

SEQ ID NO: 172539 - DNA, 20 bp, Artificial Sequence
  Description of Artificial Sequence: Synthetic oligonucleotide
  Target: ATXN1; (-) strand; PAM type: YTN; PAM sequence: TTT
taatagaacagcagggaaag

SEQ ID NO: 172540 - DNA, 20 bp, Artificial Sequence
  Description of Artificial Sequence: Synthetic oligonucleotide
  Target: ATXN1; (-) strand; PAM type: YTN; PAM sequence: CTG
acagttttaatagaacagca

SEQ ID NO: 172541 - DNA, 20 bp, Artificial Sequence
  Description of Artificial Sequence: Synthetic oligonucleotide
  Target: ATXN1; (-) strand; PAM type: YTN; PAM sequence: TTG
ctgacagttttaatagaaca

SEQ ID NO: 172542 - DNA, 20 bp, Artificial Sequence
  Description of Artificial Sequence: Synthetic oligonucleotide
  Target: ATXN1; (-) strand; PAM type: YTN; PAM sequence: TTT
gctgacagttttaatagaac

SEQ ID NO: 172543 - DNA, 20 bp, Artificial Sequence
  Description of Artificial Sequence: Synthetic oligonucleotide
  Target: ATXN1; (-) strand; PAM type: YTN; PAM sequence: CTA
tttgctgacagttttaatag

SEQ ID NO: 172544 - DNA, 20 bp, Artificial Sequence
  Description of Artificial Sequence: Synthetic oligonucleotide
  Target: ATXN1; (-) strand; PAM type: YTN; PAM sequence: TTG
gccctatttgctgacagttt

SEQ ID NO: 172545 - DNA, 20 bp, Artificial Sequence
  Description of Artificial Sequence: Synthetic oligonucleotide
  Target: ATXN1; (-) strand; PAM type: YTN; PAM sequence: CTT
ggccctatttgctgacagtt

SEQ ID NO: 172546 - DNA, 20 bp, Artificial Sequence
  Description of Artificial Sequence: Synthetic oligonucleotide
  Target: ATXN1; (-) strand; PAM type: YTN; PAM sequence: CTC
ggcatagaccagtgagcgcc

SEQ ID NO: 172547 - DNA, 20 bp, Artificial Sequence
  Description of Artificial Sequence: Synthetic oligonucleotide
  Target: ATXN1; (-) strand; PAM type: YTN; PAM sequence: TTA
aggtgtcctcggcatagacc

SEQ ID NO: 172548 - DNA, 20 bp, Artificial Sequence
  Description of Artificial Sequence: Synthetic oligonucleotide
  Target: ATXN1; (-) strand; PAM type: YTN; PAM sequence: TTT
aaggtgtcctcggcatagac

SEQ ID NO: 172549 - DNA, 20 bp, Artificial Sequence
  Description of Artificial Sequence: Synthetic oligonucleotide
  Target: ATXN1; (-) strand; PAM type: YTN; PAM sequence: CTT
taaggtgtcctcggcataga

SEQ ID NO: 172550 - DNA, 20 bp, Artificial Sequence
  Description of Artificial Sequence: Synthetic oligonucleotide
  Target: ATXN1; (-) strand; PAM type: YTN; PAM sequence: TTA
ctttaaggtgtcctcggcat

SEQ ID NO: 172551 - DNA, 20 bp, Artificial Sequence
  Description of Artificial Sequence: Synthetic oligonucleotide
  Target: ATXN1; (-) strand; PAM type: YTN; PAM sequence: CTG
attactttaaggtgtcctcg

SEQ ID NO: 172552 - DNA, 20 bp, Artificial Sequence
  Description of Artificial Sequence: Synthetic oligonucleotide
  Target: ATXN1; (-) strand; PAM type: YTN; PAM sequence: TTG
acggcctgattactttaagg

SEQ ID NO: 172553 - DNA, 20 bp, Artificial Sequence
  Description of Artificial Sequence: Synthetic oligonucleotide
  Target: ATXN1; (-) strand; PAM type: YTN; PAM sequence: TTT
gacggcctgattactttaag

SEQ ID NO: 172554 - DNA, 20 bp, Artificial Sequence
  Description of Artificial Sequence: Synthetic oligonucleotide
  Target: ATXN1; (-) strand; PAM type: YTN; PAM sequence: TTA
tttgacggcctgattacttt

SEQ ID NO: 172555 - DNA, 20 bp, Artificial Sequence
  Description of Artificial Sequence: Synthetic oligonucleotide
  Target: ATXN1; (-) strand; PAM type: YTN; PAM sequence: TTT
atttgacggcctgattactt

SEQ ID NO: 172556 - DNA, 20 bp, Artificial Sequence
  Description of Artificial Sequence: Synthetic oligonucleotide
  Target: ATXN1; (-) strand; PAM type: YTN; PAM sequence: CTT
tatttgacggcctgattact

SEQ ID NO: 172557 - DNA, 20 bp, Artificial Sequence
  Description of Artificial Sequence: Synthetic oligonucleotide
  Target: ATXN1; (-) strand; PAM type: YTN; PAM sequence: TTG
cctttatttgacggcctgat

SEQ ID NO: 172558 - DNA, 20 bp, Artificial Sequence
  Description of Artificial Sequence: Synthetic oligonucleotide
  Target: ATXN1; (-) strand; PAM type: YTN; PAM sequence: TTT
gcctttatttgacggcctga

SEQ ID NO: 172559 - DNA, 20 bp, Artificial Sequence
  Description of Artificial Sequence: Synthetic oligonucleotide
  Target: ATXN1; (-) strand; PAM type: YTN; PAM sequence: TTG
agaaagtgtttgcctttatt

SEQ ID NO: 172560 - DNA, 20 bp, Artificial Sequence
  Description of Artificial Sequence: Synthetic oligonucleotide
  Target: ATXN1; (-) strand; PAM type: YTN; PAM sequence: TTA
gaaatgttgagaaagtgttt

SEQ ID NO: 172561 - DNA, 20 bp, Artificial Sequence
  Description of Artificial Sequence: Synthetic oligonucleotide
  Target: ATXN1; (-) strand; PAM type: YTN; PAM sequence: TTT
agaaatgttgagaaagtgtt

SEQ ID NO: 172562 - DNA, 20 bp, Artificial Sequence
  Description of Artificial Sequence: Synthetic oligonucleotide
  Target: ATXN1; (-) strand; PAM type: YTN; PAM sequence: CTT
tagaaatgttgagaaagtgt

SEQ ID NO: 172563 - DNA, 20 bp, Artificial Sequence
  Description of Artificial Sequence: Synthetic oligonucleotide
  Target: ATXN1; (-) strand; PAM type: YTN; PAM sequence: CTG
tctttagaaatgttgagaaa

SEQ ID NO: 172564 - DNA, 20 bp, Artificial Sequence
  Description of Artificial Sequence: Synthetic oligonucleotide
  Target: ATXN1; (-) strand; PAM type: YTN; PAM sequence: TTC
tgtctttagaaatgttgaga

SEQ ID NO: 172565 - DNA, 20 bp, Artificial Sequence
  Description of Artificial Sequence: Synthetic oligonucleotide
  Target: ATXN1; (-) strand; PAM type: YTN; PAM sequence: TTT
ctgtctttagaaatgttgag

SEQ ID NO: 172566 - DNA, 20 bp, Artificial Sequence
  Description of Artificial Sequence: Synthetic oligonucleotide
  Target: ATXN1; (-) strand; PAM type: YTN; PAM sequence: CTA
tttctgtctttagaaatgtt

SEQ ID NO: 172567 - DNA, 20 bp, Artificial Sequence
  Description of Artificial Sequence: Synthetic oligonucleotide
  Target: ATXN1; (-) strand; PAM type: YTN; PAM sequence: TTC
gctatttctgtctttagaaa

SEQ ID NO: 172568 - DNA, 20 bp, Artificial Sequence
  Description of Artificial Sequence: Synthetic oligonucleotide
  Target: ATXN1; (-) strand; PAM type: YTN; PAM sequence: TTT
cgctatttctgtctttagaa

SEQ ID NO: 172569 - DNA, 20 bp, Artificial Sequence
  Description of Artificial Sequence: Synthetic oligonucleotide
  Target: ATXN1; (-) strand; PAM type: YTN; PAM sequence: TTT
tcgctatttctgtctttaga

SEQ ID NO: 172570 - DNA, 20 bp, Artificial Sequence
  Description of Artificial Sequence: Synthetic oligonucleotide
  Target: ATXN1; (-) strand; PAM type: YTN; PAM sequence: CTT
ttcgctatttctgtctttag

SEQ ID NO: 172571 - DNA, 20 bp, Artificial Sequence
  Description of Artificial Sequence: Synthetic oligonucleotide
  Target: ATXN1; (-) strand; PAM type: YTN; PAM sequence: CTC
ttttcgctatttctgtcttt

SEQ ID NO: 172572 - DNA, 20 bp, Artificial Sequence
  Description of Artificial Sequence: Synthetic oligonucleotide
  Target: ATXN1; (-) strand; PAM type: YTN; PAM sequence: TTG
gaacgcaacactcttttcgc

SEQ ID NO: 172573 - DNA, 20 bp, Artificial Sequence
  Description of Artificial Sequence: Synthetic oligonucleotide
  Target: ATXN1; (-) strand; PAM type: YTN; PAM sequence: CTT
ggaacgcaacactcttttcg

SEQ ID NO: 172574 - DNA, 20 bp, Artificial Sequence
  Description of Artificial Sequence: Synthetic oligonucleotide
  Target: ATXN1; (-) strand; PAM type: YTN; PAM sequence: CTG
atatgcttggaacgcaacac

SEQ ID NO: 172575 - DNA, 20 bp, Artificial Sequence
  Description of Artificial Sequence: Synthetic oligonucleotide
  Target: ATXN1; (-) strand; PAM type: YTN; PAM sequence: TTA
agtctgatatgcttggaacg

SEQ ID NO: 172576 - DNA, 20 bp, Artificial Sequence
  Description of Artificial Sequence: Synthetic oligonucleotide
  Target: ATXN1; (-) strand; PAM type: YTN; PAM sequence: CTT
aagtctgatatgcttggaac

SEQ ID NO: 172577 - DNA, 20 bp, Artificial Sequence
  Description of Artificial Sequence: Synthetic oligonucleotide
  Target: ATXN1; (-) strand; PAM type: YTN; PAM sequence: CTA
gaaccatgaggcagaaatga

SEQ ID NO: 172578 - DNA, 20 bp, Artificial Sequence
  Description of Artificial Sequence: Synthetic oligonucleotide
  Target: ATXN1; (-) strand; PAM type: YTN; PAM sequence: TTC
tagaaccatgaggcagaaat

SEQ ID NO: 172579 - DNA, 20 bp, Artificial Sequence
  Description of Artificial Sequence: Synthetic oligonucleotide
  Target: ATXN1; (-) strand; PAM type: YTN; PAM sequence: CTT
ctagaaccatgaggcagaaa

SEQ ID NO: 172580 - DNA, 20 bp, Artificial Sequence
  Description of Artificial Sequence: Synthetic oligonucleotide
  Target: ATXN1; (-) strand; PAM type: YTN; PAM sequence: TTG
tcttctagaaccatgaggca

SEQ ID NO: 172581 - DNA, 20 bp, Artificial Sequence
  Description of Artificial Sequence: Synthetic oligonucleotide
  Target: ATXN1; (-) strand; PAM type: YTN; PAM sequence: CTT
gtcttctagaaccatgaggc

SEQ ID NO: 172582 - DNA, 20 bp, Artificial Sequence
  Description of Artificial Sequence: Synthetic oligonucleotide
  Target: ATXN1; (-) strand; PAM type: YTN; PAM sequence: CTC
ttgtcttctagaaccatgag

SEQ ID NO: 172583 - DNA, 20 bp, Artificial Sequence
  Description of Artificial Sequence: Synthetic oligonucleotide
  Target: ATXN1; (-) strand; PAM type: YTN; PAM sequence: CTC
cacctcttgtcttctagaac

SEQ ID NO: 172584 - DNA, 20 bp, Artificial Sequence
  Description of Artificial Sequence: Synthetic oligonucleotide
  Target: ATXN1; (-) strand; PAM type: YTN; PAM sequence: CTG
ccacctccacctcttgtctt

SEQ ID NO: 172585 - DNA, 20 bp, Artificial Sequence
  Description of Artificial Sequence: Synthetic oligonucleotide
  Target: ATXN1; (-) strand; PAM type: YTN; PAM sequence: TTG
ctgccacctccacctcttgt

SEQ ID NO: 172586 - DNA, 20 bp, Artificial Sequence
  Description of Artificial Sequence: Synthetic oligonucleotide
  Target: ATXN1; (-) strand; PAM type: YTN; PAM sequence: CTT
gctgccacctccacctcttg

SEQ ID NO: 172587 - DNA, 20 bp, Artificial Sequence
  Description of Artificial Sequence: Synthetic oligonucleotide
  Target: ATXN1; (-) strand; PAM type: YTN; PAM sequence: CTC
cccgcttgctgccacctcca

SEQ ID NO: 172588 - DNA, 20 bp, Artificial Sequence
  Description of Artificial Sequence: Synthetic oligonucleotide
  Target: ATXN1; (-) strand; PAM type: YTN; PAM sequence: TTC
cctccccgcttgctgccacc

SEQ ID NO: 172589 - DNA, 20 bp, Artificial Sequence
  Description of Artificial Sequence: Synthetic oligonucleotide
  Target: ATXN1; (-) strand; PAM type: YTN; PAM sequence: CTT
ccctccccgcttgctgccac

SEQ ID NO: 172590 - DNA, 20 bp, Artificial Sequence
  Description of Artificial Sequence: Synthetic oligonucleotide
  Target: ATXN1; (-) strand; PAM type: YTN; PAM sequence: TTA
tgtgtcttccctccccgctt

SEQ ID NO: 172591 - DNA, 20 bp, Artificial Sequence
  Description of Artificial Sequence: Synthetic oligonucleotide
  Target: ATXN1; (-) strand; PAM type: YTN; PAM sequence: TTA
gaaggagaattatgtgtctt

SEQ ID NO: 172592 - DNA, 20 bp, Artificial Sequence
  Description of Artificial Sequence: Synthetic oligonucleotide
  Target: ATXN1; (-) strand; PAM type: YTN; PAM sequence: TTG
agagccagagggttagaagg

SEQ ID NO: 172593 - DNA, 20 bp, Artificial Sequence
  Description of Artificial Sequence: Synthetic oligonucleotide
  Target: ATXN1; (-) strand; PAM type: YTN; PAM sequence: TTC
cggttgagagccagagggtt

SEQ ID NO: 172594 - DNA, 20 bp, Artificial Sequence
  Description of Artificial Sequence: Synthetic oligonucleotide
  Target: ATXN1; (-) strand; PAM type: YTN; PAM sequence: CTT
ccggttgagagccagagggt

SEQ ID NO: 172595 - DNA, 20 bp, Artificial Sequence
  Description of Artificial Sequence: Synthetic oligonucleotide
  Target: ATXN1; (-) strand; PAM type: YTN; PAM sequence: TTG
cttccggttgagagccagag

SEQ ID NO: 172596 - DNA, 20 bp, Artificial Sequence
  Description of Artificial Sequence: Synthetic oligonucleotide
  Target: ATXN1; (-) strand; PAM type: YTN; PAM sequence: TTG
cagagcaaaattgcttccgg

SEQ ID NO: 172597 - DNA, 20 bp, Artificial Sequence
  Description of Artificial Sequence: Synthetic oligonucleotide
  Target: ATXN1; (-) strand; PAM type: YTN; PAM sequence: CTT
gcagagcaaaattgcttccg

SEQ ID NO: 172598 - DNA, 20 bp, Artificial Sequence
  Description of Artificial Sequence: Synthetic oligonucleotide
  Target: ATXN1; (-) strand; PAM type: YTN; PAM sequence: TTC
caggtgtcccttgcagagca

SEQ ID NO: 172599 - DNA, 20 bp, Artificial Sequence
  Description of Artificial Sequence: Synthetic oligonucleotide
  Target: ATXN1; (-) strand; PAM type: YTN; PAM sequence: CTT
ccaggtgtcccttgcagagc

SEQ ID NO: 172600 - DNA, 20 bp, Artificial Sequence
  Description of Artificial Sequence: Synthetic oligonucleotide
  Target: ATXN1; (-) strand; PAM type: YTN; PAM sequence: CTC
agacacttccaggtgtccct

SEQ ID NO: 172601 - DNA, 20 bp, Artificial Sequence
  Description of Artificial Sequence: Synthetic oligonucleotide
  Target: ATXN1; (-) strand; PAM type: YTN; PAM sequence: TTG
tgacaatcaaaaatgtcctc

SEQ ID NO: 172602 - DNA, 20 bp, Artificial Sequence
  Description of Artificial Sequence: Synthetic oligonucleotide
  Target: ATXN1; (-) strand; PAM type: YTN; PAM sequence: CTG
gtagcacccggcagttgtga

SEQ ID NO: 172603 - DNA, 20 bp, Artificial Sequence
  Description of Artificial Sequence: Synthetic oligonucleotide
  Target: ATXN1; (-) strand; PAM type: YTN; PAM sequence: CTG
gatgctggtagcacccggca

SEQ ID NO: 172604 - DNA, 20 bp, Artificial Sequence
  Description of Artificial Sequence: Synthetic oligonucleotide
  Target: ATXN1; (-) strand; PAM type: YTN; PAM sequence: CTA
tgcgctggatgctggtagca

SEQ ID NO: 172605 - DNA, 20 bp, Artificial Sequence
  Description of Artificial Sequence: Synthetic oligonucleotide
  Target: ATXN1; (-) strand; PAM type: YTN; PAM sequence: CTC
tatgcgctggatgctggtag

SEQ ID NO: 172606 - DNA, 20 bp, Artificial Sequence
  Description of Artificial Sequence: Synthetic oligonucleotide
  Target: ATXN1; (-) strand; PAM type: YTN; PAM sequence: CTG
gcctctatgcgctggatgct

SEQ ID NO: 172607 - DNA, 20 bp, Artificial Sequence
  Description of Artificial Sequence: Synthetic oligonucleotide
  Target: ATXN1; (-) strand; PAM type: YTN; PAM sequence: TTC
ctggcctctatgcgctggat

SEQ ID NO: 172608 - DNA, 20 bp, Artificial Sequence
  Description of Artificial Sequence: Synthetic oligonucleotide
  Target: ATXN1; (-) strand; PAM type: YTN; PAM sequence: TTA
gcagcattcctggcctctat

SEQ ID NO: 172609 - DNA, 20 bp, Artificial Sequence
  Description of Artificial Sequence: Synthetic oligonucleotide
  Target: ATXN1; (-) strand; PAM type: YTN; PAM sequence: TTT
agcagcattcctggcctcta

SEQ ID NO: 172610 - DNA, 20 bp, Artificial Sequence
  Description of Artificial Sequence: Synthetic oligonucleotide
  Target: ATXN1; (-) strand; PAM type: YTN; PAM sequence: TTG
ggagaaatttagcagcattc

SEQ ID NO: 172611 - DNA, 20 bp, Artificial Sequence
  Description of Artificial Sequence: Synthetic oligonucleotide
  Target: ATXN1; (-) strand; PAM type: YTN; PAM sequence: TTG
gggaagcagggagatggagg

SEQ ID NO: 172612 - DNA, 20 bp, Artificial Sequence
  Description of Artificial Sequence: Synthetic oligonucleotide
  Target: ATXN1; (-) strand; PAM type: YTN; PAM sequence: TTT
ggggaagcagggagatggag

SEQ ID NO: 172613 - DNA, 20 bp, Artificial Sequence
  Description of Artificial Sequence: Synthetic oligonucleotide
  Target: ATXN1; (-) strand; PAM type: YTN; PAM sequence: CTA
tttggggaagcagggagatg

SEQ ID NO: 172614 - DNA, 20 bp, Artificial Sequence
  Description of Artificial Sequence: Synthetic oligonucleotide
  Target: ATXN1; (-) strand; PAM type: YTN; PAM sequence: TTG
gggcccagatcatcctattt

SEQ ID NO: 172615 - DNA, 20 bp, Artificial Sequence
  Description of Artificial Sequence: Synthetic oligonucleotide
  Target: ATXN1; (-) strand; PAM type: YTN; PAM sequence: TTT
ggggcccagatcatcctatt

SEQ ID NO: 172616 - DNA, 20 bp, Artificial Sequence
  Description of Artificial Sequence: Synthetic oligonucleotide
  Target: ATXN1; (-) strand; PAM type: YTN; PAM sequence: TTG
acatttggggcccagatcat

SEQ ID NO: 172617 - DNA, 20 bp, Artificial Sequence
  Description of Artificial Sequence: Synthetic oligonucleotide
  Target: ATXN1; (-) strand; PAM type: YTN; PAM sequence: CTG
ttgacatttggggcccagat

SEQ ID NO: 172618 - DNA, 20 bp, Artificial Sequence
  Description of Artificial Sequence: Synthetic oligonucleotide
  Target: ATXN1; (-) strand; PAM type: YTN; PAM sequence: CTC
aacagcactgttgacatttg

SEQ ID NO: 172619 - DNA, 20 bp, Artificial Sequence
  Description of Artificial Sequence: Synthetic oligonucleotide
  Target: ATXN1; (-) strand; PAM type: YTN; PAM sequence: TTA
gagcagggaatctcaacagc

SEQ ID NO: 172620 - DNA, 20 bp, Artificial Sequence
  Description of Artificial Sequence: Synthetic oligonucleotide
  Target: ATXN1; (-) strand; PAM type: YTN; PAM sequence: TTT
agagcagggaatctcaacag

SEQ ID NO: 172621 - DNA, 20 bp, Artificial Sequence
  Description of Artificial Sequence: Synthetic oligonucleotide
  Target: ATXN1; (-) strand; PAM type: YTN; PAM sequence: CTT
tagagcagggaatctcaaca

SEQ ID NO: 172622 - DNA, 20 bp, Artificial Sequence
  Description of Artificial Sequence: Synthetic oligonucleotide
  Target: ATXN1; (-) strand; PAM type: YTN; PAM sequence: TTC
cctttagagcagggaatctc

SEQ ID NO: 172623 - DNA, 20 bp, Artificial Sequence
  Description of Artificial Sequence: Synthetic oligonucleotide
  Target: ATXN1; (-) strand; PAM type: YTN; PAM sequence: CTT
ccctttagagcagggaatct

SEQ ID NO: 172624 - DNA, 20 bp, Artificial Sequence
  Description of Artificial Sequence: Synthetic oligonucleotide
  Target: ATXN1; (-) strand; PAM type: YTN; PAM sequence: CTG
cttccctttagagcagggaa

SEQ ID NO: 172625 - DNA, 20 bp, Artificial Sequence
  Description of Artificial Sequence: Synthetic oligonucleotide
  Target: ATXN1; (-) strand; PAM type: YTN; PAM sequence: TTC
tgcttccctttagagcaggg

SEQ ID NO: 172626 - DNA, 20 bp, Artificial Sequence
  Description of Artificial Sequence: Synthetic oligonucleotide
  Target: ATXN1; (-) strand; PAM type: YTN; PAM sequence: TTT
ctgcttccctttagagcagg

SEQ ID NO: 172627 - DNA, 20 bp, Artificial Sequence
  Description of Artificial Sequence: Synthetic oligonucleotide
  Target: ATXN1; (-) strand; PAM type: YTN; PAM sequence: TTT
tctgcttccctttagagcag

SEQ ID NO: 172628 - DNA, 20 bp, Artificial Sequence
  Description of Artificial Sequence: Synthetic oligonucleotide
  Target: ATXN1; (-) strand; PAM type: YTN; PAM sequence: CTT
ttctgcttccctttagagca

SEQ ID NO: 172629 - DNA, 20 bp, Artificial Sequence
  Description of Artificial Sequence: Synthetic oligonucleotide
  Target: ATXN1; (-) strand; PAM type: YTN; PAM sequence: CTG
atcttttctgcttcccttta

SEQ ID NO: 172630 - DNA, 20 bp, Artificial Sequence
  Description of Artificial Sequence: Synthetic oligonucleotide
  Target: ATXN1; (-) strand; PAM type: YTN; PAM sequence: CTG
cagctgatcttttctgcttc

SEQ ID NO: 172631 - DNA, 20 bp, Artificial Sequence
  Description of Artificial Sequence: Synthetic oligonucleotide
  Target: ATXN1; (-) strand; PAM type: YTN; PAM sequence: CTG
gctgcagctgatcttttctg

SEQ ID NO: 172632 - DNA, 20 bp, Artificial Sequence
  Description of Artificial Sequence: Synthetic oligonucleotide
  Target: ATXN1; (-) strand; PAM type: YTN; PAM sequence: CTC
tggctgcagctgatcttttc

SEQ ID NO: 172633 - DNA, 20 bp, Artificial Sequence
  Description of Artificial Sequence: Synthetic oligonucleotide
  Target: ATXN1; (-) strand; PAM type: YTN; PAM sequence: TTC
tctggctgcagctgatcttt

SEQ ID NO: 172634 - DNA, 20 bp, Artificial Sequence
  Description of Artificial Sequence: Synthetic oligonucleotide
  Target: ATXN1; (-) strand; PAM type: YTN; PAM sequence: TTA
gaaggtcaatggaaaattct

SEQ ID NO: 172635 - DNA, 20 bp, Artificial Sequence
  Description of Artificial Sequence: Synthetic oligonucleotide
  Target: ATXN1; (-) strand; PAM type: YTN; PAM sequence: CTC
caggagcccaggcaacagtt

SEQ ID NO: 172636 - DNA, 20 bp, Artificial Sequence
  Description of Artificial Sequence: Synthetic oligonucleotide
  Target: ATXN1; (-) strand; PAM type: YTN; PAM sequence: TTC
agaggatgtcctccaggagc

SEQ ID NO: 172637 - DNA, 20 bp, Artificial Sequence
  Description of Artificial Sequence: Synthetic oligonucleotide
  Target: ATXN1; (-) strand; PAM type: YTN; PAM sequence: CTT
cagaggatgtcctccaggag

SEQ ID NO: 172638 - DNA, 20 bp, Artificial Sequence
  Description of Artificial Sequence: Synthetic oligonucleotide
  Target: ATXN1; (-) strand; PAM type: YTN; PAM sequence: TTA
ggtcaaggaaacaagcatct

SEQ ID NO: 172639 - DNA, 20 bp, Artificial Sequence
  Description of Artificial Sequence: Synthetic oligonucleotide
  Target: ATXN1; (-) strand; PAM type: YTN; PAM sequence: TTT
aggtcaaggaaacaagcatc

SEQ ID NO: 172640 - DNA, 20 bp, Artificial Sequence
  Description of Artificial Sequence: Synthetic oligonucleotide
  Target: ATXN1; (-) strand; PAM type: YTN; PAM sequence: CTA
gcgtttaggtcaaggaaaca

SEQ ID NO: 172641 - DNA, 20 bp, Artificial Sequence
  Description of Artificial Sequence: Synthetic oligonucleotide
  Target: ATXN1; (-) strand; PAM type: YTN; PAM sequence: CTG
tgggccatggtgaggctagc

SEQ ID NO: 172642 - DNA, 20 bp, Artificial Sequence
  Description of Artificial Sequence: Synthetic oligonucleotide
  Target: ATXN1; (-) strand; PAM type: YTN; PAM sequence: CTG
ggctgtgggccatggtgagg

SEQ ID NO: 172643 - DNA, 20 bp, Artificial Sequence
  Description of Artificial Sequence: Synthetic oligonucleotide
  Target: ATXN1; (-) strand; PAM type: YTN; PAM sequence: CTG
ctgggctgtgggccatggtg

SEQ ID NO: 172644 - DNA, 20 bp, Artificial Sequence
  Description of Artificial Sequence: Synthetic oligonucleotide
  Target: ATXN1; (-) strand; PAM type: YTN; PAM sequence: CTG
atgctgctgggctgtgggcc

SEQ ID NO: 172645 - DNA, 20 bp, Artificial Sequence
  Description of Artificial Sequence: Synthetic oligonucleotide
  Target: ATXN1; (-) strand; PAM type: YTN; PAM sequence: CTA
gtgatgctgatgctgctggg

SEQ ID NO: 172646 - DNA, 20 bp, Artificial Sequence
  Description of Artificial Sequence: Synthetic oligonucleotide
  Target: ATXN1; (-) strand; PAM type: YTN; PAM sequence: CTC
cctagtgatgctgatgctgc

SEQ ID NO: 172647 - DNA, 20 bp, Artificial Sequence
  Description of Artificial Sequence: Synthetic oligonucleotide
  Target: ATXN1; (-) strand; PAM type: YTN; PAM sequence: TTC
ccacatgctccctagtgatg

SEQ ID NO: 172648 - DNA, 20 bp, Artificial Sequence
  Description of Artificial Sequence: Synthetic oligonucleotide
  Target: ATXN1; (-) strand; PAM type: YTN; PAM sequence: TTT
cccacatgctccctagtgat

SEQ ID NO: 172649 - DNA, 20 bp, Artificial Sequence
  Description of Artificial Sequence: Synthetic oligonucleotide
  Target: ATXN1; (-) strand; PAM type: YTN; PAM sequence: CTG
catttcccacatgctcccta

SEQ ID NO: 172650 - DNA, 20 bp, Artificial Sequence
  Description of Artificial Sequence: Synthetic oligonucleotide
  Target: ATXN1; (-) strand; PAM type: YTN; PAM sequence: TTC
tgcatttcccacatgctccc

SEQ ID NO: 172651 - DNA, 20 bp, Artificial Sequence
  Description of Artificial Sequence: Synthetic oligonucleotide
  Target: ATXN1; (-) strand; PAM type: YTN; PAM sequence: CTG
agattctgcatttcccacat

SEQ ID NO: 172652 - DNA, 20 bp, Artificial Sequence
  Description of Artificial Sequence: Synthetic oligonucleotide
  Target: ATXN1; (-) strand; PAM type: YTN; PAM sequence: CTG
ggtgggacctgagattctgc

SEQ ID NO: 172653 - DNA, 20 bp, Artificial Sequence
  Description of Artificial Sequence: Synthetic oligonucleotide
  Target: ATXN1; (-) strand; PAM type: YTN; PAM sequence: CTG
tcagtctgggtgggacctga

SEQ ID NO: 172654 - DNA, 20 bp, Artificial Sequence
  Description of Artificial Sequence: Synthetic oligonucleotide
  Target: ATXN1; (-) strand; PAM type: YTN; PAM sequence: TTC
tgtcagtctgggtgggacct

SEQ ID NO: 172655 - DNA, 20 bp, Artificial Sequence
  Description of Artificial Sequence: Synthetic oligonucleotide
  Target: ATXN1; (-) strand; PAM type: YTN; PAM sequence: CTG
gttctgtcagtctgggtggg

SEQ ID NO: 172656 - DNA, 20 bp, Artificial Sequence
  Description of Artificial Sequence: Synthetic oligonucleotide
  Target: ATXN1; (-) strand; PAM type: YTN; PAM sequence: TTC
tggttctgtcagtctgggtg

SEQ ID NO: 172657 - DNA, 20 bp, Artificial Sequence
  Description of Artificial Sequence: Synthetic oligonucleotide
  Target: ATXN1; (-) strand; PAM type: YTN; PAM sequence: CTA
gtggaaatgcacattctggt

SEQ ID NO: 172658 - DNA, 20 bp, Artificial Sequence
  Description of Artificial Sequence: Synthetic oligonucleotide
  Target: ATXN1; (-) strand; PAM type: YTN; PAM sequence: TTC
tagtggaaatgcacattctg

SEQ ID NO: 172659 - DNA, 20 bp, Artificial Sequence
  Description of Artificial Sequence: Synthetic oligonucleotide
  Target: ATXN1; (-) strand; PAM type: YTN; PAM sequence: CTA
ggaagcccccagcgttctag

SEQ ID NO: 172660 - DNA, 20 bp, Artificial Sequence
  Description of Artificial Sequence: Synthetic oligonucleotide
  Target: ATXN1; (-) strand; PAM type: YTN; PAM sequence: TTC
aagtgtctaggaagccccca

SEQ ID NO: 172661 - DNA, 20 bp, Artificial Sequence
  Description of Artificial Sequence: Synthetic oligonucleotide
  Target: ATXN1; (-) strand; PAM type: YTN; PAM sequence: TTT
caagtgtctaggaagccccc

SEQ ID NO: 172662 - DNA, 20 bp, Artificial Sequence
  Description of Artificial Sequence: Synthetic oligonucleotide
  Target: ATXN1; (-) strand; PAM type: YTN; PAM sequence: CTG
aaagtttcaagtgtctagga

SEQ ID NO: 172663 - DNA, 20 bp, Artificial Sequence
  Description of Artificial Sequence: Synthetic oligonucleotide
  Target: ATXN1; (-) strand; PAM type: YTN; PAM sequence: TTC
tgaaagtttcaagtgtctag

SEQ ID NO: 172664 - DNA, 20 bp, Artificial Sequence
  Description of Artificial Sequence: Synthetic oligonucleotide
  Target: ATXN1; (-) strand; PAM type: YTN; PAM sequence: CTT
ctgaaagtttcaagtgtcta

SEQ ID NO: 172665 - DNA, 20 bp, Artificial Sequence
  Description of Artificial Sequence: Synthetic oligonucleotide
  Target: ATXN1; (-) strand; PAM type: YTN; PAM sequence: CTG
gtgcttctgaaagtttcaag

SEQ ID NO: 172666 - DNA, 20 bp, Artificial Sequence
  Description of Artificial Sequence: Synthetic oligonucleotide
  Target: ATXN1; (-) strand; PAM type: YTN; PAM sequence: CTG
tctggtgcttctgaaagttt

SEQ ID NO: 172667 - DNA, 20 bp, Artificial Sequence
  Description of Artificial Sequence: Synthetic oligonucleotide
  Target: ATXN1; (-) strand; PAM type: YTN; PAM sequence: CTA
aggataggtgagagaggtct

SEQ ID NO: 172668 - DNA, 20 bp, Artificial Sequence
  Description of Artificial Sequence: Synthetic oligonucleotide
  Target: ATXN1; (-) strand; PAM type: YTN; PAM sequence: CTG
agtgaatagaaggacagaca

SEQ ID NO: 172669 - DNA, 20 bp, Artificial Sequence
  Description of Artificial Sequence: Synthetic oligonucleotide
  Target: ATXN1; (-) strand; PAM type: YTN; PAM sequence: TTA
atactgagtgaatagaagga

SEQ ID NO: 172670 - DNA, 20 bp, Artificial Sequence
  Description of Artificial Sequence: Synthetic oligonucleotide
  Target: ATXN1; (-) strand; PAM type: YTN; PAM sequence: TTC
agagggcagagtggaaataa

SEQ ID NO: 172671 - DNA, 20 bp, Artificial Sequence
  Description of Artificial Sequence: Synthetic oligonucleotide
  Target: ATXN1; (-) strand; PAM type: YTN; PAM sequence: CTG
tgtattcagagggcagagtg

SEQ ID NO: 172672 - DNA, 20 bp, Artificial Sequence
  Description of Artificial Sequence: Synthetic oligonucleotide
  Target: ATXN1; (-) strand; PAM type: YTN; PAM sequence: TTA
ctgtgtattcagagggcaga

SEQ ID NO: 172673 - DNA, 20 bp, Artificial Sequence
  Description of Artificial Sequence: Synthetic oligonucleotide
  Target: ATXN1; (-) strand; PAM type: YTN; PAM sequence: CTA
gattactgtgtattcagagg

SEQ ID NO: 172674 - DNA, 20 bp, Artificial Sequence
  Description of Artificial Sequence: Synthetic oligonucleotide
  Target: ATXN1; (-) strand; PAM type: YTN; PAM sequence: TTA
ctagattactgtgtattcag

SEQ ID NO: 172675 - DNA, 20 bp, Artificial Sequence
  Description of Artificial Sequence: Synthetic oligonucleotide
  Target: ATXN1; (-) strand; PAM type: YTN; PAM sequence: TTT
actagattactgtgtattca

SEQ ID NO: 172676 - DNA, 20 bp, Artificial Sequence
  Description of Artificial Sequence: Synthetic oligonucleotide
  Target: ATXN1; (-) strand; PAM type: YTN; PAM sequence: TTT
tactagattactgtgtattc

SEQ ID NO: 172677 - DNA, 20 bp, Artificial Sequence
  Description of Artificial Sequence: Synthetic oligonucleotide
  Target: ATXN1; (-) strand; PAM type: YTN; PAM sequence: TTT
ttactagattactgtgtatt

SEQ ID NO: 172678 - DNA, 20 bp, Artificial Sequence
  Description of Artificial Sequence: Synthetic oligonucleotide
  Target: ATXN1; (-) strand; PAM type: YTN; PAM sequence: CTT
tttactagattactgtgtat

SEQ ID NO: 172679 - DNA, 20 bp, Artificial Sequence
  Description of Artificial Sequence: Synthetic oligonucleotide
  Target: ATXN1; (-) strand; PAM type: YTN; PAM sequence: CTA
ctttttactagattactgtg

SEQ ID NO: 172680 - DNA, 20 bp, Artificial Sequence
  Description of Artificial Sequence: Synthetic oligonucleotide
  Target: ATXN1; (-) strand; PAM type: YTN; PAM sequence: CTG
aagcaagaagagagctactt

SEQ ID NO: 172681 - DNA, 20 bp, Artificial Sequence
  Description of Artificial Sequence: Synthetic oligonucleotide
  Target: ATXN1; (-) strand; PAM type: YTN; PAM sequence: CTG
aggaaaggctgaagcaagaa

SEQ ID NO: 172682 - DNA, 20 bp, Artificial Sequence
  Description of Artificial Sequence: Synthetic oligonucleotide
  Target: ATXN1; (-) strand; PAM type: YTN; PAM sequence: TTC
tgaggaaaggctgaagcaag

SEQ ID NO: 172683 - DNA, 20 bp, Artificial Sequence
  Description of Artificial Sequence: Synthetic oligonucleotide
  Target: ATXN1; (-) strand; PAM type: YTN; PAM sequence: TTG
gagagaatgttctgaggaaa

SEQ ID NO: 172684 - DNA, 20 bp, Artificial Sequence
  Description of Artificial Sequence: Synthetic oligonucleotide
  Target: ATXN1; (-) strand; PAM type: YTN; PAM sequence: CTG
ggttggagagaatgttctga

SEQ ID NO: 172685 - DNA, 20 bp, Artificial Sequence
  Description of Artificial Sequence: Synthetic oligonucleotide
  Target: ATXN1; (-) strand; PAM type: YTN; PAM sequence: TTA
cagtctgggttggagagaat

SEQ ID NO: 172686 - DNA, 20 bp, Artificial Sequence
  Description of Artificial Sequence: Synthetic oligonucleotide
  Target: ATXN1; (-) strand; PAM type: YTN; PAM sequence: CTG
cagggagccaaggttacagt

SEQ ID NO: 172687 - DNA, 20 bp, Artificial Sequence
  Description of Artificial Sequence: Synthetic oligonucleotide
  Target: ATXN1; (-) strand; PAM type: YTN; PAM sequence: CTG
tctgcagggagccaaggtta

SEQ ID NO: 172688 - DNA, 20 bp, Artificial Sequence
  Description of Artificial Sequence: Synthetic oligonucleotide
  Target: ATXN1; (-) strand; PAM type: YTN; PAM sequence: CTG
taggagaaacagggctgtct

SEQ ID NO: 172689 - DNA, 20 bp, Artificial Sequence
  Description of Artificial Sequence: Synthetic oligonucleotide
  Target: ATXN1; (-) strand; PAM type: YTN; PAM sequence: CTC
agagggctgtaggagaaaca

SEQ ID NO: 172690 - DNA, 20 bp, Artificial Sequence
  Description of Artificial Sequence: Synthetic oligonucleotide
  Target: ATXN1; (-) strand; PAM type: YTN; PAM sequence: CTC
cacctcagagggctgtagga

SEQ ID NO: 172691 - DNA, 20 bp, Artificial Sequence
  Description of Artificial Sequence: Synthetic oligonucleotide
  Target: ATXN1; (-) strand; PAM type: YTN; PAM sequence: CTC
tccacctcagagggctgtag

SEQ ID NO: 172692 - DNA, 20 bp, Artificial Sequence
  Description of Artificial Sequence: Synthetic oligonucleotide
  Target: ATXN1; (-) strand; PAM type: YTN; PAM sequence: CTC
tctccacctcagagggctgt

SEQ ID NO: 172693 - DNA, 20 bp, Artificial Sequence
  Description of Artificial Sequence: Synthetic oligonucleotide
  Target: ATXN1; (-) strand; PAM type: YTN; PAM sequence: TTG
agctctctccacctcagagg

SEQ ID NO: 172694 - DNA, 20 bp, Artificial Sequence
  Description of Artificial Sequence: Synthetic oligonucleotide
  Target: ATXN1; (-) strand; PAM type: YTN; PAM sequence: TTG
ggaggttgagctctctccac

SEQ ID NO: 172695 - DNA, 20 bp, Artificial Sequence
  Description of Artificial Sequence: Synthetic oligonucleotide
  Target: ATXN1; (-) strand; PAM type: YTN; PAM sequence: CTT
gggaggttgagctctctcca

SEQ ID NO: 172696 - DNA, 20 bp, Artificial Sequence
  Description of Artificial Sequence: Synthetic oligonucleotide
  Target: ATXN1; (-) strand; PAM type: YTN; PAM sequence: CTG
aacaggggcttgggaggttg

SEQ ID NO: 172697 - DNA, 20 bp, Artificial Sequence
  Description of Artificial Sequence: Synthetic oligonucleotide
  Target: ATXN1; (-) strand; PAM type: YTN; PAM sequence: TTC
gaatgaggatagaggaagta

SEQ ID NO: 172698 - DNA, 20 bp, Artificial Sequence
  Description of Artificial Sequence: Synthetic oligonucleotide
  Target: ATXN1; (-) strand; PAM type: YTN; PAM sequence: TTT
cgaatgaggatagaggaagt

SEQ ID NO: 172699 - DNA, 20 bp, Artificial Sequence
  Description of Artificial Sequence: Synthetic oligonucleotide
  Target: ATXN1; (-) strand; PAM type: YTN; PAM sequence: TTT
tcgaatgaggatagaggaag

SEQ ID NO: 172700 - DNA, 20 bp, Artificial Sequence
  Description of Artificial Sequence: Synthetic oligonucleotide
  Target: ATXN1; (-) strand; PAM type: YTN; PAM sequence: CTG
gccatggccacgtggtcaga

SEQ ID NO: 172701 - DNA, 20 bp, Artificial Sequence
  Description of Artificial Sequence: Synthetic oligonucleotide
  Target: ATXN1; (-) strand; PAM type: YTN; PAM sequence: TTG
caacaataaatggaagccaa

SEQ ID NO: 172702 - DNA, 20 bp, Artificial Sequence
  Description of Artificial Sequence: Synthetic oligonucleotide
  Target: ATXN1; (-) strand; PAM type: YTN; PAM sequence: CTT
gcaacaataaatggaagcca

SEQ ID NO: 172703 - DNA, 20 bp, Artificial Sequence
  Description of Artificial Sequence: Synthetic oligonucleotide
  Target: ATXN1; (-) strand; PAM type: YTN; PAM sequence: TTG
taccttgcaacaataaatgg

SEQ ID NO: 172704 - DNA, 20 bp, Artificial Sequence
  Description of Artificial Sequence: Synthetic oligonucleotide
  Target: ATXN1; (-) strand; PAM type: YTN; PAM sequence: CTT
gtaccttgcaacaataaatg

SEQ ID NO: 172705 - DNA, 20 bp, Artificial Sequence
  Description of Artificial Sequence: Synthetic oligonucleotide
  Target: ATXN1; (-) strand; PAM type: YTN; PAM sequence: TTG
aaaacttgtaccttgcaaca

SEQ ID NO: 172706 - DNA, 20 bp, Artificial Sequence
  Description of Artificial Sequence: Synthetic oligonucleotide
  Target: ATXN1; (-) strand; PAM type: YTN; PAM sequence: CTT
gaaaacttgtaccttgcaac

SEQ ID NO: 172707 - DNA, 20 bp, Artificial Sequence
  Description of Artificial Sequence: Synthetic oligonucleotide
  Target: ATXN1; (-) strand; PAM type: YTN; PAM sequence: CTG
gcttgaaaacttgtaccttg

SEQ ID NO: 172708 - DNA, 20 bp, Artificial Sequence
  Description of Artificial Sequence: Synthetic oligonucleotide
  Target: ATXN1; (-) strand; PAM type: YTN; PAM sequence: CTA
gaactggcttgaaaacttgt

SEQ ID NO: 172709 - DNA, 20 bp, Artificial Sequence
  Description of Artificial Sequence: Synthetic oligonucleotide
  Target: ATXN1; (-) strand; PAM type: YTN; PAM sequence: TTG
agggcaaataggaatgccat

SEQ ID NO: 172710 - DNA, 20 bp, Artificial Sequence
  Description of Artificial Sequence: Synthetic oligonucleotide
  Target: ATXN1; (-) strand; PAM type: YTN; PAM sequence: TTG
ggttgagggcaaataggaat

SEQ ID NO: 172711 - DNA, 20 bp, Artificial Sequence
  Description of Artificial Sequence: Synthetic oligonucleotide
  Target: ATXN1; (-) strand; PAM type: YTN; PAM sequence: TTC
cacagttgggttgagggcaa

SEQ ID NO: 172712 - DNA, 20 bp, Artificial Sequence
  Description of Artificial Sequence: Synthetic oligonucleotide
  Target: ATXN1; (-) strand; PAM type: YTN; PAM sequence: CTG
gagaattccacagttgggtt

SEQ ID NO: 172713 - DNA, 20 bp, Artificial Sequence
  Description of Artificial Sequence: Synthetic oligonucleotide
  Target: ATXN1; (-) strand; PAM type: YTN; PAM sequence: TTG
tgtaagatgtcatccacata

SEQ ID NO: 172714 - DNA, 20 bp, Artificial Sequence
  Description of Artificial Sequence: Synthetic oligonucleotide
  Target: ATXN1; (-) strand; PAM type: YTN; PAM sequence: CTT
gtgtaagatgtcatccacat

SEQ ID NO: 172715 - DNA, 20 bp, Artificial Sequence
  Description of Artificial Sequence: Synthetic oligonucleotide
  Target: ATXN1; (-) strand; PAM type: YTN; PAM sequence: TTC
ttgtgtaagatgtcatccac

SEQ ID NO: 172716 - DNA, 20 bp, Artificial Sequence
  Description of Artificial Sequence: Synthetic oligonucleotide
  Target: ATXN1; (-) strand; PAM type: YTN; PAM sequence: TTC
aggaaccaggaattcttgtg

SEQ ID NO: 172717 - DNA, 20 bp, Artificial Sequence
  Description of Artificial Sequence: Synthetic oligonucleotide
  Target: ATXN1; (-) strand; PAM type: YTN; PAM sequence: CTG
tagaaaaggttcaggaacca

SEQ ID NO: 172718 - DNA, 20 bp, Artificial Sequence
  Description of Artificial Sequence: Synthetic oligonucleotide
  Target: ATXN1; (-) strand; PAM type: YTN; PAM sequence: TTG
ccactgtagaaaaggttcag

SEQ ID NO: 172719 - DNA, 20 bp, Artificial Sequence
  Description of Artificial Sequence: Synthetic oligonucleotide
  Target: ATXN1; (-) strand; PAM type: YTN; PAM sequence: TTG
ttgccactgtagaaaaggtt

SEQ ID NO: 172720 - DNA, 20 bp, Artificial Sequence
  Description of Artificial Sequence: Synthetic oligonucleotide
  Target: ATXN1; (-) strand; PAM type: YTN; PAM sequence: CTG
aaggggaatgtggttgttgc

SEQ ID NO: 172721 - DNA, 20 bp, Artificial Sequence
  Description of Artificial Sequence: Synthetic oligonucleotide
  Target: ATXN1; (-) strand; PAM type: YTN; PAM sequence: TTC
tgaaggggaatgtggttgtt

SEQ ID NO: 172722 - DNA, 20 bp, Artificial Sequence
  Description of Artificial Sequence: Synthetic oligonucleotide
  Target: ATXN1; (-) strand; PAM type: YTN; PAM sequence: TTA
acaaatgaatgttctgaagg

SEQ ID NO: 172723 - DNA, 20 bp, Artificial Sequence
  Description of Artificial Sequence: Synthetic oligonucleotide
  Target: ATXN1; (-) strand; PAM type: YTN; PAM sequence: TTG
gattaacaaatgaatgttct

SEQ ID NO: 172724 - DNA, 20 bp, Artificial Sequence
  Description of Artificial Sequence: Synthetic oligonucleotide
  Target: ATXN1; (-) strand; PAM type: YTN; PAM sequence: TTA
gcacacagtcagatatgaaa

SEQ ID NO: 172725 - DNA, 20 bp, Artificial Sequence
  Description of Artificial Sequence: Synthetic oligonucleotide
  Target: ATXN1; (-) strand; PAM type: YTN; PAM sequence: TTT
agcacacagtcagatatgaa

SEQ ID NO: 172726 - DNA, 20 bp, Artificial Sequence
  Description of Artificial Sequence: Synthetic oligonucleotide
  Target: ATXN1; (-) strand; PAM type: YTN; PAM sequence: CTT
tagcacacagtcagatatga

SEQ ID NO: 172727 - DNA, 20 bp, Artificial Sequence
  Description of Artificial Sequence: Synthetic oligonucleotide
  Target: ATXN1; (-) strand; PAM type: YTN; PAM sequence: TTA
atatctttagcacacagtca

SEQ ID NO: 172728 - DNA, 20 bp, Artificial Sequence
  Description of Artificial Sequence: Synthetic oligonucleotide
  Target: ATXN1; (-) strand; PAM type: YTN; PAM sequence: CTT
aatatctttagcacacagtc

SEQ ID NO: 172729 - DNA, 20 bp, Artificial Sequence
  Description of Artificial Sequence: Synthetic oligonucleotide
  Target: ATXN1; (-) strand; PAM type: YTN; PAM sequence: TTG
agaacaaggacaatatggta

SEQ ID NO: 172730 - DNA, 20 bp, Artificial Sequence
  Description of Artificial Sequence: Synthetic oligonucleotide
  Target: ATXN1; (-) strand; PAM type: YTN; PAM sequence: CTC
attgagaacaaggacaatat

SEQ ID NO: 172731 - DNA, 20 bp, Artificial Sequence
  Description of Artificial Sequence: Synthetic oligonucleotide
  Target: ATXN1; (-) strand; PAM type: YTN; PAM sequence: CTG
taagctcattgagaacaagg

SEQ ID NO: 172732 - DNA, 20 bp, Artificial Sequence
  Description of Artificial Sequence: Synthetic oligonucleotide
  Target: ATXN1; (-) strand; PAM type: YTN; PAM sequence: TTA
gactgtaagctcattgagaa

SEQ ID NO: 172733 - DNA, 20 bp, Artificial Sequence
  Description of Artificial Sequence: Synthetic oligonucleotide
  Target: ATXN1; (-) strand; PAM type: YTN; PAM sequence: TTT
agactgtaagctcattgaga

SEQ ID NO: 172734 - DNA, 20 bp, Artificial Sequence
  Description of Artificial Sequence: Synthetic oligonucleotide
  Target: ATXN1; (-) strand; PAM type: YTN; PAM sequence: TTT
tagactgtaagctcattgag

SEQ ID NO: 172735 - DNA, 20 bp, Artificial Sequence
  Description of Artificial Sequence: Synthetic oligonucleotide
  Target: ATXN1; (-) strand; PAM type: YTN; PAM sequence: CTT
ttagactgtaagctcattga

SEQ ID NO: 172736 - DNA, 20 bp, Artificial Sequence
  Description of Artificial Sequence: Synthetic oligonucleotide
  Target: ATXN1; (-) strand; PAM type: YTN; PAM sequence: CTC
ttttagactgtaagctcatt

SEQ ID NO: 172737 - DNA, 20 bp, Artificial Sequence
  Description of Artificial Sequence: Synthetic oligonucleotide
  Target: ATXN1; (-) strand; PAM type: YTN; PAM sequence: CTC
cctcttttagactgtaagct

SEQ ID NO: 172738 - DNA, 20 bp, Artificial Sequence
  Description of Artificial Sequence: Synthetic oligonucleotide
  Target: ATXN1; (-) strand; PAM type: YTN; PAM sequence: CTC
cctccctcttttagactgta

SEQ ID NO: 172739 - DNA, 20 bp, Artificial Sequence
  Description of Artificial Sequence: Synthetic oligonucleotide
  Target: ATXN1; (-) strand; PAM type: YTN; PAM sequence: CTC
cctccctccctcttttagac

SEQ ID NO: 172740 - DNA, 20 bp, Artificial Sequence
  Description of Artificial Sequence: Synthetic oligonucleotide
  Target: ATXN1; (-) strand; PAM type: YTN; PAM sequence: TTC
tccctccctccctcttttag

SEQ ID NO: 172741 - DNA, 20 bp, Artificial Sequence
  Description of Artificial Sequence: Synthetic oligonucleotide
  Target: ATXN1; (-) strand; PAM type: YTN; PAM sequence: CTT
ctccctccctccctctttta

SEQ ID NO: 172742 - DNA, 20 bp, Artificial Sequence
  Description of Artificial Sequence: Synthetic oligonucleotide
  Target: ATXN1; (-) strand; PAM type: YTN; PAM sequence: CTA
gtgccaaaatacttctccct

SEQ ID NO: 172743 - DNA, 20 bp, Artificial Sequence
  Description of Artificial Sequence: Synthetic oligonucleotide
  Target: ATXN1; (-) strand; PAM type: YTN; PAM sequence: TTC
tagtgccaaaatacttctcc

SEQ ID NO: 172744 - DNA, 20 bp, Artificial Sequence
  Description of Artificial Sequence: Synthetic oligonucleotide
  Target: ATXN1; (-) strand; PAM type: YTN; PAM sequence: CTT
ctagtgccaaaatacttctc

SEQ ID NO: 172745 - DNA, 20 bp, Artificial Sequence
  Description of Artificial Sequence: Synthetic oligonucleotide
  Target: ATXN1; (-) strand; PAM type: YTN; PAM sequence: CTC
cttctagtgccaaaatactt

SEQ ID NO: 172746 - DNA, 20 bp, Artificial Sequence
  Description of Artificial Sequence: Synthetic oligonucleotide
  Target: ATXN1; (-) strand; PAM type: YTN; PAM sequence: TTC
ccgaagctccttctagtgcc

SEQ ID NO: 172747 - DNA, 20 bp, Artificial Sequence
  Description of Artificial Sequence: Synthetic oligonucleotide
  Target: ATXN1; (-) strand; PAM type: YTN; PAM sequence: TTG
taattcccgaagctccttct

SEQ ID NO: 172748 - DNA, 20 bp, Artificial Sequence
  Description of Artificial Sequence: Synthetic oligonucleotide
  Target: ATXN1; (-) strand; PAM type: YTN; PAM sequence: CTT
gtaattcccgaagctccttc

SEQ ID NO: 172749 - DNA, 20 bp, Artificial Sequence
  Description of Artificial Sequence: Synthetic oligonucleotide
  Target: ATXN1; (-) strand; PAM type: YTN; PAM sequence: CTG
gcttgtaattcccgaagctc

SEQ ID NO: 172750 - DNA, 20 bp, Artificial Sequence
  Description of Artificial Sequence: Synthetic oligonucleotide
  Target: ATXN1; (-) strand; PAM type: YTN; PAM sequence: CTC
tggcttgtaattcccgaagc

SEQ ID NO: 172751 - DNA, 20 bp, Artificial Sequence
  Description of Artificial Sequence: Synthetic oligonucleotide
  Target: ATXN1; (-) strand; PAM type: YTN; PAM sequence: TTC
tctggcttgtaattcccgaa

SEQ ID NO: 172752 - DNA, 20 bp, Artificial Sequence
  Description of Artificial Sequence: Synthetic oligonucleotide
  Target: ATXN1; (-) strand; PAM type: YTN; PAM sequence: TTT
ctctggcttgtaattcccga

SEQ ID NO: 172753 - DNA, 20 bp, Artificial Sequence
  Description of Artificial Sequence: Synthetic oligonucleotide
  Target: ATXN1; (-) strand; PAM type: YTN; PAM sequence: TTT
tctctggcttgtaattcccg

SEQ ID NO: 172754 - DNA, 20 bp, Artificial Sequence
  Description of Artificial Sequence: Synthetic oligonucleotide
  Target: ATXN1; (-) strand; PAM type: YTN; PAM sequence: CTT
ttctctggcttgtaattccc

SEQ ID NO: 172755 - DNA, 20 bp, Artificial Sequence
  Description of Artificial Sequence: Synthetic oligonucleotide
  Target: ATXN1; (-) strand; PAM type: YTN; PAM sequence: TTG
agcttttctctggcttgtaa

SEQ ID NO: 172756 - DNA, 20 bp, Artificial Sequence
  Description of Artificial Sequence: Synthetic oligonucleotide
  Target: ATXN1; (-) strand; PAM type: YTN; PAM sequence: TTT
gagcttttctctggcttgta

SEQ ID NO: 172757 - DNA, 20 bp, Artificial Sequence
  Description of Artificial Sequence: Synthetic oligonucleotide
  Target: ATXN1; (-) strand; PAM type: YTN; PAM sequence: CTT
tgagcttttctctggcttgt

SEQ ID NO: 172758 - DNA, 20 bp, Artificial Sequence
  Description of Artificial Sequence: Synthetic oligonucleotide
  Target: ATXN1; (-) strand; PAM type: YTN; PAM sequence: TTC
tttgagcttttctctggctt

SEQ ID NO: 172759 - DNA, 20 bp, Artificial Sequence
  Description of Artificial Sequence: Synthetic oligonucleotide
  Target: ATXN1; (-) strand; PAM type: YTN; PAM sequence: CTT
ctttgagcttttctctggct

SEQ ID NO: 172760 - DNA, 20 bp, Artificial Sequence
  Description of Artificial Sequence: Synthetic oligonucleotide
  Target: ATXN1; (-) strand; PAM type: YTN; PAM sequence: TTA
gccaataaaaatggccaaaa

SEQ ID NO: 172761 - DNA, 20 bp, Artificial Sequence
  Description of Artificial Sequence: Synthetic oligonucleotide
  Target: ATXN1; (-) strand; PAM type: YTN; PAM sequence: TTG
gagtgttagccaataaaaat

SEQ ID NO: 172762 - DNA, 20 bp, Artificial Sequence
  Description of Artificial Sequence: Synthetic oligonucleotide
  Target: ATXN1; (-) strand; PAM type: YTN; PAM sequence: CTG
ggttggagtgttagccaata

SEQ ID NO: 172763 - DNA, 20 bp, Artificial Sequence
  Description of Artificial Sequence: Synthetic oligonucleotide
  Target: ATXN1; (-) strand; PAM type: YTN; PAM sequence: CTA
ctgggttggagtgttagcca

SEQ ID NO: 172764 - DNA, 20 bp, Artificial Sequence
  Description of Artificial Sequence: Synthetic oligonucleotide
  Target: ATXN1; (-) strand; PAM type: YTN; PAM sequence: CTC
agaccagcatgtgggaacta

SEQ ID NO: 172765 - DNA, 20 bp, Artificial Sequence
  Description of Artificial Sequence: Synthetic oligonucleotide
  Target: ATXN1; (-) strand; PAM type: YTN; PAM sequence: TTC
tcagaccagcatgtgggaac

SEQ ID NO: 172766 - DNA, 20 bp, Artificial Sequence
  Description of Artificial Sequence: Synthetic oligonucleotide
  Target: ATXN1; (-) strand; PAM type: YTN; PAM sequence: CTG
gttctcagaccagcatgtgg

SEQ ID NO: 172767 - DNA, 20 bp, Artificial Sequence
  Description of Artificial Sequence: Synthetic oligonucleotide
  Target: ATXN1; (-) strand; PAM type: YTN; PAM sequence: TTG
gccctggttctcagaccagc

SEQ ID NO: 172768 - DNA, 20 bp, Artificial Sequence
  Description of Artificial Sequence: Synthetic oligonucleotide
  Target: ATXN1; (-) strand; PAM type: YTN; PAM sequence: TTC
cacggattggccctggttct

SEQ ID NO: 172769 - DNA, 20 bp, Artificial Sequence
  Description of Artificial Sequence: Synthetic oligonucleotide
  Target: ATXN1; (-) strand; PAM type: YTN; PAM sequence: TTT
ccacggattggccctggttc

SEQ ID NO: 172770 - DNA, 20 bp, Artificial Sequence
  Description of Artificial Sequence: Synthetic oligonucleotide
  Target: ATXN1; (-) strand; PAM type: YTN; PAM sequence: TTC
atttccacggattggccctg

SEQ ID NO: 172771 - DNA, 20 bp, Artificial Sequence
  Description of Artificial Sequence: Synthetic oligonucleotide
  Target: ATXN1; (-) strand; PAM type: YTN; PAM sequence: CTT
catttccacggattggccct

SEQ ID NO: 172772 - DNA, 20 bp, Artificial Sequence
  Description of Artificial Sequence: Synthetic oligonucleotide
  Target: ATXN1; (-) strand; PAM type: YTN; PAM sequence: TTC
ttcatttccacggattggcc

SEQ ID NO: 172773 - DNA, 20 bp, Artificial Sequence
  Description of Artificial Sequence: Synthetic oligonucleotide
  Target: ATXN1; (-) strand; PAM type: YTN; PAM sequence: TTT
cttcatttccacggattggc

SEQ ID NO: 172774 - DNA, 20 bp, Artificial Sequence
  Description of Artificial Sequence: Synthetic oligonucleotide
  Target: ATXN1; (-) strand; PAM type: YTN; PAM sequence: TTT
tcttcatttccacggattgg

SEQ ID NO: 172775 - DNA, 20 bp, Artificial Sequence
  Description of Artificial Sequence: Synthetic oligonucleotide
  Target: ATXN1; (-) strand; PAM type: YTN; PAM sequence: TTT
ttcttcatttccacggattg

SEQ ID NO: 172776 - DNA, 20 bp, Artificial Sequence
  Description of Artificial Sequence: Synthetic oligonucleotide
  Target: ATXN1; (-) strand; PAM type: YTN; PAM sequence: TTA
tttttcttcatttccacgga

SEQ ID NO: 172777 - DNA, 20 bp, Artificial Sequence
  Description of Artificial Sequence: Synthetic oligonucleotide
  Target: ATXN1; (-) strand; PAM type: YTN; PAM sequence: TTT
atttttcttcatttccacgg

SEQ ID NO: 172778 - DNA, 20 bp, Artificial Sequence
  Description of Artificial Sequence: Synthetic oligonucleotide
  Target: ATXN1; (-) strand; PAM type: YTN; PAM sequence: CTT
tatttttcttcatttccacg

SEQ ID NO: 172779 - DNA, 20 bp, Artificial Sequence
  Description of Artificial Sequence: Synthetic oligonucleotide
  Target: ATXN1; (-) strand; PAM type: YTN; PAM sequence: TTG
tctttatttttcttcatttc

SEQ ID NO: 172780 - DNA, 20 bp, Artificial Sequence
  Description of Artificial Sequence: Synthetic oligonucleotide
  Target: ATXN1; (-) strand; PAM type: YTN; PAM sequence: CTA
tgttgtctttatttttcttc

SEQ ID NO: 172781 - DNA, 20 bp, Artificial Sequence
  Description of Artificial Sequence: Synthetic oligonucleotide
  Target: ATXN1; (-) strand; PAM type: YTN; PAM sequence: TTA
ctatgttgtctttatttttc

SEQ ID NO: 172782 - DNA, 20 bp, Artificial Sequence
  Description of Artificial Sequence: Synthetic oligonucleotide
  Target: ATXN1; (-) strand; PAM type: YTN; PAM sequence: TTT
actatgttgtctttattttt

SEQ ID NO: 172783 - DNA, 20 bp, Artificial Sequence
  Description of Artificial Sequence: Synthetic oligonucleotide
  Target: ATXN1; (-) strand; PAM type: YTN; PAM sequence: TTA
tggtacatttactatgttgt

SEQ ID NO: 172784 - DNA, 20 bp, Artificial Sequence
  Description of Artificial Sequence: Synthetic oligonucleotide
  Target: ATXN1; (-) strand; PAM type: YTN; PAM sequence: TTA
atattatggtacatttacta

SEQ ID NO: 172785 - DNA, 20 bp, Artificial Sequence
  Description of Artificial Sequence: Synthetic oligonucleotide
  Target: ATXN1; (-) strand; PAM type: YTN; PAM sequence: TTT
aatattatggtacatttact

SEQ ID NO: 172786 - DNA, 20 bp, Artificial Sequence
  Description of Artificial Sequence: Synthetic oligonucleotide
  Target: ATXN1; (-) strand; PAM type: YTN; PAM sequence: CTA
gaaatttaatattatggtac

SEQ ID NO: 172787 - DNA, 20 bp, Artificial Sequence
  Description of Artificial Sequence: Synthetic oligonucleotide
  Target: ATXN1; (-) strand; PAM type: YTN; PAM sequence: TTA
acatccccaaagtgaaaata

SEQ ID NO: 172788 - DNA, 20 bp, Artificial Sequence
  Description of Artificial Sequence: Synthetic oligonucleotide
  Target: ATXN1; (-) strand; PAM type: YTN; PAM sequence: TTT
aacatccccaaagtgaaaat

SEQ ID NO: 172789 - DNA, 20 bp, Artificial Sequence
  Description of Artificial Sequence: Synthetic oligonucleotide
  Target: ATXN1; (-) strand; PAM type: YTN; PAM sequence: TTT
taacatccccaaagtgaaaa

SEQ ID NO: 172790 - DNA, 20 bp, Artificial Sequence
  Description of Artificial Sequence: Synthetic oligonucleotide
  Target: ATXN1; (-) strand; PAM type: YTN; PAM sequence: TTA
aaaaggaagggatattttaa

SEQ ID NO: 172791 - DNA, 20 bp, Artificial Sequence
  Description of Artificial Sequence: Synthetic oligonucleotide
  Target: ATXN1; (-) strand; PAM type: YTN; PAM sequence: TTT
aaaaaggaagggatatttta

SEQ ID NO: 172792 - DNA, 20 bp, Artificial Sequence
  Description of Artificial Sequence: Synthetic oligonucleotide
  Target: ATXN1; (-) strand; PAM type: YTN; PAM sequence: TTT
taaaaaggaagggatatttt

SEQ ID NO: 172793 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaggaagggatattt

SEQ ID NO: 172794 - DNA, 20 bp, Artificial Sequence
  Description of Artificial Sequence: Synthetic oligonucleotide
  Target: ATXN1; (-) strand; PAM type: YTN; PAM sequence: CTT
tttaaaaaggaagggatatt

SEQ ID NO: 172795 - DNA, 20 bp, Artificial Sequence
  Description of Artificial Sequence: Synthetic oligonucleotide
  Target: ATXN1; (-) strand; PAM type: YTN; PAM sequence: CTA
atctttttaaaaaggaaggg

SEQ ID NO: 172796 - DNA, 20 bp, Artificial Sequence
  Description of Artificial Sequence: Synthetic oligonucleotide
  Target: ATXN1; (-) strand; PAM type: YTN; PAM sequence: TTC
taatctttttaaaaaggaag

SEQ ID NO: 172797 - DNA, 20 bp, Artificial Sequence
  Description of Artificial Sequence: Synthetic oligonucleotide
  Target: ATXN1; (-) strand; PAM type: YTN; PAM sequence: TTT
ctaatctttttaaaaaggaa

SEQ ID NO: 172798 - DNA, 20 bp, Artificial Sequence
  Description of Artificial Sequence: Synthetic oligonucleotide
  Target: ATXN1; (-) strand; PAM type: YTN; PAM sequence: TTT
tctaatctttttaaaaagga

SEQ ID NO: 172799 - DNA, 20 bp, Artificial Sequence
  Description of Artificial Sequence: Synthetic oligonucleotide
  Target: ATXN1; (-) strand; PAM type: YTN; PAM sequence: TTA
aaataagttttctaatcttt

SEQ ID NO: 172800 - DNA, 20 bp, Artificial Sequence
  Description of Artificial Sequence: Synthetic oligonucleotide
  Target: ATXN1; (-) strand; PAM type: YTN; PAM sequence: TTT
aaaataagttttctaatctt

SEQ ID NO: 172801 - DNA, 20 bp, Artificial Sequence
  Description of Artificial Sequence: Synthetic oligonucleotide
  Target: ATXN1; (-) strand; PAM type: YTN; PAM sequence: CTT
taaaataagttttctaatct

SEQ ID NO: 172802 - DNA, 20 bp, Artificial Sequence
  Description of Artificial Sequence: Synthetic oligonucleotide
  Target: ATXN1; (-) strand; PAM type: YTN; PAM sequence: CTG
gacactttaaaataagtttt

SEQ ID NO: 172803 - DNA, 20 bp, Artificial Sequence
  Description of Artificial Sequence: Synthetic oligonucleotide
  Target: ATXN1; (-) strand; PAM type: YTN; PAM sequence: TTA
atgtaaggacactggacact

SEQ ID NO: 172804 - DNA, 20 bp, Artificial Sequence
  Description of Artificial Sequence: Synthetic oligonucleotide
  Target: ATXN1; (-) strand; PAM type: YTN; PAM sequence: TTT
aatgtaaggacactggacac

SEQ ID NO: 172805 - DNA, 20 bp, Artificial Sequence
  Description of Artificial Sequence: Synthetic oligonucleotide
  Target: ATXN1; (-) strand; PAM type: YTN; PAM sequence: TTT
taatgtaaggacactggaca

SEQ ID NO: 172806 - DNA, 20 bp, Artificial Sequence
  Description of Artificial Sequence: Synthetic oligonucleotide
  Target: ATXN1; (-) strand; PAM type: YTN; PAM sequence: TTA
ttttaatgtaaggacactgg

SEQ ID NO: 172807 - DNA, 20 bp, Artificial Sequence
  Description of Artificial Sequence: Synthetic oligonucleotide
  Target: ATXN1; (-) strand; PAM type: YTN; PAM sequence: TTT
attttaatgtaaggacactg

SEQ ID NO: 172808 - DNA, 20 bp, Artificial Sequence
  Description of Artificial Sequence: Synthetic oligonucleotide
  Target: ATXN1; (-) strand; PAM type: YTN; PAM sequence: CTT
tattttaatgtaaggacact

SEQ ID NO: 172809 - DNA, 20 bp, Artificial Sequence
  Description of Artificial Sequence: Synthetic oligonucleotide
  Target: ATXN1; (-) strand; PAM type: YTN; PAM sequence: CTC
tttattttaatgtaaggaca

SEQ ID NO: 172810 - DNA, 20 bp, Artificial Sequence
  Description of Artificial Sequence: Synthetic oligonucleotide
  Target: ATXN1; (-) strand; PAM type: YTN; PAM sequence: CTA
gcatatgtgggtcaactctt

SEQ ID NO: 172811 - DNA, 20 bp, Artificial Sequence
  Description of Artificial Sequence: Synthetic oligonucleotide
  Target: ATXN1; (-) strand; PAM type: YTN; PAM sequence: TTA
atggggtactagcatatgtg

SEQ ID NO: 172812 - DNA, 20 bp, Artificial Sequence
  Description of Artificial Sequence: Synthetic oligonucleotide
  Target: ATXN1; (-) strand; PAM type: YTN; PAM sequence: TTA
gaaaattaatggggtactag

SEQ ID NO: 172813 - DNA, 20 bp, Artificial Sequence
  Description of Artificial Sequence: Synthetic oligonucleotide
  Target: ATXN1; (-) strand; PAM type: YTN; PAM sequence: TTT
agaaaattaatggggtacta

SEQ ID NO: 172814 - DNA, 20 bp, Artificial Sequence
  Description of Artificial Sequence: Synthetic oligonucleotide
  Target: ATXN1; (-) strand; PAM type: YTN; PAM sequence: TTT
tagaaaattaatggggtact

SEQ ID NO: 172815 - DNA, 20 bp, Artificial Sequence
  Description of Artificial Sequence: Synthetic oligonucleotide
  Target: ATXN1; (-) strand; PAM type: YTN; PAM sequence: TTC
aaggatgagttttagaaaat

SEQ ID NO: 172816 - DNA, 20 bp, Artificial Sequence
  Description of Artificial Sequence: Synthetic oligonucleotide
  Target: ATXN1; (-) strand; PAM type: YTN; PAM sequence: TTT
caaggatgagttttagaaaa

SEQ ID NO: 172817 - DNA, 20 bp, Artificial Sequence
  Description of Artificial Sequence: Synthetic oligonucleotide
  Target: ATXN1; (-) strand; PAM type: YTN; PAM sequence: TTC
caggtttcaaggatgagttt

SEQ ID NO: 172818 - DNA, 20 bp, Artificial Sequence
  Description of Artificial Sequence: Synthetic oligonucleotide
  Target: ATXN1; (-) strand; PAM type: YTN; PAM sequence: CTT
ccaggtttcaaggatgagtt

SEQ ID NO: 172819 - DNA, 20 bp, Artificial Sequence
  Description of Artificial Sequence: Synthetic oligonucleotide
  Target: ATXN1; (-) strand; PAM type: YTN; PAM sequence: CTG
gaaagccacttccaggtttc

SEQ ID NO: 172820 - DNA, 20 bp, Artificial Sequence
  Description of Artificial Sequence: Synthetic oligonucleotide
  Target: ATXN1; (-) strand; PAM type: YTN; PAM sequence: CTC
ccatgtagacctggaaagcc

SEQ ID NO: 172821 - DNA, 20 bp, Artificial Sequence
  Description of Artificial Sequence: Synthetic oligonucleotide
  Target: ATXN1; (-) strand; PAM type: YTN; PAM sequence: CTA
agcaagcccctcccatgtag

SEQ ID NO: 172822 - DNA, 20 bp, Artificial Sequence
  Description of Artificial Sequence: Synthetic oligonucleotide
  Target: ATXN1; (-) strand; PAM type: YTN; PAM sequence: CTG
gcctaagcaagcccctccca

SEQ ID NO: 172823 - DNA, 20 bp, Artificial Sequence
  Description of Artificial Sequence: Synthetic oligonucleotide
  Target: ATXN1; (-) strand; PAM type: YTN; PAM sequence: CTG
tccctggcctaagcaagccc

SEQ ID NO: 172824 - DNA, 20 bp, Artificial Sequence
  Description of Artificial Sequence: Synthetic oligonucleotide
  Target: ATXN1; (-) strand; PAM type: YTN; PAM sequence: CTA
caaccagactgtccctggcc

SEQ ID NO: 172825 - DNA, 20 bp, Artificial Sequence
  Description of Artificial Sequence: Synthetic oligonucleotide
  Target: ATXN1; (-) strand; PAM type: YTN; PAM sequence: CTC
gctacaaccagactgtccct

SEQ ID NO: 172826 - DNA, 20 bp, Artificial Sequence
  Description of Artificial Sequence: Synthetic oligonucleotide
  Target: ATXN1; (-) strand; PAM type: YTN; PAM sequence: TTG
ccaaccctcgctacaaccag

SEQ ID NO: 172827 - DNA, 20 bp, Artificial Sequence
  Description of Artificial Sequence: Synthetic oligonucleotide
  Target: ATXN1; (-) strand; PAM type: YTN; PAM sequence: CTT
gccaaccctcgctacaacca

SEQ ID NO: 172828 - DNA, 20 bp, Artificial Sequence
  Description of Artificial Sequence: Synthetic oligonucleotide
  Target: ATXN1; (-) strand; PAM type: YTN; PAM sequence: TTC
aaagcaagtcttgccaaccc

SEQ ID NO: 172829 - DNA, 20 bp, Artificial Sequence
  Description of Artificial Sequence: Synthetic oligonucleotide
  Target: ATXN1; (-) strand; PAM type: YTN; PAM sequence: CTT
caaagcaagtcttgccaacc

SEQ ID NO: 172830 - DNA, 20 bp, Artificial Sequence
  Description of Artificial Sequence: Synthetic oligonucleotide
  Target: ATXN1; (-) strand; PAM type: YTN; PAM sequence: TTG
tgtaaagagacgggcaaatg

SEQ ID NO: 172831 - DNA, 20 bp, Artificial Sequence
  Description of Artificial Sequence: Synthetic oligonucleotide
  Target: ATXN1; (-) strand; PAM type: YTN; PAM sequence: TTC
ccatgttgtgtaaagagacg

SEQ ID NO: 172832 - DNA, 20 bp, Artificial Sequence
  Description of Artificial Sequence: Synthetic oligonucleotide
  Target: ATXN1; (-) strand; PAM type: YTN; PAM sequence: CTT
cccatgttgtgtaaagagac

SEQ ID NO: 172833 - DNA, 20 bp, Artificial Sequence
  Description of Artificial Sequence: Synthetic oligonucleotide
  Target: ATXN1; (-) strand; PAM type: YTN; PAM sequence: TTA
atgacttcccatgttgtgta

SEQ ID NO: 172834 - DNA, 20 bp, Artificial Sequence
  Description of Artificial Sequence: Synthetic oligonucleotide
  Target: ATXN1; (-) strand; PAM type: YTN; PAM sequence: TTA
tgaagaacaattaatgactt

SEQ ID NO: 172835 - DNA, 20 bp, Artificial Sequence
  Description of Artificial Sequence: Synthetic oligonucleotide
  Target: ATXN1; (-) strand; PAM type: YTN; PAM sequence: TTT
atgaagaacaattaatgact

SEQ ID NO: 172836 - DNA, 20 bp, Artificial Sequence
  Description of Artificial Sequence: Synthetic oligonucleotide
  Target: ATXN1; (-) strand; PAM type: YTN; PAM sequence: TTT
tatgaagaacaattaatgac

SEQ ID NO: 172837 - DNA, 20 bp, Artificial Sequence
  Description of Artificial Sequence: Synthetic oligonucleotide
  Target: ATXN1; (-) strand; PAM type: YTN; PAM sequence: CTT
ttatgaagaacaattaatga

SEQ ID NO: 172838 - DNA, 20 bp, Artificial Sequence
  Description of Artificial Sequence: Synthetic oligonucleotide
  Target: ATXN1; (-) strand; PAM type: YTN; PAM sequence: TTG
aatcttttatgaagaacaat

SEQ ID NO: 172839 - DNA, 20 bp, Artificial Sequence
  Description of Artificial Sequence: Synthetic oligonucleotide
  Target: ATXN1; (-) strand; PAM type: YTN; PAM sequence: TTG
gcacattgaatcttttatga

SEQ ID NO: 172840 - DNA, 20 bp, Artificial Sequence
  Description of Artificial Sequence: Synthetic oligonucleotide
  Target: ATXN1; (-) strand; PAM type: YTN; PAM sequence: CTT
ggcacattgaatcttttatg

SEQ ID NO: 172841 - DNA, 20 bp, Artificial Sequence
  Description of Artificial Sequence: Synthetic oligonucleotide
  Target: ATXN1; (-) strand; PAM type: YTN; PAM sequence: TTG
acttggcacattgaatcttt

SEQ ID NO: 172842 - DNA, 20 bp, Artificial Sequence
  Description of Artificial Sequence: Synthetic oligonucleotide
  Target: ATXN1; (-) strand; PAM type: YTN; PAM sequence: CTT
gacttggcacattgaatctt

SEQ ID NO: 172843 - DNA, 20 bp, Artificial Sequence
  Description of Artificial Sequence: Synthetic oligonucleotide
  Target: ATXN1; (-) strand; PAM type: YTN; PAM sequence: CTG
gtcccccaggcttgacttgg

SEQ ID NO: 172844 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagcctggtcccc

SEQ ID NO: 172845 - DNA, 20 bp, Artificial Sequence
  Description of Artificial Sequence: Synthetic oligonucleotide
  Target: ATXN1; (-) strand; PAM type: YTN; PAM sequence: TTC
ccaaaacaccaggattacag

SEQ ID NO: 172846 - DNA, 20 bp, Artificial Sequence
  Description of Artificial Sequence: Synthetic oligonucleotide
  Target: ATXN1; (-) strand; PAM type: YTN; PAM sequence: CTT
cccaaaacaccaggattaca

SEQ ID NO: 172847 - DNA, 20 bp, Artificial Sequence
  Description of Artificial Sequence: Synthetic oligonucleotide
  Target: ATXN1; (-) strand; PAM type: YTN; PAM sequence: CTC
agcttcccaaaacaccagga

SEQ ID NO: 172848 - DNA, 20 bp, Artificial Sequence
  Description of Artificial Sequence: Synthetic oligonucleotide
  Target: ATXN1; (-) strand; PAM type: YTN; PAM sequence: CTG
cctcagcttcccaaaacacc

SEQ ID NO: 172849 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcttcccaaaac

SEQ ID NO: 172850 - DNA, 20 bp, Artificial Sequence
  Description of Artificial Sequence: Synthetic oligonucleotide
  Target: ATXN1; (-) strand; PAM type: YTN; PAM sequence: CTG
gtgtcaagtgatcctcctgc

SEQ ID NO: 172851 - DNA, 20 bp, Artificial Sequence
  Description of Artificial Sequence: Synthetic oligonucleotide
  Target: ATXN1; (-) strand; PAM type: YTN; PAM sequence: CTC
ctggtgtcaagtgatcctcc

SEQ ID NO: 172852 - DNA, 20 bp, Artificial Sequence
  Description of Artificial Sequence: Synthetic oligonucleotide
  Target: ATXN1; (-) strand; PAM type: YTN; PAM sequence: TTG
acctcctggtgtcaagtgat

SEQ ID NO: 172853 - DNA, 20 bp, Artificial Sequence
  Description of Artificial Sequence: Synthetic oligonucleotide
  Target: ATXN1; (-) strand; PAM type: YTN; PAM sequence: CTT
gacctcctggtgtcaagtga

SEQ ID NO: 172854 - DNA, 20 bp, Artificial Sequence
  Description of Artificial Sequence: Synthetic oligonucleotide
  Target: ATXN1; (-) strand; PAM type: YTN; PAM sequence: CTG
atcttgacctcctggtgtca

SEQ ID NO: 172855 - DNA, 20 bp, Artificial Sequence
  Description of Artificial Sequence: Synthetic oligonucleotide
  Target: ATXN1; (-) strand; PAM type: YTN; PAM sequence: CTC
cggctgatcttgacctcctg

SEQ ID NO: 172856 - DNA, 20 bp, Artificial Sequence
  Description of Artificial Sequence: Synthetic oligonucleotide
  Target: ATXN1; (-) strand; PAM type: YTN; PAM sequence: TTC
tccggctgatcttgacctcc

SEQ ID NO: 172857 - DNA, 20 bp, Artificial Sequence
  Description of Artificial Sequence: Synthetic oligonucleotide
  Target: ATXN1; (-) strand; PAM type: YTN; PAM sequence: TTT
ctccggctgatcttgacctc

SEQ ID NO: 172858 - DNA, 20 bp, Artificial Sequence
  Description of Artificial Sequence: Synthetic oligonucleotide
  Target: ATXN1; (-) strand; PAM type: YTN; PAM sequence: TTG
tttctccggctgatcttgac

SEQ ID NO: 172859 - DNA, 20 bp, Artificial Sequence
  Description of Artificial Sequence: Synthetic oligonucleotide
  Target: ATXN1; (-) strand; PAM type: YTN; PAM sequence: CTT
gtttctccggctgatcttga

SEQ ID NO: 172860 - DNA, 20 bp, Artificial Sequence
  Description of Artificial Sequence: Synthetic oligonucleotide
  Target: ATXN1; (-) strand; PAM type: YTN; PAM sequence: CTC
accttgtttctccggctgat

SEQ ID NO: 172861 - DNA, 20 bp, Artificial Sequence
  Description of Artificial Sequence: Synthetic oligonucleotide
  Target: ATXN1; (-) strand; PAM type: YTN; PAM sequence: TTA
gagtcaagggtctcaccttg

SEQ ID NO: 172862 - DNA, 20 bp, Artificial Sequence
  Description of Artificial Sequence: Synthetic oligonucleotide
  Target: ATXN1; (-) strand; PAM type: YTN; PAM sequence: TTT
agagtcaagggtctcacctt

SEQ ID NO: 172863 - DNA, 20 bp, Artificial Sequence
  Description of Artificial Sequence: Synthetic oligonucleotide
  Target: ATXN1; (-) strand; PAM type: YTN; PAM sequence: TTT
tagagtcaagggtctcacct

SEQ ID NO: 172864 - DNA, 20 bp, Artificial Sequence
  Description of Artificial Sequence: Synthetic oligonucleotide
  Target: ATXN1; (-) strand; PAM type: YTN; PAM sequence: TTT
ttagagtcaagggtctcacc

SEQ ID NO: 172865 - DNA, 20 bp, Artificial Sequence
  Description of Artificial Sequence: Synthetic oligonucleotide
  Target: ATXN1; (-) strand; PAM type: YTN; PAM sequence: TTT
tttagagtcaagggtctcac

SEQ ID NO: 172866 - DNA, 20 bp, Artificial Sequence
  Description of Artificial Sequence: Synthetic oligonucleotide
  Target: ATXN1; (-) strand; PAM type: YTN; PAM sequence: TTA
tgttttttagagtcaagggt

SEQ ID NO: 172867 - DNA, 20 bp, Artificial Sequence
  Description of Artificial Sequence: Synthetic oligonucleotide
  Target: ATXN1; (-) strand; PAM type: YTN; PAM sequence: TTA
aattatgttttttagagtca

SEQ ID NO: 172868 - DNA, 20 bp, Artificial Sequence
  Description of Artificial Sequence: Synthetic oligonucleotide
  Target: ATXN1; (-) strand; PAM type: YTN; PAM sequence: TTT
aaattatgttttttagagtc

SEQ ID NO: 172869 - DNA, 20 bp, Artificial Sequence
  Description of Artificial Sequence: Synthetic oligonucleotide
  Target: ATXN1; (-) strand; PAM type: YTN; PAM sequence: TTT
taaattatgttttttagagt

SEQ ID NO: 172870 - DNA, 20 bp, Artificial Sequence
  Description of Artificial Sequence: Synthetic oligonucleotide
  Target: ATXN1; (-) strand; PAM type: YTN; PAM sequence: TTT
ttaaattatgttttttagag

SEQ ID NO: 172871 - DNA, 20 bp, Artificial Sequence
  Description of Artificial Sequence: Synthetic oligonucleotide
  Target: ATXN1; (-) strand; PAM type: YTN; PAM sequence: TTA
aatttttaaattatgttttt

SEQ ID NO: 172872 - DNA, 20 bp, Artificial Sequence
  Description of Artificial Sequence: Synthetic oligonucleotide
  Target: ATXN1; (-) strand; PAM type: YTN; PAM sequence: TTT
aaatttttaaattatgtttt

SEQ ID NO: 172873 - DNA, 20 bp, Artificial Sequence
  Description of Artificial Sequence: Synthetic oligonucleotide
  Target: ATXN1; (-) strand; PAM type: YTN; PAM sequence: TTT
taaatttttaaattatgttt

SEQ ID NO: 172874 - DNA, 20 bp, Artificial Sequence
  Description of Artificial Sequence: Synthetic oligonucleotide
  Target: ATXN1; (-) strand; PAM type: YTN; PAM sequence: TTT
ttaaatttttaaattatgtt

SEQ ID NO: 172875 - DNA, 20 bp, Artificial Sequence
  Description of Artificial Sequence: Synthetic oligonucleotide
  Target: ATXN1; (-) strand; PAM type: YTN; PAM sequence: TTT
tttaaatttttaaattatgt

SEQ ID NO: 172876 - DNA, 20 bp, Artificial Sequence
  Description of Artificial Sequence: Synthetic oligonucleotide
  Target: ATXN1; (-) strand; PAM type: YTN; PAM sequence: TTT
ttttaaatttttaaattatg

SEQ ID NO: 172877 - DNA, 20 bp, Artificial Sequence
  Description of Artificial Sequence: Synthetic oligonucleotide
  Target: ATXN1; (-) strand; PAM type: YTN; PAM sequence: TTT
tttttaaatttttaaattat

SEQ ID NO: 172878 - DNA, 20 bp, Artificial Sequence
  Description of Artificial Sequence: Synthetic oligonucleotide
  Target: ATXN1; (-) strand; PAM type: YTN; PAM sequence: CTA
ttttttttaaatttttaaat

SEQ ID NO: 172879 - DNA, 20 bp, Artificial Sequence
  Description of Artificial Sequence: Synthetic oligonucleotide
  Target: ATXN1; (-) strand; PAM type: YTN; PAM sequence: CTG
caggcacatgtaccacaccc

SEQ ID NO: 172880 - DNA, 20 bp, Artificial Sequence
  Description of Artificial Sequence: Synthetic oligonucleotide
  Target: ATXN1; (-) strand; PAM type: YTN; PAM sequence: CTG
ggactgcaggcacatgtacc

SEQ ID NO: 172881 - DNA, 20 bp, Artificial Sequence
  Description of Artificial Sequence: Synthetic oligonucleotide
  Target: ATXN1; (-) strand; PAM type: YTN; PAM sequence: CTG
agtagctgggactgcaggca

SEQ ID NO: 172882 - DNA, 20 bp, Artificial Sequence
  Description of Artificial Sequence: Synthetic oligonucleotide
  Target: ATXN1; (-) strand; PAM type: YTN; PAM sequence: CTC
tgagtagctgggactgcagg

SEQ ID NO: 172883 - DNA, 20 bp, Artificial Sequence
  Description of Artificial Sequence: Synthetic oligonucleotide
  Target: ATXN1; (-) strand; PAM type: YTN; PAM sequence: CTC
agcctctgagtagctgggac

SEQ ID NO: 172884 - DNA, 20 bp, Artificial Sequence
  Description of Artificial Sequence: Synthetic oligonucleotide
  Target: ATXN1; (-) strand; PAM type: YTN; PAM sequence: CTC
caccctcagcctctgagtag

SEQ ID NO: 172885 - DNA, 20 bp, Artificial Sequence
  Description of Artificial Sequence: Synthetic oligonucleotide
  Target: ATXN1; (-) strand; PAM type: YTN; PAM sequence: TTC
tccaccctcagcctctgagt

SEQ ID NO: 172886 - DNA, 20 bp, Artificial Sequence
  Description of Artificial Sequence: Synthetic oligonucleotide
  Target: ATXN1; (-) strand; PAM type: YTN; PAM sequence: CTC
aagcgattctccaccctcag

SEQ ID NO: 172887 - DNA, 20 bp, Artificial Sequence
  Description of Artificial Sequence: Synthetic oligonucleotide
  Target: ATXN1; (-) strand; PAM type: YTN; PAM sequence: CTC
tcaagcgattctccaccctc

SEQ ID NO: 172888 - DNA, 20 bp, Artificial Sequence
  Description of Artificial Sequence: Synthetic oligonucleotide
  Target: ATXN1; (-) strand; PAM type: YTN; PAM sequence: CTC
tctcaagcgattctccaccc

SEQ ID NO: 172889 - DNA, 20 bp, Artificial Sequence
  Description of Artificial Sequence: Synthetic oligonucleotide
  Target: ATXN1; (-) strand; PAM type: YTN; PAM sequence: CTA
gccacagctctctcaagcga

SEQ ID NO: 172890 - DNA, 20 bp, Artificial Sequence
  Description of Artificial Sequence: Synthetic oligonucleotide
  Target: ATXN1; (-) strand; PAM type: YTN; PAM sequence: CTA
aaagtcctagccacagctct

SEQ ID NO: 172891 - DNA, 20 bp, Artificial Sequence
  Description of Artificial Sequence: Synthetic oligonucleotide
  Target: ATXN1; (-) strand; PAM type: YTN; PAM sequence: CTG
ccccaactaaaagtcctagc

SEQ ID NO: 172892 - DNA, 20 bp, Artificial Sequence
  Description of Artificial Sequence: Synthetic oligonucleotide
  Target: ATXN1; (-) strand; PAM type: YTN; PAM sequence: TTC
atctgccccaactaaaagtc

SEQ ID NO: 172893 - DNA, 20 bp, Artificial Sequence
  Description of Artificial Sequence: Synthetic oligonucleotide
  Target: ATXN1; (-) strand; PAM type: YTN; PAM sequence: TTT
catctgccccaactaaaagt

SEQ ID NO: 172894 - DNA, 20 bp, Artificial Sequence
  Description of Artificial Sequence: Synthetic oligonucleotide
  Target: ATXN1; (-) strand; PAM type: YTN; PAM sequence: TTA
gaccatttcatctgccccaa

SEQ ID NO: 172895 - DNA, 20 bp, Artificial Sequence
  Description of Artificial Sequence: Synthetic oligonucleotide
  Target: ATXN1; (-) strand; PAM type: YTN; PAM sequence: CTT
agaccatttcatctgcccca

SEQ ID NO: 172896 - DNA, 20 bp, Artificial Sequence
  Description of Artificial Sequence: Synthetic oligonucleotide
  Target: ATXN1; (-) strand; PAM type: YTN; PAM sequence: CTA
accttagaccatttcatctg

SEQ ID NO: 172897 - DNA, 20 bp, Artificial Sequence
  Description of Artificial Sequence: Synthetic oligonucleotide
  Target: ATXN1; (-) strand; PAM type: YTN; PAM sequence: CTG
tctaaccttagaccatttca

SEQ ID NO: 172898 - DNA, 20 bp, Artificial Sequence
  Description of Artificial Sequence: Synthetic oligonucleotide
  Target: ATXN1; (-) strand; PAM type: YTN; PAM sequence: TTG
ctgtctaaccttagaccatt

SEQ ID NO: 172899 - DNA, 20 bp, Artificial Sequence
  Description of Artificial Sequence: Synthetic oligonucleotide
  Target: ATXN1; (-) strand; PAM type: YTN; PAM sequence: TTG
ttgctgtctaaccttagacc

SEQ ID NO: 172900 - DNA, 20 bp, Artificial Sequence
  Description of Artificial Sequence: Synthetic oligonucleotide
  Target: ATXN1; (-) strand; PAM type: YTN; PAM sequence: TTT
gttgctgtctaaccttagac

SEQ ID NO: 172901 - DNA, 20 bp, Artificial Sequence
  Description of Artificial Sequence: Synthetic oligonucleotide
  Target: ATXN1; (-) strand; PAM type: YTN; PAM sequence: TTT
tgttgctgtctaaccttaga

SEQ ID NO: 172902 - DNA, 20 bp, Artificial Sequence
  Description of Artificial Sequence: Synthetic oligonucleotide
  Target: ATXN1; (-) strand; PAM type: YTN; PAM sequence: TTT
ttgttgctgtctaaccttag

SEQ ID NO: 172903 - DNA, 20 bp, Artificial Sequence
  Description of Artificial Sequence: Synthetic oligonucleotide
  Target: ATXN1; (-) strand; PAM type: YTN; PAM sequence: TTG
tttttgttgctgtctaacct

SEQ ID NO: 172904 - DNA, 20 bp, Artificial Sequence
  Description of Artificial Sequence: Synthetic oligonucleotide
  Target: ATXN1; (-) strand; PAM type: YTN; PAM sequence: CTG
ccaaagttgtttttgttgct

SEQ ID NO: 172905 - DNA, 20 bp, Artificial Sequence
  Description of Artificial Sequence: Synthetic oligonucleotide
  Target: ATXN1; (-) strand; PAM type: YTN; PAM sequence: TTC
ccaatggaggcaaaatctgc

SEQ ID NO: 172906 - DNA, 20 bp, Artificial Sequence
  Description of Artificial Sequence: Synthetic oligonucleotide
  Target: ATXN1; (-) strand; PAM type: YTN; PAM sequence: CTT
cccaatggaggcaaaatctg

SEQ ID NO: 172907 - DNA, 20 bp, Artificial Sequence
  Description of Artificial Sequence: Synthetic oligonucleotide
  Target: ATXN1; (-) strand; PAM type: YTN; PAM sequence: CTC
ttcccaatggaggcaaaatc

SEQ ID NO: 172908 - DNA, 20 bp, Artificial Sequence
  Description of Artificial Sequence: Synthetic oligonucleotide
  Target: ATXN1; (-) strand; PAM type: YTN; PAM sequence: CTC
aaagtgtgtccaccaggagc

SEQ ID NO: 172909 - DNA, 20 bp, Artificial Sequence
  Description of Artificial Sequence: Synthetic oligonucleotide
  Target: ATXN1; (-) strand; PAM type: YTN; PAM sequence: TTG
agactcaaagtgtgtccacc

SEQ ID NO: 172910 - DNA, 20 bp, Artificial Sequence
  Description of Artificial Sequence: Synthetic oligonucleotide
  Target: ATXN1; (-) strand; PAM type: YTN; PAM sequence: TTT
gagactcaaagtgtgtccac

SEQ ID NO: 172911 - DNA, 20 bp, Artificial Sequence
  Description of Artificial Sequence: Synthetic oligonucleotide
  Target: ATXN1; (-) strand; PAM type: YTN; PAM sequence: TTT
tgagactcaaagtgtgtcca

SEQ ID NO: 172912 - DNA, 20 bp, Artificial Sequence
  Description of Artificial Sequence: Synthetic oligonucleotide
  Target: ATXN1; (-) strand; PAM type: YTN; PAM sequence: TTT
ttgagactcaaagtgtgtcc

SEQ ID NO: 172913 - DNA, 20 bp, Artificial Sequence
  Description of Artificial Sequence: Synthetic oligonucleotide
  Target: ATXN1; (-) strand; PAM type: YTN; PAM sequence: CTT
tttgagactcaaagtgtgtc

SEQ ID NO: 172914 - DNA, 20 bp, Artificial Sequence
  Description of Artificial Sequence: Synthetic oligonucleotide
  Target: ATXN1; (-) strand; PAM type: YTN; PAM sequence: TTC
ctttttgagactcaaagtgt

SEQ ID NO: 172915 - DNA, 20 bp, Artificial Sequence
  Description of Artificial Sequence: Synthetic oligonucleotide
  Target: ATXN1; (-) strand; PAM type: YTN; PAM sequence: TTT
cctttttgagactcaaagtg

SEQ ID NO: 172916 - DNA, 20 bp, Artificial Sequence
  Description of Artificial Sequence: Synthetic oligonucleotide
  Target: ATXN1; (-) strand; PAM type: YTN; PAM sequence: TTT
tcctttttgagactcaaagt

SEQ ID NO: 172917 - DNA, 20 bp, Artificial Sequence
  Description of Artificial Sequence: Synthetic oligonucleotide
  Target: ATXN1; (-) strand; PAM type: YTN; PAM sequence: TTA
ttttcctttttgagactcaa

SEQ ID NO: 172918 - DNA, 20 bp, Artificial Sequence
  Description of Artificial Sequence: Synthetic oligonucleotide
  Target: ATXN1; (-) strand; PAM type: YTN; PAM sequence: CTA
aaagtcaacattattttcct

SEQ ID NO: 172919 - DNA, 20 bp, Artificial Sequence
  Description of Artificial Sequence: Synthetic oligonucleotide
  Target: ATXN1; (-) strand; PAM type: YTN; PAM sequence: CTG
aagagctaaaagtcaacatt

SEQ ID NO: 172920 - DNA, 20 bp, Artificial Sequence
  Description of Artificial Sequence: Synthetic oligonucleotide
  Target: ATXN1; (-) strand; PAM type: YTN; PAM sequence: CTG
agaactgaagagctaaaagt

SEQ ID NO: 172921 - DNA, 20 bp, Artificial Sequence
  Description of Artificial Sequence: Synthetic oligonucleotide
  Target: ATXN1; (-) strand; PAM type: YTN; PAM sequence: CTG
ctgagaactgaagagctaaa

SEQ ID NO: 172922 - DNA, 20 bp, Artificial Sequence
  Description of Artificial Sequence: Synthetic oligonucleotide
  Target: ATXN1; (-) strand; PAM type: YTN; PAM sequence: TTG
taactgctgagaactgaaga

SEQ ID NO: 172923 - DNA, 20 bp, Artificial Sequence
  Description of Artificial Sequence: Synthetic oligonucleotide
  Target: ATXN1; (-) strand; PAM type: YTN; PAM sequence: TTG
ttgtaactgctgagaactga

SEQ ID NO: 172924 - DNA, 20 bp, Artificial Sequence
  Description of Artificial Sequence: Synthetic oligonucleotide
  Target: ATXN1; (-) strand; PAM type: YTN; PAM sequence: TTT
gttgtaactgctgagaactg

SEQ ID NO: 172925 - DNA, 20 bp, Artificial Sequence
  Description of Artificial Sequence: Synthetic oligonucleotide
  Target: ATXN1; (-) strand; PAM type: YTN; PAM sequence: TTT
tgttgtaactgctgagaact

SEQ ID NO: 172926 - DNA, 20 bp, Artificial Sequence
  Description of Artificial Sequence: Synthetic oligonucleotide
  Target: ATXN1; (-) strand; PAM type: YTN; PAM sequence: CTT
ttgttgtaactgctgagaac

SEQ ID NO: 172927 - DNA, 20 bp, Artificial Sequence
  Description of Artificial Sequence: Synthetic oligonucleotide
  Target: ATXN1; (-) strand; PAM type: YTN; PAM sequence: CTC
atgagatataaacatagtac

SEQ ID NO: 172928 - DNA, 20 bp, Artificial Sequence
  Description of Artificial Sequence: Synthetic oligonucleotide
  Target: ATXN1; (-) strand; PAM type: YTN; PAM sequence: TTA
cactcatgagatataaacat

SEQ ID NO: 172929 - DNA, 20 bp, Artificial Sequence
  Description of Artificial Sequence: Synthetic oligonucleotide
  Target: ATXN1; (-) strand; PAM type: YTN; PAM sequence: TTC
agttacactcatgagatata

SEQ ID NO: 172930 - DNA, 20 bp, Artificial Sequence
  Description of Artificial Sequence: Synthetic oligonucleotide
  Target: ATXN1; (-) strand; PAM type: YTN; PAM sequence: CTA
aaggggaaaaatattcagtt

SEQ ID NO: 172931 - DNA, 20 bp, Artificial Sequence
  Description of Artificial Sequence: Synthetic oligonucleotide
  Target: ATXN1; (-) strand; PAM type: YTN; PAM sequence: TTG
accctaaaggggaaaaatat

SEQ ID NO: 172932 - DNA, 20 bp, Artificial Sequence
  Description of Artificial Sequence: Synthetic oligonucleotide
  Target: ATXN1; (-) strand; PAM type: YTN; PAM sequence: CTT
gaccctaaaggggaaaaata

SEQ ID NO: 172933 - DNA, 20 bp, Artificial Sequence
  Description of Artificial Sequence: Synthetic oligonucleotide
  Target: ATXN1; (-) strand; PAM type: YTN; PAM sequence: CTG
agacagagcccttgacccta

SEQ ID NO: 172934 - DNA, 20 bp, Artificial Sequence
  Description of Artificial Sequence: Synthetic oligonucleotide
  Target: ATXN1; (-) strand; PAM type: YTN; PAM sequence: TTA
agaaacaagtgatccctgag

SEQ ID NO: 172935 - DNA, 20 bp, Artificial Sequence
  Description of Artificial Sequence: Synthetic oligonucleotide
  Target: ATXN1; (-) strand; PAM type: YTN; PAM sequence: TTT
aagaaacaagtgatccctga

SEQ ID NO: 172936 - DNA, 20 bp, Artificial Sequence
  Description of Artificial Sequence: Synthetic oligonucleotide
  Target: ATXN1; (-) strand; PAM type: YTN; PAM sequence: CTG
agatttaagaaacaagtgat

SEQ ID NO: 172937 - DNA, 20 bp, Artificial Sequence
  Description of Artificial Sequence: Synthetic oligonucleotide
  Target: ATXN1; (-) strand; PAM type: YTN; PAM sequence: TTG
agaaaatgtagcagcctgag

SEQ ID NO: 172938 - DNA, 20 bp, Artificial Sequence
  Description of Artificial Sequence: Synthetic oligonucleotide
  Target: ATXN1; (-) strand; PAM type: YTN; PAM sequence: CTG
gtggttgagaaaatgtagca

SEQ ID NO: 172939 - DNA, 20 bp, Artificial Sequence
  Description of Artificial Sequence: Synthetic oligonucleotide
  Target: ATXN1; (-) strand; PAM type: YTN; PAM sequence: CTA
atacgactggtggttgagaa

SEQ ID NO: 172940 - DNA, 20 bp, Artificial Sequence
  Description of Artificial Sequence: Synthetic oligonucleotide
  Target: ATXN1; (-) strand; PAM type: YTN; PAM sequence: TTA
tcaacagcataaaaatggac

SEQ ID NO: 172941 - DNA, 20 bp, Artificial Sequence
  Description of Artificial Sequence: Synthetic oligonucleotide
  Target: ATXN1; (-) strand; PAM type: YTN; PAM sequence: TTT
atcaacagcataaaaatgga

SEQ ID NO: 172942 - DNA, 20 bp, Artificial Sequence
  Description of Artificial Sequence: Synthetic oligonucleotide
  Target: ATXN1; (-) strand; PAM type: YTN; PAM sequence: CTT
tatcaacagcataaaaatgg

SEQ ID NO: 172943 - DNA, 20 bp, Artificial Sequence
  Description of Artificial Sequence: Synthetic oligonucleotide
  Target: ATXN1; (-) strand; PAM type: YTN; PAM sequence: CTC
gggtatgtctttatcaacag

SEQ ID NO: 172944 - DNA, 20 bp, Artificial Sequence
  Description of Artificial Sequence: Synthetic oligonucleotide
  Target: ATXN1; (-) strand; PAM type: YTN; PAM sequence: CTC
agtctcgggtatgtctttat

SEQ ID NO: 172945 - DNA, 20 bp, Artificial Sequence
  Description of Artificial Sequence: Synthetic oligonucleotide
  Target: ATXN1; (-) strand; PAM type: YTN; PAM sequence: TTG
ctcagtctcgggtatgtctt

SEQ ID NO: 172946 - DNA, 20 bp, Artificial Sequence
  Description of Artificial Sequence: Synthetic oligonucleotide
  Target: ATXN1; (-) strand; PAM type: YTN; PAM sequence: TTG
taaattgctcagtctcgggt

SEQ ID NO: 172947 - DNA, 20 bp, Artificial Sequence
  Description of Artificial Sequence: Synthetic oligonucleotide
  Target: ATXN1; (-) strand; PAM type: YTN; PAM sequence: TTT
gtaaattgctcagtctcggg

SEQ ID NO: 172948 - DNA, 20 bp, Artificial Sequence
  Description of Artificial Sequence: Synthetic oligonucleotide
  Target: ATXN1; (-) strand; PAM type: YTN; PAM sequence: TTT
tgtaaattgctcagtctcgg

SEQ ID NO: 172949 - DNA, 20 bp, Artificial Sequence
  Description of Artificial Sequence: Synthetic oligonucleotide
  Target: ATXN1; (-) strand; PAM type: YTN; PAM sequence: CTT
ttgtaaattgctcagtctcg

SEQ ID NO: 172950 - DNA, 20 bp, Artificial Sequence
  Description of Artificial Sequence: Synthetic oligonucleotide
  Target: ATXN1; (-) strand; PAM type: YTN; PAM sequence: TTC
ttttgtaaattgctcagtct

SEQ ID NO: 172951 - DNA, 20 bp, Artificial Sequence
  Description of Artificial Sequence: Synthetic oligonucleotide
  Target: ATXN1; (-) strand; PAM type: YTN; PAM sequence: TTT
cttttgtaaattgctcagtc

SEQ ID NO: 172952 - DNA, 20 bp, Artificial Sequence
  Description of Artificial Sequence: Synthetic oligonucleotide
  Target: ATXN1; (-) strand; PAM type: YTN; PAM sequence: CTT
tcttttgtaaattgctcagt

SEQ ID NO: 172953 - DNA, 20 bp, Artificial Sequence
  Description of Artificial Sequence: Synthetic oligonucleotide
  Target: ATXN1; (-) strand; PAM type: YTN; PAM sequence: CTC
tttcttttgtaaattgctca

SEQ ID NO: 172954 - DNA, 20 bp, Artificial Sequence
  Description of Artificial Sequence: Synthetic oligonucleotide
  Target: ATXN1; (-) strand; PAM type: YTN; PAM sequence: TTA
aacctctttcttttgtaaat

SEQ ID NO: 172955 - DNA, 20 bp, Artificial Sequence
  Description of Artificial Sequence: Synthetic oligonucleotide
  Target: ATXN1; (-) strand; PAM type: YTN; PAM sequence: CTG
taagtccaattaaacctctt

SEQ ID NO: 172956 - DNA, 20 bp, Artificial Sequence
  Description of Artificial Sequence: Synthetic oligonucleotide
  Target: ATXN1; (-) strand; PAM type: YTN; PAM sequence: CTC
agccatgtggaactgtaagt

SEQ ID NO: 172957 - DNA, 20 bp, Artificial Sequence
  Description of Artificial Sequence: Synthetic oligonucleotide
  Target: ATXN1; (-) strand; PAM type: YTN; PAM sequence: TTC
ctcagccatgtggaactgta

SEQ ID NO: 172958 - DNA, 20 bp, Artificial Sequence
  Description of Artificial Sequence: Synthetic oligonucleotide
  Target: ATXN1; (-) strand; PAM type: YTN; PAM sequence: CTT
cctcagccatgtggaactgt

SEQ ID NO: 172959 - DNA, 20 bp, Artificial Sequence
  Description of Artificial Sequence: Synthetic oligonucleotide
  Target: ATXN1; (-) strand; PAM type: YTN; PAM sequence: TTG
agaggcttcctcagccatgt

SEQ ID NO: 172960 - DNA, 20 bp, Artificial Sequence
  Description of Artificial Sequence: Synthetic oligonucleotide
  Target: ATXN1; (-) strand; PAM type: YTN; PAM sequence: TTC
caccatgattgagaggcttc

SEQ ID NO: 172961 - DNA, 20 bp, Artificial Sequence
  Description of Artificial Sequence: Synthetic oligonucleotide
  Target: ATXN1; (-) strand; PAM type: YTN; PAM sequence: CTT
ccaccatgattgagaggctt

SEQ ID NO: 172962 - DNA, 20 bp, Artificial Sequence
  Description of Artificial Sequence: Synthetic oligonucleotide
  Target: ATXN1; (-) strand; PAM type: YTN; PAM sequence: TTG
ccttccaccatgattgagag

SEQ ID NO: 172963 - DNA, 20 bp, Artificial Sequence
  Description of Artificial Sequence: Synthetic oligonucleotide
  Target: ATXN1; (-) strand; PAM type: YTN; PAM sequence: CTT
gccttccaccatgattgaga

SEQ ID NO: 172964 - DNA, 20 bp, Artificial Sequence
  Description of Artificial Sequence: Synthetic oligonucleotide
  Target: ATXN1; (-) strand; PAM type: YTN; PAM sequence: CTC
cttgccttccaccatgattg

SEQ ID NO: 172965 - DNA, 20 bp, Artificial Sequence
  Description of Artificial Sequence: Synthetic oligonucleotide
  Target: ATXN1; (-) strand; PAM type: YTN; PAM sequence: CTC
ctccttgccttccaccatga

SEQ ID NO: 172966 - DNA, 20 bp, Artificial Sequence
  Description of Artificial Sequence: Synthetic oligonucleotide
  Target: ATXN1; (-) strand; PAM type: YTN; PAM sequence: TTG
ctcctccttgccttccacca

SEQ ID NO: 172967 - DNA, 20 bp, Artificial Sequence
  Description of Artificial Sequence: Synthetic oligonucleotide
  Target: ATXN1; (-) strand; PAM type: YTN; PAM sequence: CTT
gctcctccttgccttccacc

SEQ ID NO: 172968 - DNA, 20 bp, Artificial Sequence
  Description of Artificial Sequence: Synthetic oligonucleotide
  Target: ATXN1; (-) strand; PAM type: YTN; PAM sequence: CTG
ccaccatccatgtaagatgt

SEQ ID NO: 172969 - DNA, 20 bp, Artificial Sequence
  Description of Artificial Sequence: Synthetic oligonucleotide
  Target: ATXN1; (-) strand; PAM type: YTN; PAM sequence: TTG
cctgccaccatccatgtaag

SEQ ID NO: 172970 - DNA, 20 bp, Artificial Sequence
  Description of Artificial Sequence: Synthetic oligonucleotide
  Target: ATXN1; (-) strand; PAM type: YTN; PAM sequence: TTT
gcctgccaccatccatgtaa

SEQ ID NO: 172971 - DNA, 20 bp, Artificial Sequence
  Description of Artificial Sequence: Synthetic oligonucleotide
  Target: ATXN1; (-) strand; PAM type: YTN; PAM sequence: TTT
tgcctgccaccatccatgta

SEQ ID NO: 172972 - DNA, 20 bp, Artificial Sequence
  Description of Artificial Sequence: Synthetic oligonucleotide
  Target: ATXN1; (-) strand; PAM type: YTN; PAM sequence: TTT
ttgcctgccaccatccatgt

SEQ ID NO: 172973 - DNA, 20 bp, Artificial Sequence
  Description of Artificial Sequence: Synthetic oligonucleotide
  Target: ATXN1; (-) strand; PAM type: YTN; PAM sequence: TTT
tttgcctgccaccatccatg

SEQ ID NO: 172974 - DNA, 20 bp, Artificial Sequence
  Description of Artificial Sequence: Synthetic oligonucleotide
  Target: ATXN1; (-) strand; PAM type: YTN; PAM sequence: CTC
attttttgcctgccaccatc

SEQ ID NO: 172975 - DNA, 20 bp, Artificial Sequence
  Description of Artificial Sequence: Synthetic oligonucleotide
  Target: ATXN1; (-) strand; PAM type: YTN; PAM sequence: CTC
tcattttttgcctgccacca

SEQ ID NO: 172976 - DNA, 20 bp, Artificial Sequence
  Description of Artificial Sequence: Synthetic oligonucleotide
  Target: ATXN1; (-) strand; PAM type: YTN; PAM sequence: CTC
tctcattttttgcctgccac

SEQ ID NO: 172977 - DNA, 20 bp, Artificial Sequence
  Description of Artificial Sequence: Synthetic oligonucleotide
  Target: ATXN1; (-) strand; PAM type: YTN; PAM sequence: CTC
tctctcattttttgcctgcc

SEQ ID NO: 172978 - DNA, 20 bp, Artificial Sequence
  Description of Artificial Sequence: Synthetic oligonucleotide
  Target: ATXN1; (-) strand; PAM type: YTN; PAM sequence: CTG
cataagctctctctcatttt

SEQ ID NO: 172979 - DNA, 20 bp, Artificial Sequence
  Description of Artificial Sequence: Synthetic oligonucleotide
  Target: ATXN1; (-) strand; PAM type: YTN; PAM sequence: TTC
ccctgcataagctctctctc

SEQ ID NO: 172980 - DNA, 20 bp, Artificial Sequence
  Description of Artificial Sequence: Synthetic oligonucleotide
  Target: ATXN1; (-) strand; PAM type: YTN; PAM sequence: TTA
aaaagaggcattcccctgca

SEQ ID NO: 172981 - DNA, 20 bp, Artificial Sequence
  Description of Artificial Sequence: Synthetic oligonucleotide
  Target: ATXN1; (-) strand; PAM type: YTN; PAM sequence: TTT
aaaaagaggcattcccctgc

SEQ ID NO: 172982 - DNA, 20 bp, Artificial Sequence
  Description of Artificial Sequence: Synthetic oligonucleotide
  Target: ATXN1; (-) strand; PAM type: YTN; PAM sequence: TTT
taaaaagaggcattcccctg

SEQ ID NO: 172983 - DNA, 20 bp, Artificial Sequence
  Description of Artificial Sequence: Synthetic oligonucleotide
  Target: ATXN1; (-) strand; PAM type: YTN; PAM sequence: CTG
atggttttaaaaagaggcat

SEQ ID NO: 172984 - DNA, 20 bp, Artificial Sequence
  Description of Artificial Sequence: Synthetic oligonucleotide
  Target: ATXN1; (-) strand; PAM type: YTN; PAM sequence: CTC
acgagatctgatggttttaa

SEQ ID NO: 172985 - DNA, 20 bp, Artificial Sequence
  Description of Artificial Sequence: Synthetic oligonucleotide
  Target: ATXN1; (-) strand; PAM type: YTN; PAM sequence: CTC
gtggtaatggataagtctca

SEQ ID NO: 172986 - DNA, 20 bp, Artificial Sequence
  Description of Artificial Sequence: Synthetic oligonucleotide
  Target: ATXN1; (-) strand; PAM type: YTN; PAM sequence: TTC
tcgtggtaatggataagtct

SEQ ID NO: 172987 - DNA, 20 bp, Artificial Sequence
  Description of Artificial Sequence: Synthetic oligonucleotide
  Target: ATXN1; (-) strand; PAM type: YTN; PAM sequence: CTG
ttctcgtggtaatggataag

SEQ ID NO: 172988 - DNA, 20 bp, Artificial Sequence
  Description of Artificial Sequence: Synthetic oligonucleotide
  Target: ATXN1; (-) strand; PAM type: YTN; PAM sequence: TTC
ccatgctgttctcgtggtaa

SEQ ID NO: 172989 - DNA, 20 bp, Artificial Sequence
  Description of Artificial Sequence: Synthetic oligonucleotide
  Target: ATXN1; (-) strand; PAM type: YTN; PAM sequence: TTT
cccatgctgttctcgtggta

SEQ ID NO: 172990 - DNA, 20 bp, Artificial Sequence
  Description of Artificial Sequence: Synthetic oligonucleotide
  Target: ATXN1; (-) strand; PAM type: YTN; PAM sequence: CTT
tcccatgctgttctcgtggt

SEQ ID NO: 172991 - DNA, 20 bp, Artificial Sequence
  Description of Artificial Sequence: Synthetic oligonucleotide
  Target: ATXN1; (-) strand; PAM type: YTN; PAM sequence: TTG
aatcatggggggcaggtctt

SEQ ID NO: 172992 - DNA, 20 bp, Artificial Sequence
  Description of Artificial Sequence: Synthetic oligonucleotide
  Target: ATXN1; (-) strand; PAM type: YTN; PAM sequence: CTG
gtgggaggtattgaatcatg

SEQ ID NO: 172993 - DNA, 20 bp, Artificial Sequence
  Description of Artificial Sequence: Synthetic oligonucleotide
  Target: ATXN1; (-) strand; PAM type: YTN; PAM sequence: CTC
ccatgtgtgtgggagggacc

SEQ ID NO: 172994 - DNA, 20 bp, Artificial Sequence
  Description of Artificial Sequence: Synthetic oligonucleotide
  Target: ATXN1; (-) strand; PAM type: YTN; PAM sequence: TTG
acctcccatgtgtgtgggag

SEQ ID NO: 172995 - DNA, 20 bp, Artificial Sequence
  Description of Artificial Sequence: Synthetic oligonucleotide
  Target: ATXN1; (-) strand; PAM type: YTN; PAM sequence: CTT
gacctcccatgtgtgtggga

SEQ ID NO: 172996 - DNA, 20 bp, Artificial Sequence
  Description of Artificial Sequence: Synthetic oligonucleotide
  Target: ATXN1; (-) strand; PAM type: YTN; PAM sequence: TTC
atcttgacctcccatgtgtg

SEQ ID NO: 172997 - DNA, 20 bp, Artificial Sequence
  Description of Artificial Sequence: Synthetic oligonucleotide
  Target: ATXN1; (-) strand; PAM type: YTN; PAM sequence: TTT
catcttgacctcccatgtgt

SEQ ID NO: 172998 - DNA, 20 bp, Artificial Sequence
  Description of Artificial Sequence: Synthetic oligonucleotide
  Target: ATXN1; (-) strand; PAM type: YTN; PAM sequence: CTG
cccagatttcatcttgacct

SEQ ID NO: 172999 - DNA, 20 bp, Artificial Sequence
  Description of Artificial Sequence: Synthetic oligonucleotide
  Target: ATXN1; (-) strand; PAM type: YTN; PAM sequence: CTG
tgtccctgcccagatttcat

SEQ ID NO: 173000 - DNA, 20 bp, Artificial Sequence
  Description of Artificial Sequence: Synthetic oligonucleotide
  Target: ATXN1; (-) strand; PAM type: YTN; PAM sequence: TTG
gctgtgtccctgcccagatt

SEQ ID NO: 173001 - DNA, 20 bp, Artificial Sequence
  Description of Artificial Sequence: Synthetic oligonucleotide
  Target: ATXN1; (-) strand; PAM type: YTN; PAM sequence: TTT
ggctgtgtccctgcccagat

SEQ ID NO: 173002 - DNA, 20 bp, Artificial Sequence
  Description of Artificial Sequence: Synthetic oligonucleotide
  Target: ATXN1; (-) strand; PAM type: YTN; PAM sequence: CTG
atgatatggtttggctgtgt

SEQ ID NO: 173003 - DNA, 20 bp, Artificial Sequence
  Description of Artificial Sequence: Synthetic oligonucleotide
  Target: ATXN1; (-) strand; PAM type: YTN; PAM sequence: TTC
cagccatatagatcaactga

SEQ ID NO: 173004 - DNA, 20 bp, Artificial Sequence
  Description of Artificial Sequence: Synthetic oligonucleotide
  Target: ATXN1; (-) strand; PAM type: YTN; PAM sequence: TTT
ccagccatatagatcaactg

SEQ ID NO: 173005 - DNA, 20 bp, Artificial Sequence
  Description of Artificial Sequence: Synthetic oligonucleotide
  Target: ATXN1; (-) strand; PAM type: YTN; PAM sequence: TTT
tccagccatatagatcaact

SEQ ID NO: 173006 - DNA, 20 bp, Artificial Sequence
  Description of Artificial Sequence: Synthetic oligonucleotide
  Target: ATXN1; (-) strand; PAM type: YTN; PAM sequence: TTT
ttccagccatatagatcaac

SEQ ID NO: 173007 - DNA, 20 bp, Artificial Sequence
  Description of Artificial Sequence: Synthetic oligonucleotide
  Target: ATXN1; (-) strand; PAM type: YTN; PAM sequence: TTT
tttccagccatatagatcaa

SEQ ID NO: 173008 - DNA, 20 bp, Artificial Sequence
  Description of Artificial Sequence: Synthetic oligonucleotide
  Target: ATXN1; (-) strand; PAM type: YTN; PAM sequence: TTG
ttttttccagccatatagat

SEQ ID NO: 173009 - DNA, 20 bp, Artificial Sequence
  Description of Artificial Sequence: Synthetic oligonucleotide
  Target: ATXN1; (-) strand; PAM type: YTN; PAM sequence: CTT
gttttttccagccatataga

SEQ ID NO: 173010 - DNA, 20 bp, Artificial Sequence
  Description of Artificial Sequence: Synthetic oligonucleotide
  Target: ATXN1; (-) strand; PAM type: YTN; PAM sequence: TTG
gcgagaagtcttgttttttc

SEQ ID NO: 173011 - DNA, 20 bp, Artificial Sequence
  Description of Artificial Sequence: Synthetic oligonucleotide
  Target: ATXN1; (-) strand; PAM type: YTN; PAM sequence: CTG
tcagtggttggcgagaagtc

SEQ ID NO: 173012 - DNA, 20 bp, Artificial Sequence
  Description of Artificial Sequence: Synthetic oligonucleotide
  Target: ATXN1; (-) strand; PAM type: YTN; PAM sequence: CTA
gaagcaaaaaaaaaaaaaaa

SEQ ID NO: 173013 - DNA, 20 bp, Artificial Sequence
  Description of Artificial Sequence: Synthetic oligonucleotide
  Target: ATXN1; (-) strand; PAM type: YTN; PAM sequence: TTA
gaactagaagcaaaaaaaaa

SEQ ID NO: 173014 - DNA, 20 bp, Artificial Sequence
  Description of Artificial Sequence: Synthetic oligonucleotide
  Target: ATXN1; (-) strand; PAM type: YTN; PAM sequence: TTA
atgaccaagcattagaacta

SEQ ID NO: 173015 - DNA, 20 bp, Artificial Sequence
  Description of Artificial Sequence: Synthetic oligonucleotide
  Target: ATXN1; (-) strand; PAM type: YTN; PAM sequence: CTA
gagaaattaatgaccaagca

SEQ ID NO: 173016 - DNA, 20 bp, Artificial Sequence
  Description of Artificial Sequence: Synthetic oligonucleotide
  Target: ATXN1; (-) strand; PAM type: YTN; PAM sequence: TTC
tagagaaattaatgaccaag

SEQ ID NO: 173017 - DNA, 20 bp, Artificial Sequence
  Description of Artificial Sequence: Synthetic oligonucleotide
  Target: ATXN1; (-) strand; PAM type: YTN; PAM sequence: CTG
agttctagagaaattaatga

SEQ ID NO: 173018 - DNA, 20 bp, Artificial Sequence
  Description of Artificial Sequence: Synthetic oligonucleotide
  Target: ATXN1; (-) strand; PAM type: YTN; PAM sequence: TTC
tgagttctagagaaattaat

SEQ ID NO: 173019 - DNA, 20 bp, Artificial Sequence
  Description of Artificial Sequence: Synthetic oligonucleotide
  Target: ATXN1; (-) strand; PAM type: YTN; PAM sequence: TTA
aagggtaaataaaaaggaag

SEQ ID NO: 173020 - DNA, 20 bp, Artificial Sequence
  Description of Artificial Sequence: Synthetic oligonucleotide
  Target: ATXN1; (-) strand; PAM type: YTN; PAM sequence: TTG
tgaaaacattaaagggtaaa

SEQ ID NO: 173021 - DNA, 20 bp, Artificial Sequence
  Description of Artificial Sequence: Synthetic oligonucleotide
  Target: ATXN1; (-) strand; PAM type: YTN; PAM sequence: TTT
gtgaaaacattaaagggtaa

SEQ ID NO: 173022 - DNA, 20 bp, Artificial Sequence
  Description of Artificial Sequence: Synthetic oligonucleotide
  Target: ATXN1; (-) strand; PAM type: YTN; PAM sequence: TTT
tgtgaaaacattaaagggta

SEQ ID NO: 173023 - DNA, 20 bp, Artificial Sequence
  Description of Artificial Sequence: Synthetic oligonucleotide
  Target: ATXN1; (-) strand; PAM type: YTN; PAM sequence: CTG
ttttgtgaaaacattaaagg

SEQ ID NO: 173024 - DNA, 20 bp, Artificial Sequence
  Description of Artificial Sequence: Synthetic oligonucleotide
  Target: ATXN1; (-) strand; PAM type: YTN; PAM sequence: TTG
tccctgttttgtgaaaacat

SEQ ID NO: 173025 - DNA, 20 bp, Artificial Sequence
  Description of Artificial Sequence: Synthetic oligonucleotide
  Target: ATXN1; (-) strand; PAM type: YTN; PAM sequence: CTA
tgcacattgtccctgttttg

SEQ ID NO: 173026 - DNA, 20 bp, Artificial Sequence
  Description of Artificial Sequence: Synthetic oligonucleotide
  Target: ATXN1; (-) strand; PAM type: YTN; PAM sequence: CTG
gcctatgcacattgtccctg

SEQ ID NO: 173027 - DNA, 20 bp, Artificial Sequence
  Description of Artificial Sequence: Synthetic oligonucleotide
  Target: ATXN1; (-) strand; PAM type: YTN; PAM sequence: CTC
tggcctatgcacattgtccc

SEQ ID NO: 173028 - DNA, 20 bp, Artificial Sequence
  Description of Artificial Sequence: Synthetic oligonucleotide
  Target: ATXN1; (-) strand; PAM type: YTN; PAM sequence: TTA
gaaaaaccataaaatcctct

SEQ ID NO: 173029 - DNA, 20 bp, Artificial Sequence
  Description of Artificial Sequence: Synthetic oligonucleotide
  Target: ATXN1; (-) strand; PAM type: YTN; PAM sequence: TTA
aaaacgaattagaaaaacca

SEQ ID NO: 173030 - DNA, 20 bp, Artificial Sequence
  Description of Artificial Sequence: Synthetic oligonucleotide
  Target: ATXN1; (-) strand; PAM type: YTN; PAM sequence: TTT
aaaaacgaattagaaaaacc

SEQ ID NO: 173031 - DNA, 20 bp, Artificial Sequence
  Description of Artificial Sequence: Synthetic oligonucleotide
  Target: ATXN1; (-) strand; PAM type: YTN; PAM sequence: TTT
taaaaacgaattagaaaaac

SEQ ID NO: 173032 - DNA, 20 bp, Artificial Sequence
  Description of Artificial Sequence: Synthetic oligonucleotide
  Target: ATXN1; (-) strand; PAM type: YTN; PAM sequence: CTC
gtaagttttaaaaacgaatt

SEQ ID NO: 173033 - DNA, 20 bp, Artificial Sequence
  Description of Artificial Sequence: Synthetic oligonucleotide
  Target: ATXN1; (-) strand; PAM type: YTN; PAM sequence: TTG
tctcgtaagttttaaaaacg

SEQ ID NO: 173034 - DNA, 20 bp, Artificial Sequence
  Description of Artificial Sequence: Synthetic oligonucleotide
  Target: ATXN1; (-) strand; PAM type: YTN; PAM sequence: CTA
taagccagttgtctcgtaag

SEQ ID NO: 173035 - DNA, 20 bp, Artificial Sequence
  Description of Artificial Sequence: Synthetic oligonucleotide
  Target: ATXN1; (-) strand; PAM type: YTN; PAM sequence: TTG
ctataagccagttgtctcgt

SEQ ID NO: 173036 - DNA, 20 bp, Artificial Sequence
  Description of Artificial Sequence: Synthetic oligonucleotide
  Target: ATXN1; (-) strand; PAM type: YTN; PAM sequence: CTG
gaaaattgctataagccagt

SEQ ID NO: 173037 - DNA, 20 bp, Artificial Sequence
  Description of Artificial Sequence: Synthetic oligonucleotide
  Target: ATXN1; (-) strand; PAM type: YTN; PAM sequence: TTA
actggaaaattgctataagc

SEQ ID NO: 173038 - DNA, 20 bp, Artificial Sequence
  Description of Artificial Sequence: Synthetic oligonucleotide
  Target: ATXN1; (-) strand; PAM type: YTN; PAM sequence: TTG
ttaactggaaaattgctata

SEQ ID NO: 173039 - DNA, 20 bp, Artificial Sequence
  Description of Artificial Sequence: Synthetic oligonucleotide
  Target: ATXN1; (-) strand; PAM type: YTN; PAM sequence: TTC
gtgttgttaactggaaaatt

SEQ ID NO: 173040 - DNA, 20 bp, Artificial Sequence
  Description of Artificial Sequence: Synthetic oligonucleotide
  Target: ATXN1; (-) strand; PAM type: YTN; PAM sequence: TTG
tgttcgtgttgttaactgga

SEQ ID NO: 173041 - DNA, 20 bp, Artificial Sequence
  Description of Artificial Sequence: Synthetic oligonucleotide
  Target: ATXN1; (-) strand; PAM type: YTN; PAM sequence: TTG
tgggttgtgttcgtgttgtt

SEQ ID NO: 173042 - DNA, 20 bp, Artificial Sequence
  Description of Artificial Sequence: Synthetic oligonucleotide
  Target: ATXN1; (-) strand; PAM type: YTN; PAM sequence: CTT
gtgggttgtgttcgtgttgt

SEQ ID NO: 173043 - DNA, 20 bp, Artificial Sequence
  Description of Artificial Sequence: Synthetic oligonucleotide
  Target: ATXN1; (-) strand; PAM type: YTN; PAM sequence: TTG
gcttgtgggttgtgttcgtg

SEQ ID NO: 173044 - DNA, 20 bp, Artificial Sequence
  Description of Artificial Sequence: Synthetic oligonucleotide
  Target: ATXN1; (-) strand; PAM type: YTN; PAM sequence: CTT
ggcttgtgggttgtgttcgt

SEQ ID NO: 173045 - DNA, 20 bp, Artificial Sequence
  Description of Artificial Sequence: Synthetic oligonucleotide
  Target: ATXN1; (-) strand; PAM type: YTN; PAM sequence: TTC
ttggcttgtgggttgtgttc

SEQ ID NO: 173046 - DNA, 20 bp, Artificial Sequence
  Description of Artificial Sequence: Synthetic oligonucleotide
  Target: ATXN1; (-) strand; PAM type: YTN; PAM sequence: TTG
ttcttggcttgtgggttgtg

SEQ ID NO: 173047 - DNA, 20 bp, Artificial Sequence
  Description of Artificial Sequence: Synthetic oligonucleotide
  Target: ATXN1; (-) strand; PAM type: YTN; PAM sequence: CTG
ttgttcttggcttgtgggtt

SEQ ID NO: 173048 - DNA, 20 bp, Artificial Sequence
  Description of Artificial Sequence: Synthetic oligonucleotide
  Target: ATXN1; (-) strand; PAM type: YTN; PAM sequence: TTC
tgttgttcttggcttgtggg

SEQ ID NO: 173049 - DNA, 20 bp, Artificial Sequence
  Description of Artificial Sequence: Synthetic oligonucleotide
  Target: ATXN1; (-) strand; PAM type: YTN; PAM sequence: CTT
ctgttgttcttggcttgtgg

SEQ ID NO: 173050 - DNA, 20 bp, Artificial Sequence
  Description of Artificial Sequence: Synthetic oligonucleotide
  Target: ATXN1; (-) strand; PAM type: YTN; PAM sequence: CTC
ttctgttgttcttggcttgt

SEQ ID NO: 173051 - DNA, 20 bp, Artificial Sequence
  Description of Artificial Sequence: Synthetic oligonucleotide
  Target: ATXN1; (-) strand; PAM type: YTN; PAM sequence: CTC
ctcttctgttgttcttggct

SEQ ID NO: 173052 - DNA, 20 bp, Artificial Sequence
  Description of Artificial Sequence: Synthetic oligonucleotide
  Target: ATXN1; (-) strand; PAM type: YTN; PAM sequence: CTC
tcctcttctgttgttcttgg

SEQ ID NO: 173053 - DNA, 20 bp, Artificial Sequence
  Description of Artificial Sequence: Synthetic oligonucleotide
  Target: ATXN1; (-) strand; PAM type: YTN; PAM sequence: CTG
tctctcctcttctgttgttc

SEQ ID NO: 173054 - DNA, 20 bp, Artificial Sequence
  Description of Artificial Sequence: Synthetic oligonucleotide
  Target: ATXN1; (-) strand; PAM type: YTN; PAM sequence: TTC
tgtctctcctcttctgttgt

SEQ ID NO: 173055 - DNA, 20 bp, Artificial Sequence
  Description of Artificial Sequence: Synthetic oligonucleotide
  Target: ATXN1; (-) strand; PAM type: YTN; PAM sequence: TTT
ctgtctctcctcttctgttg

SEQ ID NO: 173056 - DNA, 20 bp, Artificial Sequence
  Description of Artificial Sequence: Synthetic oligonucleotide
  Target: ATXN1; (-) strand; PAM type: YTN; PAM sequence: CTT
tctgtctctcctcttctgtt

SEQ ID NO: 173057 - DNA, 20 bp, Artificial Sequence
  Description of Artificial Sequence: Synthetic oligonucleotide
  Target: ATXN1; (-) strand; PAM type: YTN; PAM sequence: TTC
tttctgtctctcctcttctg

SEQ ID NO: 173058 - DNA, 20 bp, Artificial Sequence
  Description of Artificial Sequence: Synthetic oligonucleotide
  Target: ATXN1; (-) strand; PAM type: YTN; PAM sequence: TTA
tgttctttctgtctctcctc

SEQ ID NO: 173059 - DNA, 20 bp, Artificial Sequence
  Description of Artificial Sequence: Synthetic oligonucleotide
  Target: ATXN1; (-) strand; PAM type: YTN; PAM sequence: TTT
atgttctttctgtctctcct

SEQ ID NO: 173060 - DNA, 20 bp, Artificial Sequence
  Description of Artificial Sequence: Synthetic oligonucleotide
  Target: ATXN1; (-) strand; PAM type: YTN; PAM sequence: TTT
tatgttctttctgtctctcc

SEQ ID NO: 173061 - DNA, 20 bp, Artificial Sequence
  Description of Artificial Sequence: Synthetic oligonucleotide
  Target: ATXN1; (-) strand; PAM type: YTN; PAM sequence: CTC
ataagtaatgttttatgttc

SEQ ID NO: 173062 - DNA, 20 bp, Artificial Sequence
  Description of Artificial Sequence: Synthetic oligonucleotide
  Target: ATXN1; (-) strand; PAM type: YTN; PAM sequence: CTA
agcagtgggaaagatctcat

SEQ ID NO: 173063 - DNA, 20 bp, Artificial Sequence
  Description of Artificial Sequence: Synthetic oligonucleotide
  Target: ATXN1; (-) strand; PAM type: YTN; PAM sequence: CTG
gtgctaagcagtgggaaaga

SEQ ID NO: 173064 - DNA, 20 bp, Artificial Sequence
  Description of Artificial Sequence: Synthetic oligonucleotide
  Target: ATXN1; (-) strand; PAM type: YTN; PAM sequence: TTA
tagatctggtgctaagcagt

SEQ ID NO: 173065 - DNA, 20 bp, Artificial Sequence
  Description of Artificial Sequence: Synthetic oligonucleotide
  Target: ATXN1; (-) strand; PAM type: YTN; PAM sequence: TTG
catgcattatagatctggtg

SEQ ID NO: 173066 - DNA, 20 bp, Artificial Sequence
  Description of Artificial Sequence: Synthetic oligonucleotide
  Target: ATXN1; (-) strand; PAM type: YTN; PAM sequence: CTT
gcatgcattatagatctggt

SEQ ID NO: 173067 - DNA, 20 bp, Artificial Sequence
  Description of Artificial Sequence: Synthetic oligonucleotide
  Target: ATXN1; (-) strand; PAM type: YTN; PAM sequence: CTA
agccttgcatgcattataga

SEQ ID NO: 173068 - DNA, 20 bp, Artificial Sequence
  Description of Artificial Sequence: Synthetic oligonucleotide
  Target: ATXN1; (-) strand; PAM type: YTN; PAM sequence: TTC
cagctaagccttgcatgcat

SEQ ID NO: 173069 - DNA, 20 bp, Artificial Sequence
  Description of Artificial Sequence: Synthetic oligonucleotide
  Target: ATXN1; (-) strand; PAM type: YTN; PAM sequence: TTG
ttccagctaagccttgcatg

SEQ ID NO: 173070 - DNA, 20 bp, Artificial Sequence
  Description of Artificial Sequence: Synthetic oligonucleotide
  Target: ATXN1; (-) strand; PAM type: YTN; PAM sequence: TTT
gttccagctaagccttgcat

SEQ ID NO: 173071 - DNA, 20 bp, Artificial Sequence
  Description of Artificial Sequence: Synthetic oligonucleotide
  Target: ATXN1; (-) strand; PAM type: YTN; PAM sequence: TTC
atcatttgttccagctaagc

SEQ ID NO: 173072 - DNA, 20 bp, Artificial Sequence
  Description of Artificial Sequence: Synthetic oligonucleotide
  Target: ATXN1; (-) strand; PAM type: YTN; PAM sequence: TTT
catcatttgttccagctaag

SEQ ID NO: 173073 - DNA, 20 bp, Artificial Sequence
  Description of Artificial Sequence: Synthetic oligonucleotide
  Target: ATXN1; (-) strand; PAM type: YTN; PAM sequence: CTT
tcatcatttgttccagctaa

SEQ ID NO: 173074 - DNA, 20 bp, Artificial Sequence
  Description of Artificial Sequence: Synthetic oligonucleotide
  Target: ATXN1; (-) strand; PAM type: YTN; PAM sequence: TTG
aaaggaggaacagctttcat

SEQ ID NO: 173075 - DNA, 20 bp, Artificial Sequence
  Description of Artificial Sequence: Synthetic oligonucleotide
  Target: ATXN1; (-) strand; PAM type: YTN; PAM sequence: CTT
gaaaggaggaacagctttca

SEQ ID NO: 173076 - DNA, 20 bp, Artificial Sequence
  Description of Artificial Sequence: Synthetic oligonucleotide
  Target: ATXN1; (-) strand; PAM type: YTN; PAM sequence: CTC
ccttgaaaggaggaacagct

SEQ ID NO: 173077 - DNA, 20 bp, Artificial Sequence
  Description of Artificial Sequence: Synthetic oligonucleotide
  Target: ATXN1; (-) strand; PAM type: YTN; PAM sequence: CTG
ggcccatgtaaatgatcctc

SEQ ID NO: 173078 - DNA, 20 bp, Artificial Sequence
  Description of Artificial Sequence: Synthetic oligonucleotide
  Target: ATXN1; (-) strand; PAM type: YTN; PAM sequence: TTG
aataaatgagaacaggagtg

SEQ ID NO: 173079 - DNA, 20 bp, Artificial Sequence
  Description of Artificial Sequence: Synthetic oligonucleotide
  Target: ATXN1; (-) strand; PAM type: YTN; PAM sequence: CTG
gaagttgaataaatgagaac

SEQ ID NO: 173080 - DNA, 20 bp, Artificial Sequence
  Description of Artificial Sequence: Synthetic oligonucleotide
  Target: ATXN1; (-) strand; PAM type: YTN; PAM sequence: TTA
atgtcagtgagggctggaag

SEQ ID NO: 173081 - DNA, 20 bp, Artificial Sequence
  Description of Artificial Sequence: Synthetic oligonucleotide
  Target: ATXN1; (-) strand; PAM type: YTN; PAM sequence: CTG
gttaatgtcagtgagggctg

SEQ ID NO: 173082 - DNA, 20 bp, Artificial Sequence
  Description of Artificial Sequence: Synthetic oligonucleotide
  Target: ATXN1; (-) strand; PAM type: YTN; PAM sequence: CTC
ctggttaatgtcagtgaggg

SEQ ID NO: 173083 - DNA, 20 bp, Artificial Sequence
  Description of Artificial Sequence: Synthetic oligonucleotide
  Target: ATXN1; (-) strand; PAM type: YTN; PAM sequence: CTG
ctcctggttaatgtcagtga

SEQ ID NO: 173084 - DNA, 20 bp, Artificial Sequence
  Description of Artificial Sequence: Synthetic oligonucleotide
  Target: ATXN1; (-) strand; PAM type: YTN; PAM sequence: CTC
tgctcctggttaatgtcagt

SEQ ID NO: 173085 - DNA, 20 bp, Artificial Sequence
  Description of Artificial Sequence: Synthetic oligonucleotide
  Target: ATXN1; (-) strand; PAM type: YTN; PAM sequence: TTC
tctgctcctggttaatgtca

SEQ ID NO: 173086 - DNA, 20 bp, Artificial Sequence
  Description of Artificial Sequence: Synthetic oligonucleotide
  Target: ATXN1; (-) strand; PAM type: YTN; PAM sequence: CTG
acaccagatgttctctgctc

SEQ ID NO: 173087 - DNA, 20 bp, Artificial Sequence
  Description of Artificial Sequence: Synthetic oligonucleotide
  Target: ATXN1; (-) strand; PAM type: YTN; PAM sequence: TTC
tgacaccagatgttctctgc

SEQ ID NO: 173088 - DNA, 20 bp, Artificial Sequence
  Description of Artificial Sequence: Synthetic oligonucleotide
  Target: ATXN1; (-) strand; PAM type: YTN; PAM sequence: TTG
gttctgacaccagatgttct

SEQ ID NO: 173089 - DNA, 20 bp, Artificial Sequence
  Description of Artificial Sequence: Synthetic oligonucleotide
  Target: ATXN1; (-) strand; PAM type: YTN; PAM sequence: CTG
ggcacagcgggagttggttc

SEQ ID NO: 173090 - DNA, 20 bp, Artificial Sequence
  Description of Artificial Sequence: Synthetic oligonucleotide
  Target: ATXN1; (-) strand; PAM type: YTN; PAM sequence: CTG
caacagtgagacaacagccc

SEQ ID NO: 173091 - DNA, 20 bp, Artificial Sequence
  Description of Artificial Sequence: Synthetic oligonucleotide
  Target: ATXN1; (-) strand; PAM type: YTN; PAM sequence: TTC
tgcaacagtgagacaacagc

SEQ ID NO: 173092 - DNA, 20 bp, Artificial Sequence
  Description of Artificial Sequence: Synthetic oligonucleotide
  Target: ATXN1; (-) strand; PAM type: YTN; PAM sequence: TTT
ctgcaacagtgagacaacag

SEQ ID NO: 173093 - DNA, 20 bp, Artificial Sequence
  Description of Artificial Sequence: Synthetic oligonucleotide
  Target: ATXN1; (-) strand; PAM type: YTN; PAM sequence: TTT
tctgcaacagtgagacaaca

SEQ ID NO: 173094 - DNA, 20 bp, Artificial Sequence
  Description of Artificial Sequence: Synthetic oligonucleotide
  Target: ATXN1; (-) strand; PAM type: YTN; PAM sequence: CTT
ttctgcaacagtgagacaac

SEQ ID NO: 173095 - DNA, 20 bp, Artificial Sequence
  Description of Artificial Sequence: Synthetic oligonucleotide
  Target: ATXN1; (-) strand; PAM type: YTN; PAM sequence: CTG
gccttttctgcaacagtgag

SEQ ID NO: 173096 - DNA, 20 bp, Artificial Sequence
  Description of Artificial Sequence: Synthetic oligonucleotide
  Target: ATXN1; (-) strand; PAM type: YTN; PAM sequence: CTC
tggccttttctgcaacagtg

SEQ ID NO: 173097 - DNA, 20 bp, Artificial Sequence
  Description of Artificial Sequence: Synthetic oligonucleotide
  Target: ATXN1; (-) strand; PAM type: YTN; PAM sequence: TTG
ccctctggccttttctgcaa

SEQ ID NO: 173098 - DNA, 20 bp, Artificial Sequence
  Description of Artificial Sequence: Synthetic oligonucleotide
  Target: ATXN1; (-) strand; PAM type: YTN; PAM sequence: CTT
gccctctggccttttctgca

SEQ ID NO: 173099 - DNA, 20 bp, Artificial Sequence
  Description of Artificial Sequence: Synthetic oligonucleotide
  Target: ATXN1; (-) strand; PAM type: YTN; PAM sequence: TTC
agccaagcagccttgccctc

SEQ ID NO: 173100 - DNA, 20 bp, Artificial Sequence
  Description of Artificial Sequence: Synthetic oligonucleotide
  Target: ATXN1; (-) strand; PAM type: YTN; PAM sequence: CTT
cagccaagcagccttgccct

SEQ ID NO: 173101 - DNA, 20 bp, Artificial Sequence
  Description of Artificial Sequence: Synthetic oligonucleotide
  Target: ATXN1; (-) strand; PAM type: YTN; PAM sequence: CTG
aggcccatcttcagccaagc

SEQ ID NO: 173102 - DNA, 20 bp, Artificial Sequence
  Description of Artificial Sequence: Synthetic oligonucleotide
  Target: ATXN1; (-) strand; PAM type: YTN; PAM sequence: CTC
tgaggcccatcttcagccaa

SEQ ID NO: 173103 - DNA, 20 bp, Artificial Sequence
  Description of Artificial Sequence: Synthetic oligonucleotide
  Target: ATXN1; (-) strand; PAM type: YTN; PAM sequence: TTC
cataaaaagcccagaacctc

SEQ ID NO: 173104 - DNA, 20 bp, Artificial Sequence
  Description of Artificial Sequence: Synthetic oligonucleotide
  Target: ATXN1; (-) strand; PAM type: YTN; PAM sequence: CTA
attccataaaaagcccagaa

SEQ ID NO: 173105 - DNA, 20 bp, Artificial Sequence
  Description of Artificial Sequence: Synthetic oligonucleotide
  Target: ATXN1; (-) strand; PAM type: YTN; PAM sequence: TTC
ccatgcctaattccataaaa

SEQ ID NO: 173106 - DNA, 20 bp, Artificial Sequence
  Description of Artificial Sequence: Synthetic oligonucleotide
  Target: ATXN1; (-) strand; PAM type: YTN; PAM sequence: CTT
cccatgcctaattccataaa

SEQ ID NO: 173107 - DNA, 20 bp, Artificial Sequence
  Description of Artificial Sequence: Synthetic oligonucleotide
  Target: ATXN1; (-) strand; PAM type: YTN; PAM sequence: CTG
cttcccatgcctaattccat

SEQ ID NO: 173108 - DNA, 20 bp, Artificial Sequence
  Description of Artificial Sequence: Synthetic oligonucleotide
  Target: ATXN1; (-) strand; PAM type: YTN; PAM sequence: TTG
atgtaggagagcaaagctgc

SEQ ID NO: 173109 - DNA, 20 bp, Artificial Sequence
  Description of Artificial Sequence: Synthetic oligonucleotide
  Target: ATXN1; (-) strand; PAM type: YTN; PAM sequence: TTT
gatgtaggagagcaaagctg

SEQ ID NO: 173110 - DNA, 20 bp, Artificial Sequence
  Description of Artificial Sequence: Synthetic oligonucleotide
  Target: ATXN1; (-) strand; PAM type: YTN; PAM sequence: TTA
agataacgtttgatgtagga

SEQ ID NO: 173111 - DNA, 20 bp, Artificial Sequence
  Description of Artificial Sequence: Synthetic oligonucleotide
  Target: ATXN1; (-) strand; PAM type: YTN; PAM sequence: CTG
tggagttaagataacgtttg

SEQ ID NO: 173112 - DNA, 20 bp, Artificial Sequence
  Description of Artificial Sequence: Synthetic oligonucleotide
  Target: ATXN1; (-) strand; PAM type: YTN; PAM sequence: TTC
tgtggagttaagataacgtt

SEQ ID NO: 173113 - DNA, 20 bp, Artificial Sequence
  Description of Artificial Sequence: Synthetic oligonucleotide
  Target: ATXN1; (-) strand; PAM type: YTN; PAM sequence: TTT
ctgtggagttaagataacgt

SEQ ID NO: 173114 - DNA, 20 bp, Artificial Sequence
  Description of Artificial Sequence: Synthetic oligonucleotide
  Target: ATXN1; (-) strand; PAM type: YTN; PAM sequence: TTT
tctgtggagttaagataacg

SEQ ID NO: 173115 - DNA, 20 bp, Artificial Sequence
  Description of Artificial Sequence: Synthetic oligonucleotide
  Target: ATXN1; (-) strand; PAM type: YTN; PAM sequence: TTT
ttctgtggagttaagataac

SEQ ID NO: 173116 - DNA, 20 bp, Artificial Sequence
  Description of Artificial Sequence: Synthetic oligonucleotide
  Target: ATXN1; (-) strand; PAM type: YTN; PAM sequence: TTT
tttctgtggagttaagataa

SEQ ID NO: 173117 - DNA, 20 bp, Artificial Sequence
  Description of Artificial Sequence: Synthetic oligonucleotide
  Target: ATXN1; (-) strand; PAM type: YTN; PAM sequence: TTC
gtgaattttttctgtggagt

SEQ ID NO: 173118 - DNA, 20 bp, Artificial Sequence
  Description of Artificial Sequence: Synthetic oligonucleotide
  Target: ATXN1; (-) strand; PAM type: YTN; PAM sequence: TTG
gagttcgtgaattttttctg

SEQ ID NO: 173119 - DNA, 20 bp, Artificial Sequence
  Description of Artificial Sequence: Synthetic oligonucleotide
  Target: ATXN1; (-) strand; PAM type: YTN; PAM sequence: TTT
ggagttcgtgaattttttct

SEQ ID NO: 173120 - DNA, 20 bp, Artificial Sequence
  Description of Artificial Sequence: Synthetic oligonucleotide
  Target: ATXN1; (-) strand; PAM type: YTN; PAM sequence: TTT
tggagttcgtgaattttttc

SEQ ID NO: 173121 - DNA, 20 bp, Artificial Sequence
  Description of Artificial Sequence: Synthetic oligonucleotide
  Target: ATXN1; (-) strand; PAM type: YTN; PAM sequence: TTG
tcaagaggaaggttttggag

SEQ ID NO: 173122 - DNA, 20 bp, Artificial Sequence
  Description of Artificial Sequence: Synthetic oligonucleotide
  Target: ATXN1; (-) strand; PAM type: YTN; PAM sequence: CTG
gttgtcaagaggaaggtttt

SEQ ID NO: 173123 - DNA, 20 bp, Artificial Sequence
  Description of Artificial Sequence: Synthetic oligonucleotide
  Target: ATXN1; (-) strand; PAM type: YTN; PAM sequence: CTC
tggttgtcaagaggaaggtt

SEQ ID NO: 173124 - DNA, 20 bp, Artificial Sequence
  Description of Artificial Sequence: Synthetic oligonucleotide
  Target: ATXN1; (-) strand; PAM type: YTN; PAM sequence: CTC
ctctggttgtcaagaggaag

SEQ ID NO: 173125 - DNA, 20 bp, Artificial Sequence
  Description of Artificial Sequence: Synthetic oligonucleotide
  Target: ATXN1; (-) strand; PAM type: YTN; PAM sequence: TTC
ctcctctggttgtcaagagg

SEQ ID NO: 173126 - DNA, 20 bp, Artificial Sequence
  Description of Artificial Sequence: Synthetic oligonucleotide
  Target: ATXN1; (-) strand; PAM type: YTN; PAM sequence: CTT
cctcctctggttgtcaagag

SEQ ID NO: 173127 - DNA, 20 bp, Artificial Sequence
  Description of Artificial Sequence: Synthetic oligonucleotide
  Target: ATXN1; (-) strand; PAM type: YTN; PAM sequence: TTA
aaaccaccttcctcctctgg

SEQ ID NO: 173128 - DNA, 20 bp, Artificial Sequence
  Description of Artificial Sequence: Synthetic oligonucleotide
  Target: ATXN1; (-) strand; PAM type: YTN; PAM sequence: CTG
ggttaaaaccaccttcctcc

SEQ ID NO: 173129 - DNA, 20 bp, Artificial Sequence
  Description of Artificial Sequence: Synthetic oligonucleotide
  Target: ATXN1; (-) strand; PAM type: YTN; PAM sequence: TTC
agactgggttaaaaccacct

SEQ ID NO: 173130 - DNA, 20 bp, Artificial Sequence
  Description of Artificial Sequence: Synthetic oligonucleotide
  Target: ATXN1; (-) strand; PAM type: YTN; PAM sequence: TTG
aattcagactgggttaaaac

SEQ ID NO: 173131 - DNA, 20 bp, Artificial Sequence
  Description of Artificial Sequence: Synthetic oligonucleotide
  Target: ATXN1; (-) strand; PAM type: YTN; PAM sequence: TTT
gaattcagactgggttaaaa

SEQ ID NO: 173132 - DNA, 20 bp, Artificial Sequence
  Description of Artificial Sequence: Synthetic oligonucleotide
  Target: ATXN1; (-) strand; PAM type: YTN; PAM sequence: CTA
cagatttgaattcagactgg

SEQ ID NO: 173133 - DNA, 20 bp, Artificial Sequence
  Description of Artificial Sequence: Synthetic oligonucleotide
  Target: ATXN1; (-) strand; PAM type: YTN; PAM sequence: CTA
tctacagatttgaattcaga

SEQ ID NO: 173134 - DNA, 20 bp, Artificial Sequence
  Description of Artificial Sequence: Synthetic oligonucleotide
  Target: ATXN1; (-) strand; PAM type: YTN; PAM sequence: TTC
actatctacagatttgaatt

SEQ ID NO: 173135 - DNA, 20 bp, Artificial Sequence
  Description of Artificial Sequence: Synthetic oligonucleotide
  Target: ATXN1; (-) strand; PAM type: YTN; PAM sequence: TTA
aaaaaaattcactatctaca

SEQ ID NO: 173136 - DNA, 20 bp, Artificial Sequence
  Description of Artificial Sequence: Synthetic oligonucleotide
  Target: ATXN1; (-) strand; PAM type: YTN; PAM sequence: TTA
agagagttaaaaaaaattca

SEQ ID NO: 173137 - DNA, 20 bp, Artificial Sequence
  Description of Artificial Sequence: Synthetic oligonucleotide
  Target: ATXN1; (-) strand; PAM type: YTN; PAM sequence: TTT
aagagagttaaaaaaaattc

SEQ ID NO: 173138 - DNA, 20 bp, Artificial Sequence
  Description of Artificial Sequence: Synthetic oligonucleotide
  Target: ATXN1; (-) strand; PAM type: YTN; PAM sequence: TTT
taagagagttaaaaaaaatt

SEQ ID NO: 173139 - DNA, 20 bp, Artificial Sequence
  Description of Artificial Sequence: Synthetic oligonucleotide
  Target: ATXN1; (-) strand; PAM type: YTN; PAM sequence: CTG
ttttaagagagttaaaaaaa

SEQ ID NO: 173140 - DNA, 20 bp, Artificial Sequence
  Description of Artificial Sequence: Synthetic oligonucleotide
  Target: ATXN1; (-) strand; PAM type: YTN; PAM sequence: TTC
aaagcgctgttttaagagag

SEQ ID NO: 173141 - DNA, 20 bp, Artificial Sequence
  Description of Artificial Sequence: Synthetic oligonucleotide
  Target: ATXN1; (-) strand; PAM type: YTN; PAM sequence: TTC
aaaattcaaagcgctgtttt

SEQ ID NO: 173142 - DNA, 20 bp, Artificial Sequence
  Description of Artificial Sequence: Synthetic oligonucleotide
  Target: ATXN1; (-) strand; PAM type: YTN; PAM sequence: CTA
catgtgtatgtatatataat

SEQ ID NO: 173143 - DNA, 20 bp, Artificial Sequence
  Description of Artificial Sequence: Synthetic oligonucleotide
  Target: ATXN1; (-) strand; PAM type: YTN; PAM sequence: TTA
tatccatacatacatacacg

SEQ ID NO: 173144 - DNA, 20 bp, Artificial Sequence
  Description of Artificial Sequence: Synthetic oligonucleotide
  Target: ATXN1; (-) strand; PAM type: YTN; PAM sequence: TTT
atatccatacatacatacac

SEQ ID NO: 173145 - DNA, 20 bp, Artificial Sequence
  Description of Artificial Sequence: Synthetic oligonucleotide
  Target: ATXN1; (-) strand; PAM type: YTN; PAM sequence: CTG
agtgtatgtgtgtgtacatg

SEQ ID NO: 173146 - DNA, 20 bp, Artificial Sequence
  Description of Artificial Sequence: Synthetic oligonucleotide
  Target: ATXN1; (-) strand; PAM type: YTN; PAM sequence: TTC
tgagtgtatgtgtgtgtaca

SEQ ID NO: 173147 - DNA, 20 bp, Artificial Sequence
  Description of Artificial Sequence: Synthetic oligonucleotide
  Target: ATXN1; (-) strand; PAM type: YTN; PAM sequence: TTT
ctgagtgtatgtgtgtgtac

SEQ ID NO: 173148 - DNA, 20 bp, Artificial Sequence
  Description of Artificial Sequence: Synthetic oligonucleotide
  Target: ATXN1; (-) strand; PAM type: YTN; PAM sequence: CTT
tctgagtgtatgtgtgtgta

SEQ ID NO: 173149 - DNA, 20 bp, Artificial Sequence
  Description of Artificial Sequence: Synthetic oligonucleotide
  Target: ATXN1; (-) strand; PAM type: YTN; PAM sequence: CTG
ccagagtcccagtctttctg

SEQ ID NO: 173150 - DNA, 20 bp, Artificial Sequence
  Description of Artificial Sequence: Synthetic oligonucleotide
  Target: ATXN1; (-) strand; PAM type: YTN; PAM sequence: TTC
ctgccagagtcccagtcttt

SEQ ID NO: 173151 - DNA, 20 bp, Artificial Sequence
  Description of Artificial Sequence: Synthetic oligonucleotide
  Target: ATXN1; (-) strand; PAM type: YTN; PAM sequence: CTG
gttcctgccagagtcccagt

SEQ ID NO: 173152 - DNA, 20 bp, Artificial Sequence
  Description of Artificial Sequence: Synthetic oligonucleotide
  Target: ATXN1; (-) strand; PAM type: YTN; PAM sequence: TTC
tggttcctgccagagtccca

SEQ ID NO: 173153 - DNA, 20 bp, Artificial Sequence
  Description of Artificial Sequence: Synthetic oligonucleotide
  Target: ATXN1; (-) strand; PAM type: YTN; PAM sequence: TTG
ggatgtggcagaattctggt

SEQ ID NO: 173154 - DNA, 20 bp, Artificial Sequence
  Description of Artificial Sequence: Synthetic oligonucleotide
  Target: ATXN1; (-) strand; PAM type: YTN; PAM sequence: TTT
gggatgtggcagaattctgg

SEQ ID NO: 173155 - DNA, 20 bp, Artificial Sequence
  Description of Artificial Sequence: Synthetic oligonucleotide
  Target: ATXN1; (-) strand; PAM type: YTN; PAM sequence: CTA
ggtttgggatgtggcagaat

SEQ ID NO: 173156 - DNA, 20 bp, Artificial Sequence
  Description of Artificial Sequence: Synthetic oligonucleotide
  Target: ATXN1; (-) strand; PAM type: YTN; PAM sequence: CTG
ctaggtttgggatgtggcag

SEQ ID NO: 173157 - DNA, 20 bp, Artificial Sequence
  Description of Artificial Sequence: Synthetic oligonucleotide
  Target: ATXN1; (-) strand; PAM type: YTN; PAM sequence: TTG
gtctgctaggtttgggatgt

SEQ ID NO: 173158 - DNA, 20 bp, Artificial Sequence
  Description of Artificial Sequence: Synthetic oligonucleotide
  Target: ATXN1; (-) strand; PAM type: YTN; PAM sequence: CTT
ggtctgctaggtttgggatg

SEQ ID NO: 173159 - DNA, 20 bp, Artificial Sequence
  Description of Artificial Sequence: Synthetic oligonucleotide
  Target: ATXN1; (-) strand; PAM type: YTN; PAM sequence: TTG
aacttggtctgctaggtttg

SEQ ID NO: 173160 - DNA, 20 bp, Artificial Sequence
  Description of Artificial Sequence: Synthetic oligonucleotide
  Target: ATXN1; (-) strand; PAM type: YTN; PAM sequence: TTC
caaagttgaacttggtctgc

SEQ ID NO: 173161 - DNA, 20 bp, Artificial Sequence
  Description of Artificial Sequence: Synthetic oligonucleotide
  Target: ATXN1; (-) strand; PAM type: YTN; PAM sequence: TTT
ccaaagttgaacttggtctg

SEQ ID NO: 173162 - DNA, 20 bp, Artificial Sequence
  Description of Artificial Sequence: Synthetic oligonucleotide
  Target: ATXN1; (-) strand; PAM type: YTN; PAM sequence: CTG
gcgtgaaggtgatgatgcat

SEQ ID NO: 173163 - DNA, 20 bp, Artificial Sequence
  Description of Artificial Sequence: Synthetic oligonucleotide
  Target: ATXN1; (-) strand; PAM type: YTN; PAM sequence: TTC
tggcgtgaaggtgatgatgc

SEQ ID NO: 173164 - DNA, 20 bp, Artificial Sequence
  Description of Artificial Sequence: Synthetic oligonucleotide
  Target: ATXN1; (-) strand; PAM type: YTN; PAM sequence: TTG
tgattctggcgtgaaggtga

SEQ ID NO: 173165 - DNA, 20 bp, Artificial Sequence
  Description of Artificial Sequence: Synthetic oligonucleotide
  Target: ATXN1; (-) strand; PAM type: YTN; PAM sequence: TTT
gtgattctggcgtgaaggtg

SEQ ID NO: 173166 - DNA, 20 bp, Artificial Sequence
  Description of Artificial Sequence: Synthetic oligonucleotide
  Target: ATXN1; (-) strand; PAM type: YTN; PAM sequence: TTG
cccgtgtgtttgtgattctg

SEQ ID NO: 173167 - DNA, 20 bp, Artificial Sequence
  Description of Artificial Sequence: Synthetic oligonucleotide
  Target: ATXN1; (-) strand; PAM type: YTN; PAM sequence: CTT
gcccgtgtgtttgtgattct

SEQ ID NO: 173168 - DNA, 20 bp, Artificial Sequence
  Description of Artificial Sequence: Synthetic oligonucleotide
  Target: ATXN1; (-) strand; PAM type: YTN; PAM sequence: CTC
ttgcccgtgtgtttgtgatt

SEQ ID NO: 173169 - DNA, 20 bp, Artificial Sequence
  Description of Artificial Sequence: Synthetic oligonucleotide
  Target: ATXN1; (-) strand; PAM type: YTN; PAM sequence: TTC
aacctcttgcccgtgtgttt

SEQ ID NO: 173170 - DNA, 20 bp, Artificial Sequence
  Description of Artificial Sequence: Synthetic oligonucleotide
  Target: ATXN1; (-) strand; PAM type: YTN; PAM sequence: TTT
caacctcttgcccgtgtgtt

SEQ ID NO: 173171 - DNA, 20 bp, Artificial Sequence
  Description of Artificial Sequence: Synthetic oligonucleotide
  Target: ATXN1; (-) strand; PAM type: YTN; PAM sequence: CTG
ggatttcaacctcttgcccg

SEQ ID NO: 173172 - DNA, 20 bp, Artificial Sequence
  Description of Artificial Sequence: Synthetic oligonucleotide
  Target: ATXN1; (-) strand; PAM type: YTN; PAM sequence: CTG
agaagccgaggacctgggat

SEQ ID NO: 173173 - DNA, 20 bp, Artificial Sequence
  Description of Artificial Sequence: Synthetic oligonucleotide
  Target: ATXN1; (-) strand; PAM type: YTN; PAM sequence: CTG
atgtgtcagctgagaagccg

SEQ ID NO: 173174 - DNA, 20 bp, Artificial Sequence
  Description of Artificial Sequence: Synthetic oligonucleotide
  Target: ATXN1; (-) strand; PAM type: YTN; PAM sequence: CTC
tgatgtgtcagctgagaagc

SEQ ID NO: 173175 - DNA, 20 bp, Artificial Sequence
  Description of Artificial Sequence: Synthetic oligonucleotide
  Target: ATXN1; (-) strand; PAM type: YTN; PAM sequence: TTA
gaaaacgcataaactctgat

SEQ ID NO: 173176 - DNA, 20 bp, Artificial Sequence
  Description of Artificial Sequence: Synthetic oligonucleotide
  Target: ATXN1; (-) strand; PAM type: YTN; PAM sequence: CTT
agaaaacgcataaactctga

SEQ ID NO: 173177 - DNA, 20 bp, Artificial Sequence
  Description of Artificial Sequence: Synthetic oligonucleotide
  Target: ATXN1; (-) strand; PAM type: YTN; PAM sequence: TTC
ttagaaaacgcataaactct

SEQ ID NO: 173178 - DNA, 20 bp, Artificial Sequence
  Description of Artificial Sequence: Synthetic oligonucleotide
  Target: ATXN1; (-) strand; PAM type: YTN; PAM sequence: CTT
cttagaaaacgcataaactc

SEQ ID NO: 173179 - DNA, 20 bp, Artificial Sequence
  Description of Artificial Sequence: Synthetic oligonucleotide
  Target: ATXN1; (-) strand; PAM type: YTN; PAM sequence: CTC
ttcttagaaaacgcataaac

SEQ ID NO: 173180 - DNA, 20 bp, Artificial Sequence
  Description of Artificial Sequence: Synthetic oligonucleotide
  Target: ATXN1; (-) strand; PAM type: YTN; PAM sequence: TTC
ctcttcttagaaaacgcata

SEQ ID NO: 173181 - DNA, 20 bp, Artificial Sequence
  Description of Artificial Sequence: Synthetic oligonucleotide
  Target: ATXN1; (-) strand; PAM type: YTN; PAM sequence: CTT
cctcttcttagaaaacgcat

SEQ ID NO: 173182 - DNA, 20 bp, Artificial Sequence
  Description of Artificial Sequence: Synthetic oligonucleotide
  Target: ATXN1; (-) strand; PAM type: YTN; PAM sequence: TTG
aataacttcctcttcttaga

SEQ ID NO: 173183 - DNA, 20 bp, Artificial Sequence
  Description of Artificial Sequence: Synthetic oligonucleotide
  Target: ATXN1; (-) strand; PAM type: YTN; PAM sequence: CTT
gaataacttcctcttcttag

SEQ ID NO: 173184 - DNA, 20 bp, Artificial Sequence
  Description of Artificial Sequence: Synthetic oligonucleotide
  Target: ATXN1; (-) strand; PAM type: YTN; PAM sequence: TTA
aagagcttgaataacttcct

SEQ ID NO: 173185 - DNA, 20 bp, Artificial Sequence
  Description of Artificial Sequence: Synthetic oligonucleotide
  Target: ATXN1; (-) strand; PAM type: YTN; PAM sequence: TTT
aaagagcttgaataacttcc

SEQ ID NO: 173186 - DNA, 20 bp, Artificial Sequence
  Description of Artificial Sequence: Synthetic oligonucleotide
  Target: ATXN1; (-) strand; PAM type: YTN; PAM sequence: TTT
taaagagcttgaataacttc

SEQ ID NO: 173187 - DNA, 20 bp, Artificial Sequence
  Description of Artificial Sequence: Synthetic oligonucleotide
  Target: ATXN1; (-) strand; PAM type: YTN; PAM sequence: TTT
ttaaagagcttgaataactt

SEQ ID NO: 173188 - DNA, 20 bp, Artificial Sequence
  Description of Artificial Sequence: Synthetic oligonucleotide
  Target: ATXN1; (-) strand; PAM type: YTN; PAM sequence: TTT
tttaaagagcttgaataact

SEQ ID NO: 173189 - DNA, 20 bp, Artificial Sequence
  Description of Artificial Sequence: Synthetic oligonucleotide
  Target: ATXN1; (-) strand; PAM type: YTN; PAM sequence: TTT
ttttaaagagcttgaataac

SEQ ID NO: 173190 - DNA, 20 bp, Artificial Sequence
  Description of Artificial Sequence: Synthetic oligonucleotide
  Target: ATXN1; (-) strand; PAM type: YTN; PAM sequence: TTT
tttttaaagagcttgaataa

SEQ ID NO: 173191 - DNA, 20 bp, Artificial Sequence
  Description of Artificial Sequence: Synthetic oligonucleotide
  Target: ATXN1; (-) strand; PAM type: YTN; PAM sequence: TTT
ttttttaaagagcttgaata

SEQ ID NO: 173192 - DNA, 20 bp, Artificial Sequence
  Description of Artificial Sequence: Synthetic oligonucleotide
  Target: ATXN1; (-) strand; PAM type: YTN; PAM sequence: TTA
aaaaatttttttttaaagag

SEQ ID NO: 173193 - DNA, 20 bp, Artificial Sequence
  Description of Artificial Sequence: Synthetic oligonucleotide
  Target: ATXN1; (-) strand; PAM type: YTN; PAM sequence: CTT
aaaaaatttttttttaaaga

SEQ ID NO: 173194 - DNA, 20 bp, Artificial Sequence
  Description of Artificial Sequence: Synthetic oligonucleotide
  Target: ATXN1; (-) strand; PAM type: YTN; PAM sequence: CTG
tcttaaaaaattttttttta

SEQ ID NO: 173195 - DNA, 20 bp, Artificial Sequence
  Description of Artificial Sequence: Synthetic oligonucleotide
  Target: ATXN1; (-) strand; PAM type: YTN; PAM sequence: CTG
agtgacaaagtgagaccctg

SEQ ID NO: 173196 - DNA, 20 bp, Artificial Sequence
  Description of Artificial Sequence: Synthetic oligonucleotide
  Target: ATXN1; (-) strand; PAM type: YTN; PAM sequence: CTC
caacctgagtgacaaagtga

SEQ ID NO: 173197 - DNA, 20 bp, Artificial Sequence
  Description of Artificial Sequence: Synthetic oligonucleotide
  Target: ATXN1; (-) strand; PAM type: YTN; PAM sequence: CTG
cactccaacctgagtgacaa

SEQ ID NO: 173198 - DNA, 20 bp, Artificial Sequence
  Description of Artificial Sequence: Synthetic oligonucleotide
  Target: ATXN1; (-) strand; PAM type: YTN; PAM sequence: TTA
caccactgcactccaacctg

SEQ ID NO: 173199 - DNA, 20 bp, Artificial Sequence
  Description of Artificial Sequence: Synthetic oligonucleotide
  Target: ATXN1; (-) strand; PAM type: YTN; PAM sequence: CTG
agattacaccactgcactcc

SEQ ID NO: 173200 - DNA, 20 bp, Artificial Sequence
  Description of Artificial Sequence: Synthetic oligonucleotide
  Target: ATXN1; (-) strand; PAM type: YTN; PAM sequence: CTG
aagtgagctgagattacacc

SEQ ID NO: 173201 - DNA, 20 bp, Artificial Sequence
  Description of Artificial Sequence: Synthetic oligonucleotide
  Target: ATXN1; (-) strand; PAM type: YTN; PAM sequence: TTG
aacccagaaggtcaaggctg

SEQ ID NO: 173202 - DNA, 20 bp, Artificial Sequence
  Description of Artificial Sequence: Synthetic oligonucleotide
  Target: ATXN1; (-) strand; PAM type: YTN; PAM sequence: CTT
gaacccagaaggtcaaggct

SEQ ID NO: 173203 - DNA, 20 bp, Artificial Sequence
  Description of Artificial Sequence: Synthetic oligonucleotide
  Target: ATXN1; (-) strand; PAM type: YTN; PAM sequence: TTG
cttgaacccagaaggtcaag

SEQ ID NO: 173204 - DNA, 20 bp, Artificial Sequence
  Description of Artificial Sequence: Synthetic oligonucleotide
  Target: ATXN1; (-) strand; PAM type: YTN; PAM sequence: CTG
aagcaggagaattgcttgaa

SEQ ID NO: 173205 - DNA, 20 bp, Artificial Sequence
  Description of Artificial Sequence: Synthetic oligonucleotide
  Target: ATXN1; (-) strand; PAM type: YTN; PAM sequence: TTA
aggggctgaagcaggagaat

SEQ ID NO: 173206 - DNA, 20 bp, Artificial Sequence
  Description of Artificial Sequence: Synthetic oligonucleotide
  Target: ATXN1; (-) strand; PAM type: YTN; PAM sequence: CTT
aaggggctgaagcaggagaa

SEQ ID NO: 173207 - DNA, 20 bp, Artificial Sequence
  Description of Artificial Sequence: Synthetic oligonucleotide
  Target: ATXN1; (-) strand; PAM type: YTN; PAM sequence: CTA
cttaaggggctgaagcagga

SEQ ID NO: 173208 - DNA, 20 bp, Artificial Sequence
  Description of Artificial Sequence: Synthetic oligonucleotide
  Target: ATXN1; (-) strand; PAM type: YTN; PAM sequence: CTG
tagtcccaactacttaaggg

SEQ ID NO: 173209 - DNA, 20 bp, Artificial Sequence
  Description of Artificial Sequence: Synthetic oligonucleotide
  Target: ATXN1; (-) strand; PAM type: YTN; PAM sequence: TTG
gcatgcatctgtagtcccaa

SEQ ID NO: 173210 - DNA, 20 bp, Artificial Sequence
  Description of Artificial Sequence: Synthetic oligonucleotide
  Target: ATXN1; (-) strand; PAM type: YTN; PAM sequence: TTA
gtcaggtgtattggcatgca

SEQ ID NO: 173211 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattagtcag

SEQ ID NO: 173212 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaattagt

SEQ ID NO: 173213 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaatta

SEQ ID NO: 173214 - DNA, 20 bp, Artificial Sequence
  Description of Artificial Sequence: Synthetic oligonucleotide
  Target: ATXN1; (-) strand; PAM type: YTN; PAM sequence: CTG
gccaatgtggcgaaacccca

SEQ ID NO: 173215 - DNA, 20 bp, Artificial Sequence
  Description of Artificial Sequence: Synthetic oligonucleotide
  Target: ATXN1; (-) strand; PAM type: YTN; PAM sequence: TTC
gagaccagcctggccaatgt

SEQ ID NO: 173216 - DNA, 20 bp, Artificial Sequence
  Description of Artificial Sequence: Synthetic oligonucleotide
  Target: ATXN1; (-) strand; PAM type: YTN; PAM sequence: CTC
aagagttcgagaccagcctg

SEQ ID NO: 173217 - DNA, 20 bp, Artificial Sequence
  Description of Artificial Sequence: Synthetic oligonucleotide
  Target: ATXN1; (-) strand; PAM type: YTN; PAM sequence: TTG
agctcaagagttcgagacca

SEQ ID NO: 173218 - DNA, 20 bp, Artificial Sequence
  Description of Artificial Sequence: Synthetic oligonucleotide
  Target: ATXN1; (-) strand; PAM type: YTN; PAM sequence: CTT
gagctcaagagttcgagacc

SEQ ID NO: 173219 - DNA, 20 bp, Artificial Sequence
  Description of Artificial Sequence: Synthetic oligonucleotide
  Target: ATXN1; (-) strand; PAM type: YTN; PAM sequence: TTG
gaggccaaggtgtgaggatc

SEQ ID NO: 173220 - DNA, 20 bp, Artificial Sequence
  Description of Artificial Sequence: Synthetic oligonucleotide
  Target: ATXN1; (-) strand; PAM type: YTN; PAM sequence: TTT
ggaggccaaggtgtgaggat

SEQ ID NO: 173221 - DNA, 20 bp, Artificial Sequence
  Description of Artificial Sequence: Synthetic oligonucleotide
  Target: ATXN1; (-) strand; PAM type: YTN; PAM sequence: TTT
tggaggccaaggtgtgagga

SEQ ID NO: 173222 - DNA, 20 bp, Artificial Sequence
  Description of Artificial Sequence: Synthetic oligonucleotide
  Target: ATXN1; (-) strand; PAM type: YTN; PAM sequence: CTT
ttggaggccaaggtgtgagg

SEQ ID NO: 173223 - DNA, 20 bp, Artificial Sequence
  Description of Artificial Sequence: Synthetic oligonucleotide
  Target: ATXN1; (-) strand; PAM type: YTN; PAM sequence: CTA
gcacttttggaggccaaggt

SEQ ID NO: 173224 - DNA, 20 bp, Artificial Sequence
  Description of Artificial Sequence: Synthetic oligonucleotide
  Target: ATXN1; (-) strand; PAM type: YTN; PAM sequence: CTG
taatcctagcacttttggag

SEQ ID NO: 173225 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcctagcact

SEQ ID NO: 173226 - DNA, 20 bp, Artificial Sequence
  Description of Artificial Sequence: Synthetic oligonucleotide
  Target: ATXN1; (-) strand; PAM type: YTN; PAM sequence: TTA
gggccgggcgccatggctca

SEQ ID NO: 173227 - DNA, 20 bp, Artificial Sequence
  Description of Artificial Sequence: Synthetic oligonucleotide
  Target: ATXN1; (-) strand; PAM type: YTN; PAM sequence: CTT
agggccgggcgccatggctc

SEQ ID NO: 173228 - DNA, 20 bp, Artificial Sequence
  Description of Artificial Sequence: Synthetic oligonucleotide
  Target: ATXN1; (-) strand; PAM type: YTN; PAM sequence: TTA
aagagcttagggccgggcgc

SEQ ID NO: 173229 - DNA, 20 bp, Artificial Sequence
  Description of Artificial Sequence: Synthetic oligonucleotide
  Target: ATXN1; (-) strand; PAM type: YTN; PAM sequence: TTT
aaagagcttagggccgggcg

SEQ ID NO: 173230 - DNA, 20 bp, Artificial Sequence
  Description of Artificial Sequence: Synthetic oligonucleotide
  Target: ATXN1; (-) strand; PAM type: YTN; PAM sequence: CTG
catttaaagagcttagggcc

SEQ ID NO: 173231 - DNA, 20 bp, Artificial Sequence
  Description of Artificial Sequence: Synthetic oligonucleotide
  Target: ATXN1; (-) strand; PAM type: YTN; PAM sequence: TTG
ctgcatttaaagagcttagg

SEQ ID NO: 173232 - DNA, 20 bp, Artificial Sequence
  Description of Artificial Sequence: Synthetic oligonucleotide
  Target: ATXN1; (-) strand; PAM type: YTN; PAM sequence: CTC
aggaggggacagggtaataa

SEQ ID NO: 173233 - DNA, 20 bp, Artificial Sequence
  Description of Artificial Sequence: Synthetic oligonucleotide
  Target: ATXN1; (-) strand; PAM type: YTN; PAM sequence: TTG
gaggtagaagaagatgaagt

SEQ ID NO: 173234 - DNA, 20 bp, Artificial Sequence
  Description of Artificial Sequence: Synthetic oligonucleotide
  Target: ATXN1; (-) strand; PAM type: YTN; PAM sequence: TTT
ggaggtagaagaagatgaag

SEQ ID NO: 173235 - DNA, 20 bp, Artificial Sequence
  Description of Artificial Sequence: Synthetic oligonucleotide
  Target: ATXN1; (-) strand; PAM type: YTN; PAM sequence: TTT
tggaggtagaagaagatgaa

SEQ ID NO: 173236 - DNA, 20 bp, Artificial Sequence
  Description of Artificial Sequence: Synthetic oligonucleotide
  Target: ATXN1; (-) strand; PAM type: YTN; PAM sequence: TTC
aggatgaggagagttttgga

SEQ ID NO: 173237 - DNA, 20 bp, Artificial Sequence
  Description of Artificial Sequence: Synthetic oligonucleotide
  Target: ATXN1; (-) strand; PAM type: YTN; PAM sequence: TTT
caggatgaggagagttttgg

SEQ ID NO: 173238 - DNA, 20 bp, Artificial Sequence
  Description of Artificial Sequence: Synthetic oligonucleotide
  Target: ATXN1; (-) strand; PAM type: YTN; PAM sequence: TTT
tcaggatgaggagagttttg

SEQ ID NO: 173239 - DNA, 20 bp, Artificial Sequence
  Description of Artificial Sequence: Synthetic oligonucleotide
  Target: ATXN1; (-) strand; PAM type: YTN; PAM sequence: TTT
ttcaggatgaggagagtttt

SEQ ID NO: 173240 - DNA, 20 bp, Artificial Sequence
  Description of Artificial Sequence: Synthetic oligonucleotide
  Target: ATXN1; (-) strand; PAM type: YTN; PAM sequence: TTT
tttcaggatgaggagagttt

SEQ ID NO: 173241 - DNA, 20 bp, Artificial Sequence
  Description of Artificial Sequence: Synthetic oligonucleotide
  Target: ATXN1; (-) strand; PAM type: YTN; PAM sequence: TTT
ttttcaggatgaggagagtt

SEQ ID NO: 173242 - DNA, 20 bp, Artificial Sequence
  Description of Artificial Sequence: Synthetic oligonucleotide
  Target: ATXN1; (-) strand; PAM type: YTN; PAM sequence: CTT
tttttcaggatgaggagagt

SEQ ID NO: 173243 - DNA, 20 bp, Artificial Sequence
  Description of Artificial Sequence: Synthetic oligonucleotide
  Target: ATXN1; (-) strand; PAM type: YTN; PAM sequence: CTG
tgctttttttcaggatgagg

SEQ ID NO: 173244 - DNA, 20 bp, Artificial Sequence
  Description of Artificial Sequence: Synthetic oligonucleotide
  Target: ATXN1; (-) strand; PAM type: YTN; PAM sequence: CTG
tctgtgctttttttcaggat

SEQ ID NO: 173245 - DNA, 20 bp, Artificial Sequence
  Description of Artificial Sequence: Synthetic oligonucleotide
  Target: ATXN1; (-) strand; PAM type: YTN; PAM sequence: CTG
ctgtctgtgctttttttcag

SEQ ID NO: 173246 - DNA, 20 bp, Artificial Sequence
  Description of Artificial Sequence: Synthetic oligonucleotide
  Target: ATXN1; (-) strand; PAM type: YTN; PAM sequence: TTC
ctgctgtctgtgcttttttt

SEQ ID NO: 173247 - DNA, 20 bp, Artificial Sequence
  Description of Artificial Sequence: Synthetic oligonucleotide
  Target: ATXN1; (-) strand; PAM type: YTN; PAM sequence: TTG
tccattcctgctgtctgtgc

SEQ ID NO: 173248 - DNA, 20 bp, Artificial Sequence
  Description of Artificial Sequence: Synthetic oligonucleotide
  Target: ATXN1; (-) strand; PAM type: YTN; PAM sequence: CTA
tagattgtccattcctgctg

SEQ ID NO: 173249 - DNA, 20 bp, Artificial Sequence
  Description of Artificial Sequence: Synthetic oligonucleotide
  Target: ATXN1; (-) strand; PAM type: YTN; PAM sequence: TTC
aagaacagaacgtgaaagcc

SEQ ID NO: 173250 - DNA, 20 bp, Artificial Sequence
  Description of Artificial Sequence: Synthetic oligonucleotide
  Target: ATXN1; (-) strand; PAM type: YTN; PAM sequence: CTT
caagaacagaacgtgaaagc

SEQ ID NO: 173251 - DNA, 20 bp, Artificial Sequence
  Description of Artificial Sequence: Synthetic oligonucleotide
  Target: ATXN1; (-) strand; PAM type: YTN; PAM sequence: TTA
cttcaagaacagaacgtgaa

SEQ ID NO: 173252 - DNA, 20 bp, Artificial Sequence
  Description of Artificial Sequence: Synthetic oligonucleotide
  Target: ATXN1; (-) strand; PAM type: YTN; PAM sequence: CTT
acttcaagaacagaacgtga

SEQ ID NO: 173253 - DNA, 20 bp, Artificial Sequence
  Description of Artificial Sequence: Synthetic oligonucleotide
  Target: ATXN1; (-) strand; PAM type: YTN; PAM sequence: TTA
agcttacttcaagaacagaa

SEQ ID NO: 173254 - DNA, 20 bp, Artificial Sequence
  Description of Artificial Sequence: Synthetic oligonucleotide
  Target: ATXN1; (-) strand; PAM type: YTN; PAM sequence: TTT
aagcttacttcaagaacaga

SEQ ID NO: 173255 - DNA, 20 bp, Artificial Sequence
  Description of Artificial Sequence: Synthetic oligonucleotide
  Target: ATXN1; (-) strand; PAM type: YTN; PAM sequence: CTT
taagcttacttcaagaacag

SEQ ID NO: 173256 - DNA, 20 bp, Artificial Sequence
  Description of Artificial Sequence: Synthetic oligonucleotide
  Target: ATXN1; (-) strand; PAM type: YTN; PAM sequence: TTG
tctttaagcttacttcaaga

SEQ ID NO: 173257 - DNA, 20 bp, Artificial Sequence
  Description of Artificial Sequence: Synthetic oligonucleotide
  Target: ATXN1; (-) strand; PAM type: YTN; PAM sequence: TTA
ttgtctttaagcttacttca

SEQ ID NO: 173258 - DNA, 20 bp, Artificial Sequence
  Description of Artificial Sequence: Synthetic oligonucleotide
  Target: ATXN1; (-) strand; PAM type: YTN; PAM sequence: TTA
accatagcagggagagtatg

SEQ ID NO: 173259 - DNA, 20 bp, Artificial Sequence
  Description of Artificial Sequence: Synthetic oligonucleotide
  Target: ATXN1; (-) strand; PAM type: YTN; PAM sequence: TTT
aaccatagcagggagagtat

SEQ ID NO: 173260 - DNA, 20 bp, Artificial Sequence
  Description of Artificial Sequence: Synthetic oligonucleotide
  Target: ATXN1; (-) strand; PAM type: YTN; PAM sequence: TTT
taaccatagcagggagagta

SEQ ID NO: 173261 - DNA, 20 bp, Artificial Sequence
  Description of Artificial Sequence: Synthetic oligonucleotide
  Target: ATXN1; (-) strand; PAM type: YTN; PAM sequence: CTT
ttaaccatagcagggagagt

SEQ ID NO: 173262 - DNA, 20 bp, Artificial Sequence
  Description of Artificial Sequence: Synthetic oligonucleotide
  Target: ATXN1; (-) strand; PAM type: YTN; PAM sequence: TTC
ttttaaccatagcagggaga

SEQ ID NO: 173263 - DNA, 20 bp, Artificial Sequence
  Description of Artificial Sequence: Synthetic oligonucleotide
  Target: ATXN1; (-) strand; PAM type: YTN; PAM sequence: CTA
agaattcttttaaccatagc

SEQ ID NO: 173264 - DNA, 20 bp, Artificial Sequence
  Description of Artificial Sequence: Synthetic oligonucleotide
  Target: ATXN1; (-) strand; PAM type: YTN; PAM sequence: TTC
ccaaagatcctaagaattct

SEQ ID NO: 173265 - DNA, 20 bp, Artificial Sequence
  Description of Artificial Sequence: Synthetic oligonucleotide
  Target: ATXN1; (-) strand; PAM type: YTN; PAM sequence: TTT
cccaaagatcctaagaattc

SEQ ID NO: 173266 - DNA, 20 bp, Artificial Sequence
  Description of Artificial Sequence: Synthetic oligonucleotide
  Target: ATXN1; (-) strand; PAM type: YTN; PAM sequence: TTT
tcccaaagatcctaagaatt

SEQ ID NO: 173267 - DNA, 20 bp, Artificial Sequence
  Description of Artificial Sequence: Synthetic oligonucleotide
  Target: ATXN1; (-) strand; PAM type: YTN; PAM sequence: TTT
ttcccaaagatcctaagaat

SEQ ID NO: 173268 - DNA, 20 bp, Artificial Sequence
  Description of Artificial Sequence: Synthetic oligonucleotide
  Target: ATXN1; (-) strand; PAM type: YTN; PAM sequence: TTT
tttcccaaagatcctaagaa

SEQ ID NO: 173269 - DNA, 20 bp, Artificial Sequence
  Description of Artificial Sequence: Synthetic oligonucleotide
  Target: ATXN1; (-) strand; PAM type: YTN; PAM sequence: TTT
ttttcccaaagatcctaaga

SEQ ID NO: 173270 - DNA, 20 bp, Artificial Sequence
  Description of Artificial Sequence: Synthetic oligonucleotide
  Target: ATXN1; (-) strand; PAM type: YTN; PAM sequence: TTT
tttttcccaaagatcctaag

SEQ ID NO: 173271 - DNA, 20 bp, Artificial Sequence
  Description of Artificial Sequence: Synthetic oligonucleotide
  Target: ATXN1; (-) strand; PAM type: YTN; PAM sequence: TTT
ttttttcccaaagatcctaa

SEQ ID NO: 173272 - DNA, 20 bp, Artificial Sequence
  Description of Artificial Sequence: Synthetic oligonucleotide
  Target: ATXN1; (-) strand; PAM type: YTN; PAM sequence: TTT
tttttttcccaaagatccta

SEQ ID NO: 173273 - DNA, 20 bp, Artificial Sequence
  Description of Artificial Sequence: Synthetic oligonucleotide
  Target: ATXN1; (-) strand; PAM type: YTN; PAM sequence: TTT
ttttttttcccaaagatcct

SEQ ID NO: 173274 - DNA, 20 bp, Artificial Sequence
  Description of Artificial Sequence: Synthetic oligonucleotide
  Target: ATXN1; (-) strand; PAM type: YTN; PAM sequence: TTG
agatttttttttttcccaaa

SEQ ID NO: 173275 - DNA, 20 bp, Artificial Sequence
  Description of Artificial Sequence: Synthetic oligonucleotide
  Target: ATXN1; (-) strand; PAM type: YTN; PAM sequence: TTT
gagatttttttttttcccaa

SEQ ID NO: 173276 - DNA, 20 bp, Artificial Sequence
  Description of Artificial Sequence: Synthetic oligonucleotide
  Target: ATXN1; (-) strand; PAM type: YTN; PAM sequence: CTT
tgagatttttttttttccca

SEQ ID NO: 173277 - DNA, 20 bp, Artificial Sequence
  Description of Artificial Sequence: Synthetic oligonucleotide
  Target: ATXN1; (-) strand; PAM type: YTN; PAM sequence: TTA
ctttgagatttttttttttc

SEQ ID NO: 173278 - DNA, 20 bp, Artificial Sequence
  Description of Artificial Sequence: Synthetic oligonucleotide
  Target: ATXN1; (-) strand; PAM type: YTN; PAM sequence: TTT
actttgagattttttttttt

SEQ ID NO: 173279 - DNA, 20 bp, Artificial Sequence
  Description of Artificial Sequence: Synthetic oligonucleotide
  Target: ATXN1; (-) strand; PAM type: YTN; PAM sequence: TTG
tcatatttactttgagattt

SEQ ID NO: 173280 - DNA, 20 bp, Artificial Sequence
  Description of Artificial Sequence: Synthetic oligonucleotide
  Target: ATXN1; (-) strand; PAM type: YTN; PAM sequence: CTA
tattgtcatatttactttga

SEQ ID NO: 173281 - DNA, 20 bp, Artificial Sequence
  Description of Artificial Sequence: Synthetic oligonucleotide
  Target: ATXN1; (-) strand; PAM type: YTN; PAM sequence: CTC
tatattgtcatatttacttt

SEQ ID NO: 173282 - DNA, 20 bp, Artificial Sequence
  Description of Artificial Sequence: Synthetic oligonucleotide
  Target: ATXN1; (-) strand; PAM type: YTN; PAM sequence: CTC
cagtgtctctatattgtcat

SEQ ID NO: 173283 - DNA, 20 bp, Artificial Sequence
  Description of Artificial Sequence: Synthetic oligonucleotide
  Target: ATXN1; (-) strand; PAM type: YTN; PAM sequence: CTC
cctccagtgtctctatattg

SEQ ID NO: 173284 - DNA, 20 bp, Artificial Sequence
  Description of Artificial Sequence: Synthetic oligonucleotide
  Target: ATXN1; (-) strand; PAM type: YTN; PAM sequence: TTA
gagctccctccagtgtctct

SEQ ID NO: 173285 - DNA, 20 bp, Artificial Sequence
  Description of Artificial Sequence: Synthetic oligonucleotide
  Target: ATXN1; (-) strand; PAM type: YTN; PAM sequence: TTT
agagctccctccagtgtctc

SEQ ID NO: 173286 - DNA, 20 bp, Artificial Sequence
  Description of Artificial Sequence: Synthetic oligonucleotide
  Target: ATXN1; (-) strand; PAM type: YTN; PAM sequence: CTA
gatgtttagagctccctcca

SEQ ID NO: 173287 - DNA, 20 bp, Artificial Sequence
  Description of Artificial Sequence: Synthetic oligonucleotide
  Target: ATXN1; (-) strand; PAM type: YTN; PAM sequence: CTA
tcactagatgtttagagctc

SEQ ID NO: 173288 - DNA, 20 bp, Artificial Sequence
  Description of Artificial Sequence: Synthetic oligonucleotide
  Target: ATXN1; (-) strand; PAM type: YTN; PAM sequence: TTC
ctatcactagatgtttagag

SEQ ID NO: 173289 - DNA, 20 bp, Artificial Sequence
  Description of Artificial Sequence: Synthetic oligonucleotide
  Target: ATXN1; (-) strand; PAM type: YTN; PAM sequence: TTT
cctatcactagatgtttaga

SEQ ID NO: 173290 - DNA, 20 bp, Artificial Sequence
  Description of Artificial Sequence: Synthetic oligonucleotide
  Target: ATXN1; (-) strand; PAM type: YTN; PAM sequence: TTT
tcctatcactagatgtttag

SEQ ID NO: 173291 - DNA, 20 bp, Artificial Sequence
  Description of Artificial Sequence: Synthetic oligonucleotide
  Target: ATXN1; (-) strand; PAM type: YTN; PAM sequence: TTT
ttcctatcactagatgttta

SEQ ID NO: 173292 - DNA, 20 bp, Artificial Sequence
  Description of Artificial Sequence: Synthetic oligonucleotide
  Target: ATXN1; (-) strand; PAM type: YTN; PAM sequence: TTC
agcatttttcctatcactag

SEQ ID NO: 173293 - DNA, 20 bp, Artificial Sequence
  Description of Artificial Sequence: Synthetic oligonucleotide
  Target: ATXN1; (-) strand; PAM type: YTN; PAM sequence: TTT
cagcatttttcctatcacta

SEQ ID NO: 173294 - DNA, 20 bp, Artificial Sequence
  Description of Artificial Sequence: Synthetic oligonucleotide
  Target: ATXN1; (-) strand; PAM type: YTN; PAM sequence: TTA
ggatacataatttcagcatt

SEQ ID NO: 173295 - DNA, 20 bp, Artificial Sequence
  Description of Artificial Sequence: Synthetic oligonucleotide
  Target: ATXN1; (-) strand; PAM type: YTN; PAM sequence: TTT
aggatacataatttcagcat

SEQ ID NO: 173296 - DNA, 20 bp, Artificial Sequence
  Description of Artificial Sequence: Synthetic oligonucleotide
  Target: ATXN1; (-) strand; PAM type: YTN; PAM sequence: TTT
taggatacataatttcagca

SEQ ID NO: 173297 - DNA, 20 bp, Artificial Sequence
  Description of Artificial Sequence: Synthetic oligonucleotide
  Target: ATXN1; (-) strand; PAM type: YTN; PAM sequence: TTC
aattttaggatacataattt

SEQ ID NO: 173298 - DNA, 20 bp, Artificial Sequence
  Description of Artificial Sequence: Synthetic oligonucleotide
  Target: ATXN1; (-) strand; PAM type: YTN; PAM sequence: TTT
caattttaggatacataatt

SEQ ID NO: 173299 - DNA, 20 bp, Artificial Sequence
  Description of Artificial Sequence: Synthetic oligonucleotide
  Target: ATXN1; (-) strand; PAM type: YTN; PAM sequence: TTT
tcaattttaggatacataat

SEQ ID NO: 173300 - DNA, 20 bp, Artificial Sequence
  Description of Artificial Sequence: Synthetic oligonucleotide
  Target: ATXN1; (-) strand; PAM type: YTN; PAM sequence: CTT
ttcaattttaggatacataa

SEQ ID NO: 173301 - DNA, 20 bp, Artificial Sequence
  Description of Artificial Sequence: Synthetic oligonucleotide
  Target: ATXN1; (-) strand; PAM type: YTN; PAM sequence: TTA
tcccacaaagcagtaacttt

SEQ ID NO: 173302 - DNA, 20 bp, Artificial Sequence
  Description of Artificial Sequence: Synthetic oligonucleotide
  Target: ATXN1; (-) strand; PAM type: YTN; PAM sequence: TTA
ccatattatcccacaaagca

SEQ ID NO: 173303 - DNA, 20 bp, Artificial Sequence
  Description of Artificial Sequence: Synthetic oligonucleotide
  Target: ATXN1; (-) strand; PAM type: YTN; PAM sequence: TTT
accatattatcccacaaagc

SEQ ID NO: 173304 - DNA, 20 bp, Artificial Sequence
  Description of Artificial Sequence: Synthetic oligonucleotide
  Target: ATXN1; (-) strand; PAM type: YTN; PAM sequence: CTA
aaagccagaatttaccatat

SEQ ID NO: 173305 - DNA, 20 bp, Artificial Sequence
  Description of Artificial Sequence: Synthetic oligonucleotide
  Target: ATXN1; (-) strand; PAM type: YTN; PAM sequence: TTA
agaatgggcacagagatgac

SEQ ID NO: 173306 - DNA, 20 bp, Artificial Sequence
  Description of Artificial Sequence: Synthetic oligonucleotide
  Target: ATXN1; (-) strand; PAM type: YTN; PAM sequence: CTG
aatcagtattaagaatgggc

SEQ ID NO: 173307 - DNA, 20 bp, Artificial Sequence
  Description of Artificial Sequence: Synthetic oligonucleotide
  Target: ATXN1; (-) strand; PAM type: YTN; PAM sequence: CTC
tgaatcagtattaagaatgg

SEQ ID NO: 173308 - DNA, 20 bp, Artificial Sequence
  Description of Artificial Sequence: Synthetic oligonucleotide
  Target: ATXN1; (-) strand; PAM type: YTN; PAM sequence: CTG
ctctgaatcagtattaagaa

SEQ ID NO: 173309 - DNA, 20 bp, Artificial Sequence
  Description of Artificial Sequence: Synthetic oligonucleotide
  Target: ATXN1; (-) strand; PAM type: YTN; PAM sequence: TTC
tgctctgaatcagtattaag

SEQ ID NO: 173310 - DNA, 20 bp, Artificial Sequence
  Description of Artificial Sequence: Synthetic oligonucleotide
  Target: ATXN1; (-) strand; PAM type: YTN; PAM sequence: CTT
ctgctctgaatcagtattaa

SEQ ID NO: 173311 - DNA, 20 bp, Artificial Sequence
  Description of Artificial Sequence: Synthetic oligonucleotide
  Target: ATXN1; (-) strand; PAM type: YTN; PAM sequence: CTA
tcttctgctctgaatcagta

SEQ ID NO: 173312 - DNA, 20 bp, Artificial Sequence
  Description of Artificial Sequence: Synthetic oligonucleotide
  Target: ATXN1; (-) strand; PAM type: YTN; PAM sequence: TTA
actatcttctgctctgaatc

SEQ ID NO: 173313 - DNA, 20 bp, Artificial Sequence
  Description of Artificial Sequence: Synthetic oligonucleotide
  Target: ATXN1; (-) strand; PAM type: YTN; PAM sequence: TTG
atatggttaactatcttctg

SEQ ID NO: 173314 - DNA, 20 bp, Artificial Sequence
  Description of Artificial Sequence: Synthetic oligonucleotide
  Target: ATXN1; (-) strand; PAM type: YTN; PAM sequence: CTG
ccccgcatgcacacacgttg

SEQ ID NO: 173315 - DNA, 20 bp, Artificial Sequence
  Description of Artificial Sequence: Synthetic oligonucleotide
  Target: ATXN1; (-) strand; PAM type: YTN; PAM sequence: CTC
ctgccccgcatgcacacacg

SEQ ID NO: 173316 - DNA, 20 bp, Artificial Sequence
  Description of Artificial Sequence: Synthetic oligonucleotide
  Target: ATXN1; (-) strand; PAM type: YTN; PAM sequence: CTC
cccccacctcctgccccgca

SEQ ID NO: 173317 - DNA, 20 bp, Artificial Sequence
  Description of Artificial Sequence: Synthetic oligonucleotide
  Target: ATXN1; (-) strand; PAM type: YTN; PAM sequence: TTG
ctccccccacctcctgcccc

SEQ ID NO: 173318 - DNA, 20 bp, Artificial Sequence
  Description of Artificial Sequence: Synthetic oligonucleotide
  Target: ATXN1; (-) strand; PAM type: YTN; PAM sequence: TTT
gctccccccacctcctgccc

SEQ ID NO: 173319 - DNA, 20 bp, Artificial Sequence
  Description of Artificial Sequence: Synthetic oligonucleotide
  Target: ATXN1; (-) strand; PAM type: YTN; PAM sequence: TTA
tttgctccccccacctcctg

SEQ ID NO: 173320 - DNA, 20 bp, Artificial Sequence
  Description of Artificial Sequence: Synthetic oligonucleotide
  Target: ATXN1; (-) strand; PAM type: YTN; PAM sequence: TTT
atttgctccccccacctcct

SEQ ID NO: 173321 - DNA, 20 bp, Artificial Sequence
  Description of Artificial Sequence: Synthetic oligonucleotide
  Target: ATXN1; (-) strand; PAM type: YTN; PAM sequence: TTT
tatttgctccccccacctcc

SEQ ID NO: 173322 - DNA, 20 bp, Artificial Sequence
  Description of Artificial Sequence: Synthetic oligonucleotide
  Target: ATXN1; (-) strand; PAM type: YTN; PAM sequence: TTA
agatagttttatttgctccc

SEQ ID NO: 173323 - DNA, 20 bp, Artificial Sequence
  Description of Artificial Sequence: Synthetic oligonucleotide
  Target: ATXN1; (-) strand; PAM type: YTN; PAM sequence: TTT
aagatagttttatttgctcc

SEQ ID NO: 173324 - DNA, 20 bp, Artificial Sequence
  Description of Artificial Sequence: Synthetic oligonucleotide
  Target: ATXN1; (-) strand; PAM type: YTN; PAM sequence: TTG
ggtaaagagtcatatgttta

SEQ ID NO: 173325 - DNA, 20 bp, Artificial Sequence
  Description of Artificial Sequence: Synthetic oligonucleotide
  Target: ATXN1; (-) strand; PAM type: YTN; PAM sequence: TTT
gggtaaagagtcatatgttt

SEQ ID NO: 173326 - DNA, 20 bp, Artificial Sequence
  Description of Artificial Sequence: Synthetic oligonucleotide
  Target: ATXN1; (-) strand; PAM type: YTN; PAM sequence: TTT
tgggtaaagagtcatatgtt

SEQ ID NO: 173327 - DNA, 20 bp, Artificial Sequence
  Description of Artificial Sequence: Synthetic oligonucleotide
  Target: ATXN1; (-) strand; PAM type: YTN; PAM sequence: TTT
ttgggtaaagagtcatatgt

SEQ ID NO: 173328 - DNA, 20 bp, Artificial Sequence
  Description of Artificial Sequence: Synthetic oligonucleotide
  Target: ATXN1; (-) strand; PAM type: YTN; PAM sequence: TTT
tttgggtaaagagtcatatg

SEQ ID NO: 173329 - DNA, 20 bp, Artificial Sequence
  Description of Artificial Sequence: Synthetic oligonucleotide
  Target: ATXN1; (-) strand; PAM type: YTN; PAM sequence: CTT
ttttgggtaaagagtcatat

SEQ ID NO: 173330 - DNA, 20 bp, Artificial Sequence
  Description of Artificial Sequence: Synthetic oligonucleotide
  Target: ATXN1; (-) strand; PAM type: YTN; PAM sequence: CTC
cttttttgggtaaagagtca

SEQ ID NO: 173331 - DNA, 20 bp, Artificial Sequence
  Description of Artificial Sequence: Synthetic oligonucleotide
  Target: ATXN1; (-) strand; PAM type: YTN; PAM sequence: CTG
tggaagccaagaataaatgg

SEQ ID NO: 173332 - DNA, 20 bp, Artificial Sequence
  Description of Artificial Sequence: Synthetic oligonucleotide
  Target: ATXN1; (-) strand; PAM type: YTN; PAM sequence: TTC
agaggccctgtggaagccaa

SEQ ID NO: 173333 - DNA, 20 bp, Artificial Sequence
  Description of Artificial Sequence: Synthetic oligonucleotide
  Target: ATXN1; (-) strand; PAM type: YTN; PAM sequence: TTT
cagaggccctgtggaagcca

SEQ ID NO: 173334 - DNA, 20 bp, Artificial Sequence
  Description of Artificial Sequence: Synthetic oligonucleotide
  Target: ATXN1; (-) strand; PAM type: YTN; PAM sequence: TTT
tcagaggccctgtggaagcc

SEQ ID NO: 173335 - DNA, 20 bp, Artificial Sequence
  Description of Artificial Sequence: Synthetic oligonucleotide
  Target: ATXN1; (-) strand; PAM type: YTN; PAM sequence: CTT
ttcagaggccctgtggaagc

SEQ ID NO: 173336 - DNA, 20 bp, Artificial Sequence
  Description of Artificial Sequence: Synthetic oligonucleotide
  Target: ATXN1; (-) strand; PAM type: YTN; PAM sequence: TTC
agagtatacttttcagaggc

SEQ ID NO: 173337 - DNA, 20 bp, Artificial Sequence
  Description of Artificial Sequence: Synthetic oligonucleotide
  Target: ATXN1; (-) strand; PAM type: YTN; PAM sequence: TTT
cagagtatacttttcagagg

SEQ ID NO: 173338 - DNA, 20 bp, Artificial Sequence
  Description of Artificial Sequence: Synthetic oligonucleotide
  Target: ATXN1; (-) strand; PAM type: YTN; PAM sequence: TTT
tcagagtatacttttcagag

SEQ ID NO: 173339 - DNA, 20 bp, Artificial Sequence
  Description of Artificial Sequence: Synthetic oligonucleotide
  Target: ATXN1; (-) strand; PAM type: YTN; PAM sequence: CTC
caagaaaatattttcagagt

SEQ ID NO: 173340 - DNA, 20 bp, Artificial Sequence
  Description of Artificial Sequence: Synthetic oligonucleotide
  Target: ATXN1; (-) strand; PAM type: YTN; PAM sequence: CTC
tccaagaaaatattttcaga

SEQ ID NO: 173341 - DNA, 20 bp, Artificial Sequence
  Description of Artificial Sequence: Synthetic oligonucleotide
  Target: ATXN1; (-) strand; PAM type: YTN; PAM sequence: TTA
aagaactctccaagaaaata

SEQ ID NO: 173342 - DNA, 20 bp, Artificial Sequence
  Description of Artificial Sequence: Synthetic oligonucleotide
  Target: ATXN1; (-) strand; PAM type: YTN; PAM sequence: TTT
aaagaactctccaagaaaat

SEQ ID NO: 173343 - DNA, 20 bp, Artificial Sequence
  Description of Artificial Sequence: Synthetic oligonucleotide
  Target: ATXN1; (-) strand; PAM type: YTN; PAM sequence: CTT
taaagaactctccaagaaaa

SEQ ID NO: 173344 - DNA, 20 bp, Artificial Sequence
  Description of Artificial Sequence: Synthetic oligonucleotide
  Target: ATXN1; (-) strand; PAM type: YTN; PAM sequence: CTG
ctttaaagaactctccaaga

SEQ ID NO: 173345 - DNA, 20 bp, Artificial Sequence
  Description of Artificial Sequence: Synthetic oligonucleotide
  Target: ATXN1; (-) strand; PAM type: YTN; PAM sequence: TTC
tgctttaaagaactctccaa

SEQ ID NO: 173346 - DNA, 20 bp, Artificial Sequence
  Description of Artificial Sequence: Synthetic oligonucleotide
  Target: ATXN1; (-) strand; PAM type: YTN; PAM sequence: TTT
ctgctttaaagaactctcca

SEQ ID NO: 173347 - DNA, 20 bp, Artificial Sequence
  Description of Artificial Sequence: Synthetic oligonucleotide
  Target: ATXN1; (-) strand; PAM type: YTN; PAM sequence: CTT
tctgctttaaagaactctcc

SEQ ID NO: 173348 - DNA, 20 bp, Artificial Sequence
  Description of Artificial Sequence: Synthetic oligonucleotide
  Target: ATXN1; (-) strand; PAM type: YTN; PAM sequence: TTA
aatctttctgctttaaagaa

SEQ ID NO: 173349 - DNA, 20 bp, Artificial Sequence
  Description of Artificial Sequence: Synthetic oligonucleotide
  Target: ATXN1; (-) strand; PAM type: YTN; PAM sequence: CTT
aaatctttctgctttaaaga

SEQ ID NO: 173350 - DNA, 20 bp, Artificial Sequence
  Description of Artificial Sequence: Synthetic oligonucleotide
  Target: ATXN1; (-) strand; PAM type: YTN; PAM sequence: CTC
ttaaatctttctgctttaaa

SEQ ID NO: 173351 - DNA, 20 bp, Artificial Sequence
  Description of Artificial Sequence: Synthetic oligonucleotide
  Target: ATXN1; (-) strand; PAM type: YTN; PAM sequence: CTG
cctcttaaatctttctgctt

SEQ ID NO: 173352 - DNA, 20 bp, Artificial Sequence
  Description of Artificial Sequence: Synthetic oligonucleotide
  Target: ATXN1; (-) strand; PAM type: YTN; PAM sequence: TTC
ctgcctcttaaatctttctg

SEQ ID NO: 173353 - DNA, 20 bp, Artificial Sequence
  Description of Artificial Sequence: Synthetic oligonucleotide
  Target: ATXN1; (-) strand; PAM type: YTN; PAM sequence: TTA
tgttcctgcctcttaaatct

SEQ ID NO: 173354 - DNA, 20 bp, Artificial Sequence
  Description of Artificial Sequence: Synthetic oligonucleotide
  Target: ATXN1; (-) strand; PAM type: YTN; PAM sequence: TTG
ttatgttcctgcctcttaaa

SEQ ID NO: 173355 - DNA, 20 bp, Artificial Sequence
  Description of Artificial Sequence: Synthetic oligonucleotide
  Target: ATXN1; (-) strand; PAM type: YTN; PAM sequence: TTT
gttatgttcctgcctcttaa

SEQ ID NO: 173356 - DNA, 20 bp, Artificial Sequence
  Description of Artificial Sequence: Synthetic oligonucleotide
  Target: ATXN1; (-) strand; PAM type: YTN; PAM sequence: CTT
tgttatgttcctgcctctta

SEQ ID NO: 173357 - DNA, 20 bp, Artificial Sequence
  Description of Artificial Sequence: Synthetic oligonucleotide
  Target: ATXN1; (-) strand; PAM type: YTN; PAM sequence: TTC
ctttgttatgttcctgcctc

SEQ ID NO: 173358 - DNA, 20 bp, Artificial Sequence
  Description of Artificial Sequence: Synthetic oligonucleotide
  Target: ATXN1; (-) strand; PAM type: YTN; PAM sequence: CTT
cctttgttatgttcctgcct

SEQ ID NO: 173359 - DNA, 20 bp, Artificial Sequence
  Description of Artificial Sequence: Synthetic oligonucleotide
  Target: ATXN1; (-) strand; PAM type: YTN; PAM sequence: TTG
gtccagtacttcctttgtta

SEQ ID NO: 173360 - DNA, 20 bp, Artificial Sequence
  Description of Artificial Sequence: Synthetic oligonucleotide
  Target: ATXN1; (-) strand; PAM type: YTN; PAM sequence: TTT
ggtccagtacttcctttgtt

SEQ ID NO: 173361 - DNA, 20 bp, Artificial Sequence
  Description of Artificial Sequence: Synthetic oligonucleotide
  Target: ATXN1; (-) strand; PAM type: YTN; PAM sequence: CTT
tggtccagtacttcctttgt

SEQ ID NO: 173362 - DNA, 20 bp, Artificial Sequence
  Description of Artificial Sequence: Synthetic oligonucleotide
  Target: ATXN1; (-) strand; PAM type: YTN; PAM sequence: CTC
actttggtccagtacttcct

SEQ ID NO: 173363 - DNA, 20 bp, Artificial Sequence
  Description of Artificial Sequence: Synthetic oligonucleotide
  Target: ATXN1; (-) strand; PAM type: YTN; PAM sequence: TTC
aaacaaggctcactttggtc

SEQ ID NO: 173364 - DNA, 20 bp, Artificial Sequence
  Description of Artificial Sequence: Synthetic oligonucleotide
  Target: ATXN1; (-) strand; PAM type: YTN; PAM sequence: CTC
agttcaaacaaggctcactt

SEQ ID NO: 173365 - DNA, 20 bp, Artificial Sequence
  Description of Artificial Sequence: Synthetic oligonucleotide
  Target: ATXN1; (-) strand; PAM type: YTN; PAM sequence: TTA
gtggaaaatgtgaaaacaaa

SEQ ID NO: 173366 - DNA, 20 bp, Artificial Sequence
  Description of Artificial Sequence: Synthetic oligonucleotide
  Target: ATXN1; (-) strand; PAM type: YTN; PAM sequence: TTT
agtggaaaatgtgaaaacaa

SEQ ID NO: 173367 - DNA, 20 bp, Artificial Sequence
  Description of Artificial Sequence: Synthetic oligonucleotide
  Target: ATXN1; (-) strand; PAM type: YTN; PAM sequence: TTT
tagtggaaaatgtgaaaaca

SEQ ID NO: 173368 - DNA, 20 bp, Artificial Sequence
  Description of Artificial Sequence: Synthetic oligonucleotide
  Target: ATXN1; (-) strand; PAM type: YTN; PAM sequence: CTT
ttagtggaaaatgtgaaaac

SEQ ID NO: 173369 - DNA, 20 bp, Artificial Sequence
  Description of Artificial Sequence: Synthetic oligonucleotide
  Target: ATXN1; (-) strand; PAM type: YTN; PAM sequence: CTC
ccaaaggacaaagcaccttt

SEQ ID NO: 173370 - DNA, 20 bp, Artificial Sequence
  Description of Artificial Sequence: Synthetic oligonucleotide
  Target: ATXN1; (-) strand; PAM type: YTN; PAM sequence: TTC
ctcccaaaggacaaagcacc

SEQ ID NO: 173371 - DNA, 20 bp, Artificial Sequence
  Description of Artificial Sequence: Synthetic oligonucleotide
  Target: ATXN1; (-) strand; PAM type: YTN; PAM sequence: CTG
ggagggaaaggtgggatgaa

SEQ ID NO: 173372 - DNA, 20 bp, Artificial Sequence
  Description of Artificial Sequence: Synthetic oligonucleotide
  Target: ATXN1; (-) strand; PAM type: YTN; PAM sequence: CTC
tgggagggaaaggtgggatg

SEQ ID NO: 173373 - DNA, 20 bp, Artificial Sequence
  Description of Artificial Sequence: Synthetic oligonucleotide
  Target: ATXN1; (-) strand; PAM type: YTN; PAM sequence: CTG
ggggctctgggagggaaagg

SEQ ID NO: 173374 - DNA, 20 bp, Artificial Sequence
  Description of Artificial Sequence: Synthetic oligonucleotide
  Target: ATXN1; (-) strand; PAM type: YTN; PAM sequence: TTG
ctgggggctctgggagggaa

SEQ ID NO: 173375 - DNA, 20 bp, Artificial Sequence
  Description of Artificial Sequence: Synthetic oligonucleotide
  Target: ATXN1; (-) strand; PAM type: YTN; PAM sequence: CTC
attgctgggggctctgggag

SEQ ID NO: 173376 - DNA, 20 bp, Artificial Sequence
  Description of Artificial Sequence: Synthetic oligonucleotide
  Target: ATXN1; (-) strand; PAM type: YTN; PAM sequence: CTC
tcattgctgggggctctggg

SEQ ID NO: 173377 - DNA, 20 bp, Artificial Sequence
  Description of Artificial Sequence: Synthetic oligonucleotide
  Target: ATXN1; (-) strand; PAM type: YTN; PAM sequence: CTG
acagatgtgaaccagacgcc

SEQ ID NO: 173378 - DNA, 20 bp, Artificial Sequence
  Description of Artificial Sequence: Synthetic oligonucleotide
  Target: ATXN1; (-) strand; PAM type: YTN; PAM sequence: CTG
gacctgacagatgtgaacca

SEQ ID NO: 173379 - DNA, 20 bp, Artificial Sequence
  Description of Artificial Sequence: Synthetic oligonucleotide
  Target: ATXN1; (-) strand; PAM type: YTN; PAM sequence: TTC
tggacctgacagatgtgaac

SEQ ID NO: 173380 - DNA, 20 bp, Artificial Sequence
  Description of Artificial Sequence: Synthetic oligonucleotide
  Target: ATXN1; (-) strand; PAM type: YTN; PAM sequence: TTA
gtcaggttctggacctgaca

SEQ ID NO: 173381 - DNA, 20 bp, Artificial Sequence
  Description of Artificial Sequence: Synthetic oligonucleotide
  Target: ATXN1; (-) strand; PAM type: YTN; PAM sequence: CTT
agtcaggttctggacctgac

SEQ ID NO: 173382 - DNA, 20 bp, Artificial Sequence
  Description of Artificial Sequence: Synthetic oligonucleotide
  Target: ATXN1; (-) strand; PAM type: YTN; PAM sequence: TTG
tgcttagtcaggttctggac

SEQ ID NO: 173383 - DNA, 20 bp, Artificial Sequence
  Description of Artificial Sequence: Synthetic oligonucleotide
  Target: ATXN1; (-) strand; PAM type: YTN; PAM sequence: CTT
gtgcttagtcaggttctgga

SEQ ID NO: 173384 - DNA, 20 bp, Artificial Sequence
  Description of Artificial Sequence: Synthetic oligonucleotide
  Target: ATXN1; (-) strand; PAM type: YTN; PAM sequence: TTG
agtcccatcaggacagaact

SEQ ID NO: 173385 - DNA, 20 bp, Artificial Sequence
  Description of Artificial Sequence: Synthetic oligonucleotide
  Target: ATXN1; (-) strand; PAM type: YTN; PAM sequence: CTT
gagtcccatcaggacagaac

SEQ ID NO: 173386 - DNA, 20 bp, Artificial Sequence
  Description of Artificial Sequence: Synthetic oligonucleotide
  Target: ATXN1; (-) strand; PAM type: YTN; PAM sequence: CTC
ttgagtcccatcaggacaga

SEQ ID NO: 173387 - DNA, 20 bp, Artificial Sequence
  Description of Artificial Sequence: Synthetic oligonucleotide
  Target: ATXN1; (-) strand; PAM type: YTN; PAM sequence: CTC
agcatctcttgagtcccatc

SEQ ID NO: 173388 - DNA, 20 bp, Artificial Sequence
  Description of Artificial Sequence: Synthetic oligonucleotide
  Target: ATXN1; (-) strand; PAM type: YTN; PAM sequence: CTC
actcagcatctcttgagtcc

SEQ ID NO: 173389 - DNA, 20 bp, Artificial Sequence
  Description of Artificial Sequence: Synthetic oligonucleotide
  Target: ATXN1; (-) strand; PAM type: YTN; PAM sequence: CTG
agcgtgacaggaaccccaag

SEQ ID NO: 173390 - DNA, 20 bp, Artificial Sequence
  Description of Artificial Sequence: Synthetic oligonucleotide
  Target: ATXN1; (-) strand; PAM type: YTN; PAM sequence: CTG
gtaaaagtcgagcaggaagc

SEQ ID NO: 173391 - DNA, 20 bp, Artificial Sequence
  Description of Artificial Sequence: Synthetic oligonucleotide
  Target: ATXN1; (-) strand; PAM type: YTN; PAM sequence: CTC
tggtaaaagtcgagcaggaa

SEQ ID NO: 173392 - DNA, 20 bp, Artificial Sequence
  Description of Artificial Sequence: Synthetic oligonucleotide
  Target: ATXN1; (-) strand; PAM type: YTN; PAM sequence: TTA
ccaggcagactctggtaaaa

SEQ ID NO: 173393 - DNA, 20 bp, Artificial Sequence
  Description of Artificial Sequence: Synthetic oligonucleotide
  Target: ATXN1; (-) strand; PAM type: YTN; PAM sequence: TTT
accaggcagactctggtaaa

SEQ ID NO: 173394 - DNA, 20 bp, Artificial Sequence
  Description of Artificial Sequence: Synthetic oligonucleotide
  Target: ATXN1; (-) strand; PAM type: YTN; PAM sequence: CTT
taccaggcagactctggtaa

SEQ ID NO: 173395 - DNA, 20 bp, Artificial Sequence
  Description of Artificial Sequence: Synthetic oligonucleotide
  Target: ATXN1; (-) strand; PAM type: YTN; PAM sequence: CTG
gaggaaagactttaccaggc

SEQ ID NO: 173396 - DNA, 20 bp, Artificial Sequence
  Description of Artificial Sequence: Synthetic oligonucleotide
  Target: ATXN1; (-) strand; PAM type: YTN; PAM sequence: TTA
actggaggaaagactttacc

SEQ ID NO: 173397 - DNA, 20 bp, Artificial Sequence
  Description of Artificial Sequence: Synthetic oligonucleotide
  Target: ATXN1; (-) strand; PAM type: YTN; PAM sequence: CTT
aactggaggaaagactttac

SEQ ID NO: 173398 - DNA, 20 bp, Artificial Sequence
  Description of Artificial Sequence: Synthetic oligonucleotide
  Target: ATXN1; (-) strand; PAM type: YTN; PAM sequence: TTG
aatacaacccagggacctta

SEQ ID NO: 173399 - DNA, 20 bp, Artificial Sequence
  Description of Artificial Sequence: Synthetic oligonucleotide
  Target: ATXN1; (-) strand; PAM type: YTN; PAM sequence: CTT
gaatacaacccagggacctt

SEQ ID NO: 173400 - DNA, 20 bp, Artificial Sequence
  Description of Artificial Sequence: Synthetic oligonucleotide
  Target: ATXN1; (-) strand; PAM type: YTN; PAM sequence: CTG
gggacagcttgaatacaacc

SEQ ID NO: 173401 - DNA, 20 bp, Artificial Sequence
  Description of Artificial Sequence: Synthetic oligonucleotide
  Target: ATXN1; (-) strand; PAM type: YTN; PAM sequence: CTA
acaacgtggagtgtgtgtgc

SEQ ID NO: 173402 - DNA, 20 bp, Artificial Sequence
  Description of Artificial Sequence: Synthetic oligonucleotide
  Target: ATXN1; (-) strand; PAM type: YTN; PAM sequence: TTC
acaggaaatgacccagaaaa

SEQ ID NO: 173403 - DNA, 20 bp, Artificial Sequence
  Description of Artificial Sequence: Synthetic oligonucleotide
  Target: ATXN1; (-) strand; PAM type: YTN; PAM sequence: TTT
cacaggaaatgacccagaaa

SEQ ID NO: 173404 - DNA, 20 bp, Artificial Sequence
  Description of Artificial Sequence: Synthetic oligonucleotide
  Target: ATXN1; (-) strand; PAM type: YTN; PAM sequence: CTA
aagagggaacagtgacattt

SEQ ID NO: 173405 - DNA, 20 bp, Artificial Sequence
  Description of Artificial Sequence: Synthetic oligonucleotide
  Target: ATXN1; (-) strand; PAM type: YTN; PAM sequence: CTG
agatccggccactaaagagg

SEQ ID NO: 173406 - DNA, 20 bp, Artificial Sequence
  Description of Artificial Sequence: Synthetic oligonucleotide
  Target: ATXN1; (-) strand; PAM type: YTN; PAM sequence: CTC
ccaggctgagatccggccac

SEQ ID NO: 173407 - DNA, 20 bp, Artificial Sequence
  Description of Artificial Sequence: Synthetic oligonucleotide
  Target: ATXN1; (-) strand; PAM type: YTN; PAM sequence: CTC
agtcggactcccaggctgag

SEQ ID NO: 173408 - DNA, 20 bp, Artificial Sequence
  Description of Artificial Sequence: Synthetic oligonucleotide
  Target: ATXN1; (-) strand; PAM type: YTN; PAM sequence: CTC
tcagtcggactcccaggctg

SEQ ID NO: 173409 - DNA, 20 bp, Artificial Sequence
  Description of Artificial Sequence: Synthetic oligonucleotide
  Target: ATXN1; (-) strand; PAM type: YTN; PAM sequence: TTG
ctctcagtcggactcccagg

SEQ ID NO: 173410 - DNA, 20 bp, Artificial Sequence
  Description of Artificial Sequence: Synthetic oligonucleotide
  Target: ATXN1; (-) strand; PAM type: YTN; PAM sequence: CTT
gctctcagtcggactcccag

SEQ ID NO: 173411 - DNA, 20 bp, Artificial Sequence
  Description of Artificial Sequence: Synthetic oligonucleotide
  Target: ATXN1; (-) strand; PAM type: YTN; PAM sequence: CTG
taccgacagccccttgctct

SEQ ID NO: 173412 - DNA, 20 bp, Artificial Sequence
  Description of Artificial Sequence: Synthetic oligonucleotide
  Target: ATXN1; (-) strand; PAM type: YTN; PAM sequence: CTC
cccaggctgtaccgacagcc

SEQ ID NO: 173413 - DNA, 20 bp, Artificial Sequence
  Description of Artificial Sequence: Synthetic oligonucleotide
  Target: ATXN1; (-) strand; PAM type: YTN; PAM sequence: CTC
tccccaggctgtaccgacag

SEQ ID NO: 173414 - DNA, 20 bp, Artificial Sequence
  Description of Artificial Sequence: Synthetic oligonucleotide
  Target: ATXN1; (-) strand; PAM type: YTN; PAM sequence: CTG
gtgtgaggtgggggtgggac

SEQ ID NO: 173415 - DNA, 20 bp, Artificial Sequence
  Description of Artificial Sequence: Synthetic oligonucleotide
  Target: ATXN1; (-) strand; PAM type: YTN; PAM sequence: TTA
atacaaaatctggtgtgagg

SEQ ID NO: 173416 - DNA, 20 bp, Artificial Sequence
  Description of Artificial Sequence: Synthetic oligonucleotide
  Target: ATXN1; (-) strand; PAM type: YTN; PAM sequence: TTA
ttaatacaaaatctggtgtg

SEQ ID NO: 173417 - DNA, 20 bp, Artificial Sequence
  Description of Artificial Sequence: Synthetic oligonucleotide
  Target: ATXN1; (-) strand; PAM type: YTN; PAM sequence: TTA
ttattaatacaaaatctggt

SEQ ID NO: 173418 - DNA, 20 bp, Artificial Sequence
  Description of Artificial Sequence: Synthetic oligonucleotide
  Target: ATXN1; (-) strand; PAM type: YTN; PAM sequence: CTA
gaaacaggtgagtggagacg

SEQ ID NO: 173419 - DNA, 20 bp, Artificial Sequence
  Description of Artificial Sequence: Synthetic oligonucleotide
  Target: ATXN1; (-) strand; PAM type: YTN; PAM sequence: TTC
ccaggctagaaacaggtgag

SEQ ID NO: 173420 - DNA, 20 bp, Artificial Sequence
  Description of Artificial Sequence: Synthetic oligonucleotide
  Target: ATXN1; (-) strand; PAM type: YTN; PAM sequence: TTT
cccaggctagaaacaggtga

SEQ ID NO: 173421 - DNA, 20 bp, Artificial Sequence
  Description of Artificial Sequence: Synthetic oligonucleotide
  Target: ATXN1; (-) strand; PAM type: YTN; PAM sequence: CTG
aatgaaggaagaaagtttcc

SEQ ID NO: 173422 - DNA, 20 bp, Artificial Sequence
  Description of Artificial Sequence: Synthetic oligonucleotide
  Target: ATXN1; (-) strand; PAM type: YTN; PAM sequence: TTA
ggtgtgcaataaatagtgct

SEQ ID NO: 173423 - DNA, 20 bp, Artificial Sequence
  Description of Artificial Sequence: Synthetic oligonucleotide
  Target: ATXN1; (-) strand; PAM type: YTN; PAM sequence: TTT
aggtgtgcaataaatagtgc

SEQ ID NO: 173424 - DNA, 20 bp, Artificial Sequence
  Description of Artificial Sequence: Synthetic oligonucleotide
  Target: ATXN1; (-) strand; PAM type: YTN; PAM sequence: TTT
taggtgtgcaataaatagtg

SEQ ID NO: 173425 - DNA, 20 bp, Artificial Sequence
  Description of Artificial Sequence: Synthetic oligonucleotide
  Target: ATXN1; (-) strand; PAM type: YTN; PAM sequence: TTA
atgttttaggtgtgcaataa

SEQ ID NO: 173426 - DNA, 20 bp, Artificial Sequence
  Description of Artificial Sequence: Synthetic oligonucleotide
  Target: ATXN1; (-) strand; PAM type: YTN; PAM sequence: TTC
caagccccacacagtagcat

SEQ ID NO: 173427 - DNA, 20 bp, Artificial Sequence
  Description of Artificial Sequence: Synthetic oligonucleotide
  Target: ATXN1; (-) strand; PAM type: YTN; PAM sequence: CTT
ccaagccccacacagtagca

SEQ ID NO: 173428 - DNA, 20 bp, Artificial Sequence
  Description of Artificial Sequence: Synthetic oligonucleotide
  Target: ATXN1; (-) strand; PAM type: YTN; PAM sequence: CTG
agaaagtacccaaacaccag

SEQ ID NO: 173429 - DNA, 20 bp, Artificial Sequence
  Description of Artificial Sequence: Synthetic oligonucleotide
  Target: ATXN1; (-) strand; PAM type: YTN; PAM sequence: TTC
tgagaaagtacccaaacacc

SEQ ID NO: 173430 - DNA, 20 bp, Artificial Sequence
  Description of Artificial Sequence: Synthetic oligonucleotide
  Target: ATXN1; (-) strand; PAM type: YTN; PAM sequence: CTT
ctgagaaagtacccaaacac

SEQ ID NO: 173431 - DNA, 20 bp, Artificial Sequence
  Description of Artificial Sequence: Synthetic oligonucleotide
  Target: ATXN1; (-) strand; PAM type: YTN; PAM sequence: TTG
cttctgagaaagtacccaaa

SEQ ID NO: 173432 - DNA, 20 bp, Artificial Sequence
  Description of Artificial Sequence: Synthetic oligonucleotide
  Target: ATXN1; (-) strand; PAM type: YTN; PAM sequence: CTT
gcttctgagaaagtacccaa

SEQ ID NO: 173433 - DNA, 20 bp, Artificial Sequence
  Description of Artificial Sequence: Synthetic oligonucleotide
  Target: ATXN1; (-) strand; PAM type: YTN; PAM sequence: TTC
agagacccaaatgagaaagt

SEQ ID NO: 173434 - DNA, 20 bp, Artificial Sequence
  Description of Artificial Sequence: Synthetic oligonucleotide
  Target: ATXN1; (-) strand; PAM type: YTN; PAM sequence: TTG
atattcagagacccaaatga

SEQ ID NO: 173435 - DNA, 20 bp, Artificial Sequence
  Description of Artificial Sequence: Synthetic oligonucleotide
  Target: ATXN1; (-) strand; PAM type: YTN; PAM sequence: TTT
gatattcagagacccaaatg

SEQ ID NO: 173436 - DNA, 20 bp, Artificial Sequence
  Description of Artificial Sequence: Synthetic oligonucleotide
  Target: ATXN1; (-) strand; PAM type: YTN; PAM sequence: CTG
gtcacatttgatattcagag

SEQ ID NO: 173437 - DNA, 20 bp, Artificial Sequence
  Description of Artificial Sequence: Synthetic oligonucleotide
  Target: ATXN1; (-) strand; PAM type: YTN; PAM sequence: TTG
gctggtcacatttgatattc

SEQ ID NO: 173438 - DNA, 20 bp, Artificial Sequence
  Description of Artificial Sequence: Synthetic oligonucleotide
  Target: ATXN1; (-) strand; PAM type: YTN; PAM sequence: TTG
ttggctggtcacatttgata

SEQ ID NO: 173439 - DNA, 20 bp, Artificial Sequence
  Description of Artificial Sequence: Synthetic oligonucleotide
  Target: ATXN1; (-) strand; PAM type: YTN; PAM sequence: CTT
gttggctggtcacatttgat

SEQ ID NO: 173440 - DNA, 20 bp, Artificial Sequence
  Description of Artificial Sequence: Synthetic oligonucleotide
  Target: ATXN1; (-) strand; PAM type: YTN; PAM sequence: CTG
aaatgtacatacttgttggc

SEQ ID NO: 173441 - DNA, 20 bp, Artificial Sequence
  Description of Artificial Sequence: Synthetic oligonucleotide
  Target: ATXN1; (-) strand; PAM type: YTN; PAM sequence: CTC
caggaaaaggtgagggactg

SEQ ID NO: 173442 - DNA, 20 bp, Artificial Sequence
  Description of Artificial Sequence: Synthetic oligonucleotide
  Target: ATXN1; (-) strand; PAM type: YTN; PAM sequence: TTC
tccaggaaaaggtgagggac

SEQ ID NO: 173443 - DNA, 20 bp, Artificial Sequence
  Description of Artificial Sequence: Synthetic oligonucleotide
  Target: ATXN1; (-) strand; PAM type: YTN; PAM sequence: CTA
ttctccaggaaaaggtgagg

SEQ ID NO: 173444 - DNA, 20 bp, Artificial Sequence
  Description of Artificial Sequence: Synthetic oligonucleotide
  Target: ATXN1; (-) strand; PAM type: YTN; PAM sequence: CTC
tattctccaggaaaaggtga

SEQ ID NO: 173445 - DNA, 20 bp, Artificial Sequence
  Description of Artificial Sequence: Synthetic oligonucleotide
  Target: ATXN1; (-) strand; PAM type: YTN; PAM sequence: TTC
atatcaaactctattctcca

SEQ ID NO: 173446 - DNA, 20 bp, Artificial Sequence
  Description of Artificial Sequence: Synthetic oligonucleotide
  Target: ATXN1; (-) strand; PAM type: YTN; PAM sequence: TTA
atgttcatatcaaactctat

SEQ ID NO: 173447 - DNA, 20 bp, Artificial Sequence
  Description of Artificial Sequence: Synthetic oligonucleotide
  Target: ATXN1; (-) strand; PAM type: YTN; PAM sequence: CTT
aatgttcatatcaaactcta

SEQ ID NO: 173448 - DNA, 20 bp, Artificial Sequence
  Description of Artificial Sequence: Synthetic oligonucleotide
  Target: ATXN1; (-) strand; PAM type: YTN; PAM sequence: CTG
atgtaaatccacttaatgtt

SEQ ID NO: 173449 - DNA, 20 bp, Artificial Sequence
  Description of Artificial Sequence: Synthetic oligonucleotide
  Target: ATXN1; (-) strand; PAM type: YTN; PAM sequence: CTG
aggagcactgatgtaaatcc

SEQ ID NO: 173450 - DNA, 20 bp, Artificial Sequence
  Description of Artificial Sequence: Synthetic oligonucleotide
  Target: ATXN1; (-) strand; PAM type: YTN; PAM sequence: CTG
tcgtgtgtgctgaggagcac

SEQ ID NO: 173451 - DNA, 20 bp, Artificial Sequence
  Description of Artificial Sequence: Synthetic oligonucleotide
  Target: ATXN1; (-) strand; PAM type: YTN; PAM sequence: TTC
tgtcgtgtgtgctgaggagc

SEQ ID NO: 173452 - DNA, 20 bp, Artificial Sequence
  Description of Artificial Sequence: Synthetic oligonucleotide
  Target: ATXN1; (-) strand; PAM type: YTN; PAM sequence: TTT
ctgtcgtgtgtgctgaggag

SEQ ID NO: 173453 - DNA, 20 bp, Artificial Sequence
  Description of Artificial Sequence: Synthetic oligonucleotide
  Target: ATXN1; (-) strand; PAM type: YTN; PAM sequence: TTT
tctgtcgtgtgtgctgagga

SEQ ID NO: 173454 - DNA, 20 bp, Artificial Sequence
  Description of Artificial Sequence: Synthetic oligonucleotide
  Target: ATXN1; (-) strand; PAM type: YTN; PAM sequence: TTA
gtccagagcagatatatttt

SEQ ID NO: 173455 - DNA, 20 bp, Artificial Sequence
  Description of Artificial Sequence: Synthetic oligonucleotide
  Target: ATXN1; (-) strand; PAM type: YTN; PAM sequence: TTA
ttagtccagagcagatatat

SEQ ID NO: 173456 - DNA, 20 bp, Artificial Sequence
  Description of Artificial Sequence: Synthetic oligonucleotide
  Target: ATXN1; (-) strand; PAM type: YTN; PAM sequence: CTT
attagtccagagcagatata

SEQ ID NO: 173457 - DNA, 20 bp, Artificial Sequence
  Description of Artificial Sequence: Synthetic oligonucleotide
  Target: ATXN1; (-) strand; PAM type: YTN; PAM sequence: CTG
tgatatacttattagtccag

SEQ ID NO: 173458 - DNA, 20 bp, Artificial Sequence
  Description of Artificial Sequence: Synthetic oligonucleotide
  Target: ATXN1; (-) strand; PAM type: YTN; PAM sequence: TTG
tgcctgtgatatacttatta

SEQ ID NO: 173459 - DNA, 20 bp, Artificial Sequence
  Description of Artificial Sequence: Synthetic oligonucleotide
  Target: ATXN1; (-) strand; PAM type: YTN; PAM sequence: TTT
gtgcctgtgatatacttatt

SEQ ID NO: 173460 - DNA, 20 bp, Artificial Sequence
  Description of Artificial Sequence: Synthetic oligonucleotide
  Target: ATXN1; (-) strand; PAM type: YTN; PAM sequence: TTG
tttgtgcctgtgatatactt

SEQ ID NO: 173461 - DNA, 20 bp, Artificial Sequence
  Description of Artificial Sequence: Synthetic oligonucleotide
  Target: ATXN1; (-) strand; PAM type: YTN; PAM sequence: CTA
cagagttgtttgtgcctgtg

SEQ ID NO: 173462 - DNA, 20 bp, Artificial Sequence
  Description of Artificial Sequence: Synthetic oligonucleotide
  Target: ATXN1; (-) strand; PAM type: YTN; PAM sequence: TTG
gctacagagttgtttgtgcc

SEQ ID NO: 173463 - DNA, 20 bp, Artificial Sequence
  Description of Artificial Sequence: Synthetic oligonucleotide
  Target: ATXN1; (-) strand; PAM type: YTN; PAM sequence: TTA
atcaaaagttggctacagag

SEQ ID NO: 173464 - DNA, 20 bp, Artificial Sequence
  Description of Artificial Sequence: Synthetic oligonucleotide
  Target: ATXN1; (-) strand; PAM type: YTN; PAM sequence: TTT
aatcaaaagttggctacaga

SEQ ID NO: 173465 - DNA, 20 bp, Artificial Sequence
  Description of Artificial Sequence: Synthetic oligonucleotide
  Target: ATXN1; (-) strand; PAM type: YTN; PAM sequence: CTT
taatcaaaagttggctacag

SEQ ID NO: 173466 - DNA, 20 bp, Artificial Sequence
  Description of Artificial Sequence: Synthetic oligonucleotide
  Target: ATXN1; (-) strand; PAM type: YTN; PAM sequence: CTG
tgtctttaatcaaaagttgg

SEQ ID NO: 173467 - DNA, 20 bp, Artificial Sequence
  Description of Artificial Sequence: Synthetic oligonucleotide
  Target: ATXN1; (-) strand; PAM type: YTN; PAM sequence: TTA
atggtagagactgtgtcttt

SEQ ID NO: 173468 - DNA, 20 bp, Artificial Sequence
  Description of Artificial Sequence: Synthetic oligonucleotide
  Target: ATXN1; (-) strand; PAM type: YTN; PAM sequence: CTT
aatggtagagactgtgtctt

SEQ ID NO: 173469 - DNA, 20 bp, Artificial Sequence
  Description of Artificial Sequence: Synthetic oligonucleotide
  Target: ATXN1; (-) strand; PAM type: YTN; PAM sequence: CTC
cttaatggtagagactgtgt

SEQ ID NO: 173470 - DNA, 20 bp, Artificial Sequence
  Description of Artificial Sequence: Synthetic oligonucleotide
  Target: ATXN1; (-) strand; PAM type: YTN; PAM sequence: CTG
ctccttaatggtagagactg

SEQ ID NO: 173471 - DNA, 20 bp, Artificial Sequence
  Description of Artificial Sequence: Synthetic oligonucleotide
  Target: ATXN1; (-) strand; PAM type: YTN; PAM sequence: TTG
gtgtgatatagatgcgctgc

SEQ ID NO: 173472 - DNA, 20 bp, Artificial Sequence
  Description of Artificial Sequence: Synthetic oligonucleotide
  Target: ATXN1; (-) strand; PAM type: YTN; PAM sequence: TTA
ttggtgtgatatagatgcgc

SEQ ID NO: 173473 - DNA, 20 bp, Artificial Sequence
  Description of Artificial Sequence: Synthetic oligonucleotide
  Target: ATXN1; (-) strand; PAM type: YTN; PAM sequence: TTT
attggtgtgatatagatgcg

SEQ ID NO: 173474 - DNA, 20 bp, Artificial Sequence
  Description of Artificial Sequence: Synthetic oligonucleotide
  Target: ATXN1; (-) strand; PAM type: YTN; PAM sequence: TTT
tattggtgtgatatagatgc

SEQ ID NO: 173475 - DNA, 20 bp, Artificial Sequence
  Description of Artificial Sequence: Synthetic oligonucleotide
  Target: ATXN1; (-) strand; PAM type: YTN; PAM sequence: CTT
ttattggtgtgatatagatg

SEQ ID NO: 173476 - DNA, 20 bp, Artificial Sequence
  Description of Artificial Sequence: Synthetic oligonucleotide
  Target: ATXN1; (-) strand; PAM type: YTN; PAM sequence: TTG
gcttttattggtgtgatata

SEQ ID NO: 173477 - DNA, 20 bp, Artificial Sequence
  Description of Artificial Sequence: Synthetic oligonucleotide
  Target: ATXN1; (-) strand; PAM type: YTN; PAM sequence: CTT
ggcttttattggtgtgatat

SEQ ID NO: 173478 - DNA, 20 bp, Artificial Sequence
  Description of Artificial Sequence: Synthetic oligonucleotide
  Target: ATXN1; (-) strand; PAM type: YTN; PAM sequence: CTC
ttggcttttattggtgtgat

SEQ ID NO: 173479 - DNA, 20 bp, Artificial Sequence
  Description of Artificial Sequence: Synthetic oligonucleotide
  Target: ATXN1; (-) strand; PAM type: YTN; PAM sequence: CTA
ggactcttggcttttattgg

SEQ ID NO: 173480 - DNA, 20 bp, Artificial Sequence
  Description of Artificial Sequence: Synthetic oligonucleotide
  Target: ATXN1; (-) strand; PAM type: YTN; PAM sequence: CTG
ctaggactcttggcttttat

SEQ ID NO: 173481 - DNA, 20 bp, Artificial Sequence
  Description of Artificial Sequence: Synthetic oligonucleotide
  Target: ATXN1; (-) strand; PAM type: YTN; PAM sequence: TTG
tagcaaactgctaggactct

SEQ ID NO: 173482 - DNA, 20 bp, Artificial Sequence
  Description of Artificial Sequence: Synthetic oligonucleotide
  Target: ATXN1; (-) strand; PAM type: YTN; PAM sequence: TTT
gtagcaaactgctaggactc

SEQ ID NO: 173483 - DNA, 20 bp, Artificial Sequence
  Description of Artificial Sequence: Synthetic oligonucleotide
  Target: ATXN1; (-) strand; PAM type: YTN; PAM sequence: CTA
cgtagtcgtttgtagcaaac

SEQ ID NO: 173484 - DNA, 20 bp, Artificial Sequence
  Description of Artificial Sequence: Synthetic oligonucleotide
  Target: ATXN1; (-) strand; PAM type: YTN; PAM sequence: CTC
actacgtagtcgtttgtagc

SEQ ID NO: 173485 - DNA, 20 bp, Artificial Sequence
  Description of Artificial Sequence: Synthetic oligonucleotide
  Target: ATXN1; (-) strand; PAM type: YTN; PAM sequence: CTC
tcactacgtagtcgtttgta

SEQ ID NO: 173486 - DNA, 20 bp, Artificial Sequence
  Description of Artificial Sequence: Synthetic oligonucleotide
  Target: ATXN1; (-) strand; PAM type: YTN; PAM sequence: CTA
actctcactacgtagtcgtt

SEQ ID NO: 173487 - DNA, 20 bp, Artificial Sequence
  Description of Artificial Sequence: Synthetic oligonucleotide
  Target: ATXN1; (-) strand; PAM type: YTN; PAM sequence: TTC
ctaactctcactacgtagtc

SEQ ID NO: 173488 - DNA, 20 bp, Artificial Sequence
  Description of Artificial Sequence: Synthetic oligonucleotide
  Target: ATXN1; (-) strand; PAM type: YTN; PAM sequence: TTA
ggataaaatacagaatccag

SEQ ID NO: 173489 - DNA, 20 bp, Artificial Sequence
  Description of Artificial Sequence: Synthetic oligonucleotide
  Target: ATXN1; (-) strand; PAM type: YTN; PAM sequence: TTT
aggataaaatacagaatcca

SEQ ID NO: 173490 - DNA, 20 bp, Artificial Sequence
  Description of Artificial Sequence: Synthetic oligonucleotide
  Target: ATXN1; (-) strand; PAM type: YTN; PAM sequence: CTT
taggataaaatacagaatcc

SEQ ID NO: 173491 - DNA, 20 bp, Artificial Sequence
  Description of Artificial Sequence: Synthetic oligonucleotide
  Target: ATXN1; (-) strand; PAM type: YTN; PAM sequence: TTA
aataaaggtctttaggataa

SEQ ID NO: 173492 - DNA, 20 bp, Artificial Sequence
  Description of Artificial Sequence: Synthetic oligonucleotide
  Target: ATXN1; (-) strand; PAM type: YTN; PAM sequence: TTT
aaataaaggtctttaggata

SEQ ID NO: 173493 - DNA, 20 bp, Artificial Sequence
  Description of Artificial Sequence: Synthetic oligonucleotide
  Target: ATXN1; (-) strand; PAM type: YTN; PAM sequence: CTG
gaaaatttaaataaaggtct

SEQ ID NO: 173494 - DNA, 20 bp, Artificial Sequence
  Description of Artificial Sequence: Synthetic oligonucleotide
  Target: ATXN1; (-) strand; PAM type: YTN; PAM sequence: CTG
agtggaatgggaaggagata

SEQ ID NO: 173495 - DNA, 20 bp, Artificial Sequence
  Description of Artificial Sequence: Synthetic oligonucleotide
  Target: ATXN1; (-) strand; PAM type: YTN; PAM sequence: TTG
ggggaagcaatgtcaaatga

SEQ ID NO: 173496 - DNA, 20 bp, Artificial Sequence
  Description of Artificial Sequence: Synthetic oligonucleotide
  Target: ATXN1; (-) strand; PAM type: YTN; PAM sequence: CTT
gggggaagcaatgtcaaatg

SEQ ID NO: 173497 - DNA, 20 bp, Artificial Sequence
  Description of Artificial Sequence: Synthetic oligonucleotide
  Target: ATXN1; (-) strand; PAM type: YTN; PAM sequence: TTG
ccatccacaaggtgcatgac

SEQ ID NO: 173498 - DNA, 20 bp, Artificial Sequence
  Description of Artificial Sequence: Synthetic oligonucleotide
  Target: ATXN1; (-) strand; PAM type: YTN; PAM sequence: TTA
tagcacagatcattgccatc

SEQ ID NO: 173499 - DNA, 20 bp, Artificial Sequence
  Description of Artificial Sequence: Synthetic oligonucleotide
  Target: ATXN1; (-) strand; PAM type: YTN; PAM sequence: TTG
aattatagcacagatcattg

SEQ ID NO: 173500 - DNA, 20 bp, Artificial Sequence
  Description of Artificial Sequence: Synthetic oligonucleotide
  Target: ATXN1; (-) strand; PAM type: YTN; PAM sequence: TTT
gaattatagcacagatcatt

SEQ ID NO: 173501 - DNA, 20 bp, Artificial Sequence
  Description of Artificial Sequence: Synthetic oligonucleotide
  Target: ATXN1; (-) strand; PAM type: YTN; PAM sequence: TTT
tgaattatagcacagatcat

SEQ ID NO: 173502 - DNA, 20 bp, Artificial Sequence
  Description of Artificial Sequence: Synthetic oligonucleotide
  Target: ATXN1; (-) strand; PAM type: YTN; PAM sequence: CTG
agagcattttgaattatagc

SEQ ID NO: 173503 - DNA, 20 bp, Artificial Sequence
  Description of Artificial Sequence: Synthetic oligonucleotide
  Target: ATXN1; (-) strand; PAM type: YTN; PAM sequence: CTC
cctgagagcattttgaatta

SEQ ID NO: 173504 - DNA, 20 bp, Artificial Sequence
  Description of Artificial Sequence: Synthetic oligonucleotide
  Target: ATXN1; (-) strand; PAM type: YTN; PAM sequence: CTC
ccagctccctgagagcattt

SEQ ID NO: 173505 - DNA, 20 bp, Artificial Sequence
  Description of Artificial Sequence: Synthetic oligonucleotide
  Target: ATXN1; (-) strand; PAM type: YTN; PAM sequence: TTG
ctcccagctccctgagagca

SEQ ID NO: 173506 - DNA, 20 bp, Artificial Sequence
  Description of Artificial Sequence: Synthetic oligonucleotide
  Target: ATXN1; (-) strand; PAM type: YTN; PAM sequence: TTT
gctcccagctccctgagagc

SEQ ID NO: 173507 - DNA, 20 bp, Artificial Sequence
  Description of Artificial Sequence: Synthetic oligonucleotide
  Target: ATXN1; (-) strand; PAM type: YTN; PAM sequence: CTT
tgctcccagctccctgagag

SEQ ID NO: 173508 - DNA, 20 bp, Artificial Sequence
  Description of Artificial Sequence: Synthetic oligonucleotide
  Target: ATXN1; (-) strand; PAM type: YTN; PAM sequence: CTC
tttgctcccagctccctgag

SEQ ID NO: 173509 - DNA, 20 bp, Artificial Sequence
  Description of Artificial Sequence: Synthetic oligonucleotide
  Target: ATXN1; (-) strand; PAM type: YTN; PAM sequence: TTC
tctttgctcccagctccctg

SEQ ID NO: 173510 - DNA, 20 bp, Artificial Sequence
  Description of Artificial Sequence: Synthetic oligonucleotide
  Target: ATXN1; (-) strand; PAM type: YTN; PAM sequence: TTT
ctctttgctcccagctccct

SEQ ID NO: 173511 - DNA, 20 bp, Artificial Sequence
  Description of Artificial Sequence: Synthetic oligonucleotide
  Target: ATXN1; (-) strand; PAM type: YTN; PAM sequence: TTT
tctctttgctcccagctccc

SEQ ID NO: 173512 - DNA, 20 bp, Artificial Sequence
  Description of Artificial Sequence: Synthetic oligonucleotide
  Target: ATXN1; (-) strand; PAM type: YTN; PAM sequence: CTG
catcaccaatgtgttttctc

SEQ ID NO: 173513 - DNA, 20 bp, Artificial Sequence
  Description of Artificial Sequence: Synthetic oligonucleotide
  Target: ATXN1; (-) strand; PAM type: YTN; PAM sequence: TTC
ctgcatcaccaatgtgtttt

SEQ ID NO: 173514 - DNA, 20 bp, Artificial Sequence
  Description of Artificial Sequence: Synthetic oligonucleotide
  Target: ATXN1; (-) strand; PAM type: YTN; PAM sequence: CTT
cctgcatcaccaatgtgttt

SEQ ID NO: 173515 - DNA, 20 bp, Artificial Sequence
  Description of Artificial Sequence: Synthetic oligonucleotide
  Target: ATXN1; (-) strand; PAM type: YTN; PAM sequence: TTG
cttcctgcatcaccaatgtg

SEQ ID NO: 173516 - DNA, 20 bp, Artificial Sequence
  Description of Artificial Sequence: Synthetic oligonucleotide
  Target: ATXN1; (-) strand; PAM type: YTN; PAM sequence: TTA
ttgcttcctgcatcaccaat

SEQ ID NO: 173517 - DNA, 20 bp, Artificial Sequence
  Description of Artificial Sequence: Synthetic oligonucleotide
  Target: ATXN1; (-) strand; PAM type: YTN; PAM sequence: TTT
attgcttcctgcatcaccaa

SEQ ID NO: 173518 - DNA, 20 bp, Artificial Sequence
  Description of Artificial Sequence: Synthetic oligonucleotide
  Target: ATXN1; (-) strand; PAM type: YTN; PAM sequence: TTT
tattgcttcctgcatcacca

SEQ ID NO: 173519 - DNA, 20 bp, Artificial Sequence
  Description of Artificial Sequence: Synthetic oligonucleotide
  Target: ATXN1; (-) strand; PAM type: YTN; PAM sequence: TTG
ttttattgcttcctgcatca

SEQ ID NO: 173520 - DNA, 20 bp, Artificial Sequence
  Description of Artificial Sequence: Synthetic oligonucleotide
  Target: ATXN1; (-) strand; PAM type: YTN; PAM sequence: TTC
aaacagattgttttattgct

SEQ ID NO: 173521 - DNA, 20 bp, Artificial Sequence
  Description of Artificial Sequence: Synthetic oligonucleotide
  Target: ATXN1; (-) strand; PAM type: YTN; PAM sequence: TTT
caaacagattgttttattgc

SEQ ID NO: 173522 - DNA, 20 bp, Artificial Sequence
  Description of Artificial Sequence: Synthetic oligonucleotide
  Target: ATXN1; (-) strand; PAM type: YTN; PAM sequence: TTT
tcaaacagattgttttattg

SEQ ID NO: 173523 - DNA, 20 bp, Artificial Sequence
  Description of Artificial Sequence: Synthetic oligonucleotide
  Target: ATXN1; (-) strand; PAM type: YTN; PAM sequence: CTT
ttcaaacagattgttttatt

SEQ ID NO: 173524 - DNA, 20 bp, Artificial Sequence
  Description of Artificial Sequence: Synthetic oligonucleotide
  Target: ATXN1; (-) strand; PAM type: YTN; PAM sequence: CTG
tgcttttcaaacagattgtt

SEQ ID NO: 173525 - DNA, 20 bp, Artificial Sequence
  Description of Artificial Sequence: Synthetic oligonucleotide
  Target: ATXN1; (-) strand; PAM type: YTN; PAM sequence: TTA
tgaaacctgtgcttttcaaa

SEQ ID NO: 173526 - DNA, 20 bp, Artificial Sequence
  Description of Artificial Sequence: Synthetic oligonucleotide
  Target: ATXN1; (-) strand; PAM type: YTN; PAM sequence: TTT
atgaaacctgtgcttttcaa

SEQ ID NO: 173527 - DNA, 20 bp, Artificial Sequence
  Description of Artificial Sequence: Synthetic oligonucleotide
  Target: ATXN1; (-) strand; PAM type: YTN; PAM sequence: TTT
tatgaaacctgtgcttttca

SEQ ID NO: 173528 - DNA, 20 bp, Artificial Sequence
  Description of Artificial Sequence: Synthetic oligonucleotide
  Target: ATXN1; (-) strand; PAM type: YTN; PAM sequence: CTA
acattttatgaaacctgtgc

SEQ ID NO: 173529 - DNA, 20 bp, Artificial Sequence
  Description of Artificial Sequence: Synthetic oligonucleotide
  Target: ATXN1; (-) strand; PAM type: YTN; PAM sequence: TTC
cagcgctaacattttatgaa

SEQ ID NO: 173530 - DNA, 20 bp, Artificial Sequence
  Description of Artificial Sequence: Synthetic oligonucleotide
  Target: ATXN1; (-) strand; PAM type: YTN; PAM sequence: TTC
cattccagcgctaacatttt

SEQ ID NO: 173531 - DNA, 20 bp, Artificial Sequence
  Description of Artificial Sequence: Synthetic oligonucleotide
  Target: ATXN1; (-) strand; PAM type: YTN; PAM sequence: CTT
ccattccagcgctaacattt

SEQ ID NO: 173532 - DNA, 20 bp, Artificial Sequence
  Description of Artificial Sequence: Synthetic oligonucleotide
  Target: ATXN1; (-) strand; PAM type: YTN; PAM sequence: CTG
aaatcgcttccattccagcg

SEQ ID NO: 173533 - DNA, 20 bp, Artificial Sequence
  Description of Artificial Sequence: Synthetic oligonucleotide
  Target: ATXN1; (-) strand; PAM type: YTN; PAM sequence: CTC
tgaaatcgcttccattccag

SEQ ID NO: 173534 - DNA, 20 bp, Artificial Sequence
  Description of Artificial Sequence: Synthetic oligonucleotide
  Target: ATXN1; (-) strand; PAM type: YTN; PAM sequence: TTC
atctctgaaatcgcttccat

SEQ ID NO: 173535 - DNA, 20 bp, Artificial Sequence
  Description of Artificial Sequence: Synthetic oligonucleotide
  Target: ATXN1; (-) strand; PAM type: YTN; PAM sequence: TTG
caagagttcatctctgaaat

SEQ ID NO: 173536 - DNA, 20 bp, Artificial Sequence
  Description of Artificial Sequence: Synthetic oligonucleotide
  Target: ATXN1; (-) strand; PAM type: YTN; PAM sequence: CTT
gcaagagttcatctctgaaa

SEQ ID NO: 173537 - DNA, 20 bp, Artificial Sequence
  Description of Artificial Sequence: Synthetic oligonucleotide
  Target: ATXN1; (-) strand; PAM type: YTN; PAM sequence: TTC
ggccgccagagtgcttgcaa

SEQ ID NO: 173538 - DNA, 20 bp, Artificial Sequence
  Description of Artificial Sequence: Synthetic oligonucleotide
  Target: ATXN1; (-) strand; PAM type: YTN; PAM sequence: CTT
cggccgccagagtgcttgca

SEQ ID NO: 173539 - DNA, 20 bp, Artificial Sequence
  Description of Artificial Sequence: Synthetic oligonucleotide
  Target: ATXN1; (-) strand; PAM type: YTN; PAM sequence: TTG
gatgcttcggccgccagagt

SEQ ID NO: 173540 - DNA, 20 bp, Artificial Sequence
  Description of Artificial Sequence: Synthetic oligonucleotide
  Target: ATXN1; (-) strand; PAM type: YTN; PAM sequence: TTT
ggatgcttcggccgccagag

SEQ ID NO: 173541 - DNA, 20 bp, Artificial Sequence
  Description of Artificial Sequence: Synthetic oligonucleotide
  Target: ATXN1; (-) strand; PAM type: YTN; PAM sequence: CTC
cagccaaccacagcaaccag

SEQ ID NO: 173542 - DNA, 20 bp, Artificial Sequence
  Description of Artificial Sequence: Synthetic oligonucleotide
  Target: ATXN1; (-) strand; PAM type: YTN; PAM sequence: CTC
ctccagccaaccacagcaac

SEQ ID NO: 173543 - DNA, 20 bp, Artificial Sequence
  Description of Artificial Sequence: Synthetic oligonucleotide
  Target: ATXN1; (-) strand; PAM type: YTN; PAM sequence: TTG
tagactcctccagccaacca

SEQ ID NO: 173544 - DNA, 20 bp, Artificial Sequence
  Description of Artificial Sequence: Synthetic oligonucleotide
  Target: ATXN1; (-) strand; PAM type: YTN; PAM sequence: TTG
gggttgtagactcctccagc

SEQ ID NO: 173545 - DNA, 20 bp, Artificial Sequence
  Description of Artificial Sequence: Synthetic oligonucleotide
  Target: ATXN1; (-) strand; PAM type: YTN; PAM sequence: CTA
tgataagagtcaaaggcagg

SEQ ID NO: 173546 - DNA, 20 bp, Artificial Sequence
  Description of Artificial Sequence: Synthetic oligonucleotide
  Target: ATXN1; (-) strand; PAM type: YTN; PAM sequence: CTG
caagcagtctatgataagag

SEQ ID NO: 173547 - DNA, 20 bp, Artificial Sequence
  Description of Artificial Sequence: Synthetic oligonucleotide
  Target: ATXN1; (-) strand; PAM type: YTN; PAM sequence: TTA
ggcaagtccaaggacaggat

SEQ ID NO: 173548 - DNA, 20 bp, Artificial Sequence
  Description of Artificial Sequence: Synthetic oligonucleotide
  Target: ATXN1; (-) strand; PAM type: YTN; PAM sequence: TTC
gcacatggtatgcacaaata

SEQ ID NO: 173549 - DNA, 20 bp, Artificial Sequence
  Description of Artificial Sequence: Synthetic oligonucleotide
  Target: ATXN1; (-) strand; PAM type: YTN; PAM sequence: CTT
cgcacatggtatgcacaaat

SEQ ID NO: 173550 - DNA, 20 bp, Artificial Sequence
  Description of Artificial Sequence: Synthetic oligonucleotide
  Target: ATXN1; (-) strand; PAM type: YTN; PAM sequence: TTA
gcagtacttcgcacatggta

SEQ ID NO: 173551 - DNA, 20 bp, Artificial Sequence
  Description of Artificial Sequence: Synthetic oligonucleotide
  Target: ATXN1; (-) strand; PAM type: YTN; PAM sequence: TTC
atgagcgtaaaggacattag

SEQ ID NO: 173552 - DNA, 20 bp, Artificial Sequence
  Description of Artificial Sequence: Synthetic oligonucleotide
  Target: ATXN1; (-) strand; PAM type: YTN; PAM sequence: TTT
catgagcgtaaaggacatta

SEQ ID NO: 173553 - DNA, 20 bp, Artificial Sequence
  Description of Artificial Sequence: Synthetic oligonucleotide
  Target: ATXN1; (-) strand; PAM type: YTN; PAM sequence: CTG
atttcatgagcgtaaaggac

SEQ ID NO: 173554 - DNA, 20 bp, Artificial Sequence
  Description of Artificial Sequence: Synthetic oligonucleotide
  Target: ATXN1; (-) strand; PAM type: YTN; PAM sequence: CTG
agcactgatttcatgagcgt

SEQ ID NO: 173555 - DNA, 20 bp, Artificial Sequence
  Description of Artificial Sequence: Synthetic oligonucleotide
  Target: ATXN1; (-) strand; PAM type: YTN; PAM sequence: TTC
agctgagcactgatttcatg

SEQ ID NO: 173556 - DNA, 20 bp, Artificial Sequence
  Description of Artificial Sequence: Synthetic oligonucleotide
  Target: ATXN1; (-) strand; PAM type: YTN; PAM sequence: CTT
cagctgagcactgatttcat

SEQ ID NO: 173557 - DNA, 20 bp, Artificial Sequence
  Description of Artificial Sequence: Synthetic oligonucleotide
  Target: ATXN1; (-) strand; PAM type: YTN; PAM sequence: TTA
atgtcttcagctgagcactg

SEQ ID NO: 173558 - DNA, 20 bp, Artificial Sequence
  Description of Artificial Sequence: Synthetic oligonucleotide
  Target: ATXN1; (-) strand; PAM type: YTN; PAM sequence: TTT
aatgtcttcagctgagcact

SEQ ID NO: 173559 - DNA, 20 bp, Artificial Sequence
  Description of Artificial Sequence: Synthetic oligonucleotide
  Target: ATXN1; (-) strand; PAM type: YTN; PAM sequence: TTC
accgccagtaaatttaatgt

SEQ ID NO: 173560 - DNA, 20 bp, Artificial Sequence
  Description of Artificial Sequence: Synthetic oligonucleotide
  Target: ATXN1; (-) strand; PAM type: YTN; PAM sequence: TTT
caccgccagtaaatttaatg

SEQ ID NO: 173561 - DNA, 20 bp, Artificial Sequence
  Description of Artificial Sequence: Synthetic oligonucleotide
  Target: ATXN1; (-) strand; PAM type: YTN; PAM sequence: CTT
tcaccgccagtaaatttaat

SEQ ID NO: 173562 - DNA, 20 bp, Artificial Sequence
  Description of Artificial Sequence: Synthetic oligonucleotide
  Target: ATXN1; (-) strand; PAM type: YTN; PAM sequence: TTC
tttcaccgccagtaaattta

SEQ ID NO: 173563 - DNA, 20 bp, Artificial Sequence
  Description of Artificial Sequence: Synthetic oligonucleotide
  Target: ATXN1; (-) strand; PAM type: YTN; PAM sequence: TTT
ctttcaccgccagtaaattt

SEQ ID NO: 173564 - DNA, 20 bp, Artificial Sequence
  Description of Artificial Sequence: Synthetic oligonucleotide
  Target: ATXN1; (-) strand; PAM type: YTN; PAM sequence: TTT
tctttcaccgccagtaaatt

SEQ ID NO: 173565 - DNA, 20 bp, Artificial Sequence
  Description of Artificial Sequence: Synthetic oligonucleotide
  Target: ATXN1; (-) strand; PAM type: YTN; PAM sequence: CTT
ttctttcaccgccagtaaat

SEQ ID NO: 173566 - DNA, 20 bp, Artificial Sequence
  Description of Artificial Sequence: Synthetic oligonucleotide
  Target: ATXN1; (-) strand; PAM type: YTN; PAM sequence: TTC
ccgacttttctttcaccgcc

SEQ ID NO: 173567 - DNA, 20 bp, Artificial Sequence
  Description of Artificial Sequence: Synthetic oligonucleotide
  Target: ATXN1; (-) strand; PAM type: YTN; PAM sequence: TTT
cccgacttttctttcaccgc

SEQ ID NO: 173568 - DNA, 20 bp, Artificial Sequence
  Description of Artificial Sequence: Synthetic oligonucleotide
  Target: ATXN1; (-) strand; PAM type: YTN; PAM sequence: TTC
catttcccgacttttctttc

SEQ ID NO: 173569 - DNA, 20 bp, Artificial Sequence
  Description of Artificial Sequence: Synthetic oligonucleotide
  Target: ATXN1; (-) strand; PAM type: YTN; PAM sequence: TTT
ccatttcccgacttttcttt

SEQ ID NO: 173570 - DNA, 20 bp, Artificial Sequence
  Description of Artificial Sequence: Synthetic oligonucleotide
  Target: ATXN1; (-) strand; PAM type: YTN; PAM sequence: CTT
tccatttcccgacttttctt

SEQ ID NO: 173571 - DNA, 20 bp, Artificial Sequence
  Description of Artificial Sequence: Synthetic oligonucleotide
  Target: ATXN1; (-) strand; PAM type: YTN; PAM sequence: CTC
tttccatttcccgacttttc

SEQ ID NO: 173572 - DNA, 20 bp, Artificial Sequence
  Description of Artificial Sequence: Synthetic oligonucleotide
  Target: ATXN1; (-) strand; PAM type: YTN; PAM sequence: TTC
cagcacctctttccatttcc

SEQ ID NO: 173573 - DNA, 20 bp, Artificial Sequence
  Description of Artificial Sequence: Synthetic oligonucleotide
  Target: ATXN1; (-) strand; PAM type: YTN; PAM sequence: TTC
ccagcccccgttccagcacc

SEQ ID NO: 173574 - DNA, 20 bp, Artificial Sequence
  Description of Artificial Sequence: Synthetic oligonucleotide
  Target: ATXN1; (-) strand; PAM type: YTN; PAM sequence: CTT
cccagcccccgttccagcac

SEQ ID NO: 173575 - DNA, 20 bp, Artificial Sequence
  Description of Artificial Sequence: Synthetic oligonucleotide
  Target: ATXN1; (-) strand; PAM type: YTN; PAM sequence: TTC
cttcccagcccccgttccag

SEQ ID NO: 173576 - DNA, 20 bp, Artificial Sequence
  Description of Artificial Sequence: Synthetic oligonucleotide
  Target: ATXN1; (-) strand; PAM type: YTN; PAM sequence: CTT
ccttcccagcccccgttcca

SEQ ID NO: 173577 - DNA, 20 bp, Artificial Sequence
  Description of Artificial Sequence: Synthetic oligonucleotide
  Target: ATXN1; (-) strand; PAM type: YTN; PAM sequence: CTG
cagtgcggccttccttccca

SEQ ID NO: 173578 - DNA, 20 bp, Artificial Sequence
  Description of Artificial Sequence: Synthetic oligonucleotide
  Target: ATXN1; (-) strand; PAM type: YTN; PAM sequence: TTA
accccaccaagagcactgca

SEQ ID NO: 173579 - DNA, 20 bp, Artificial Sequence
  Description of Artificial Sequence: Synthetic oligonucleotide
  Target: ATXN1; (-) strand; PAM type: YTN; PAM sequence: TTC
atgaagcagtagggagcaga

SEQ ID NO: 173580 - DNA, 20 bp, Artificial Sequence
  Description of Artificial Sequence: Synthetic oligonucleotide
  Target: ATXN1; (-) strand; PAM type: YTN; PAM sequence: TTT
catgaagcagtagggagcag

SEQ ID NO: 173581 - DNA, 20 bp, Artificial Sequence
  Description of Artificial Sequence: Synthetic oligonucleotide
  Target: ATXN1; (-) strand; PAM type: YTN; PAM sequence: CTG
gcatttcatgaagcagtagg

SEQ ID NO: 173582 - DNA, 20 bp, Artificial Sequence
  Description of Artificial Sequence: Synthetic oligonucleotide
  Target: ATXN1; (-) strand; PAM type: YTN; PAM sequence: TTC
atacactggcatttcatgaa

SEQ ID NO: 173583 - DNA, 20 bp, Artificial Sequence
  Description of Artificial Sequence: Synthetic oligonucleotide
  Target: ATXN1; (-) strand; PAM type: YTN; PAM sequence: CTA
tggttcatacactggcattt

SEQ ID NO: 173584 - DNA, 20 bp, Artificial Sequence
  Description of Artificial Sequence: Synthetic oligonucleotide
  Target: ATXN1; (-) strand; PAM type: YTN; PAM sequence: TTC
acatgctatggttcatacac

SEQ ID NO: 173585 - DNA, 20 bp, Artificial Sequence
  Description of Artificial Sequence: Synthetic oligonucleotide
  Target: ATXN1; (-) strand; PAM type: YTN; PAM sequence: CTT
cacatgctatggttcataca

SEQ ID NO: 173586 - DNA, 20 bp, Artificial Sequence
  Description of Artificial Sequence: Synthetic oligonucleotide
  Target: ATXN1; (-) strand; PAM type: YTN; PAM sequence: TTG
tgcagtaaaaggtccttcac

SEQ ID NO: 173587 - DNA, 20 bp, Artificial Sequence
  Description of Artificial Sequence: Synthetic oligonucleotide
  Target: ATXN1; (-) strand; PAM type: YTN; PAM sequence: CTG
agagtgaacattgtgcagta

SEQ ID NO: 173588 - DNA, 20 bp, Artificial Sequence
  Description of Artificial Sequence: Synthetic oligonucleotide
  Target: ATXN1; (-) strand; PAM type: YTN; PAM sequence: TTC
tgagagtgaacattgtgcag

SEQ ID NO: 173589 - DNA, 20 bp, Artificial Sequence
  Description of Artificial Sequence: Synthetic oligonucleotide
  Target: ATXN1; (-) strand; PAM type: YTN; PAM sequence: TTT
ctgagagtgaacattgtgca

SEQ ID NO: 173590 - DNA, 20 bp, Artificial Sequence
  Description of Artificial Sequence: Synthetic oligonucleotide
  Target: ATXN1; (-) strand; PAM type: YTN; PAM sequence: CTT
tctgagagtgaacattgtgc

SEQ ID NO: 173591 - DNA, 20 bp, Artificial Sequence
  Description of Artificial Sequence: Synthetic oligonucleotide
  Target: ATXN1; (-) strand; PAM type: YTN; PAM sequence: TTC
tttctgagagtgaacattgt

SEQ ID NO: 173592 - DNA, 20 bp, Artificial Sequence
  Description of Artificial Sequence: Synthetic oligonucleotide
  Target: ATXN1; (-) strand; PAM type: YTN; PAM sequence: TTT
ctttctgagagtgaacattg

SEQ ID NO: 173593 - DNA, 20 bp, Artificial Sequence
  Description of Artificial Sequence: Synthetic oligonucleotide
  Target: ATXN1; (-) strand; PAM type: YTN; PAM sequence: TTT
tctttctgagagtgaacatt

SEQ ID NO: 173594 - DNA, 20 bp, Artificial Sequence
  Description of Artificial Sequence: Synthetic oligonucleotide
  Target: ATXN1; (-) strand; PAM type: YTN; PAM sequence: TTA
tagtattttctttctgagag

SEQ ID NO: 173595 - DNA, 20 bp, Artificial Sequence
  Description of Artificial Sequence: Synthetic oligonucleotide
  Target: ATXN1; (-) strand; PAM type: YTN; PAM sequence: TTT
atagtattttctttctgaga

SEQ ID NO: 173596 - DNA, 20 bp, Artificial Sequence
  Description of Artificial Sequence: Synthetic oligonucleotide
  Target: ATXN1; (-) strand; PAM type: YTN; PAM sequence: CTC
aaacacaggtttatagtatt

SEQ ID NO: 173597 - DNA, 20 bp, Artificial Sequence
  Description of Artificial Sequence: Synthetic oligonucleotide
  Target: ATXN1; (-) strand; PAM type: YTN; PAM sequence: TTG
aaagcaagagaaatagctca

SEQ ID NO: 173598 - DNA, 20 bp, Artificial Sequence
  Description of Artificial Sequence: Synthetic oligonucleotide
  Target: ATXN1; (-) strand; PAM type: YTN; PAM sequence: CTG
cattgaaagcaagagaaata

SEQ ID NO: 173599 - DNA, 20 bp, Artificial Sequence
  Description of Artificial Sequence: Synthetic oligonucleotide
  Target: ATXN1; (-) strand; PAM type: YTN; PAM sequence: CTA
aatctgcattgaaagcaaga

SEQ ID NO: 173600 - DNA, 20 bp, Artificial Sequence
  Description of Artificial Sequence: Synthetic oligonucleotide
  Target: ATXN1; (-) strand; PAM type: YTN; PAM sequence: TTG
aacaatcagctaaatctgca

SEQ ID NO: 173601 - DNA, 20 bp, Artificial Sequence
  Description of Artificial Sequence: Synthetic oligonucleotide
  Target: ATXN1; (-) strand; PAM type: YTN; PAM sequence: CTC
acgttgaacaatcagctaaa

SEQ ID NO: 173602 - DNA, 20 bp, Artificial Sequence
  Description of Artificial Sequence: Synthetic oligonucleotide
  Target: ATXN1; (-) strand; PAM type: YTN; PAM sequence: TTA
agacctcacgttgaacaatc

SEQ ID NO: 173603 - DNA, 20 bp, Artificial Sequence
  Description of Artificial Sequence: Synthetic oligonucleotide
  Target: ATXN1; (-) strand; PAM type: YTN; PAM sequence: TTT
aagacctcacgttgaacaat

SEQ ID NO: 173604 - DNA, 20 bp, Artificial Sequence
  Description of Artificial Sequence: Synthetic oligonucleotide
  Target: ATXN1; (-) strand; PAM type: YTN; PAM sequence: TTT
taagacctcacgttgaacaa

SEQ ID NO: 173605 - DNA, 20 bp, Artificial Sequence
  Description of Artificial Sequence: Synthetic oligonucleotide
  Target: ATXN1; (-) strand; PAM type: YTN; PAM sequence: TTG
ttttaagacctcacgttgaa

SEQ ID NO: 173606 - DNA, 20 bp, Artificial Sequence
  Description of Artificial Sequence: Synthetic oligonucleotide
  Target: ATXN1; (-) strand; PAM type: YTN; PAM sequence: CTG
tgaagagagagggttgtttt

SEQ ID NO: 173607 - DNA, 20 bp, Artificial Sequence
  Description of Artificial Sequence: Synthetic oligonucleotide
  Target: ATXN1; (-) strand; PAM type: YTN; PAM sequence: TTA
atgaaggaaagtcataggga

SEQ ID NO: 173608 - DNA, 20 bp, Artificial Sequence
  Description of Artificial Sequence: Synthetic oligonucleotide
  Target: ATXN1; (-) strand; PAM type: YTN; PAM sequence: CTT
aatgaaggaaagtcataggg

SEQ ID NO: 173609 - DNA, 20 bp, Artificial Sequence
  Description of Artificial Sequence: Synthetic oligonucleotide
  Target: ATXN1; (-) strand; PAM type: YTN; PAM sequence: TTA
acttaatgaaggaaagtcat

SEQ ID NO: 173610 - DNA, 20 bp, Artificial Sequence
  Description of Artificial Sequence: Synthetic oligonucleotide
  Target: ATXN1; (-) strand; PAM type: YTN; PAM sequence: TTT
aacttaatgaaggaaagtca

SEQ ID NO: 173611 - DNA, 20 bp, Artificial Sequence
  Description of Artificial Sequence: Synthetic oligonucleotide
  Target: ATXN1; (-) strand; PAM type: YTN; PAM sequence: TTT
taacttaatgaaggaaagtc

SEQ ID NO: 173612 - DNA, 20 bp, Artificial Sequence
  Description of Artificial Sequence: Synthetic oligonucleotide
  Target: ATXN1; (-) strand; PAM type: YTN; PAM sequence: CTC
attttaacttaatgaaggaa

SEQ ID NO: 173613 - DNA, 20 bp, Artificial Sequence
  Description of Artificial Sequence: Synthetic oligonucleotide
  Target: ATXN1; (-) strand; PAM type: YTN; PAM sequence: CTC
tcattttaacttaatgaagg

SEQ ID NO: 173614 - DNA, 20 bp, Artificial Sequence
  Description of Artificial Sequence: Synthetic oligonucleotide
  Target: ATXN1; (-) strand; PAM type: YTN; PAM sequence: TTA
gtctctcattttaacttaat

SEQ ID NO: 173615 - DNA, 20 bp, Artificial Sequence
  Description of Artificial Sequence: Synthetic oligonucleotide
  Target: ATXN1; (-) strand; PAM type: YTN; PAM sequence: TTT
agtctctcattttaacttaa

SEQ ID NO: 173616 - DNA, 20 bp, Artificial Sequence
  Description of Artificial Sequence: Synthetic oligonucleotide
  Target: ATXN1; (-) strand; PAM type: YTN; PAM sequence: TTT
tagtctctcattttaactta

SEQ ID NO: 173617 - DNA, 20 bp, Artificial Sequence
  Description of Artificial Sequence: Synthetic oligonucleotide
  Target: ATXN1; (-) strand; PAM type: YTN; PAM sequence: TTT
ttagtctctcattttaactt

SEQ ID NO: 173618 - DNA, 20 bp, Artificial Sequence
  Description of Artificial Sequence: Synthetic oligonucleotide
  Target: ATXN1; (-) strand; PAM type: YTN; PAM sequence: TTT
tttagtctctcattttaact

SEQ ID NO: 173619 - DNA, 20 bp, Artificial Sequence
  Description of Artificial Sequence: Synthetic oligonucleotide
  Target: ATXN1; (-) strand; PAM type: YTN; PAM sequence: CTT
ttttagtctctcattttaac

SEQ ID NO: 173620 - DNA, 20 bp, Artificial Sequence
  Description of Artificial Sequence: Synthetic oligonucleotide
  Target: ATXN1; (-) strand; PAM type: YTN; PAM sequence: TTC
cacttttttagtctctcatt

SEQ ID NO: 173621 - DNA, 20 bp, Artificial Sequence
  Description of Artificial Sequence: Synthetic oligonucleotide
  Target: ATXN1; (-) strand; PAM type: YTN; PAM sequence: TTC
acatgttccacttttttagt

SEQ ID NO: 173622 - DNA, 20 bp, Artificial Sequence
  Description of Artificial Sequence: Synthetic oligonucleotide
  Target: ATXN1; (-) strand; PAM type: YTN; PAM sequence: CTT
cacatgttccacttttttag

SEQ ID NO: 173623 - DNA, 20 bp, Artificial Sequence
  Description of Artificial Sequence: Synthetic oligonucleotide
  Target: ATXN1; (-) strand; PAM type: YTN; PAM sequence: TTC
cttcacatgttccacttttt

SEQ ID NO: 173624 - DNA, 20 bp, Artificial Sequence
  Description of Artificial Sequence: Synthetic oligonucleotide
  Target: ATXN1; (-) strand; PAM type: YTN; PAM sequence: CTC
atcattccttcacatgttcc

SEQ ID NO: 173625 - DNA, 20 bp, Artificial Sequence
  Description of Artificial Sequence: Synthetic oligonucleotide
  Target: ATXN1; (-) strand; PAM type: YTN; PAM sequence: TTG
acctcatcattccttcacat

SEQ ID NO: 173626 - DNA, 20 bp, Artificial Sequence
  Description of Artificial Sequence: Synthetic oligonucleotide
  Target: ATXN1; (-) strand; PAM type: YTN; PAM sequence: CTG
ttgacctcatcattccttca

SEQ ID NO: 173627 - DNA, 20 bp, Artificial Sequence
  Description of Artificial Sequence: Synthetic oligonucleotide
  Target: ATXN1; (-) strand; PAM type: YTN; PAM sequence: CTG
agaatgctgttgacctcatc

SEQ ID NO: 173628 - DNA, 20 bp, Artificial Sequence
  Description of Artificial Sequence: Synthetic oligonucleotide
  Target: ATXN1; (-) strand; PAM type: YTN; PAM sequence: TTA
gagagaaaggaatctgagaa

SEQ ID NO: 173629 - DNA, 20 bp, Artificial Sequence
  Description of Artificial Sequence: Synthetic oligonucleotide
  Target: ATXN1; (-) strand; PAM type: YTN; PAM sequence: TTT
agagagaaaggaatctgaga

SEQ ID NO: 173630 - DNA, 20 bp, Artificial Sequence
  Description of Artificial Sequence: Synthetic oligonucleotide
  Target: ATXN1; (-) strand; PAM type: YTN; PAM sequence: TTA
atttagagagaaaggaatct

SEQ ID NO: 173631 - DNA, 20 bp, Artificial Sequence
  Description of Artificial Sequence: Synthetic oligonucleotide
  Target: ATXN1; (-) strand; PAM type: YTN; PAM sequence: TTG
gtatgattaatttagagaga

SEQ ID NO: 173632 - DNA, 20 bp, Artificial Sequence
  Description of Artificial Sequence: Synthetic oligonucleotide
  Target: ATXN1; (-) strand; PAM type: YTN; PAM sequence: CTT
ggtatgattaatttagagag

SEQ ID NO: 173633 - DNA, 20 bp, Artificial Sequence
  Description of Artificial Sequence: Synthetic oligonucleotide
  Target: ATXN1; (-) strand; PAM type: YTN; PAM sequence: CTC
cttggtatgattaatttaga

SEQ ID NO: 173634 - DNA, 20 bp, Artificial Sequence
  Description of Artificial Sequence: Synthetic oligonucleotide
  Target: ATXN1; (-) strand; PAM type: YTN; PAM sequence: TTC
tccttggtatgattaattta

SEQ ID NO: 173635 - DNA, 20 bp, Artificial Sequence
  Description of Artificial Sequence: Synthetic oligonucleotide
  Target: ATXN1; (-) strand; PAM type: YTN; PAM sequence: TTG
ggttctccttggtatgatta

SEQ ID NO: 173636 - DNA, 20 bp, Artificial Sequence
  Description of Artificial Sequence: Synthetic oligonucleotide
  Target: ATXN1; (-) strand; PAM type: YTN; PAM sequence: CTT
gggttctccttggtatgatt

SEQ ID NO: 173637 - DNA, 20 bp, Artificial Sequence
  Description of Artificial Sequence: Synthetic oligonucleotide
  Target: ATXN1; (-) strand; PAM type: YTN; PAM sequence: TTA
acttgggttctccttggtat

SEQ ID NO: 173638 - DNA, 20 bp, Artificial Sequence
  Description of Artificial Sequence: Synthetic oligonucleotide
  Target: ATXN1; (-) strand; PAM type: YTN; PAM sequence: TTT
aacttgggttctccttggta

SEQ ID NO: 173639 - DNA, 20 bp, Artificial Sequence
  Description of Artificial Sequence: Synthetic oligonucleotide
  Target: ATXN1; (-) strand; PAM type: YTN; PAM sequence: TTA
tttaacttgggttctccttg

SEQ ID NO: 173640 - DNA, 20 bp, Artificial Sequence
  Description of Artificial Sequence: Synthetic oligonucleotide
  Target: ATXN1; (-) strand; PAM type: YTN; PAM sequence: TTG
aaaaaattatttaacttggg

SEQ ID NO: 173641 - DNA, 20 bp, Artificial Sequence
  Description of Artificial Sequence: Synthetic oligonucleotide
  Target: ATXN1; (-) strand; PAM type: YTN; PAM sequence: CTT
gaaaaaattatttaacttgg

SEQ ID NO: 173642 - DNA, 20 bp, Artificial Sequence
  Description of Artificial Sequence: Synthetic oligonucleotide
  Target: ATXN1; (-) strand; PAM type: YTN; PAM sequence: TTC
ttgaaaaaattatttaactt

SEQ ID NO: 173643 - DNA, 20 bp, Artificial Sequence
  Description of Artificial Sequence: Synthetic oligonucleotide
  Target: ATXN1; (-) strand; PAM type: YTN; PAM sequence: TTA
gattcttgaaaaaattattt

SEQ ID NO: 173644 - DNA, 20 bp, Artificial Sequence
  Description of Artificial Sequence: Synthetic oligonucleotide
  Target: ATXN1; (-) strand; PAM type: YTN; PAM sequence: TTT
agattcttgaaaaaattatt

SEQ ID NO: 173645 - DNA, 20 bp, Artificial Sequence
  Description of Artificial Sequence: Synthetic oligonucleotide
  Target: ATXN1; (-) strand; PAM type: YTN; PAM sequence: TTA
tttagattcttgaaaaaatt

SEQ ID NO: 173646 - DNA, 20 bp, Artificial Sequence
  Description of Artificial Sequence: Synthetic oligonucleotide
  Target: ATXN1; (-) strand; PAM type: YTN; PAM sequence: TTT
atttagattcttgaaaaaat

SEQ ID NO: 173647 - DNA, 20 bp, Artificial Sequence
  Description of Artificial Sequence: Synthetic oligonucleotide
  Target: ATXN1; (-) strand; PAM type: YTN; PAM sequence: TTT
tatttagattcttgaaaaaa

SEQ ID NO: 173648 - DNA, 20 bp, Artificial Sequence
  Description of Artificial Sequence: Synthetic oligonucleotide
  Target: ATXN1; (-) strand; PAM type: YTN; PAM sequence: TTA
aagttttatttagattcttg

SEQ ID NO: 173649 - DNA, 20 bp, Artificial Sequence
  Description of Artificial Sequence: Synthetic oligonucleotide
  Target: ATXN1; (-) strand; PAM type: YTN; PAM sequence: TTT
aaagttttatttagattctt

SEQ ID NO: 173650 - DNA, 20 bp, Artificial Sequence
  Description of Artificial Sequence: Synthetic oligonucleotide
  Target: ATXN1; (-) strand; PAM type: YTN; PAM sequence: TTA
tttaaagttttatttagatt

SEQ ID NO: 173651 - DNA, 20 bp, Artificial Sequence
  Description of Artificial Sequence: Synthetic oligonucleotide
  Target: ATXN1; (-) strand; PAM type: YTN; PAM sequence: TTT
atttaaagttttatttagat

SEQ ID NO: 173652 - DNA, 20 bp, Artificial Sequence
  Description of Artificial Sequence: Synthetic oligonucleotide
  Target: ATXN1; (-) strand; PAM type: YTN; PAM sequence: CTT
tatttaaagttttatttaga

SEQ ID NO: 173653 - DNA, 20 bp, Artificial Sequence
  Description of Artificial Sequence: Synthetic oligonucleotide
  Target: ATXN1; (-) strand; PAM type: YTN; PAM sequence: CTG
tgagtaaaaccaaataaagc

SEQ ID NO: 173654 - DNA, 20 bp, Artificial Sequence
  Description of Artificial Sequence: Synthetic oligonucleotide
  Target: ATXN1; (-) strand; PAM type: YTN; PAM sequence: TTG
gctgtgagtaaaaccaaata

SEQ ID NO: 173655 - DNA, 20 bp, Artificial Sequence
  Description of Artificial Sequence: Synthetic oligonucleotide
  Target: ATXN1; (-) strand; PAM type: YTN; PAM sequence: TTG
gttggctgtgagtaaaacca

SEQ ID NO: 173656 - DNA, 20 bp, Artificial Sequence
  Description of Artificial Sequence: Synthetic oligonucleotide
  Target: ATXN1; (-) strand; PAM type: YTN; PAM sequence: TTA
ttggttggctgtgagtaaaa

SEQ ID NO: 173657 - DNA, 20 bp, Artificial Sequence
  Description of Artificial Sequence: Synthetic oligonucleotide
  Target: ATXN1; (-) strand; PAM type: YTN; PAM sequence: CTC
aattattggttggctgtgag

SEQ ID NO: 173658 - DNA, 20 bp, Artificial Sequence
  Description of Artificial Sequence: Synthetic oligonucleotide
  Target: ATXN1; (-) strand; PAM type: YTN; PAM sequence: TTA
aaaatagagatgactcaatt

SEQ ID NO: 173659 - DNA, 20 bp, Artificial Sequence
  Description of Artificial Sequence: Synthetic oligonucleotide
  Target: ATXN1; (-) strand; PAM type: YTN; PAM sequence: TTT
aaaaatagagatgactcaat

SEQ ID NO: 173660 - DNA, 20 bp, Artificial Sequence
  Description of Artificial Sequence: Synthetic oligonucleotide
  Target: ATXN1; (-) strand; PAM type: YTN; PAM sequence: CTT
taaaaatagagatgactcaa

SEQ ID NO: 173661 - DNA, 20 bp, Artificial Sequence
  Description of Artificial Sequence: Synthetic oligonucleotide
  Target: ATXN1; (-) strand; PAM type: YTN; PAM sequence: TTA
ctttaaaaatagagatgact

SEQ ID NO: 173662 - DNA, 20 bp, Artificial Sequence
  Description of Artificial Sequence: Synthetic oligonucleotide
  Target: ATXN1; (-) strand; PAM type: YTN; PAM sequence: TTC
acattactttaaaaatagag

SEQ ID NO: 173663 - DNA, 20 bp, Artificial Sequence
  Description of Artificial Sequence: Synthetic oligonucleotide
  Target: ATXN1; (-) strand; PAM type: YTN; PAM sequence: CTT
cacattactttaaaaataga

SEQ ID NO: 173664 - DNA, 20 bp, Artificial Sequence
  Description of Artificial Sequence: Synthetic oligonucleotide
  Target: ATXN1; (-) strand; PAM type: YTN; PAM sequence: CTG
atcttcacattactttaaaa

SEQ ID NO: 173665 - DNA, 20 bp, Artificial Sequence
  Description of Artificial Sequence: Synthetic oligonucleotide
  Target: ATXN1; (-) strand; PAM type: YTN; PAM sequence: CTA
actgatcttcacattacttt

SEQ ID NO: 173666 - DNA, 20 bp, Artificial Sequence
  Description of Artificial Sequence: Synthetic oligonucleotide
  Target: ATXN1; (-) strand; PAM type: YTN; PAM sequence: TTG
aactaactgatcttcacatt

SEQ ID NO: 173667 - DNA, 20 bp, Artificial Sequence
  Description of Artificial Sequence: Synthetic oligonucleotide
  Target: ATXN1; (-) strand; PAM type: YTN; PAM sequence: TTT
gaactaactgatcttcacat

SEQ ID NO: 173668 - DNA, 20 bp, Artificial Sequence
  Description of Artificial Sequence: Synthetic oligonucleotide
  Target: ATXN1; (-) strand; PAM type: YTN; PAM sequence: TTA
ggtttgaactaactgatctt

SEQ ID NO: 173669 - DNA, 20 bp, Artificial Sequence
  Description of Artificial Sequence: Synthetic oligonucleotide
  Target: ATXN1; (-) strand; PAM type: YTN; PAM sequence: TTA
tgaatgcccggtatccgtta

SEQ ID NO: 173670 - DNA, 20 bp, Artificial Sequence
  Description of Artificial Sequence: Synthetic oligonucleotide
  Target: ATXN1; (-) strand; PAM type: YTN; PAM sequence: CTC
aaaagttatgaatgcccggt

SEQ ID NO: 173671 - DNA, 20 bp, Artificial Sequence
  Description of Artificial Sequence: Synthetic oligonucleotide
  Target: ATXN1; (-) strand; PAM type: YTN; PAM sequence: CTA
gtaatgccctcaaaagttat

SEQ ID NO: 173672 - DNA, 20 bp, Artificial Sequence
  Description of Artificial Sequence: Synthetic oligonucleotide
  Target: ATXN1; (-) strand; PAM type: YTN; PAM sequence: TTA
aggaaatagggtgtctagta

SEQ ID NO: 173673 - DNA, 20 bp, Artificial Sequence
  Description of Artificial Sequence: Synthetic oligonucleotide
  Target: ATXN1; (-) strand; PAM type: YTN; PAM sequence: TTA
cattaaggaaatagggtgtc

SEQ ID NO: 173674 - DNA, 20 bp, Artificial Sequence
  Description of Artificial Sequence: Synthetic oligonucleotide
  Target: ATXN1; (-) strand; PAM type: YTN; PAM sequence: TTT
acattaaggaaatagggtgt

SEQ ID NO: 173675 - DNA, 20 bp, Artificial Sequence
  Description of Artificial Sequence: Synthetic oligonucleotide
  Target: ATXN1; (-) strand; PAM type: YTN; PAM sequence: TTT
tacattaaggaaatagggtg

SEQ ID NO: 173676 - DNA, 20 bp, Artificial Sequence
  Description of Artificial Sequence: Synthetic oligonucleotide
  Target: ATXN1; (-) strand; PAM type: YTN; PAM sequence: TTT
ttacattaaggaaatagggt

SEQ ID NO: 173677 - DNA, 20 bp, Artificial Sequence
  Description of Artificial Sequence: Synthetic oligonucleotide
  Target: ATXN1; (-) strand; PAM type: YTN; PAM sequence: CTT
tttacattaaggaaataggg

SEQ ID NO: 173678 - DNA, 20 bp, Artificial Sequence
  Description of Artificial Sequence: Synthetic oligonucleotide
  Target: ATXN1; (-) strand; PAM type: YTN; PAM sequence: TTA
ctttttacattaaggaaata

SEQ ID NO: 173679 - DNA, 20 bp, Artificial Sequence
  Description of Artificial Sequence: Synthetic oligonucleotide
  Target: ATXN1; (-) strand; PAM type: YTN; PAM sequence: TTT
actttttacattaaggaaat

SEQ ID NO: 173680 - DNA, 20 bp, Artificial Sequence
  Description of Artificial Sequence: Synthetic oligonucleotide
  Target: ATXN1; (-) strand; PAM type: YTN; PAM sequence: CTT
tactttttacattaaggaaa

SEQ ID NO: 173681 - DNA, 20 bp, Artificial Sequence
  Description of Artificial Sequence: Synthetic oligonucleotide
  Target: ATXN1; (-) strand; PAM type: YTN; PAM sequence: CTA
ctttactttttacattaagg

SEQ ID NO: 173682 - DNA, 20 bp, Artificial Sequence
  Description of Artificial Sequence: Synthetic oligonucleotide
  Target: ATXN1; (-) strand; PAM type: YTN; PAM sequence: CTC
tactttactttttacattaa

SEQ ID NO: 173683 - DNA, 20 bp, Artificial Sequence
  Description of Artificial Sequence: Synthetic oligonucleotide
  Target: ATXN1; (-) strand; PAM type: YTN; PAM sequence: TTG
aagaggaacctctactttac

SEQ ID NO: 173684 - DNA, 20 bp, Artificial Sequence
  Description of Artificial Sequence: Synthetic oligonucleotide
  Target: ATXN1; (-) strand; PAM type: YTN; PAM sequence: TTT
gaagaggaacctctacttta

SEQ ID NO: 173685 - DNA, 20 bp, Artificial Sequence
  Description of Artificial Sequence: Synthetic oligonucleotide
  Target: ATXN1; (-) strand; PAM type: YTN; PAM sequence: CTT
tgaagaggaacctctacttt

SEQ ID NO: 173686 - DNA, 20 bp, Artificial Sequence
  Description of Artificial Sequence: Synthetic oligonucleotide
  Target: ATXN1; (-) strand; PAM type: YTN; PAM sequence: TTA
gatggggaggaaaatctttg

SEQ ID NO: 173687 - DNA, 20 bp, Artificial Sequence
  Description of Artificial Sequence: Synthetic oligonucleotide
  Target: ATXN1; (-) strand; PAM type: YTN; PAM sequence: CTA
attagatggggaggaaaatc

SEQ ID NO: 173688 - DNA, 20 bp, Artificial Sequence
  Description of Artificial Sequence: Synthetic oligonucleotide
  Target: ATXN1; (-) strand; PAM type: YTN; PAM sequence: TTC
ctaattagatggggaggaaa

SEQ ID NO: 173689 - DNA, 20 bp, Artificial Sequence
  Description of Artificial Sequence: Synthetic oligonucleotide
  Target: ATXN1; (-) strand; PAM type: YTN; PAM sequence: TTA
attcctaattagatggggag

SEQ ID NO: 173690 - DNA, 20 bp, Artificial Sequence
  Description of Artificial Sequence: Synthetic oligonucleotide
  Target: ATXN1; (-) strand; PAM type: YTN; PAM sequence: CTA
ttaattcctaattagatggg

SEQ ID NO: 173691 - DNA, 20 bp, Artificial Sequence
  Description of Artificial Sequence: Synthetic oligonucleotide
  Target: ATXN1; (-) strand; PAM type: YTN; PAM sequence: CTA
agagaaagtactattaattc

SEQ ID NO: 173692 - DNA, 20 bp, Artificial Sequence
  Description of Artificial Sequence: Synthetic oligonucleotide
  Target: ATXN1; (-) strand; PAM type: YTN; PAM sequence: TTC
taagagaaagtactattaat

SEQ ID NO: 173693 - DNA, 20 bp, Artificial Sequence
  Description of Artificial Sequence: Synthetic oligonucleotide
  Target: ATXN1; (-) strand; PAM type: YTN; PAM sequence: CTT
ctaagagaaagtactattaa

SEQ ID NO: 173694 - DNA, 20 bp, Artificial Sequence
  Description of Artificial Sequence: Synthetic oligonucleotide
  Target: ATXN1; (-) strand; PAM type: YTN; PAM sequence: TTG
cttctaagagaaagtactat

SEQ ID NO: 173695 - DNA, 20 bp, Artificial Sequence
  Description of Artificial Sequence: Synthetic oligonucleotide
  Target: ATXN1; (-) strand; PAM type: YTN; PAM sequence: TTT
gcttctaagagaaagtacta

SEQ ID NO: 173696 - DNA, 20 bp, Artificial Sequence
  Description of Artificial Sequence: Synthetic oligonucleotide
  Target: ATXN1; (-) strand; PAM type: YTN; PAM sequence: TTT
tgcttctaagagaaagtact

SEQ ID NO: 173697 - DNA, 20 bp, Artificial Sequence
  Description of Artificial Sequence: Synthetic oligonucleotide
  Target: ATXN1; (-) strand; PAM type: YTN; PAM sequence: TTG
aataaattttgcttctaaga

SEQ ID NO: 173698 - DNA, 20 bp, Artificial Sequence
  Description of Artificial Sequence: Synthetic oligonucleotide
  Target: ATXN1; (-) strand; PAM type: YTN; PAM sequence: TTT
gaataaattttgcttctaag

SEQ ID NO: 173699 - DNA, 20 bp, Artificial Sequence
  Description of Artificial Sequence: Synthetic oligonucleotide
  Target: ATXN1; (-) strand; PAM type: YTN; PAM sequence: CTT
tgaataaattttgcttctaa

SEQ ID NO: 173700 - DNA, 20 bp, Artificial Sequence
  Description of Artificial Sequence: Synthetic oligonucleotide
  Target: ATXN1; (-) strand; PAM type: YTN; PAM sequence: TTA
gcacaggtctttgaataaat

SEQ ID NO: 173701 - DNA, 20 bp, Artificial Sequence
  Description of Artificial Sequence: Synthetic oligonucleotide
  Target: ATXN1; (-) strand; PAM type: YTN; PAM sequence: TTA
agaatgttagcacaggtctt

SEQ ID NO: 173702 - DNA, 20 bp, Artificial Sequence
  Description of Artificial Sequence: Synthetic oligonucleotide
  Target: ATXN1; (-) strand; PAM type: YTN; PAM sequence: TTT
aagaatgttagcacaggtct

SEQ ID NO: 173703 - DNA, 20 bp, Artificial Sequence
  Description of Artificial Sequence: Synthetic oligonucleotide
  Target: ATXN1; (-) strand; PAM type: YTN; PAM sequence: CTA
gcagatatttaagaatgtta

SEQ ID NO: 173704 - DNA, 20 bp, Artificial Sequence
  Description of Artificial Sequence: Synthetic oligonucleotide
  Target: ATXN1; (-) strand; PAM type: YTN; PAM sequence: TTA
cagctagcagatatttaaga

SEQ ID NO: 173705 - DNA, 20 bp, Artificial Sequence
  Description of Artificial Sequence: Synthetic oligonucleotide
  Target: ATXN1; (-) strand; PAM type: YTN; PAM sequence: TTA
ttacagctagcagatattta

SEQ ID NO: 173706 - DNA, 20 bp, Artificial Sequence
  Description of Artificial Sequence: Synthetic oligonucleotide
  Target: ATXN1; (-) strand; PAM type: YTN; PAM sequence: TTT
attacagctagcagatattt

SEQ ID NO: 173707 - DNA, 20 bp, Artificial Sequence
  Description of Artificial Sequence: Synthetic oligonucleotide
  Target: ATXN1; (-) strand; PAM type: YTN; PAM sequence: CTT
tattacagctagcagatatt

SEQ ID NO: 173708 - DNA, 20 bp, Artificial Sequence
  Description of Artificial Sequence: Synthetic oligonucleotide
  Target: ATXN1; (-) strand; PAM type: YTN; PAM sequence: TTC
tttattacagctagcagata

SEQ ID NO: 173709 - DNA, 20 bp, Artificial Sequence
  Description of Artificial Sequence: Synthetic oligonucleotide
  Target: ATXN1; (-) strand; PAM type: YTN; PAM sequence: TTT
ctttattacagctagcagat

SEQ ID NO: 173710 - DNA, 20 bp, Artificial Sequence
  Description of Artificial Sequence: Synthetic oligonucleotide
  Target: ATXN1; (-) strand; PAM type: YTN; PAM sequence: TTG
atttctttattacagctagc

SEQ ID NO: 173711 - DNA, 20 bp, Artificial Sequence
  Description of Artificial Sequence: Synthetic oligonucleotide
  Target: ATXN1; (-) strand; PAM type: YTN; PAM sequence: CTA
agaacataaagtacattgat

SEQ ID NO: 173712 - DNA, 20 bp, Artificial Sequence
  Description of Artificial Sequence: Synthetic oligonucleotide
  Target: ATXN1; (-) strand; PAM type: YTN; PAM sequence: TTG
tgggagctaagaacataaag

SEQ ID NO: 173713 - DNA, 20 bp, Artificial Sequence
  Description of Artificial Sequence: Synthetic oligonucleotide
  Target: ATXN1; (-) strand; PAM type: YTN; PAM sequence: CTA
aattgtgggagctaagaaca

SEQ ID NO: 173714 - DNA, 20 bp, Artificial Sequence
  Description of Artificial Sequence: Synthetic oligonucleotide
  Target: ATXN1; (-) strand; PAM type: YTN; PAM sequence: TTA
ggctaaattgtgggagctaa

SEQ ID NO: 173715 - DNA, 20 bp, Artificial Sequence
  Description of Artificial Sequence: Synthetic oligonucleotide
  Target: ATXN1; (-) strand; PAM type: YTN; PAM sequence: TTT
aggctaaattgtgggagcta

SEQ ID NO: 173716 - DNA, 20 bp, Artificial Sequence
  Description of Artificial Sequence: Synthetic oligonucleotide
  Target: ATXN1; (-) strand; PAM type: YTN; PAM sequence: CTA
gggtaaatatttaggctaaa

SEQ ID NO: 173717 - DNA, 20 bp, Artificial Sequence
  Description of Artificial Sequence: Synthetic oligonucleotide
  Target: ATXN1; (-) strand; PAM type: YTN; PAM sequence: TTG
gaccagtataagcatgctag

SEQ ID NO: 173718 - DNA, 20 bp, Artificial Sequence
  Description of Artificial Sequence: Synthetic oligonucleotide
  Target: ATXN1; (-) strand; PAM type: YTN; PAM sequence: CTT
ggaccagtataagcatgcta

SEQ ID NO: 173719 - DNA, 20 bp, Artificial Sequence
  Description of Artificial Sequence: Synthetic oligonucleotide
  Target: ATXN1; (-) strand; PAM type: YTN; PAM sequence: TTG
cttggaccagtataagcatg

SEQ ID NO: 173720 - DNA, 20 bp, Artificial Sequence
  Description of Artificial Sequence: Synthetic oligonucleotide
  Target: ATXN1; (-) strand; PAM type: YTN; PAM sequence: CTT
gcttggaccagtataagcat

SEQ ID NO: 173721 - DNA, 20 bp, Artificial Sequence
  Description of Artificial Sequence: Synthetic oligonucleotide
  Target: ATXN1; (-) strand; PAM type: YTN; PAM sequence: CTA
atgcttgcttggaccagtat

SEQ ID NO: 173722 - DNA, 20 bp, Artificial Sequence
  Description of Artificial Sequence: Synthetic oligonucleotide
  Target: ATXN1; (-) strand; PAM type: YTN; PAM sequence: CTA
tgacctaatgcttgcttgga

SEQ ID NO: 173723 - DNA, 20 bp, Artificial Sequence
  Description of Artificial Sequence: Synthetic oligonucleotide
  Target: ATXN1; (-) strand; PAM type: YTN; PAM sequence: TTC
aaataaggaagaggaacagg

SEQ ID NO: 173724 - DNA, 20 bp, Artificial Sequence
  Description of Artificial Sequence: Synthetic oligonucleotide
  Target: ATXN1; (-) strand; PAM type: YTN; PAM sequence: CTT
caaataaggaagaggaacag

SEQ ID NO: 173725 - DNA, 20 bp, Artificial Sequence
  Description of Artificial Sequence: Synthetic oligonucleotide
  Target: ATXN1; (-) strand; PAM type: YTN; PAM sequence: CTG
agaaaggtaaaaaaccttca

SEQ ID NO: 173726 - DNA, 20 bp, Artificial Sequence
  Description of Artificial Sequence: Synthetic oligonucleotide
  Target: ATXN1; (-) strand; PAM type: YTN; PAM sequence: TTG
tgaaatgctgagaaaggtaa

SEQ ID NO: 173727 - DNA, 20 bp, Artificial Sequence
  Description of Artificial Sequence: Synthetic oligonucleotide
  Target: ATXN1; (-) strand; PAM type: YTN; PAM sequence: CTT
gtgaaatgctgagaaaggta

SEQ ID NO: 173728 - DNA, 20 bp, Artificial Sequence
  Description of Artificial Sequence: Synthetic oligonucleotide
  Target: ATXN1; (-) strand; PAM type: YTN; PAM sequence: TTA
aaagcagcaaaagcagaaga

SEQ ID NO: 173729 - DNA, 20 bp, Artificial Sequence
  Description of Artificial Sequence: Synthetic oligonucleotide
  Target: ATXN1; (-) strand; PAM type: YTN; PAM sequence: TTT
aaaagcagcaaaagcagaag

SEQ ID NO: 173730 - DNA, 20 bp, Artificial Sequence
  Description of Artificial Sequence: Synthetic oligonucleotide
  Target: ATXN1; (-) strand; PAM type: YTN; PAM sequence: TTT
taaaagcagcaaaagcagaa

SEQ ID NO: 173731 - DNA, 20 bp, Artificial Sequence
  Description of Artificial Sequence: Synthetic oligonucleotide
  Target: ATXN1; (-) strand; PAM type: YTN; PAM sequence: TTT
ttaaaagcagcaaaagcaga

SEQ ID NO: 173732 - DNA, 20 bp, Artificial Sequence
  Description of Artificial Sequence: Synthetic oligonucleotide
  Target: ATXN1; (-) strand; PAM type: YTN; PAM sequence: CTT
tttaaaagcagcaaaagcag

SEQ ID NO: 173733 - DNA, 20 bp, Artificial Sequence
  Description of Artificial Sequence: Synthetic oligonucleotide
  Target: ATXN1; (-) strand; PAM type: YTN; PAM sequence: TTA
gaactttttaaaagcagcaa

SEQ ID NO: 173734 - DNA, 20 bp, Artificial Sequence
  Description of Artificial Sequence: Synthetic oligonucleotide
  Target: ATXN1; (-) strand; PAM type: YTN; PAM sequence: CTT
agaactttttaaaagcagca

SEQ ID NO: 173735 - DNA, 20 bp, Artificial Sequence
  Description of Artificial Sequence: Synthetic oligonucleotide
  Target: ATXN1; (-) strand; PAM type: YTN; PAM sequence: CTA
gcagcttagaactttttaaa

SEQ ID NO: 173736 - DNA, 20 bp, Artificial Sequence
  Description of Artificial Sequence: Synthetic oligonucleotide
  Target: ATXN1; (-) strand; PAM type: YTN; PAM sequence: TTG
tcccgaatggctagcagctt

SEQ ID NO: 173737 - DNA, 20 bp, Artificial Sequence
  Description of Artificial Sequence: Synthetic oligonucleotide
  Target: ATXN1; (-) strand; PAM type: YTN; PAM sequence: TTT
gtcccgaatggctagcagct

SEQ ID NO: 173738 - DNA, 20 bp, Artificial Sequence
  Description of Artificial Sequence: Synthetic oligonucleotide
  Target: ATXN1; (-) strand; PAM type: YTN; PAM sequence: CTG
tatttgtcccgaatggctag

SEQ ID NO: 173739 - DNA, 20 bp, Artificial Sequence
  Description of Artificial Sequence: Synthetic oligonucleotide
  Target: ATXN1; (-) strand; PAM type: YTN; PAM sequence: TTC
tgtatttgtcccgaatggct

SEQ ID NO: 173740 - DNA, 20 bp, Artificial Sequence
  Description of Artificial Sequence: Synthetic oligonucleotide
  Target: ATXN1; (-) strand; PAM type: YTN; PAM sequence: CTC
acattctgtatttgtcccga

SEQ ID NO: 173741 - DNA, 20 bp, Artificial Sequence
  Description of Artificial Sequence: Synthetic oligonucleotide
  Target: ATXN1; (-) strand; PAM type: YTN; PAM sequence: CTG
gaatgggacctcacattctg

SEQ ID NO: 173742 - DNA, 20 bp, Artificial Sequence
  Description of Artificial Sequence: Synthetic oligonucleotide
  Target: ATXN1; (-) strand; PAM type: YTN; PAM sequence: TTG
gctggaatgggacctcacat

SEQ ID NO: 173743 - DNA, 20 bp, Artificial Sequence
  Description of Artificial Sequence: Synthetic oligonucleotide
  Target: ATXN1; (-) strand; PAM type: YTN; PAM sequence: TTC
cattggctggaatgggacct

SEQ ID NO: 173744 - DNA, 20 bp, Artificial Sequence
  Description of Artificial Sequence: Synthetic oligonucleotide
  Target: ATXN1; (-) strand; PAM type: YTN; PAM sequence: TTT
ccattggctggaatgggacc

SEQ ID NO: 173745 - DNA, 20 bp, Artificial Sequence
  Description of Artificial Sequence: Synthetic oligonucleotide
  Target: ATXN1; (-) strand; PAM type: YTN; PAM sequence: CTA
tgtccagtttccattggctg

SEQ ID NO: 173746 - DNA, 20 bp, Artificial Sequence
  Description of Artificial Sequence: Synthetic oligonucleotide
  Target: ATXN1; (-) strand; PAM type: YTN; PAM sequence: CTG
ctatgtccagtttccattgg

SEQ ID NO: 173747 - DNA, 20 bp, Artificial Sequence
  Description of Artificial Sequence: Synthetic oligonucleotide
  Target: ATXN1; (-) strand; PAM type: YTN; PAM sequence: CTA
ctgctatgtccagtttccat

SEQ ID NO: 173748 - DNA, 20 bp, Artificial Sequence
  Description of Artificial Sequence: Synthetic oligonucleotide
  Target: ATXN1; (-) strand; PAM type: YTN; PAM sequence: CTG
acgcgtccaccctactgcta

SEQ ID NO: 173749 - DNA, 20 bp, Artificial Sequence
  Description of Artificial Sequence: Synthetic oligonucleotide
  Target: ATXN1; (-) strand; PAM type: YTN; PAM sequence: TTA
taacctgacgcgtccaccct

SEQ ID NO: 173750 - DNA, 20 bp, Artificial Sequence
  Description of Artificial Sequence: Synthetic oligonucleotide
  Target: ATXN1; (-) strand; PAM type: YTN; PAM sequence: TTG
ccacaagagtacacggaaca

SEQ ID NO: 173751 - DNA, 20 bp, Artificial Sequence
  Description of Artificial Sequence: Synthetic oligonucleotide
  Target: ATXN1; (-) strand; PAM type: YTN; PAM sequence: TTT
gccacaagagtacacggaac

SEQ ID NO: 173752 - DNA, 20 bp, Artificial Sequence
  Description of Artificial Sequence: Synthetic oligonucleotide
  Target: ATXN1; (-) strand; PAM type: YTN; PAM sequence: TTT
tgccacaagagtacacggaa

SEQ ID NO: 173753 - DNA, 20 bp, Artificial Sequence
  Description of Artificial Sequence: Synthetic oligonucleotide
  Target: ATXN1; (-) strand; PAM type: YTN; PAM sequence: TTG
ccagcagttttgccacaaga

SEQ ID NO: 173754 - DNA, 20 bp, Artificial Sequence
  Description of Artificial Sequence: Synthetic oligonucleotide
  Target: ATXN1; (-) strand; PAM type: YTN; PAM sequence: CTT
gccagcagttttgccacaag

SEQ ID NO: 173755 - DNA, 20 bp, Artificial Sequence
  Description of Artificial Sequence: Synthetic oligonucleotide
  Target: ATXN1; (-) strand; PAM type: YTN; PAM sequence: CTG
cagaaagggtacacttgcca

SEQ ID NO: 173756 - DNA, 20 bp, Artificial Sequence
  Description of Artificial Sequence: Synthetic oligonucleotide
  Target: ATXN1; (-) strand; PAM type: YTN; PAM sequence: TTC
tgcagaaagggtacacttgc

SEQ ID NO: 173757 - DNA, 20 bp, Artificial Sequence
  Description of Artificial Sequence: Synthetic oligonucleotide
  Target: ATXN1; (-) strand; PAM type: YTN; PAM sequence: TTT
ctgcagaaagggtacacttg

SEQ ID NO: 173758 - DNA, 20 bp, Artificial Sequence
  Description of Artificial Sequence: Synthetic oligonucleotide
  Target: ATXN1; (-) strand; PAM type: YTN; PAM sequence: CTT
tctgcagaaagggtacactt

SEQ ID NO: 173759 - DNA, 20 bp, Artificial Sequence
  Description of Artificial Sequence: Synthetic oligonucleotide
  Target: ATXN1; (-) strand; PAM type: YTN; PAM sequence: TTA
ctttctgcagaaagggtaca

SEQ ID NO: 173760 - DNA, 20 bp, Artificial Sequence
  Description of Artificial Sequence: Synthetic oligonucleotide
  Target: ATXN1; (-) strand; PAM type: YTN; PAM sequence: TTT
actttctgcagaaagggtac

SEQ ID NO: 173761 - DNA, 20 bp, Artificial Sequence
  Description of Artificial Sequence: Synthetic oligonucleotide
  Target: ATXN1; (-) strand; PAM type: YTN; PAM sequence: TTT
tactttctgcagaaagggta

SEQ ID NO: 173762 - DNA, 20 bp, Artificial Sequence
  Description of Artificial Sequence: Synthetic oligonucleotide
  Target: ATXN1; (-) strand; PAM type: YTN; PAM sequence: TTT
ttactttctgcagaaagggt

SEQ ID NO: 173763 - DNA, 20 bp, Artificial Sequence
  Description of Artificial Sequence: Synthetic oligonucleotide
  Target: ATXN1; (-) strand; PAM type: YTN; PAM sequence: CTC
agcaagaccatttttacttt

SEQ ID NO: 173764 - DNA, 20 bp, Artificial Sequence
  Description of Artificial Sequence: Synthetic oligonucleotide
  Target: ATXN1; (-) strand; PAM type: YTN; PAM sequence: TTC
ctcagcaagaccatttttac

SEQ ID NO: 173765 - DNA, 20 bp, Artificial Sequence
  Description of Artificial Sequence: Synthetic oligonucleotide
  Target: ATXN1; (-) strand; PAM type: YTN; PAM sequence: TTT
cctcagcaagaccattttta

SEQ ID NO: 173766 - DNA, 20 bp, Artificial Sequence
  Description of Artificial Sequence: Synthetic oligonucleotide
  Target: ATXN1; (-) strand; PAM type: YTN; PAM sequence: TTA
atttcctcagcaagaccatt

SEQ ID NO: 173767 - DNA, 20 bp, Artificial Sequence
  Description of Artificial Sequence: Synthetic oligonucleotide
  Target: ATXN1; (-) strand; PAM type: YTN; PAM sequence: TTT
aatttcctcagcaagaccat

SEQ ID NO: 173768 - DNA, 20 bp, Artificial Sequence
  Description of Artificial Sequence: Synthetic oligonucleotide
  Target: ATXN1; (-) strand; PAM type: YTN; PAM sequence: TTG
aacataaatttaatttcctc

SEQ ID NO: 173769 - DNA, 20 bp, Artificial Sequence
  Description of Artificial Sequence: Synthetic oligonucleotide
  Target: ATXN1; (-) strand; PAM type: YTN; PAM sequence: CTT
gaacataaatttaatttcct

SEQ ID NO: 173770 - DNA, 20 bp, Artificial Sequence
  Description of Artificial Sequence: Synthetic oligonucleotide
  Target: ATXN1; (-) strand; PAM type: YTN; PAM sequence: CTG
taaagaaatagaccttgaac

SEQ ID NO: 173771 - DNA, 20 bp, Artificial Sequence
  Description of Artificial Sequence: Synthetic oligonucleotide
  Target: ATXN1; (-) strand; PAM type: YTN; PAM sequence: TTG
gtgctgtaaagaaatagacc

SEQ ID NO: 173772 - DNA, 20 bp, Artificial Sequence
  Description of Artificial Sequence: Synthetic oligonucleotide
  Target: ATXN1; (-) strand; PAM type: YTN; PAM sequence: TTT
ggtgctgtaaagaaatagac

SEQ ID NO: 173773 - DNA, 20 bp, Artificial Sequence
  Description of Artificial Sequence: Synthetic oligonucleotide
  Target: ATXN1; (-) strand; PAM type: YTN; PAM sequence: CTT
tggtgctgtaaagaaataga

SEQ ID NO: 173774 - DNA, 20 bp, Artificial Sequence
  Description of Artificial Sequence: Synthetic oligonucleotide
  Target: ATXN1; (-) strand; PAM type: YTN; PAM sequence: TTC
tttggtgctgtaaagaaata

SEQ ID NO: 173775 - DNA, 20 bp, Artificial Sequence
  Description of Artificial Sequence: Synthetic oligonucleotide
  Target: ATXN1; (-) strand; PAM type: YTN; PAM sequence: TTG
ttctttggtgctgtaaagaa

SEQ ID NO: 173776 - DNA, 20 bp, Artificial Sequence
  Description of Artificial Sequence: Synthetic oligonucleotide
  Target: ATXN1; (-) strand; PAM type: YTN; PAM sequence: CTT
gttctttggtgctgtaaaga

SEQ ID NO: 173777 - DNA, 20 bp, Artificial Sequence
  Description of Artificial Sequence: Synthetic oligonucleotide
  Target: ATXN1; (-) strand; PAM type: YTN; PAM sequence: TTA
gaaatgcttgttctttggtg

SEQ ID NO: 173778 - DNA, 20 bp, Artificial Sequence
  Description of Artificial Sequence: Synthetic oligonucleotide
  Target: ATXN1; (-) strand; PAM type: YTN; PAM sequence: TTA
agtgttagaaatgcttgttc

SEQ ID NO: 173779 - DNA, 20 bp, Artificial Sequence
  Description of Artificial Sequence: Synthetic oligonucleotide
  Target: ATXN1; (-) strand; PAM type: YTN; PAM sequence: CTT
aagtgttagaaatgcttgtt

SEQ ID NO: 173780 - DNA, 20 bp, Artificial Sequence
  Description of Artificial Sequence: Synthetic oligonucleotide
  Target: ATXN1; (-) strand; PAM type: YTN; PAM sequence: TTC
catagtacacatcttaagtg

SEQ ID NO: 173781 - DNA, 20 bp, Artificial Sequence
  Description of Artificial Sequence: Synthetic oligonucleotide
  Target: ATXN1; (-) strand; PAM type: YTN; PAM sequence: CTG
attccatagtacacatctta

SEQ ID NO: 173782 - DNA, 20 bp, Artificial Sequence
  Description of Artificial Sequence: Synthetic oligonucleotide
  Target: ATXN1; (-) strand; PAM type: YTN; PAM sequence: TTA
caaatctgattccatagtac

SEQ ID NO: 173783 - DNA, 20 bp, Artificial Sequence
  Description of Artificial Sequence: Synthetic oligonucleotide
  Target: ATXN1; (-) strand; PAM type: YTN; PAM sequence: TTT
acaaatctgattccatagta

SEQ ID NO: 173784 - DNA, 20 bp, Artificial Sequence
  Description of Artificial Sequence: Synthetic oligonucleotide
  Target: ATXN1; (-) strand; PAM type: YTN; PAM sequence: TTT
tacaaatctgattccatagt

SEQ ID NO: 173785 - DNA, 20 bp, Artificial Sequence
  Description of Artificial Sequence: Synthetic oligonucleotide
  Target: ATXN1; (-) strand; PAM type: YTN; PAM sequence: CTT
ttacaaatctgattccatag

SEQ ID NO: 173786 - DNA, 20 bp, Artificial Sequence
  Description of Artificial Sequence: Synthetic oligonucleotide
  Target: ATXN1; (-) strand; PAM type: YTN; PAM sequence: CTG
tgaacttttacaaatctgat

SEQ ID NO: 173787 - DNA, 20 bp, Artificial Sequence
  Description of Artificial Sequence: Synthetic oligonucleotide
  Target: ATXN1; (-) strand; PAM type: YTN; PAM sequence: CTG
ccgctgtgaacttttacaaa

SEQ ID NO: 173788 - DNA, 20 bp, Artificial Sequence
  Description of Artificial Sequence: Synthetic oligonucleotide
  Target: ATXN1; (-) strand; PAM type: YTN; PAM sequence: CTC
ctgccgctgtgaacttttac

SEQ ID NO: 173789 - DNA, 20 bp, Artificial Sequence
  Description of Artificial Sequence: Synthetic oligonucleotide
  Target: ATXN1; (-) strand; PAM type: YTN; PAM sequence: CTA
gtctcctgccgctgtgaact

SEQ ID NO: 173790 - DNA, 20 bp, Artificial Sequence
  Description of Artificial Sequence: Synthetic oligonucleotide
  Target: ATXN1; (-) strand; PAM type: YTN; PAM sequence: CTC
atggatgatcactagtctcc

SEQ ID NO: 173791 - DNA, 20 bp, Artificial Sequence
  Description of Artificial Sequence: Synthetic oligonucleotide
  Target: ATXN1; (-) strand; PAM type: YTN; PAM sequence: TTC
ctcatggatgatcactagtc

SEQ ID NO: 173792 - DNA, 20 bp, Artificial Sequence
  Description of Artificial Sequence: Synthetic oligonucleotide
  Target: ATXN1; (-) strand; PAM type: YTN; PAM sequence: CTT
cctcatggatgatcactagt

SEQ ID NO: 173793 - DNA, 20 bp, Artificial Sequence
  Description of Artificial Sequence: Synthetic oligonucleotide
  Target: ATXN1; (-) strand; PAM type: YTN; PAM sequence: CTA
taacttcctcatggatgatc

SEQ ID NO: 173794 - DNA, 20 bp, Artificial Sequence
  Description of Artificial Sequence: Synthetic oligonucleotide
  Target: ATXN1; (-) strand; PAM type: YTN; PAM sequence: CTG
agctataacttcctcatgga

SEQ ID NO: 173795 - DNA, 20 bp, Artificial Sequence
  Description of Artificial Sequence: Synthetic oligonucleotide
  Target: ATXN1; (-) strand; PAM type: YTN; PAM sequence: CTC
tgagctataacttcctcatg

SEQ ID NO: 173796 - DNA, 20 bp, Artificial Sequence
  Description of Artificial Sequence: Synthetic oligonucleotide
  Target: ATXN1; (-) strand; PAM type: YTN; PAM sequence: CTC
tctgagctataacttcctca

SEQ ID NO: 173797 - DNA, 20 bp, Artificial Sequence
  Description of Artificial Sequence: Synthetic oligonucleotide
  Target: ATXN1; (-) strand; PAM type: YTN; PAM sequence: TTA
tctctctgagctataacttc

SEQ ID NO: 173798 - DNA, 20 bp, Artificial Sequence
  Description of Artificial Sequence: Synthetic oligonucleotide
  Target: ATXN1; (-) strand; PAM type: YTN; PAM sequence: CTC
aggcatgcccattatctctc

SEQ ID NO: 173799 - DNA, 20 bp, Artificial Sequence
  Description of Artificial Sequence: Synthetic oligonucleotide
  Target: ATXN1; (-) strand; PAM type: YTN; PAM sequence: CTG
tgatctcaggcatgcccatt

SEQ ID NO: 173800 - DNA, 20 bp, Artificial Sequence
  Description of Artificial Sequence: Synthetic oligonucleotide
  Target: ATXN1; (-) strand; PAM type: YTN; PAM sequence: CTC
tgtgatctcaggcatgccca

SEQ ID NO: 173801 - DNA, 20 bp, Artificial Sequence
  Description of Artificial Sequence: Synthetic oligonucleotide
  Target: ATXN1; (-) strand; PAM type: YTN; PAM sequence: TTA
ctctgtgatctcaggcatgc

SEQ ID NO: 173802 - DNA, 20 bp, Artificial Sequence
  Description of Artificial Sequence: Synthetic oligonucleotide
  Target: ATXN1; (-) strand; PAM type: YTN; PAM sequence: TTA
acagtcattactctgtgatc

SEQ ID NO: 173803 - DNA, 20 bp, Artificial Sequence
  Description of Artificial Sequence: Synthetic oligonucleotide
  Target: ATXN1; (-) strand; PAM type: YTN; PAM sequence: TTA
aaatgaagccaagttaacag

SEQ ID NO: 173804 - DNA, 20 bp, Artificial Sequence
  Description of Artificial Sequence: Synthetic oligonucleotide
  Target: ATXN1; (-) strand; PAM type: YTN; PAM sequence: TTT
aaaatgaagccaagttaaca

SEQ ID NO: 173805 - DNA, 20 bp, Artificial Sequence
  Description of Artificial Sequence: Synthetic oligonucleotide
  Target: ATXN1; (-) strand; PAM type: YTN; PAM sequence: TTT
taaaatgaagccaagttaac

SEQ ID NO: 173806 - DNA, 20 bp, Artificial Sequence
  Description of Artificial Sequence: Synthetic oligonucleotide
  Target: ATXN1; (-) strand; PAM type: YTN; PAM sequence: CTT
ttaaaatgaagccaagttaa

SEQ ID NO: 173807 - DNA, 20 bp, Artificial Sequence
  Description of Artificial Sequence: Synthetic oligonucleotide
  Target: ATXN1; (-) strand; PAM type: YTN; PAM sequence: TTA
agataagggtagtgcccaca

SEQ ID NO: 173808 - DNA, 20 bp, Artificial Sequence
  Description of Artificial Sequence: Synthetic oligonucleotide
  Target: ATXN1; (-) strand; PAM type: YTN; PAM sequence: TTT
aagataagggtagtgcccac

SEQ ID NO: 173809 - DNA, 20 bp, Artificial Sequence
  Description of Artificial Sequence: Synthetic oligonucleotide
  Target: ATXN1; (-) strand; PAM type: YTN; PAM sequence: CTT
taagataagggtagtgccca

SEQ ID NO: 173810 - DNA, 20 bp, Artificial Sequence
  Description of Artificial Sequence: Synthetic oligonucleotide
  Target: ATXN1; (-) strand; PAM type: YTN; PAM sequence: TTA
agactttaagataagggtag

SEQ ID NO: 173811 - DNA, 20 bp, Artificial Sequence
  Description of Artificial Sequence: Synthetic oligonucleotide
  Target: ATXN1; (-) strand; PAM type: YTN; PAM sequence: TTA
acatgaagttaagactttaa

SEQ ID NO: 173812 - DNA, 20 bp, Artificial Sequence
  Description of Artificial Sequence: Synthetic oligonucleotide
  Target: ATXN1; (-) strand; PAM type: YTN; PAM sequence: TTC
attaacatgaagttaagact

SEQ ID NO: 173813 - DNA, 20 bp, Artificial Sequence
  Description of Artificial Sequence: Synthetic oligonucleotide
  Target: ATXN1; (-) strand; PAM type: YTN; PAM sequence: TTT
cattaacatgaagttaagac

SEQ ID NO: 173814 - DNA, 20 bp, Artificial Sequence
  Description of Artificial Sequence: Synthetic oligonucleotide
  Target: ATXN1; (-) strand; PAM type: YTN; PAM sequence: TTG
tttcattaacatgaagttaa

SEQ ID NO: 173815 - DNA, 20 bp, Artificial Sequence
  Description of Artificial Sequence: Synthetic oligonucleotide
  Target: ATXN1; (-) strand; PAM type: YTN; PAM sequence: TTT
gtttcattaacatgaagtta

SEQ ID NO: 173816 - DNA, 20 bp, Artificial Sequence
  Description of Artificial Sequence: Synthetic oligonucleotide
  Target: ATXN1; (-) strand; PAM type: YTN; PAM sequence: TTA
ataatgtatttgtttcatta

SEQ ID NO: 173817 - DNA, 20 bp, Artificial Sequence
  Description of Artificial Sequence: Synthetic oligonucleotide
  Target: ATXN1; (-) strand; PAM type: YTN; PAM sequence: TTT
aataatgtatttgtttcatt

SEQ ID NO: 173818 - DNA, 20 bp, Artificial Sequence
  Description of Artificial Sequence: Synthetic oligonucleotide
  Target: ATXN1; (-) strand; PAM type: YTN; PAM sequence: TTA
aaaaatttaataatgtattt

SEQ ID NO: 173819 - DNA, 20 bp, Artificial Sequence
  Description of Artificial Sequence: Synthetic oligonucleotide
  Target: ATXN1; (-) strand; PAM type: YTN; PAM sequence: TTT
aaaaaatttaataatgtatt

SEQ ID NO: 173820 - DNA, 20 bp, Artificial Sequence
  Description of Artificial Sequence: Synthetic oligonucleotide
  Target: ATXN1; (-) strand; PAM type: YTN; PAM sequence: TTA
gaggagaacatttaaaaaat

SEQ ID NO: 173821 - DNA, 20 bp, Artificial Sequence
  Description of Artificial Sequence: Synthetic oligonucleotide
  Target: ATXN1; (-) strand; PAM type: YTN; PAM sequence: CTT
agaggagaacatttaaaaaa

SEQ ID NO: 173822 - DNA, 20 bp, Artificial Sequence
  Description of Artificial Sequence: Synthetic oligonucleotide
  Target: ATXN1; (-) strand; PAM type: YTN; PAM sequence: TTG
aatcataaaggcatatcctt

SEQ ID NO: 173823 - DNA, 20 bp, Artificial Sequence
  Description of Artificial Sequence: Synthetic oligonucleotide
  Target: ATXN1; (-) strand; PAM type: YTN; PAM sequence: TTT
gaatcataaaggcatatcct

SEQ ID NO: 173824 - DNA, 20 bp, Artificial Sequence
  Description of Artificial Sequence: Synthetic oligonucleotide
  Target: ATXN1; (-) strand; PAM type: YTN; PAM sequence: TTT
tgaatcataaaggcatatcc

SEQ ID NO: 173825 - DNA, 20 bp, Artificial Sequence
  Description of Artificial Sequence: Synthetic oligonucleotide
  Target: ATXN1; (-) strand; PAM type: YTN; PAM sequence: TTA
ttttgaatcataaaggcata

SEQ ID NO: 173826 - DNA, 20 bp, Artificial Sequence
  Description of Artificial Sequence: Synthetic oligonucleotide
  Target: ATXN1; (-) strand; PAM type: YTN; PAM sequence: TTC
cgaccatattattttgaatc

SEQ ID NO: 173827 - DNA, 20 bp, Artificial Sequence
  Description of Artificial Sequence: Synthetic oligonucleotide
  Target: ATXN1; (-) strand; PAM type: YTN; PAM sequence: TTC
attccgaccatattattttg

SEQ ID NO: 173828 - DNA, 20 bp, Artificial Sequence
  Description of Artificial Sequence: Synthetic oligonucleotide
  Target: ATXN1; (-) strand; PAM type: YTN; PAM sequence: TTC
ccattcattccgaccatatt

SEQ ID NO: 173829 - DNA, 20 bp, Artificial Sequence
  Description of Artificial Sequence: Synthetic oligonucleotide
  Target: ATXN1; (-) strand; PAM type: YTN; PAM sequence: CTT
cccattcattccgaccatat

SEQ ID NO: 173830 - DNA, 20 bp, Artificial Sequence
  Description of Artificial Sequence: Synthetic oligonucleotide
  Target: ATXN1; (-) strand; PAM type: YTN; PAM sequence: CTG
gtggacacagcagtatcctt

SEQ ID NO: 173831 - DNA, 20 bp, Artificial Sequence
  Description of Artificial Sequence: Synthetic oligonucleotide
  Target: ATXN1; (-) strand; PAM type: YTN; PAM sequence: TTA
ggcactggtggacacagcag

SEQ ID NO: 173832 - DNA, 20 bp, Artificial Sequence
  Description of Artificial Sequence: Synthetic oligonucleotide
  Target: ATXN1; (-) strand; PAM type: YTN; PAM sequence: TTA
aatgtccagttaggcactgg

SEQ ID NO: 173833 - DNA, 20 bp, Artificial Sequence
  Description of Artificial Sequence: Synthetic oligonucleotide
  Target: ATXN1; (-) strand; PAM type: YTN; PAM sequence: TTT
aaatgtccagttaggcactg

SEQ ID NO: 173834 - DNA, 20 bp, Artificial Sequence
  Description of Artificial Sequence: Synthetic oligonucleotide
  Target: ATXN1; (-) strand; PAM type: YTN; PAM sequence: CTG
ccatttaaatgtccagttag

SEQ ID NO: 173835 - DNA, 20 bp, Artificial Sequence
  Description of Artificial Sequence: Synthetic oligonucleotide
  Target: ATXN1; (-) strand; PAM type: YTN; PAM sequence: TTC
tgccatttaaatgtccagtt

SEQ ID NO: 173836 - DNA, 20 bp, Artificial Sequence
  Description of Artificial Sequence: Synthetic oligonucleotide
  Target: ATXN1; (-) strand; PAM type: YTN; PAM sequence: CTT
ctgccatttaaatgtccagt

SEQ ID NO: 173837 - DNA, 20 bp, Artificial Sequence
  Description of Artificial Sequence: Synthetic oligonucleotide
  Target: ATXN1; (-) strand; PAM type: YTN; PAM sequence: TTG
gaagaagagcttctgccatt

SEQ ID NO: 173838 - DNA, 20 bp, Artificial Sequence
  Description of Artificial Sequence: Synthetic oligonucleotide
  Target: ATXN1; (-) strand; PAM type: YTN; PAM sequence: TTC
aatgtgccattggaagaaga

SEQ ID NO: 173839 - DNA, 20 bp, Artificial Sequence
  Description of Artificial Sequence: Synthetic oligonucleotide
  Target: ATXN1; (-) strand; PAM type: YTN; PAM sequence: TTT
caatgtgccattggaagaag

SEQ ID NO: 173840 - DNA, 20 bp, Artificial Sequence
  Description of Artificial Sequence: Synthetic oligonucleotide
  Target: ATXN1; (-) strand; PAM type: YTN; PAM sequence: CTC
agtgatttcaatgtgccatt

SEQ ID NO: 173841 - DNA, 20 bp, Artificial Sequence
  Description of Artificial Sequence: Synthetic oligonucleotide
  Target: ATXN1; (-) strand; PAM type: YTN; PAM sequence: CTC
tcagtgatttcaatgtgcca

SEQ ID NO: 173842 - DNA, 20 bp, Artificial Sequence
  Description of Artificial Sequence: Synthetic oligonucleotide
  Target: ATXN1; (-) strand; PAM type: YTN; PAM sequence: CTA
tgagaaggtcatctctcagt

SEQ ID NO: 173843 - DNA, 20 bp, Artificial Sequence
  Description of Artificial Sequence: Synthetic oligonucleotide
  Target: ATXN1; (-) strand; PAM type: YTN; PAM sequence: TTA
ctatgagaaggtcatctctc

SEQ ID NO: 173844 - DNA, 20 bp, Artificial Sequence
  Description of Artificial Sequence: Synthetic oligonucleotide
  Target: ATXN1; (-) strand; PAM type: YTN; PAM sequence: CTT
actatgagaaggtcatctct

SEQ ID NO: 173845 - DNA, 20 bp, Artificial Sequence
  Description of Artificial Sequence: Synthetic oligonucleotide
  Target: ATXN1; (-) strand; PAM type: YTN; PAM sequence: TTA
ggacagccttactatgagaa

SEQ ID NO: 173846 - DNA, 20 bp, Artificial Sequence
  Description of Artificial Sequence: Synthetic oligonucleotide
  Target: ATXN1; (-) strand; PAM type: YTN; PAM sequence: CTT
aggacagccttactatgaga

SEQ ID NO: 173847 - DNA, 20 bp, Artificial Sequence
  Description of Artificial Sequence: Synthetic oligonucleotide
  Target: ATXN1; (-) strand; PAM type: YTN; PAM sequence: TTC
cttaggacagccttactatg

SEQ ID NO: 173848 - DNA, 20 bp, Artificial Sequence
  Description of Artificial Sequence: Synthetic oligonucleotide
  Target: ATXN1; (-) strand; PAM type: YTN; PAM sequence: TTC
aacatattccttaggacagc

SEQ ID NO: 173849 - DNA, 20 bp, Artificial Sequence
  Description of Artificial Sequence: Synthetic oligonucleotide
  Target: ATXN1; (-) strand; PAM type: YTN; PAM sequence: TTT
caacatattccttaggacag

SEQ ID NO: 173850 - DNA, 20 bp, Artificial Sequence
  Description of Artificial Sequence: Synthetic oligonucleotide
  Target: ATXN1; (-) strand; PAM type: YTN; PAM sequence: TTG
aggagcatgtttcaacatat

SEQ ID NO: 173851 - DNA, 20 bp, Artificial Sequence
  Description of Artificial Sequence: Synthetic oligonucleotide
  Target: ATXN1; (-) strand; PAM type: YTN; PAM sequence: TTT
gaggagcatgtttcaacata

SEQ ID NO: 173852 - DNA, 20 bp, Artificial Sequence
  Description of Artificial Sequence: Synthetic oligonucleotide
  Target: ATXN1; (-) strand; PAM type: YTN; PAM sequence: TTT
tgaggagcatgtttcaacat

SEQ ID NO: 173853 - DNA, 20 bp, Artificial Sequence
  Description of Artificial Sequence: Synthetic oligonucleotide
  Target: ATXN1; (-) strand; PAM type: YTN; PAM sequence: CTT
ttgaggagcatgtttcaaca

SEQ ID NO: 173854 - DNA, 20 bp, Artificial Sequence
  Description of Artificial Sequence: Synthetic oligonucleotide
  Target: ATXN1; (-) strand; PAM type: YTN; PAM sequence: TTG
atacagatacttttgaggag

SEQ ID NO: 173855 - DNA, 20 bp, Artificial Sequence
  Description of Artificial Sequence: Synthetic oligonucleotide
  Target: ATXN1; (-) strand; PAM type: YTN; PAM sequence: TTC
agcatccaaaagttgataca

SEQ ID NO: 173856 - DNA, 20 bp, Artificial Sequence
  Description of Artificial Sequence: Synthetic oligonucleotide
  Target: ATXN1; (-) strand; PAM type: YTN; PAM sequence: CTT
cagcatccaaaagttgatac

SEQ ID NO: 173857 - DNA, 20 bp, Artificial Sequence
  Description of Artificial Sequence: Synthetic oligonucleotide
  Target: ATXN1; (-) strand; PAM type: YTN; PAM sequence: TTG
tgagtaaaaccagcttcagc

SEQ ID NO: 173858 - DNA, 20 bp, Artificial Sequence
  Description of Artificial Sequence: Synthetic oligonucleotide
  Target: ATXN1; (-) strand; PAM type: YTN; PAM sequence: CTA
tataagcaaaccagatgttg

SEQ ID NO: 173859 - DNA, 20 bp, Artificial Sequence
  Description of Artificial Sequence: Synthetic oligonucleotide
  Target: ATXN1; (-) strand; PAM type: YTN; PAM sequence: TTG
atatgctatataagcaaacc

SEQ ID NO: 173860 - DNA, 20 bp, Artificial Sequence
  Description of Artificial Sequence: Synthetic oligonucleotide
  Target: ATXN1; (-) strand; PAM type: YTN; PAM sequence: TTG
aattgatatgctatataagc

SEQ ID NO: 173861 - DNA, 20 bp, Artificial Sequence
  Description of Artificial Sequence: Synthetic oligonucleotide
  Target: ATXN1; (-) strand; PAM type: YTN; PAM sequence: CTA
attgaattgatatgctatat

SEQ ID NO: 173862 - DNA, 20 bp, Artificial Sequence
  Description of Artificial Sequence: Synthetic oligonucleotide
  Target: ATXN1; (-) strand; PAM type: YTN; PAM sequence: TTA
atatctaattgaattgatat

SEQ ID NO: 173863 - DNA, 20 bp, Artificial Sequence
  Description of Artificial Sequence: Synthetic oligonucleotide
  Target: ATXN1; (-) strand; PAM type: YTN; PAM sequence: TTT
aatatctaattgaattgata

SEQ ID NO: 173864 - DNA, 20 bp, Artificial Sequence
  Description of Artificial Sequence: Synthetic oligonucleotide
  Target: ATXN1; (-) strand; PAM type: YTN; PAM sequence: TTT
taatatctaattgaattgat

SEQ ID NO: 173865 - DNA, 20 bp, Artificial Sequence
  Description of Artificial Sequence: Synthetic oligonucleotide
  Target: ATXN1; (-) strand; PAM type: YTN; PAM sequence: CTT
ttaatatctaattgaattga

SEQ ID NO: 173866 - DNA, 20 bp, Artificial Sequence
  Description of Artificial Sequence: Synthetic oligonucleotide
  Target: ATXN1; (-) strand; PAM type: YTN; PAM sequence: CTA
aataagtaccttttaatatc

SEQ ID NO: 173867 - DNA, 20 bp, Artificial Sequence
  Description of Artificial Sequence: Synthetic oligonucleotide
  Target: ATXN1; (-) strand; PAM type: YTN; PAM sequence: TTC
accaactaaataagtacctt

SEQ ID NO: 173868 - DNA, 20 bp, Artificial Sequence
  Description of Artificial Sequence: Synthetic oligonucleotide
  Target: ATXN1; (-) strand; PAM type: YTN; PAM sequence: CTT
caccaactaaataagtacct

SEQ ID NO: 173869 - DNA, 20 bp, Artificial Sequence
  Description of Artificial Sequence: Synthetic oligonucleotide
  Target: ATXN1; (-) strand; PAM type: YTN; PAM sequence: TTC
aacttcaccaactaaataag

SEQ ID NO: 173870 - DNA, 20 bp, Artificial Sequence
  Description of Artificial Sequence: Synthetic oligonucleotide
  Target: ATXN1; (-) strand; PAM type: YTN; PAM sequence: TTT
caacttcaccaactaaataa

SEQ ID NO: 173871 - DNA, 20 bp, Artificial Sequence
  Description of Artificial Sequence: Synthetic oligonucleotide
  Target: ATXN1; (-) strand; PAM type: YTN; PAM sequence: CTG
catttcaacttcaccaacta

SEQ ID NO: 173872 - DNA, 20 bp, Artificial Sequence
  Description of Artificial Sequence: Synthetic oligonucleotide
  Target: ATXN1; (-) strand; PAM type: YTN; PAM sequence: CTC
tgcatttcaacttcaccaac

SEQ ID NO: 173873 - DNA, 20 bp, Artificial Sequence
  Description of Artificial Sequence: Synthetic oligonucleotide
  Target: ATXN1; (-) strand; PAM type: YTN; PAM sequence: CTC
tctgcatttcaacttcacca

SEQ ID NO: 173874 - DNA, 20 bp, Artificial Sequence
  Description of Artificial Sequence: Synthetic oligonucleotide
  Target: ATXN1; (-) strand; PAM type: YTN; PAM sequence: CTC
ctctctgcatttcaacttca

SEQ ID NO: 173875 - DNA, 20 bp, Artificial Sequence
  Description of Artificial Sequence: Synthetic oligonucleotide
  Target: ATXN1; (-) strand; PAM type: YTN; PAM sequence: TTA
gtctcctctctgcatttcaa

SEQ ID NO: 173876 - DNA, 20 bp, Artificial Sequence
  Description of Artificial Sequence: Synthetic oligonucleotide
  Target: ATXN1; (-) strand; PAM type: YTN; PAM sequence: TTT
agtctcctctctgcatttca

SEQ ID NO: 173877 - DNA, 20 bp, Artificial Sequence
  Description of Artificial Sequence: Synthetic oligonucleotide
  Target: ATXN1; (-) strand; PAM type: YTN; PAM sequence: TTT
tagtctcctctctgcatttc

SEQ ID NO: 173878 - DNA, 20 bp, Artificial Sequence
  Description of Artificial Sequence: Synthetic oligonucleotide
  Target: ATXN1; (-) strand; PAM type: YTN; PAM sequence: CTG
ggaattttagtctcctctct

SEQ ID NO: 173879 - DNA, 20 bp, Artificial Sequence
  Description of Artificial Sequence: Synthetic oligonucleotide
  Target: ATXN1; (-) strand; PAM type: YTN; PAM sequence: CTG
tgcccctgggaattttagtc

SEQ ID NO: 173880 - DNA, 20 bp, Artificial Sequence
  Description of Artificial Sequence: Synthetic oligonucleotide
  Target: ATXN1; (-) strand; PAM type: YTN; PAM sequence: CTC
cacaactgtgcccctgggaa

SEQ ID NO: 173881 - DNA, 20 bp, Artificial Sequence
  Description of Artificial Sequence: Synthetic oligonucleotide
  Target: ATXN1; (-) strand; PAM type: YTN; PAM sequence: CTA
actccacaactgtgcccctg

SEQ ID NO: 173882 - DNA, 20 bp, Artificial Sequence
  Description of Artificial Sequence: Synthetic oligonucleotide
  Target: ATXN1; (-) strand; PAM type: YTN; PAM sequence: CTA
gcctaactccacaactgtgc

SEQ ID NO: 173883 - DNA, 20 bp, Artificial Sequence
  Description of Artificial Sequence: Synthetic oligonucleotide
  Target: ATXN1; (-) strand; PAM type: YTN; PAM sequence: TTC
tagcctaactccacaactgt

SEQ ID NO: 173884 - DNA, 20 bp, Artificial Sequence
  Description of Artificial Sequence: Synthetic oligonucleotide
  Target: ATXN1; (-) strand; PAM type: YTN; PAM sequence: TTT
ctagcctaactccacaactg

SEQ ID NO: 173885 - DNA, 20 bp, Artificial Sequence
  Description of Artificial Sequence: Synthetic oligonucleotide
  Target: ATXN1; (-) strand; PAM type: YTN; PAM sequence: CTT
tctagcctaactccacaact

SEQ ID NO: 173886 - DNA, 20 bp, Artificial Sequence
  Description of Artificial Sequence: Synthetic oligonucleotide
  Target: ATXN1; (-) strand; PAM type: YTN; PAM sequence: TTA
agagcacagctttctagcct

SEQ ID NO: 173887 - DNA, 20 bp, Artificial Sequence
  Description of Artificial Sequence: Synthetic oligonucleotide
  Target: ATXN1; (-) strand; PAM type: YTN; PAM sequence: TTT
aagagcacagctttctagcc

SEQ ID NO: 173888 - DNA, 20 bp, Artificial Sequence
  Description of Artificial Sequence: Synthetic oligonucleotide
  Target: ATXN1; (-) strand; PAM type: YTN; PAM sequence: CTG
ggatttaagagcacagcttt

SEQ ID NO: 173889 - DNA, 20 bp, Artificial Sequence
  Description of Artificial Sequence: Synthetic oligonucleotide
  Target: ATXN1; (-) strand; PAM type: YTN; PAM sequence: CTG
gcctgggatttaagagcaca

SEQ ID NO: 173890 - DNA, 20 bp, Artificial Sequence
  Description of Artificial Sequence: Synthetic oligonucleotide
  Target: ATXN1; (-) strand; PAM type: YTN; PAM sequence: CTA
ctggcctgggatttaagagc

SEQ ID NO: 173891 - DNA, 20 bp, Artificial Sequence
  Description of Artificial Sequence: Synthetic oligonucleotide
  Target: ATXN1; (-) strand; PAM type: YTN; PAM sequence: CTA
atgatgaaaagctactggcc

SEQ ID NO: 173892 - DNA, 20 bp, Artificial Sequence
  Description of Artificial Sequence: Synthetic oligonucleotide
  Target: ATXN1; (-) strand; PAM type: YTN; PAM sequence: CTA
catagtctaatgatgaaaag

SEQ ID NO: 173893 - DNA, 20 bp, Artificial Sequence
  Description of Artificial Sequence: Synthetic oligonucleotide
  Target: ATXN1; (-) strand; PAM type: YTN; PAM sequence: CTA
gctacatagtctaatgatga

SEQ ID NO: 173894 - DNA, 20 bp, Artificial Sequence
  Description of Artificial Sequence: Synthetic oligonucleotide
  Target: ATXN1; (-) strand; PAM type: YTN; PAM sequence: TTC
tagctacatagtctaatgat

SEQ ID NO: 173895 - DNA, 20 bp, Artificial Sequence
  Description of Artificial Sequence: Synthetic oligonucleotide
  Target: ATXN1; (-) strand; PAM type: YTN; PAM sequence: CTT
ctagctacatagtctaatga

SEQ ID NO: 173896 - DNA, 20 bp, Artificial Sequence
  Description of Artificial Sequence: Synthetic oligonucleotide
  Target: ATXN1; (-) strand; PAM type: YTN; PAM sequence: CTC
caatggggcttctagctaca

SEQ ID NO: 173897 - DNA, 20 bp, Artificial Sequence
  Description of Artificial Sequence: Synthetic oligonucleotide
  Target: ATXN1; (-) strand; PAM type: YTN; PAM sequence: CTC
agaccctccaatggggcttc

SEQ ID NO: 173898 - DNA, 20 bp, Artificial Sequence
  Description of Artificial Sequence: Synthetic oligonucleotide
  Target: ATXN1; (-) strand; PAM type: YTN; PAM sequence: CTG
cagctcagaccctccaatgg

SEQ ID NO: 173899 - DNA, 20 bp, Artificial Sequence
  Description of Artificial Sequence: Synthetic oligonucleotide
  Target: ATXN1; (-) strand; PAM type: YTN; PAM sequence: TTA
accgtgtgtctgcagctcag

SEQ ID NO: 173900 - DNA, 20 bp, Artificial Sequence
  Description of Artificial Sequence: Synthetic oligonucleotide
  Target: ATXN1; (-) strand; PAM type: YTN; PAM sequence: CTG
ggttaaccgtgtgtctgcag

SEQ ID NO: 173901 - DNA, 20 bp, Artificial Sequence
  Description of Artificial Sequence: Synthetic oligonucleotide
  Target: ATXN1; (-) strand; PAM type: YTN; PAM sequence: TTG
cctgggttaaccgtgtgtct

SEQ ID NO: 173902 - DNA, 20 bp, Artificial Sequence
  Description of Artificial Sequence: Synthetic oligonucleotide
  Target: ATXN1; (-) strand; PAM type: YTN; PAM sequence: TTT
gcctgggttaaccgtgtgtc

SEQ ID NO: 173903 - DNA, 20 bp, Artificial Sequence
  Description of Artificial Sequence: Synthetic oligonucleotide
  Target: ATXN1; (-) strand; PAM type: YTN; PAM sequence: CTG
atttgcctgggttaaccgtg

SEQ ID NO: 173904 - DNA, 20 bp, Artificial Sequence
  Description of Artificial Sequence: Synthetic oligonucleotide
  Target: ATXN1; (-) strand; PAM type: YTN; PAM sequence: TTC
acaggccacccagacgtatc

SEQ ID NO: 173905 - DNA, 20 bp, Artificial Sequence
  Description of Artificial Sequence: Synthetic oligonucleotide
  Target: ATXN1; (-) strand; PAM type: YTN; PAM sequence: CTT
cacaggccacccagacgtat

SEQ ID NO: 173906 - DNA, 20 bp, Artificial Sequence
  Description of Artificial Sequence: Synthetic oligonucleotide
  Target: ATXN1; (-) strand; PAM type: YTN; PAM sequence: CTC
cacacaaacagaacatccat

SEQ ID NO: 173907 - DNA, 20 bp, Artificial Sequence
  Description of Artificial Sequence: Synthetic oligonucleotide
  Target: ATXN1; (-) strand; PAM type: YTN; PAM sequence: CTC
atcaaacaggcctccacaca

SEQ ID NO: 173908 - DNA, 20 bp, Artificial Sequence
  Description of Artificial Sequence: Synthetic oligonucleotide
  Target: ATXN1; (-) strand; PAM type: YTN; PAM sequence: TTC
caggaggctcatcaaacagg

SEQ ID NO: 173909 - DNA, 20 bp, Artificial Sequence
  Description of Artificial Sequence: Synthetic oligonucleotide
  Target: ATXN1; (-) strand; PAM type: YTN; PAM sequence: CTT
ccaggaggctcatcaaacag

SEQ ID NO: 173910 - DNA, 20 bp, Artificial Sequence
  Description of Artificial Sequence: Synthetic oligonucleotide
  Target: ATXN1; (-) strand; PAM type: YTN; PAM sequence: TTC
ttccaggaggctcatcaaac

SEQ ID NO: 173911 - DNA, 20 bp, Artificial Sequence
  Description of Artificial Sequence: Synthetic oligonucleotide
  Target: ATXN1; (-) strand; PAM type: YTN; PAM sequence: TTT
cttccaggaggctcatcaaa

SEQ ID NO: 173912 - DNA, 20 bp, Artificial Sequence
  Description of Artificial Sequence: Synthetic oligonucleotide
  Target: ATXN1; (-) strand; PAM type: YTN; PAM sequence: TTT
tcttccaggaggctcatcaa

SEQ ID NO: 173913 - DNA, 20 bp, Artificial Sequence
  Description of Artificial Sequence: Synthetic oligonucleotide
  Target: ATXN1; (-) strand; PAM type: YTN; PAM sequence: TTT
ttcttccaggaggctcatca

SEQ ID NO: 173914 - DNA, 20 bp, Artificial Sequence
  Description of Artificial Sequence: Synthetic oligonucleotide
  Target: ATXN1; (-) strand; PAM type: YTN; PAM sequence: CTT
tttcttccaggaggctcatc

SEQ ID NO: 173915 - DNA, 20 bp, Artificial Sequence
  Description of Artificial Sequence: Synthetic oligonucleotide
  Target: ATXN1; (-) strand; PAM type: YTN; PAM sequence: TTC
tttttcttccaggaggctca

SEQ ID NO: 173916 - DNA, 20 bp, Artificial Sequence
  Description of Artificial Sequence: Synthetic oligonucleotide
  Target: ATXN1; (-) strand; PAM type: YTN; PAM sequence: TTT
ctttttcttccaggaggctc

SEQ ID NO: 173917 - DNA, 20 bp, Artificial Sequence
  Description of Artificial Sequence: Synthetic oligonucleotide
  Target: ATXN1; (-) strand; PAM type: YTN; PAM sequence: CTG
tttctttttcttccaggagg

SEQ ID NO: 173918 - DNA, 20 bp, Artificial Sequence
  Description of Artificial Sequence: Synthetic oligonucleotide
  Target: ATXN1; (-) strand; PAM type: YTN; PAM sequence: CTG
cctgtttctttttcttccag

SEQ ID NO: 173919 - DNA, 20 bp, Artificial Sequence
  Description of Artificial Sequence: Synthetic oligonucleotide
  Target: ATXN1; (-) strand; PAM type: YTN; PAM sequence: CTG
tcactgcctgtttctttttc

SEQ ID NO: 173920 - DNA, 20 bp, Artificial Sequence
  Description of Artificial Sequence: Synthetic oligonucleotide
  Target: ATXN1; (-) strand; PAM type: YTN; PAM sequence: TTC
ctgtcactgcctgtttcttt

SEQ ID NO: 173921 - DNA, 20 bp, Artificial Sequence
  Description of Artificial Sequence: Synthetic oligonucleotide
  Target: ATXN1; (-) strand; PAM type: YTN; PAM sequence: TTT
cctgtcactgcctgtttctt

SEQ ID NO: 173922 - DNA, 20 bp, Artificial Sequence
  Description of Artificial Sequence: Synthetic oligonucleotide
  Target: ATXN1; (-) strand; PAM type: YTN; PAM sequence: CTG
gcaggtttcctgtcactgcc

SEQ ID NO: 173923 - DNA, 20 bp, Artificial Sequence
  Description of Artificial Sequence: Synthetic oligonucleotide
  Target: ATXN1; (-) strand; PAM type: YTN; PAM sequence: TTA
tccctggcaggtttcctgtc

SEQ ID NO: 173924 - DNA, 20 bp, Artificial Sequence
  Description of Artificial Sequence: Synthetic oligonucleotide
  Target: ATXN1; (-) strand; PAM type: YTN; PAM sequence: TTC
agataccacatggcaccatt

SEQ ID NO: 173925 - DNA, 20 bp, Artificial Sequence
  Description of Artificial Sequence: Synthetic oligonucleotide
  Target: ATXN1; (-) strand; PAM type: YTN; PAM sequence: CTT
cagataccacatggcaccat

SEQ ID NO: 173926 - DNA, 20 bp, Artificial Sequence
  Description of Artificial Sequence: Synthetic oligonucleotide
  Target: ATXN1; (-) strand; PAM type: YTN; PAM sequence: CTG
gacttcagataccacatggc

SEQ ID NO: 173927 - DNA, 20 bp, Artificial Sequence
  Description of Artificial Sequence: Synthetic oligonucleotide
  Target: ATXN1; (-) strand; PAM type: YTN; PAM sequence: TTA
ctggacttcagataccacat

SEQ ID NO: 173928 - DNA, 20 bp, Artificial Sequence
  Description of Artificial Sequence: Synthetic oligonucleotide
  Target: ATXN1; (-) strand; PAM type: YTN; PAM sequence: TTG
aagaattactggacttcaga

SEQ ID NO: 173929 - DNA, 20 bp, Artificial Sequence
  Description of Artificial Sequence: Synthetic oligonucleotide
  Target: ATXN1; (-) strand; PAM type: YTN; PAM sequence: CTA
agaaggttgaagaattactg

SEQ ID NO: 173930 - DNA, 20 bp, Artificial Sequence
  Description of Artificial Sequence: Synthetic oligonucleotide
  Target: ATXN1; (-) strand; PAM type: YTN; PAM sequence: CTG
ctaagaaggttgaagaatta

SEQ ID NO: 173931 - DNA, 20 bp, Artificial Sequence
  Description of Artificial Sequence: Synthetic oligonucleotide
  Target: ATXN1; (-) strand; PAM type: YTN; PAM sequence: CTC
acacagcaagctgctaagaa

SEQ ID NO: 173932 - DNA, 20 bp, Artificial Sequence
  Description of Artificial Sequence: Synthetic oligonucleotide
  Target: ATXN1; (-) strand; PAM type: YTN; PAM sequence: TTC
ctcacacagcaagctgctaa

SEQ ID NO: 173933 - DNA, 20 bp, Artificial Sequence
  Description of Artificial Sequence: Synthetic oligonucleotide
  Target: ATXN1; (-) strand; PAM type: YTN; PAM sequence: CTT
cctcacacagcaagctgcta

SEQ ID NO: 173934 - DNA, 20 bp, Artificial Sequence
  Description of Artificial Sequence: Synthetic oligonucleotide
  Target: ATXN1; (-) strand; PAM type: YTN; PAM sequence: TTC
cttcctcacacagcaagctg

SEQ ID NO: 173935 - DNA, 20 bp, Artificial Sequence
  Description of Artificial Sequence: Synthetic oligonucleotide
  Target: ATXN1; (-) strand; PAM type: YTN; PAM sequence: CTG
ggtcagttccttcctcacac

SEQ ID NO: 173936 - DNA, 20 bp, Artificial Sequence
  Description of Artificial Sequence: Synthetic oligonucleotide
  Target: ATXN1; (-) strand; PAM type: YTN; PAM sequence: CTC
tgggtcagttccttcctcac

SEQ ID NO: 173937 - DNA, 20 bp, Artificial Sequence
  Description of Artificial Sequence: Synthetic oligonucleotide
  Target: ATXN1; (-) strand; PAM type: YTN; PAM sequence: TTA
acccaaccactctgggtcag

SEQ ID NO: 173938 - DNA, 20 bp, Artificial Sequence
  Description of Artificial Sequence: Synthetic oligonucleotide
  Target: ATXN1; (-) strand; PAM type: YTN; PAM sequence: CTT
aacccaaccactctgggtca

SEQ ID NO: 173939 - DNA, 20 bp, Artificial Sequence
  Description of Artificial Sequence: Synthetic oligonucleotide
  Target: ATXN1; (-) strand; PAM type: YTN; PAM sequence: CTA
gcagatgcaccttaacccaa

SEQ ID NO: 173940 - DNA, 20 bp, Artificial Sequence
  Description of Artificial Sequence: Synthetic oligonucleotide
  Target: ATXN1; (-) strand; PAM type: YTN; PAM sequence: TTG
acacccccatgcccccaatc

SEQ ID NO: 173941 - DNA, 20 bp, Artificial Sequence
  Description of Artificial Sequence: Synthetic oligonucleotide
  Target: ATXN1; (-) strand; PAM type: YTN; PAM sequence: TTG
ttgacacccccatgccccca

SEQ ID NO: 173942 - DNA, 20 bp, Artificial Sequence
  Description of Artificial Sequence: Synthetic oligonucleotide
  Target: ATXN1; (-) strand; PAM type: YTN; PAM sequence: CTG
ttgttgacacccccatgccc

SEQ ID NO: 173943 - DNA, 20 bp, Artificial Sequence
  Description of Artificial Sequence: Synthetic oligonucleotide
  Target: ATXN1; (-) strand; PAM type: YTN; PAM sequence: TTA
tatcccctgttgttgacacc

SEQ ID NO: 173944 - DNA, 20 bp, Artificial Sequence
  Description of Artificial Sequence: Synthetic oligonucleotide
  Target: ATXN1; (-) strand; PAM type: YTN; PAM sequence: CTA
atgttatatcccctgttgtt

SEQ ID NO: 173945 - DNA, 20 bp, Artificial Sequence
  Description of Artificial Sequence: Synthetic oligonucleotide
  Target: ATXN1; (-) strand; PAM type: YTN; PAM sequence: TTC
ctaatgttatatcccctgtt

SEQ ID NO: 173946 - DNA, 20 bp, Artificial Sequence
  Description of Artificial Sequence: Synthetic oligonucleotide
  Target: ATXN1; (-) strand; PAM type: YTN; PAM sequence: TTG
gtagatattcctaatgttat

SEQ ID NO: 173947 - DNA, 20 bp, Artificial Sequence
  Description of Artificial Sequence: Synthetic oligonucleotide
  Target: ATXN1; (-) strand; PAM type: YTN; PAM sequence: CTG
ggttggtagatattcctaat

SEQ ID NO: 173948 - DNA, 20 bp, Artificial Sequence
  Description of Artificial Sequence: Synthetic oligonucleotide
  Target: ATXN1; (-) strand; PAM type: YTN; PAM sequence: CTC
cccaaggggctgggttggta

SEQ ID NO: 173949 - DNA, 20 bp, Artificial Sequence
  Description of Artificial Sequence: Synthetic oligonucleotide
  Target: ATXN1; (-) strand; PAM type: YTN; PAM sequence: CTG
cacccctccccaaggggctg

SEQ ID NO: 173950 - DNA, 20 bp, Artificial Sequence
  Description of Artificial Sequence: Synthetic oligonucleotide
  Target: ATXN1; (-) strand; PAM type: YTN; PAM sequence: TTC
ctgcacccctccccaagggg

SEQ ID NO: 173951 - DNA, 20 bp, Artificial Sequence
  Description of Artificial Sequence: Synthetic oligonucleotide
  Target: ATXN1; (-) strand; PAM type: YTN; PAM sequence: CTT
cctgcacccctccccaaggg

SEQ ID NO: 173952 - DNA, 20 bp, Artificial Sequence
  Description of Artificial Sequence: Synthetic oligonucleotide
  Target: ATXN1; (-) strand; PAM type: YTN; PAM sequence: CTC
ttcctgcacccctccccaag

SEQ ID NO: 173953 - DNA, 20 bp, Artificial Sequence
  Description of Artificial Sequence: Synthetic oligonucleotide
  Target: ATXN1; (-) strand; PAM type: YTN; PAM sequence: TTA
tggccccacggtctcttcct

SEQ ID NO: 173954 - DNA, 20 bp, Artificial Sequence
  Description of Artificial Sequence: Synthetic oligonucleotide
  Target: ATXN1; (-) strand; PAM type: YTN; PAM sequence: TTT
atggccccacggtctcttcc

SEQ ID NO: 173955 - DNA, 20 bp, Artificial Sequence
  Description of Artificial Sequence: Synthetic oligonucleotide
  Target: ATXN1; (-) strand; PAM type: YTN; PAM sequence: CTT
tatggccccacggtctcttc

SEQ ID NO: 173956 - DNA, 20 bp, Artificial Sequence
  Description of Artificial Sequence: Synthetic oligonucleotide
  Target: ATXN1; (-) strand; PAM type: YTN; PAM sequence: TTC
tttatggccccacggtctct

SEQ ID NO: 173957 - DNA, 20 bp, Artificial Sequence
  Description of Artificial Sequence: Synthetic oligonucleotide
  Target: ATXN1; (-) strand; PAM type: YTN; PAM sequence: CTC
aggttctttatggccccacg

SEQ ID NO: 173958 - DNA, 20 bp, Artificial Sequence
  Description of Artificial Sequence: Synthetic oligonucleotide
  Target: ATXN1; (-) strand; PAM type: YTN; PAM sequence: CTG
agaccacaaaacatggtggc

SEQ ID NO: 173959 - DNA, 20 bp, Artificial Sequence
  Description of Artificial Sequence: Synthetic oligonucleotide
  Target: ATXN1; (-) strand; PAM type: YTN; PAM sequence: TTC
tgagaccacaaaacatggtg

SEQ ID NO: 173960 - DNA, 20 bp, Artificial Sequence
  Description of Artificial Sequence: Synthetic oligonucleotide
  Target: ATXN1; (-) strand; PAM type: YTN; PAM sequence: CTT
ctgagaccacaaaacatggt

SEQ ID NO: 173961 - DNA, 20 bp, Artificial Sequence
  Description of Artificial Sequence: Synthetic oligonucleotide
  Target: ATXN1; (-) strand; PAM type: YTN; PAM sequence: CTC
ttctgagaccacaaaacatg

SEQ ID NO: 173962 - DNA, 20 bp, Artificial Sequence
  Description of Artificial Sequence: Synthetic oligonucleotide
  Target: ATXN1; (-) strand; PAM type: YTN; PAM sequence: TTC
tcttctgagaccacaaaaca

SEQ ID NO: 173963 - DNA, 20 bp, Artificial Sequence
  Description of Artificial Sequence: Synthetic oligonucleotide
  Target: ATXN1; (-) strand; PAM type: YTN; PAM sequence: CTG
agtggtgaaagttctcttct

SEQ ID NO: 173964 - DNA, 20 bp, Artificial Sequence
  Description of Artificial Sequence: Synthetic oligonucleotide
  Target: ATXN1; (-) strand; PAM type: YTN; PAM sequence: TTC
ctgagtggtgaaagttctct

SEQ ID NO: 173965 - DNA, 20 bp, Artificial Sequence
  Description of Artificial Sequence: Synthetic oligonucleotide
  Target: ATXN1; (-) strand; PAM type: YTN; PAM sequence: CTA
ttcctgagtggtgaaagttc

SEQ ID NO: 173966 - DNA, 20 bp, Artificial Sequence
  Description of Artificial Sequence: Synthetic oligonucleotide
  Target: ATXN1; (-) strand; PAM type: YTN; PAM sequence: CTC
tattcctgagtggtgaaagt

SEQ ID NO: 173967 - DNA, 20 bp, Artificial Sequence
  Description of Artificial Sequence: Synthetic oligonucleotide
  Target: ATXN1; (-) strand; PAM type: YTN; PAM sequence: CTC
tctattcctgagtggtgaaa

SEQ ID NO: 173968 - DNA, 20 bp, Artificial Sequence
  Description of Artificial Sequence: Synthetic oligonucleotide
  Target: ATXN1; (-) strand; PAM type: YTN; PAM sequence: TTG
ccaagtacagcagggatatg

SEQ ID NO: 173969 - DNA, 20 bp, Artificial Sequence
  Description of Artificial Sequence: Synthetic oligonucleotide
  Target: ATXN1; (-) strand; PAM type: YTN; PAM sequence: TTG
ttgccaagtacagcagggat

SEQ ID NO: 173970 - DNA, 20 bp, Artificial Sequence
  Description of Artificial Sequence: Synthetic oligonucleotide
  Target: ATXN1; (-) strand; PAM type: YTN; PAM sequence: TTT
gttgccaagtacagcaggga

SEQ ID NO: 173971 - DNA, 20 bp, Artificial Sequence
  Description of Artificial Sequence: Synthetic oligonucleotide
  Target: ATXN1; (-) strand; PAM type: YTN; PAM sequence: TTT
tgttgccaagtacagcaggg

SEQ ID NO: 173972 - DNA, 20 bp, Artificial Sequence
  Description of Artificial Sequence: Synthetic oligonucleotide
  Target: ATXN1; (-) strand; PAM type: YTN; PAM sequence: TTA
ttttgttgccaagtacagca

SEQ ID NO: 173973 - DNA, 20 bp, Artificial Sequence
  Description of Artificial Sequence: Synthetic oligonucleotide
  Target: ATXN1; (-) strand; PAM type: YTN; PAM sequence: TTT
attttgttgccaagtacagc

SEQ ID NO: 173974 - DNA, 20 bp, Artificial Sequence
  Description of Artificial Sequence: Synthetic oligonucleotide
  Target: ATXN1; (-) strand; PAM type: YTN; PAM sequence: TTT
tattttgttgccaagtacag

SEQ ID NO: 173975 - DNA, 20 bp, Artificial Sequence
  Description of Artificial Sequence: Synthetic oligonucleotide
  Target: ATXN1; (-) strand; PAM type: YTN; PAM sequence: CTT
ttattttgttgccaagtaca

SEQ ID NO: 173976 - DNA, 20 bp, Artificial Sequence
  Description of Artificial Sequence: Synthetic oligonucleotide
  Target: ATXN1; (-) strand; PAM type: YTN; PAM sequence: TTC
ttttattttgttgccaagta

SEQ ID NO: 173977 - DNA, 20 bp, Artificial Sequence
  Description of Artificial Sequence: Synthetic oligonucleotide
  Target: ATXN1; (-) strand; PAM type: YTN; PAM sequence: CTT
cttttattttgttgccaagt

SEQ ID NO: 173978 - DNA, 20 bp, Artificial Sequence
  Description of Artificial Sequence: Synthetic oligonucleotide
  Target: ATXN1; (-) strand; PAM type: YTN; PAM sequence: TTC
ttcttttattttgttgccaa

SEQ ID NO: 173979 - DNA, 20 bp, Artificial Sequence
  Description of Artificial Sequence: Synthetic oligonucleotide
  Target: ATXN1; (-) strand; PAM type: YTN; PAM sequence: TTG
atgatcggttcttcttttat

SEQ ID NO: 173980 - DNA, 20 bp, Artificial Sequence
  Description of Artificial Sequence: Synthetic oligonucleotide
  Target: ATXN1; (-) strand; PAM type: YTN; PAM sequence: CTG
tgatgtcatgagggttgatg

SEQ ID NO: 173981 - DNA, 20 bp, Artificial Sequence
  Description of Artificial Sequence: Synthetic oligonucleotide
  Target: ATXN1; (-) strand; PAM type: YTN; PAM sequence: CTG
ccctgtgatgtcatgagggt

SEQ ID NO: 173982 - DNA, 20 bp, Artificial Sequence
  Description of Artificial Sequence: Synthetic oligonucleotide
  Target: ATXN1; (-) strand; PAM type: YTN; PAM sequence: TTC
tgccctgtgatgtcatgagg

SEQ ID NO: 173983 - DNA, 20 bp, Artificial Sequence
  Description of Artificial Sequence: Synthetic oligonucleotide
  Target: ATXN1; (-) strand; PAM type: YTN; PAM sequence: TTT
ctgccctgtgatgtcatgag

SEQ ID NO: 173984 - DNA, 20 bp, Artificial Sequence
  Description of Artificial Sequence: Synthetic oligonucleotide
  Target: ATXN1; (-) strand; PAM type: YTN; PAM sequence: CTC
ccgtttctgccctgtgatgt

SEQ ID NO: 173985 - DNA, 20 bp, Artificial Sequence
  Description of Artificial Sequence: Synthetic oligonucleotide
  Target: ATXN1; (-) strand; PAM type: YTN; PAM sequence: TTA
tcaactcccgtttctgccct

SEQ ID NO: 173986 - DNA, 20 bp, Artificial Sequence
  Description of Artificial Sequence: Synthetic oligonucleotide
  Target: ATXN1; (-) strand; PAM type: YTN; PAM sequence: TTA
ttatcaactcccgtttctgc

SEQ ID NO: 173987 - DNA, 20 bp, Artificial Sequence
  Description of Artificial Sequence: Synthetic oligonucleotide
  Target: ATXN1; (-) strand; PAM type: YTN; PAM sequence: CTC
gaatgttattatcaactccc

SEQ ID NO: 173988 - DNA, 20 bp, Artificial Sequence
  Description of Artificial Sequence: Synthetic oligonucleotide
  Target: ATXN1; (-) strand; PAM type: YTN; PAM sequence: TTC
tcgaatgttattatcaactc

SEQ ID NO: 173989 - DNA, 20 bp, Artificial Sequence
  Description of Artificial Sequence: Synthetic oligonucleotide
  Target: ATXN1; (-) strand; PAM type: YTN; PAM sequence: CTT
ctcgaatgttattatcaact

SEQ ID NO: 173990 - DNA, 20 bp, Artificial Sequence
  Description of Artificial Sequence: Synthetic oligonucleotide
  Target: ATXN1; (-) strand; PAM type: YTN; PAM sequence: TTC
acaaggccccagaccccctt

SEQ ID NO: 173991 - DNA, 20 bp, Artificial Sequence
  Description of Artificial Sequence: Synthetic oligonucleotide
  Target: ATXN1; (-) strand; PAM type: YTN; PAM sequence: TTT
cacaaggccccagaccccct

SEQ ID NO: 173992 - DNA, 20 bp, Artificial Sequence
  Description of Artificial Sequence: Synthetic oligonucleotide
  Target: ATXN1; (-) strand; PAM type: YTN; PAM sequence: CTG
agatttcacaaggccccaga

SEQ ID NO: 173993 - DNA, 20 bp, Artificial Sequence
  Description of Artificial Sequence: Synthetic oligonucleotide
  Target: ATXN1; (-) strand; PAM type: YTN; PAM sequence: TTA
aaggagacacgaagtaactg

SEQ ID NO: 173994 - DNA, 20 bp, Artificial Sequence
  Description of Artificial Sequence: Synthetic oligonucleotide
  Target: ATXN1; (-) strand; PAM type: YTN; PAM sequence: TTT
aaaggagacacgaagtaact

SEQ ID NO: 173995 - DNA, 20 bp, Artificial Sequence
  Description of Artificial Sequence: Synthetic oligonucleotide
  Target: ATXN1; (-) strand; PAM type: YTN; PAM sequence: TTA
tttaaaggagacacgaagta

SEQ ID NO: 173996 - DNA, 20 bp, Artificial Sequence
  Description of Artificial Sequence: Synthetic oligonucleotide
  Target: ATXN1; (-) strand; PAM type: YTN; PAM sequence: TTT
atttaaaggagacacgaagt

SEQ ID NO: 173997 - DNA, 20 bp, Artificial Sequence
  Description of Artificial Sequence: Synthetic oligonucleotide
  Target: ATXN1; (-) strand; PAM type: YTN; PAM sequence: CTA
tagtttatttaaaggagaca

SEQ ID NO: 173998 - DNA, 20 bp, Artificial Sequence
  Description of Artificial Sequence: Synthetic oligonucleotide
  Target: ATXN1; (-) strand; PAM type: YTN; PAM sequence: TTA
aaataactatagtttattta

SEQ ID NO: 173999 - DNA, 20 bp, Artificial Sequence
  Description of Artificial Sequence: Synthetic oligonucleotide
  Target: ATXN1; (-) strand; PAM type: YTN; PAM sequence: TTT
aaaataactatagtttattt

SEQ ID NO: 174000 - DNA, 20 bp, Artificial Sequence
  Description of Artificial Sequence: Synthetic oligonucleotide
  Target: ATXN1; (-) strand; PAM type: YTN; PAM sequence: CTA
tttaaaataactatagttta

SEQ ID NO: 174001 - DNA, 20 bp, Artificial Sequence
  Description of Artificial Sequence: Synthetic oligonucleotide
  Target: ATXN1; (-) strand; PAM type: YTN; PAM sequence: TTG
gtgaggccactatttaaaat

SEQ ID NO: 174002 - DNA, 20 bp, Artificial Sequence
  Description of Artificial Sequence: Synthetic oligonucleotide
  Target: ATXN1; (-) strand; PAM type: YTN; PAM sequence: TTT
ggtgaggccactatttaaaa

SEQ ID NO: 174003 - DNA, 20 bp, Artificial Sequence
  Description of Artificial Sequence: Synthetic oligonucleotide
  Target: ATXN1; (-) strand; PAM type: YTN; PAM sequence: CTT
tggtgaggccactatttaaa

SEQ ID NO: 174004 - DNA, 20 bp, Artificial Sequence
  Description of Artificial Sequence: Synthetic oligonucleotide
  Target: ATXN1; (-) strand; PAM type: YTN; PAM sequence: TTA
ataatggaatggatatagaa

SEQ ID NO: 174005 - DNA, 20 bp, Artificial Sequence
  Description of Artificial Sequence: Synthetic oligonucleotide
  Target: ATXN1; (-) strand; PAM type: YTN; PAM sequence: CTT
aataatggaatggatataga

SEQ ID NO: 174006 - DNA, 20 bp, Artificial Sequence
  Description of Artificial Sequence: Synthetic oligonucleotide
  Target: ATXN1; (-) strand; PAM type: YTN; PAM sequence: TTA
acatacttaataatggaatg

SEQ ID NO: 174007 - DNA, 20 bp, Artificial Sequence
  Description of Artificial Sequence: Synthetic oligonucleotide
  Target: ATXN1; (-) strand; PAM type: YTN; PAM sequence: TTT
aacatacttaataatggaat

SEQ ID NO: 174008 - DNA, 20 bp, Artificial Sequence
  Description of Artificial Sequence: Synthetic oligonucleotide
  Target: ATXN1; (-) strand; PAM type: YTN; PAM sequence: CTT
taacatacttaataatggaa

SEQ ID NO: 174009 - DNA, 20 bp, Artificial Sequence
  Description of Artificial Sequence: Synthetic oligonucleotide
  Target: ATXN1; (-) strand; PAM type: YTN; PAM sequence: TTC
tttaacatacttaataatgg

SEQ ID NO: 174010 - DNA, 20 bp, Artificial Sequence
  Description of Artificial Sequence: Synthetic oligonucleotide
  Target: ATXN1; (-) strand; PAM type: YTN; PAM sequence: CTT
ctttaacatacttaataatg

SEQ ID NO: 174011 - DNA, 20 bp, Artificial Sequence
  Description of Artificial Sequence: Synthetic oligonucleotide
  Target: ATXN1; (-) strand; PAM type: YTN; PAM sequence: TTA
agacaatacttctttaacat

SEQ ID NO: 174012 - DNA, 20 bp, Artificial Sequence
  Description of Artificial Sequence: Synthetic oligonucleotide
  Target: ATXN1; (-) strand; PAM type: YTN; PAM sequence: TTT
aagacaatacttctttaaca

SEQ ID NO: 174013 - DNA, 20 bp, Artificial Sequence
  Description of Artificial Sequence: Synthetic oligonucleotide
  Target: ATXN1; (-) strand; PAM type: YTN; PAM sequence: TTG
atgaaggaaagtatttaaga

SEQ ID NO: 174014 - DNA, 20 bp, Artificial Sequence
  Description of Artificial Sequence: Synthetic oligonucleotide
  Target: ATXN1; (-) strand; PAM type: YTN; PAM sequence: CTT
gatgaaggaaagtatttaag

SEQ ID NO: 174015 - DNA, 20 bp, Artificial Sequence
  Description of Artificial Sequence: Synthetic oligonucleotide
  Target: ATXN1; (-) strand; PAM type: YTN; PAM sequence: CTC
acttgatgaaggaaagtatt

SEQ ID NO: 174016 - DNA, 20 bp, Artificial Sequence
  Description of Artificial Sequence: Synthetic oligonucleotide
  Target: ATXN1; (-) strand; PAM type: YTN; PAM sequence: TTC
tcacttgatgaaggaaagta

SEQ ID NO: 174017 - DNA, 20 bp, Artificial Sequence
  Description of Artificial Sequence: Synthetic oligonucleotide
  Target: ATXN1; (-) strand; PAM type: YTN; PAM sequence: TTC
cagggttctcacttgatgaa

SEQ ID NO: 174018 - DNA, 20 bp, Artificial Sequence
  Description of Artificial Sequence: Synthetic oligonucleotide
  Target: ATXN1; (-) strand; PAM type: YTN; PAM sequence: CTT
ccagggttctcacttgatga

SEQ ID NO: 174019 - DNA, 20 bp, Artificial Sequence
  Description of Artificial Sequence: Synthetic oligonucleotide
  Target: ATXN1; (-) strand; PAM type: YTN; PAM sequence: TTC
ttccagggttctcacttgat

SEQ ID NO: 174020 - DNA, 20 bp, Artificial Sequence
  Description of Artificial Sequence: Synthetic oligonucleotide
  Target: ATXN1; (-) strand; PAM type: YTN; PAM sequence: CTT
cttccagggttctcacttga

SEQ ID NO: 174021 - DNA, 20 bp, Artificial Sequence
  Description of Artificial Sequence: Synthetic oligonucleotide
  Target: ATXN1; (-) strand; PAM type: YTN; PAM sequence: CTC
atcttcttccagggttctca

SEQ ID NO: 174022 - DNA, 20 bp, Artificial Sequence
  Description of Artificial Sequence: Synthetic oligonucleotide
  Target: ATXN1; (-) strand; PAM type: YTN; PAM sequence: TTC
tcatcttcttccagggttct

SEQ ID NO: 174023 - DNA, 20 bp, Artificial Sequence
  Description of Artificial Sequence: Synthetic oligonucleotide
  Target: ATXN1; (-) strand; PAM type: YTN; PAM sequence: CTC
attctcatcttcttccaggg

SEQ ID NO: 174024 - DNA, 20 bp, Artificial Sequence
  Description of Artificial Sequence: Synthetic oligonucleotide
  Target: ATXN1; (-) strand; PAM type: YTN; PAM sequence: TTC
ctcattctcatcttcttcca

SEQ ID NO: 174025 - DNA, 20 bp, Artificial Sequence
  Description of Artificial Sequence: Synthetic oligonucleotide
  Target: ATXN1; (-) strand; PAM type: YTN; PAM sequence: CTC
atcatgttcctcattctcat

SEQ ID NO: 174026 - DNA, 20 bp, Artificial Sequence
  Description of Artificial Sequence: Synthetic oligonucleotide
  Target: ATXN1; (-) strand; PAM type: YTN; PAM sequence: TTA
ccatcctcatcatgttcctc

SEQ ID NO: 174027 - DNA, 20 bp, Artificial Sequence
  Description of Artificial Sequence: Synthetic oligonucleotide
  Target: ATXN1; (-) strand; PAM type: YTN; PAM sequence: TTT
accatcctcatcatgttcct

SEQ ID NO: 174028 - DNA, 20 bp, Artificial Sequence
  Description of Artificial Sequence: Synthetic oligonucleotide
  Target: ATXN1; (-) strand; PAM type: YTN; PAM sequence: TTT
taccatcctcatcatgttcc

SEQ ID NO: 174029 - DNA, 20 bp, Artificial Sequence
  Description of Artificial Sequence: Synthetic oligonucleotide
  Target: ATXN1; (-) strand; PAM type: YTN; PAM sequence: TTT
ttaccatcctcatcatgttc

SEQ ID NO: 174030 - DNA, 20 bp, Artificial Sequence
  Description of Artificial Sequence: Synthetic oligonucleotide
  Target: ATXN1; (-) strand; PAM type: YTN; PAM sequence: TTT
tttaccatcctcatcatgtt

SEQ ID NO: 174031 - DNA, 20 bp, Artificial Sequence
  Description of Artificial Sequence: Synthetic oligonucleotide
  Target: ATXN1; (-) strand; PAM type: YTN; PAM sequence: TTT
ttttaccatcctcatcatgt

SEQ ID NO: 174032 - DNA, 20 bp, Artificial Sequence
  Description of Artificial Sequence: Synthetic oligonucleotide
  Target: ATXN1; (-) strand; PAM type: YTN; PAM sequence: TTT
tttttaccatcctcatcatg

SEQ ID NO: 174033 - DNA, 20 bp, Artificial Sequence
  Description of Artificial Sequence: Synthetic oligonucleotide
  Target: ATXN1; (-) strand; PAM type: YTN; PAM sequence: TTT
ttttttaccatcctcatcat

SEQ ID NO: 174034 - DNA, 20 bp, Artificial Sequence
  Description of Artificial Sequence: Synthetic oligonucleotide
  Target: ATXN1; (-) strand; PAM type: YTN; PAM sequence: TTT
tttttttaccatcctcatca

SEQ ID NO: 174035 - DNA, 20 bp, Artificial Sequence
  Description of Artificial Sequence: Synthetic oligonucleotide
  Target: ATXN1; (-) strand; PAM type: YTN; PAM sequence: TTT
ttttttttaccatcctcatc

SEQ ID NO: 174036 - DNA, 20 bp, Artificial Sequence
  Description of Artificial Sequence: Synthetic oligonucleotide
  Target: ATXN1; (-) strand; PAM type: YTN; PAM sequence: TTT
tttttttttaccatcctcat

SEQ ID NO: 174037 - DNA, 20 bp, Artificial Sequence
  Description of Artificial Sequence: Synthetic oligonucleotide
  Target: ATXN1; (-) strand; PAM type: YTN; PAM sequence: TTT
ttttttttttaccatcctca

SEQ ID NO: 174038 - DNA, 20 bp, Artificial Sequence
  Description of Artificial Sequence: Synthetic oligonucleotide
  Target: ATXN1; (-) strand; PAM type: YTN; PAM sequence: TTT
tttttttttttaccatcctc

SEQ ID NO: 174039 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttaccatcct

SEQ ID NO: 174040 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttaccatcc

SEQ ID NO: 174041 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttaccatc

SEQ ID NO: 174042 - DNA, 20 bp, Artificial Sequence
  Description of Artificial Sequence: Synthetic oligonucleotide
  Target: ATXN1; (-) strand; PAM type: YTN; PAM sequence: TTA
acttttttttttttttttac

SEQ ID NO: 174043 - DNA, 20 bp, Artificial Sequence
  Description of Artificial Sequence: Synthetic oligonucleotide
  Target: ATXN1; (-) strand; PAM type: YTN; PAM sequence: CTG
ttaacttttttttttttttt

SEQ ID NO: 174044 - DNA, 20 bp, Artificial Sequence
  Description of Artificial Sequence: Synthetic oligonucleotide
  Target: ATXN1; (-) strand; PAM type: YTN; PAM sequence: TTA
ctgttaactttttttttttt

SEQ ID NO: 174045 - DNA, 20 bp, Artificial Sequence
  Description of Artificial Sequence: Synthetic oligonucleotide
  Target: ATXN1; (-) strand; PAM type: YTN; PAM sequence: CTG
agttactgttaacttttttt

SEQ ID NO: 174046 - DNA, 20 bp, Artificial Sequence
  Description of Artificial Sequence: Synthetic oligonucleotide
  Target: ATXN1; (-) strand; PAM type: YTN; PAM sequence: CTG
tcagatgataggcctgagtt

SEQ ID NO: 174047 - DNA, 20 bp, Artificial Sequence
  Description of Artificial Sequence: Synthetic oligonucleotide
  Target: ATXN1; (-) strand; PAM type: YTN; PAM sequence: TTA
gtgcctgtcagatgataggc

SEQ ID NO: 174048 - DNA, 20 bp, Artificial Sequence
  Description of Artificial Sequence: Synthetic oligonucleotide
  Target: ATXN1; (-) strand; PAM type: YTN; PAM sequence: CTT
agtgcctgtcagatgatagg

SEQ ID NO: 174049 - DNA, 20 bp, Artificial Sequence
  Description of Artificial Sequence: Synthetic oligonucleotide
  Target: ATXN1; (-) strand; PAM type: YTN; PAM sequence: TTG
taagtgacaaaatacgtgat

SEQ ID NO: 174050 - DNA, 20 bp, Artificial Sequence
  Description of Artificial Sequence: Synthetic oligonucleotide
  Target: ATXN1; (-) strand; PAM type: YTN; PAM sequence: CTG
aaaaggttgtaagtgacaaa

SEQ ID NO: 174051 - DNA, 20 bp, Artificial Sequence
  Description of Artificial Sequence: Synthetic oligonucleotide
  Target: ATXN1; (-) strand; PAM type: YTN; PAM sequence: TTA
aaaccctgaaaaggttgtaa

SEQ ID NO: 174052 - DNA, 20 bp, Artificial Sequence
  Description of Artificial Sequence: Synthetic oligonucleotide
  Target: ATXN1; (-) strand; PAM type: YTN; PAM sequence: TTA
tcattaaaaccctgaaaagg

SEQ ID NO: 174053 - DNA, 20 bp, Artificial Sequence
  Description of Artificial Sequence: Synthetic oligonucleotide
  Target: ATXN1; (-) strand; PAM type: YTN; PAM sequence: CTT
atcattaaaaccctgaaaag

SEQ ID NO: 174054 - DNA, 20 bp, Artificial Sequence
  Description of Artificial Sequence: Synthetic oligonucleotide
  Target: ATXN1; (-) strand; PAM type: YTN; PAM sequence: TTC
cttatcattaaaaccctgaa

SEQ ID NO: 174055 - DNA, 20 bp, Artificial Sequence
  Description of Artificial Sequence: Synthetic oligonucleotide
  Target: ATXN1; (-) strand; PAM type: YTN; PAM sequence: TTT
ccttatcattaaaaccctga

SEQ ID NO: 174056 - DNA, 20 bp, Artificial Sequence
  Description of Artificial Sequence: Synthetic oligonucleotide
  Target: ATXN1; (-) strand; PAM type: YTN; PAM sequence: CTT
tccttatcattaaaaccctg

SEQ ID NO: 174057 - DNA, 20 bp, Artificial Sequence
  Description of Artificial Sequence: Synthetic oligonucleotide
  Target: ATXN1; (-) strand; PAM type: YTN; PAM sequence: TTA
ctttccttatcattaaaacc

SEQ ID NO: 174058 - DNA, 20 bp, Artificial Sequence
  Description of Artificial Sequence: Synthetic oligonucleotide
  Target: ATXN1; (-) strand; PAM type: YTN; PAM sequence: CTT
actttccttatcattaaaac

SEQ ID NO: 174059 - DNA, 20 bp, Artificial Sequence
  Description of Artificial Sequence: Synthetic oligonucleotide
  Target: ATXN1; (-) strand; PAM type: YTN; PAM sequence: TTA
tccttactttccttatcatt

SEQ ID NO: 174060 - DNA, 20 bp, Artificial Sequence
  Description of Artificial Sequence: Synthetic oligonucleotide
  Target: ATXN1; (-) strand; PAM type: YTN; PAM sequence: TTA
accacattatccttactttc

SEQ ID NO: 174061 - DNA, 20 bp, Artificial Sequence
  Description of Artificial Sequence: Synthetic oligonucleotide
  Target: ATXN1; (-) strand; PAM type: YTN; PAM sequence: TTT
aaccacattatccttacttt

SEQ ID NO: 174062 - DNA, 20 bp, Artificial Sequence
  Description of Artificial Sequence: Synthetic oligonucleotide
  Target: ATXN1; (-) strand; PAM type: YTN; PAM sequence: TTA
tttaaccacattatccttac

SEQ ID NO: 174063 - DNA, 20 bp, Artificial Sequence
  Description of Artificial Sequence: Synthetic oligonucleotide
  Target: ATXN1; (-) strand; PAM type: YTN; PAM sequence: TTG
cataagttatttaaccacat

SEQ ID NO: 174064 - DNA, 20 bp, Artificial Sequence
  Description of Artificial Sequence: Synthetic oligonucleotide
  Target: ATXN1; (-) strand; PAM type: YTN; PAM sequence: TTT
gcataagttatttaaccaca

SEQ ID NO: 174065 - DNA, 20 bp, Artificial Sequence
  Description of Artificial Sequence: Synthetic oligonucleotide
  Target: ATXN1; (-) strand; PAM type: YTN; PAM sequence: TTC
aatttgcataagttatttaa

SEQ ID NO: 174066 - DNA, 20 bp, Artificial Sequence
  Description of Artificial Sequence: Synthetic oligonucleotide
  Target: ATXN1; (-) strand; PAM type: YTN; PAM sequence: TTT
caatttgcataagttattta

SEQ ID NO: 174067 - DNA, 20 bp, Artificial Sequence
  Description of Artificial Sequence: Synthetic oligonucleotide
  Target: ATXN1; (-) strand; PAM type: YTN; PAM sequence: TTT
tcaatttgcataagttattt

SEQ ID NO: 174068 - DNA, 20 bp, Artificial Sequence
  Description of Artificial Sequence: Synthetic oligonucleotide
  Target: ATXN1; (-) strand; PAM type: YTN; PAM sequence: TTT
ttcaatttgcataagttatt

SEQ ID NO: 174069 - DNA, 20 bp, Artificial Sequence
  Description of Artificial Sequence: Synthetic oligonucleotide
  Target: ATXN1; (-) strand; PAM type: YTN; PAM sequence: TTG
tgagaaaataaatgtcaaat

SEQ ID NO: 174070 - DNA, 20 bp, Artificial Sequence
  Description of Artificial Sequence: Synthetic oligonucleotide
  Target: ATXN1; (-) strand; PAM type: YTN; PAM sequence: TTA
gttgtgagaaaataaatgtc

SEQ ID NO: 174071 - DNA, 20 bp, Artificial Sequence
  Description of Artificial Sequence: Synthetic oligonucleotide
  Target: ATXN1; (-) strand; PAM type: YTN; PAM sequence: TTA
ttagttgtgagaaaataaat

SEQ ID NO: 174072 - DNA, 20 bp, Artificial Sequence
  Description of Artificial Sequence: Synthetic oligonucleotide
  Target: ATXN1; (-) strand; PAM type: YTN; PAM sequence: CTT
attagttgtgagaaaataaa

SEQ ID NO: 174073 - DNA, 20 bp, Artificial Sequence
  Description of Artificial Sequence: Synthetic oligonucleotide
  Target: ATXN1; (-) strand; PAM type: YTN; PAM sequence: CTA
cttattagttgtgagaaaat

SEQ ID NO: 174074 - DNA, 20 bp, Artificial Sequence
  Description of Artificial Sequence: Synthetic oligonucleotide
  Target: ATXN1; (-) strand; PAM type: YTN; PAM sequence: TTC
agctacttattagttgtgag

SEQ ID NO: 174075 - DNA, 20 bp, Artificial Sequence
  Description of Artificial Sequence: Synthetic oligonucleotide
  Target: ATXN1; (-) strand; PAM type: YTN; PAM sequence: CTT
cagctacttattagttgtga

SEQ ID NO: 174076 - DNA, 20 bp, Artificial Sequence
  Description of Artificial Sequence: Synthetic oligonucleotide
  Target: ATXN1; (-) strand; PAM type: YTN; PAM sequence: CTA
cttcagctacttattagttg

SEQ ID NO: 174077 - DNA, 20 bp, Artificial Sequence
  Description of Artificial Sequence: Synthetic oligonucleotide
  Target: ATXN1; (-) strand; PAM type: YTN; PAM sequence: TTC
tacttcagctacttattagt

SEQ ID NO: 174078 - DNA, 20 bp, Artificial Sequence
  Description of Artificial Sequence: Synthetic oligonucleotide
  Target: ATXN1; (-) strand; PAM type: YTN; PAM sequence: TTC
aagttctacttcagctactt

SEQ ID NO: 174079 - DNA, 20 bp, Artificial Sequence
  Description of Artificial Sequence: Synthetic oligonucleotide
  Target: ATXN1; (-) strand; PAM type: YTN; PAM sequence: TTG
ggttcaagttctacttcagc

SEQ ID NO: 174080 - DNA, 20 bp, Artificial Sequence
  Description of Artificial Sequence: Synthetic oligonucleotide
  Target: ATXN1; (-) strand; PAM type: YTN; PAM sequence: CTT
gggttcaagttctacttcag

SEQ ID NO: 174081 - DNA, 20 bp, Artificial Sequence
  Description of Artificial Sequence: Synthetic oligonucleotide
  Target: ATXN1; (-) strand; PAM type: YTN; PAM sequence: TTA
aacacacttgggttcaagtt

SEQ ID NO: 174082 - DNA, 20 bp, Artificial Sequence
  Description of Artificial Sequence: Synthetic oligonucleotide
  Target: ATXN1; (-) strand; PAM type: YTN; PAM sequence: TTG
gaattaaacacacttgggtt

SEQ ID NO: 174083 - DNA, 20 bp, Artificial Sequence
  Description of Artificial Sequence: Synthetic oligonucleotide
  Target: ATXN1; (-) strand; PAM type: YTN; PAM sequence: TTA
aaattggaattaaacacact

SEQ ID NO: 174084 - DNA, 20 bp, Artificial Sequence
  Description of Artificial Sequence: Synthetic oligonucleotide
  Target: ATXN1; (-) strand; PAM type: YTN; PAM sequence: TTT
aaaattggaattaaacacac

SEQ ID NO: 174085 - DNA, 20 bp, Artificial Sequence
  Description of Artificial Sequence: Synthetic oligonucleotide
  Target: ATXN1; (-) strand; PAM type: YTN; PAM sequence: TTT
taaaattggaattaaacaca

SEQ ID NO: 174086 - DNA, 20 bp, Artificial Sequence
  Description of Artificial Sequence: Synthetic oligonucleotide
  Target: ATXN1; (-) strand; PAM type: YTN; PAM sequence: TTT
ttaaaattggaattaaacac

SEQ ID NO: 174087 - DNA, 20 bp, Artificial Sequence
  Description of Artificial Sequence: Synthetic oligonucleotide
  Target: ATXN1; (-) strand; PAM type: YTN; PAM sequence: TTT
tttaaaattggaattaaaca

SEQ ID NO: 174088 - DNA, 20 bp, Artificial Sequence
  Description of Artificial Sequence: Synthetic oligonucleotide
  Target: ATXN1; (-) strand; PAM type: YTN; PAM sequence: CTA
aaaaacaggttttttaaaat

SEQ ID NO: 174089 - DNA, 20 bp, Artificial Sequence
  Description of Artificial Sequence: Synthetic oligonucleotide
  Target: ATXN1; (-) strand; PAM type: YTN; PAM sequence: CTC
taaaaaacaggttttttaaa

SEQ ID NO: 174090 - DNA, 20 bp, Artificial Sequence
  Description of Artificial Sequence: Synthetic oligonucleotide
  Target: ATXN1; (-) strand; PAM type: YTN; PAM sequence: CTC
aactctaaaaaacaggtttt

SEQ ID NO: 174091 - DNA, 20 bp, Artificial Sequence
  Description of Artificial Sequence: Synthetic oligonucleotide
  Target: ATXN1; (-) strand; PAM type: YTN; PAM sequence: CTG
gatgacagagacctcaactc

SEQ ID NO: 174092 - DNA, 20 bp, Artificial Sequence
  Description of Artificial Sequence: Synthetic oligonucleotide
  Target: ATXN1; (-) strand; PAM type: YTN; PAM sequence: CTC
cagcctggatgacagagacc

SEQ ID NO: 174093 - DNA, 20 bp, Artificial Sequence
  Description of Artificial Sequence: Synthetic oligonucleotide
  Target: ATXN1; (-) strand; PAM type: YTN; PAM sequence: CTA
ccctccagcctggatgacag

SEQ ID NO: 174094 - DNA, 20 bp, Artificial Sequence
  Description of Artificial Sequence: Synthetic oligonucleotide
  Target: ATXN1; (-) strand; PAM type: YTN; PAM sequence: CTA
agaacatgccactaccctcc

SEQ ID NO: 174095 - DNA, 20 bp, Artificial Sequence
  Description of Artificial Sequence: Synthetic oligonucleotide
  Target: ATXN1; (-) strand; PAM type: YTN; PAM sequence: CTG
cagtgagctaagaacatgcc

SEQ ID NO: 174096 - DNA, 20 bp, Artificial Sequence
  Description of Artificial Sequence: Synthetic oligonucleotide
  Target: ATXN1; (-) strand; PAM type: YTN; PAM sequence: TTG
aggctgcagtgagctaagaa

SEQ ID NO: 174097 - DNA, 20 bp, Artificial Sequence
  Description of Artificial Sequence: Synthetic oligonucleotide
  Target: ATXN1; (-) strand; PAM type: YTN; PAM sequence: TTG
aacccaggagattgaggctg

SEQ ID NO: 174098 - DNA, 20 bp, Artificial Sequence
  Description of Artificial Sequence: Synthetic oligonucleotide
  Target: ATXN1; (-) strand; PAM type: YTN; PAM sequence: CTT
gaacccaggagattgaggct

SEQ ID NO: 174099 - DNA, 20 bp, Artificial Sequence
  Description of Artificial Sequence: Synthetic oligonucleotide
  Target: ATXN1; (-) strand; PAM type: YTN; PAM sequence: CTG
agacaggaggatcgcttgaa

SEQ ID NO: 174100 - DNA, 20 bp, Artificial Sequence
  Description of Artificial Sequence: Synthetic oligonucleotide
  Target: ATXN1; (-) strand; PAM type: YTN; PAM sequence: CTC
agcagactgagacaggagga

SEQ ID NO: 174101 - DNA, 20 bp, Artificial Sequence
  Description of Artificial Sequence: Synthetic oligonucleotide
  Target: ATXN1; (-) strand; PAM type: YTN; PAM sequence: CTA
ctcagcagactgagacagga

SEQ ID NO: 174102 - DNA, 20 bp, Artificial Sequence
  Description of Artificial Sequence: Synthetic oligonucleotide
  Target: ATXN1; (-) strand; PAM type: YTN; PAM sequence: CTC
atccatgtagtcccagctac

SEQ ID NO: 174103 - DNA, 20 bp, Artificial Sequence
  Description of Artificial Sequence: Synthetic oligonucleotide
  Target: ATXN1; (-) strand; PAM type: YTN; PAM sequence: TTA
agcaaagcatgatggctcat

SEQ ID NO: 174104 - DNA, 20 bp, Artificial Sequence
  Description of Artificial Sequence: Synthetic oligonucleotide
  Target: ATXN1; (-) strand; PAM type: YTN; PAM sequence: TTG
gaattaagcaaagcatgatg

SEQ ID NO: 174105 - DNA, 20 bp, Artificial Sequence
  Description of Artificial Sequence: Synthetic oligonucleotide
  Target: ATXN1; (-) strand; PAM type: YTN; PAM sequence: TTT
ggaattaagcaaagcatgat

SEQ ID NO: 174106 - DNA, 20 bp, Artificial Sequence
  Description of Artificial Sequence: Synthetic oligonucleotide
  Target: ATXN1; (-) strand; PAM type: YTN; PAM sequence: TTT
tggaattaagcaaagcatga

SEQ ID NO: 174107 - DNA, 20 bp, Artificial Sequence
  Description of Artificial Sequence: Synthetic oligonucleotide
  Target: ATXN1; (-) strand; PAM type: YTN; PAM sequence: TTA
aattttggaattaagcaaag

SEQ ID NO: 174108 - DNA, 20 bp, Artificial Sequence
  Description of Artificial Sequence: Synthetic oligonucleotide
  Target: ATXN1; (-) strand; PAM type: YTN; PAM sequence: TTG
ggtgccaaggtaagaattaa

SEQ ID NO: 174109 - DNA, 20 bp, Artificial Sequence
  Description of Artificial Sequence: Synthetic oligonucleotide
  Target: ATXN1; (-) strand; PAM type: YTN; PAM sequence: CTT
gggtgccaaggtaagaatta

SEQ ID NO: 174110 - DNA, 20 bp, Artificial Sequence
  Description of Artificial Sequence: Synthetic oligonucleotide
  Target: ATXN1; (-) strand; PAM type: YTN; PAM sequence: CTC
ttgggtgccaaggtaagaat

SEQ ID NO: 174111 - DNA, 20 bp, Artificial Sequence
  Description of Artificial Sequence: Synthetic oligonucleotide
  Target: ATXN1; (-) strand; PAM type: YTN; PAM sequence: CTG
tgtgccaaacaccctcttgg

SEQ ID NO: 174112 - DNA, 20 bp, Artificial Sequence
  Description of Artificial Sequence: Synthetic oligonucleotide
  Target: ATXN1; (-) strand; PAM type: YTN; PAM sequence: CTA
ctgtgtgccaaacaccctct

SEQ ID NO: 174113 - DNA, 20 bp, Artificial Sequence
  Description of Artificial Sequence: Synthetic oligonucleotide
  Target: ATXN1; (-) strand; PAM type: YTN; PAM sequence: TTA
tgaagcacctactgtgtgcc

SEQ ID NO: 174114 - DNA, 20 bp, Artificial Sequence
  Description of Artificial Sequence: Synthetic oligonucleotide
  Target: ATXN1; (-) strand; PAM type: YTN; PAM sequence: TTT
atgaagcacctactgtgtgc

SEQ ID NO: 174115 - DNA, 20 bp, Artificial Sequence
  Description of Artificial Sequence: Synthetic oligonucleotide
  Target: ATXN1; (-) strand; PAM type: YTN; PAM sequence: TTT
tatgaagcacctactgtgtg

SEQ ID NO: 174116 - DNA, 20 bp, Artificial Sequence
  Description of Artificial Sequence: Synthetic oligonucleotide
  Target: ATXN1; (-) strand; PAM type: YTN; PAM sequence: TTT
ttatgaagcacctactgtgt

SEQ ID NO: 174117 - DNA, 20 bp, Artificial Sequence
  Description of Artificial Sequence: Synthetic oligonucleotide
  Target: ATXN1; (-) strand; PAM type: YTN; PAM sequence: TTC
agtcaccaatttttatgaag

SEQ ID NO: 174118 - DNA, 20 bp, Artificial Sequence
  Description of Artificial Sequence: Synthetic oligonucleotide
  Target: ATXN1; (-) strand; PAM type: YTN; PAM sequence: TTG
ttcagtcaccaatttttatg

SEQ ID NO: 174119 - DNA, 20 bp, Artificial Sequence
  Description of Artificial Sequence: Synthetic oligonucleotide
  Target: ATXN1; (-) strand; PAM type: YTN; PAM sequence: TTT
gttcagtcaccaatttttat

SEQ ID NO: 174120 - DNA, 20 bp, Artificial Sequence
  Description of Artificial Sequence: Synthetic oligonucleotide
  Target: ATXN1; (-) strand; PAM type: YTN; PAM sequence: TTA
tttgttcagtcaccaatttt

SEQ ID NO: 174121 - DNA, 20 bp, Artificial Sequence
  Description of Artificial Sequence: Synthetic oligonucleotide
  Target: ATXN1; (-) strand; PAM type: YTN; PAM sequence: TTT
atttgttcagtcaccaattt

SEQ ID NO: 174122 - DNA, 20 bp, Artificial Sequence
  Description of Artificial Sequence: Synthetic oligonucleotide
  Target: ATXN1; (-) strand; PAM type: YTN; PAM sequence: TTT
tatttgttcagtcaccaatt

SEQ ID NO: 174123 - DNA, 20 bp, Artificial Sequence
  Description of Artificial Sequence: Synthetic oligonucleotide
  Target: ATXN1; (-) strand; PAM type: YTN; PAM sequence: TTT
ttatttgttcagtcaccaat

SEQ ID NO: 174124 - DNA, 20 bp, Artificial Sequence
  Description of Artificial Sequence: Synthetic oligonucleotide
  Target: ATXN1; (-) strand; PAM type: YTN; PAM sequence: CTT
tttatttgttcagtcaccaa

SEQ ID NO: 174125 - DNA, 20 bp, Artificial Sequence
  Description of Artificial Sequence: Synthetic oligonucleotide
  Target: ATXN1; (-) strand; PAM type: YTN; PAM sequence: TTC
tttttatttgttcagtcacc

SEQ ID NO: 174126 - DNA, 20 bp, Artificial Sequence
  Description of Artificial Sequence: Synthetic oligonucleotide
  Target: ATXN1; (-) strand; PAM type: YTN; PAM sequence: TTA
gaacccatgtattcttttta

SEQ ID NO: 174127 - DNA, 20 bp, Artificial Sequence
  Description of Artificial Sequence: Synthetic oligonucleotide
  Target: ATXN1; (-) strand; PAM type: YTN; PAM sequence: CTT
agaacccatgtattcttttt

SEQ ID NO: 174128 - DNA, 20 bp, Artificial Sequence
  Description of Artificial Sequence: Synthetic oligonucleotide
  Target: ATXN1; (-) strand; PAM type: YTN; PAM sequence: CTA
aaccttagaacccatgtatt

SEQ ID NO: 174129 - DNA, 20 bp, Artificial Sequence
  Description of Artificial Sequence: Synthetic oligonucleotide
  Target: ATXN1; (-) strand; PAM type: YTN; PAM sequence: TTG
actaaaccttagaacccatg

SEQ ID NO: 174130 - DNA, 20 bp, Artificial Sequence
  Description of Artificial Sequence: Synthetic oligonucleotide
  Target: ATXN1; (-) strand; PAM type: YTN; PAM sequence: TTG
attgactaaaccttagaacc

SEQ ID NO: 174131 - DNA, 20 bp, Artificial Sequence
  Description of Artificial Sequence: Synthetic oligonucleotide
  Target: ATXN1; (-) strand; PAM type: YTN; PAM sequence: TTT
gattgactaaaccttagaac

SEQ ID NO: 174132 - DNA, 20 bp, Artificial Sequence
  Description of Artificial Sequence: Synthetic oligonucleotide
  Target: ATXN1; (-) strand; PAM type: YTN; PAM sequence: TTG
caccatttgattgactaaac

SEQ ID NO: 174133 - DNA, 20 bp, Artificial Sequence
  Description of Artificial Sequence: Synthetic oligonucleotide
  Target: ATXN1; (-) strand; PAM type: YTN; PAM sequence: CTC
attgcaccatttgattgact

SEQ ID NO: 174134 - DNA, 20 bp, Artificial Sequence
  Description of Artificial Sequence: Synthetic oligonucleotide
  Target: ATXN1; (-) strand; PAM type: YTN; PAM sequence: TTA
ggtgaagaatgaggctcatt

SEQ ID NO: 174135 - DNA, 20 bp, Artificial Sequence
  Description of Artificial Sequence: Synthetic oligonucleotide
  Target: ATXN1; (-) strand; PAM type: YTN; PAM sequence: TTT
aggtgaagaatgaggctcat

SEQ ID NO: 174136 - DNA, 20 bp, Artificial Sequence
  Description of Artificial Sequence: Synthetic oligonucleotide
  Target: ATXN1; (-) strand; PAM type: YTN; PAM sequence: TTA
accagtttaggtgaagaatg

SEQ ID NO: 174137 - DNA, 20 bp, Artificial Sequence
  Description of Artificial Sequence: Synthetic oligonucleotide
  Target: ATXN1; (-) strand; PAM type: YTN; PAM sequence: CTT
aaccagtttaggtgaagaat

SEQ ID NO: 174138 - DNA, 20 bp, Artificial Sequence
  Description of Artificial Sequence: Synthetic oligonucleotide
  Target: ATXN1; (-) strand; PAM type: YTN; PAM sequence: CTG
aggtatacttaaccagttta

SEQ ID NO: 174139 - DNA, 20 bp, Artificial Sequence
  Description of Artificial Sequence: Synthetic oligonucleotide
  Target: ATXN1; (-) strand; PAM type: YTN; PAM sequence: TTA
aatgactgaggtatacttaa

SEQ ID NO: 174140 - DNA, 20 bp, Artificial Sequence
  Description of Artificial Sequence: Synthetic oligonucleotide
  Target: ATXN1; (-) strand; PAM type: YTN; PAM sequence: TTA
ggttaaatgactgaggtata

SEQ ID NO: 174141 - DNA, 20 bp, Artificial Sequence
  Description of Artificial Sequence: Synthetic oligonucleotide
  Target: ATXN1; (-) strand; PAM type: YTN; PAM sequence: CTA
ttaggttaaatgactgaggt

SEQ ID NO: 174142 - DNA, 20 bp, Artificial Sequence
  Description of Artificial Sequence: Synthetic oligonucleotide
  Target: ATXN1; (-) strand; PAM type: YTN; PAM sequence: TTC
tattaggttaaatgactgag

SEQ ID NO: 174143 - DNA, 20 bp, Artificial Sequence
  Description of Artificial Sequence: Synthetic oligonucleotide
  Target: ATXN1; (-) strand; PAM type: YTN; PAM sequence: TTT
ctattaggttaaatgactga

SEQ ID NO: 174144 - DNA, 20 bp, Artificial Sequence
  Description of Artificial Sequence: Synthetic oligonucleotide
  Target: ATXN1; (-) strand; PAM type: YTN; PAM sequence: CTG
tttctattaggttaaatgac

SEQ ID NO: 174145 - DNA, 20 bp, Artificial Sequence
  Description of Artificial Sequence: Synthetic oligonucleotide
  Target: ATXN1; (-) strand; PAM type: YTN; PAM sequence: TTA
taatgactgtttctattagg

SEQ ID NO: 174146 - DNA, 20 bp, Artificial Sequence
  Description of Artificial Sequence: Synthetic oligonucleotide
  Target: ATXN1; (-) strand; PAM type: YTN; PAM sequence: TTG
attataatgactgtttctat

SEQ ID NO: 174147 - DNA, 20 bp, Artificial Sequence
  Description of Artificial Sequence: Synthetic oligonucleotide
  Target: ATXN1; (-) strand; PAM type: YTN; PAM sequence: TTT
gattataatgactgtttcta

SEQ ID NO: 174148 - DNA, 20 bp, Artificial Sequence
  Description of Artificial Sequence: Synthetic oligonucleotide
  Target: ATXN1; (-) strand; PAM type: YTN; PAM sequence: TTA
tttgattataatgactgttt

SEQ ID NO: 174149 - DNA, 20 bp, Artificial Sequence
  Description of Artificial Sequence: Synthetic oligonucleotide
  Target: ATXN1; (-) strand; PAM type: YTN; PAM sequence: CTG
tgacattatttgattataat

SEQ ID NO: 174150 - DNA, 20 bp, Artificial Sequence
  Description of Artificial Sequence: Synthetic oligonucleotide
  Target: ATXN1; (-) strand; PAM type: YTN; PAM sequence: TTA
gcaggaaatatcgatcctgt

SEQ ID NO: 174151 - DNA, 20 bp, Artificial Sequence
  Description of Artificial Sequence: Synthetic oligonucleotide
  Target: ATXN1; (-) strand; PAM type: YTN; PAM sequence: CTT
agcaggaaatatcgatcctg

SEQ ID NO: 174152 - DNA, 20 bp, Artificial Sequence
  Description of Artificial Sequence: Synthetic oligonucleotide
  Target: ATXN1; (-) strand; PAM type: YTN; PAM sequence: TTC
cttagcaggaaatatcgatc

SEQ ID NO: 174153 - DNA, 20 bp, Artificial Sequence
  Description of Artificial Sequence: Synthetic oligonucleotide
  Target: ATXN1; (-) strand; PAM type: YTN; PAM sequence: TTA
ttccttagcaggaaatatcg

SEQ ID NO: 174154 - DNA, 20 bp, Artificial Sequence
  Description of Artificial Sequence: Synthetic oligonucleotide
  Target: ATXN1; (-) strand; PAM type: YTN; PAM sequence: TTT
attccttagcaggaaatatc

SEQ ID NO: 174155 - DNA, 20 bp, Artificial Sequence
  Description of Artificial Sequence: Synthetic oligonucleotide
  Target: ATXN1; (-) strand; PAM type: YTN; PAM sequence: TTA
gaaaataaatgtcaaagcaa

SEQ ID NO: 174156 - DNA, 20 bp, Artificial Sequence
  Description of Artificial Sequence: Synthetic oligonucleotide
  Target: ATXN1; (-) strand; PAM type: YTN; PAM sequence: TTT
agaaaataaatgtcaaagca

SEQ ID NO: 174157 - DNA, 20 bp, Artificial Sequence
  Description of Artificial Sequence: Synthetic oligonucleotide
  Target: ATXN1; (-) strand; PAM type: YTN; PAM sequence: TTT
tagaaaataaatgtcaaagc

SEQ ID NO: 174158 - DNA, 20 bp, Artificial Sequence
  Description of Artificial Sequence: Synthetic oligonucleotide
  Target: ATXN1; (-) strand; PAM type: YTN; PAM sequence: CTG
agtaagttttagaaaataaa

SEQ ID NO: 174159 - DNA, 20 bp, Artificial Sequence
  Description of Artificial Sequence: Synthetic oligonucleotide
  Target: ATXN1; (-) strand; PAM type: YTN; PAM sequence: CTG
atgtataaatatcggggcaa

SEQ ID NO: 174160 - DNA, 20 bp, Artificial Sequence
  Description of Artificial Sequence: Synthetic oligonucleotide
  Target: ATXN1; (-) strand; PAM type: YTN; PAM sequence: CTG
ctgatgtataaatatcgggg

SEQ ID NO: 174161 - DNA, 20 bp, Artificial Sequence
  Description of Artificial Sequence: Synthetic oligonucleotide
  Target: ATXN1; (-) strand; PAM type: YTN; PAM sequence: CTC
ctgctgatgtataaatatcg

SEQ ID NO: 174162 - DNA, 20 bp, Artificial Sequence
  Description of Artificial Sequence: Synthetic oligonucleotide
  Target: ATXN1; (-) strand; PAM type: YTN; PAM sequence: CTC
ggggtaaccatctcctgctg

SEQ ID NO: 174163 - DNA, 20 bp, Artificial Sequence
  Description of Artificial Sequence: Synthetic oligonucleotide
  Target: ATXN1; (-) strand; PAM type: YTN; PAM sequence: TTC
tcggggtaaccatctcctgc

SEQ ID NO: 174164 - DNA, 20 bp, Artificial Sequence
  Description of Artificial Sequence: Synthetic oligonucleotide
  Target: ATXN1; (-) strand; PAM type: YTN; PAM sequence: CTT
ctcggggtaaccatctcctg

SEQ ID NO: 174165 - DNA, 20 bp, Artificial Sequence
  Description of Artificial Sequence: Synthetic oligonucleotide
  Target: ATXN1; (-) strand; PAM type: YTN; PAM sequence: TTG
tgtggaacagagcagcttct

SEQ ID NO: 174166 - DNA, 20 bp, Artificial Sequence
  Description of Artificial Sequence: Synthetic oligonucleotide
  Target: ATXN1; (-) strand; PAM type: YTN; PAM sequence: CTA
aggcaattgtgtggaacaga

SEQ ID NO: 174167 - DNA, 20 bp, Artificial Sequence
  Description of Artificial Sequence: Synthetic oligonucleotide
  Target: ATXN1; (-) strand; PAM type: YTN; PAM sequence: TTC
ataaagaggacagacgctaa

SEQ ID NO: 174168 - DNA, 20 bp, Artificial Sequence
  Description of Artificial Sequence: Synthetic oligonucleotide
  Target: ATXN1; (-) strand; PAM type: YTN; PAM sequence: TTT
cataaagaggacagacgcta

SEQ ID NO: 174169 - DNA, 20 bp, Artificial Sequence
  Description of Artificial Sequence: Synthetic oligonucleotide
  Target: ATXN1; (-) strand; PAM type: YTN; PAM sequence: TTA
gtttcataaagaggacagac

SEQ ID NO: 174170 - DNA, 20 bp, Artificial Sequence
  Description of Artificial Sequence: Synthetic oligonucleotide
  Target: ATXN1; (-) strand; PAM type: YTN; PAM sequence: TTT
agtttcataaagaggacaga

SEQ ID NO: 174171 - DNA, 20 bp, Artificial Sequence
  Description of Artificial Sequence: Synthetic oligonucleotide
  Target: ATXN1; (-) strand; PAM type: YTN; PAM sequence: TTT
tagtttcataaagaggacag

SEQ ID NO: 174172 - DNA, 20 bp, Artificial Sequence
  Description of Artificial Sequence: Synthetic oligonucleotide
  Target: ATXN1; (-) strand; PAM type: YTN; PAM sequence: TTT
ttagtttcataaagaggaca

SEQ ID NO: 174173 - DNA, 20 bp, Artificial Sequence
  Description of Artificial Sequence: Synthetic oligonucleotide
  Target: ATXN1; (-) strand; PAM type: YTN; PAM sequence: TTT
tttagtttcataaagaggac

SEQ ID NO: 174174 - DNA, 20 bp, Artificial Sequence
  Description of Artificial Sequence: Synthetic oligonucleotide
  Target: ATXN1; (-) strand; PAM type: YTN; PAM sequence: TTT
ttttagtttcataaagagga

SEQ ID NO: 174175 - DNA, 20 bp, Artificial Sequence
  Description of Artificial Sequence: Synthetic oligonucleotide
  Target: ATXN1; (-) strand; PAM type: YTN; PAM sequence: TTT
tttttagtttcataaagagg

SEQ ID NO: 174176 - DNA, 20 bp, Artificial Sequence
  Description of Artificial Sequence: Synthetic oligonucleotide
  Target: ATXN1; (-) strand; PAM type: YTN; PAM sequence: TTT
ttttttagtttcataaagag

SEQ ID NO: 174177 - DNA, 20 bp, Artificial Sequence
  Description of Artificial Sequence: Synthetic oligonucleotide
  Target: ATXN1; (-) strand; PAM type: YTN; PAM sequence: TTT
tttttttagtttcataaaga

SEQ ID NO: 174178 - DNA, 20 bp, Artificial Sequence
  Description of Artificial Sequence: Synthetic oligonucleotide
  Target: ATXN1; (-) strand; PAM type: YTN; PAM sequence: TTT
ttttttttagtttcataaag

SEQ ID NO: 174179 - DNA, 20 bp, Artificial Sequence
  Description of Artificial Sequence: Synthetic oligonucleotide
  Target: ATXN1; (-) strand; PAM type: YTN; PAM sequence: TTT
tttttttttagtttcataaa

SEQ ID NO: 174180 - DNA, 20 bp, Artificial Sequence
  Description of Artificial Sequence: Synthetic oligonucleotide
  Target: ATXN1; (-) strand; PAM type: YTN; PAM sequence: CTG
tggttttttttttttagttt

SEQ ID NO: 174181 - DNA, 20 bp, Artificial Sequence
  Description of Artificial Sequence: Synthetic oligonucleotide
  Target: ATXN1; (-) strand; PAM type: YTN; PAM sequence: TTA
ctgtggttttttttttttag

SEQ ID NO: 174182 - DNA, 20 bp, Artificial Sequence
  Description of Artificial Sequence: Synthetic oligonucleotide
  Target: ATXN1; (-) strand; PAM type: YTN; PAM sequence: CTA
cagttactgtggtttttttt

SEQ ID NO: 174183 - DNA, 20 bp, Artificial Sequence
  Description of Artificial Sequence: Synthetic oligonucleotide
  Target: ATXN1; (-) strand; PAM type: YTN; PAM sequence: CTC
ataacaactacagttactgt

SEQ ID NO: 174184 - DNA, 20 bp, Artificial Sequence
  Description of Artificial Sequence: Synthetic oligonucleotide
  Target: ATXN1; (-) strand; PAM type: YTN; PAM sequence: TTG
gtgctcataacaactacagt

SEQ ID NO: 174185 - DNA, 20 bp, Artificial Sequence
  Description of Artificial Sequence: Synthetic oligonucleotide
  Target: ATXN1; (-) strand; PAM type: YTN; PAM sequence: TTA
aaatgttggtgctcataaca

SEQ ID NO: 174186 - DNA, 20 bp, Artificial Sequence
  Description of Artificial Sequence: Synthetic oligonucleotide
  Target: ATXN1; (-) strand; PAM type: YTN; PAM sequence: CTT
aaaatgttggtgctcataac

SEQ ID NO: 174187 - DNA, 20 bp, Artificial Sequence
  Description of Artificial Sequence: Synthetic oligonucleotide
  Target: ATXN1; (-) strand; PAM type: YTN; PAM sequence: TTA
gacttaaaatgttggtgctc

SEQ ID NO: 174188 - DNA, 20 bp, Artificial Sequence
  Description of Artificial Sequence: Synthetic oligonucleotide
  Target: ATXN1; (-) strand; PAM type: YTN; PAM sequence: TTA
attagacttaaaatgttggt

SEQ ID NO: 174189 - DNA, 20 bp, Artificial Sequence
  Description of Artificial Sequence: Synthetic oligonucleotide
  Target: ATXN1; (-) strand; PAM type: YTN; PAM sequence: TTT
aattagacttaaaatgttgg

SEQ ID NO: 174190 - DNA, 20 bp, Artificial Sequence
  Description of Artificial Sequence: Synthetic oligonucleotide
  Target: ATXN1; (-) strand; PAM type: YTN; PAM sequence: TTT
taattagacttaaaatgttg

SEQ ID NO: 174191 - DNA, 20 bp, Artificial Sequence
  Description of Artificial Sequence: Synthetic oligonucleotide
  Target: ATXN1; (-) strand; PAM type: YTN; PAM sequence: TTT
ttaattagacttaaaatgtt

SEQ ID NO: 174192 - DNA, 20 bp, Artificial Sequence
  Description of Artificial Sequence: Synthetic oligonucleotide
  Target: ATXN1; (-) strand; PAM type: YTN; PAM sequence: CTG
gccagcaagtcaaattttta

SEQ ID NO: 174193 - DNA, 20 bp, Artificial Sequence
  Description of Artificial Sequence: Synthetic oligonucleotide
  Target: ATXN1; (-) strand; PAM type: YTN; PAM sequence: TTA
gaggcatgagccacggtgcc

SEQ ID NO: 174194 - DNA, 20 bp, Artificial Sequence
  Description of Artificial Sequence: Synthetic oligonucleotide
  Target: ATXN1; (-) strand; PAM type: YTN; PAM sequence: TTG
attagaggcatgagccacgg

SEQ ID NO: 174195 - DNA, 20 bp, Artificial Sequence
  Description of Artificial Sequence: Synthetic oligonucleotide
  Target: ATXN1; (-) strand; PAM type: YTN; PAM sequence: TTT
gattagaggcatgagccacg

SEQ ID NO: 174196 - DNA, 20 bp, Artificial Sequence
  Description of Artificial Sequence: Synthetic oligonucleotide
  Target: ATXN1; (-) strand; PAM type: YTN; PAM sequence: CTT
tgattagaggcatgagccac

SEQ ID NO: 174197 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctttgattagag

SEQ ID NO: 174198 - DNA, 20 bp, Artificial Sequence
  Description of Artificial Sequence: Synthetic oligonucleotide
  Target: ATXN1; (-) strand; PAM type: YTN; PAM sequence: CTG
cctcccaaagtgctttgatt

SEQ ID NO: 174199 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaaagtgctttga

SEQ ID NO: 174200 - DNA, 20 bp, Artificial Sequence
  Description of Artificial Sequence: Synthetic oligonucleotide
  Target: ATXN1; (-) strand; PAM type: YTN; PAM sequence: CTG
cctctgcctcccaaagtgct

SEQ ID NO: 174201 - DNA, 20 bp, Artificial Sequence
  Description of Artificial Sequence: Synthetic oligonucleotide
  Target: ATXN1; (-) strand; PAM type: YTN; PAM sequence: TTA
agtgatccacctgcctctgc

SEQ ID NO: 174202 - DNA, 20 bp, Artificial Sequence
  Description of Artificial Sequence: Synthetic oligonucleotide
  Target: ATXN1; (-) strand; PAM type: YTN; PAM sequence: CTT
aagtgatccacctgcctctg

SEQ ID NO: 174203 - DNA, 20 bp, Artificial Sequence
  Description of Artificial Sequence: Synthetic oligonucleotide
  Target: ATXN1; (-) strand; PAM type: YTN; PAM sequence: CTG
accttaagtgatccacctgc

SEQ ID NO: 174204 - DNA, 20 bp, Artificial Sequence
  Description of Artificial Sequence: Synthetic oligonucleotide
  Target: ATXN1; (-) strand; PAM type: YTN; PAM sequence: CTC
ctgaccttaagtgatccacc

SEQ ID NO: 174205 - DNA, 20 bp, Artificial Sequence
  Description of Artificial Sequence: Synthetic oligonucleotide
  Target: ATXN1; (-) strand; PAM type: YTN; PAM sequence: TTG
aactcctgaccttaagtgat

SEQ ID NO: 174206 - DNA, 20 bp, Artificial Sequence
  Description of Artificial Sequence: Synthetic oligonucleotide
  Target: ATXN1; (-) strand; PAM type: YTN; PAM sequence: CTT
gaactcctgaccttaagtga

SEQ ID NO: 174207 - DNA, 20 bp, Artificial Sequence
  Description of Artificial Sequence: Synthetic oligonucleotide
  Target: ATXN1; (-) strand; PAM type: YTN; PAM sequence: CTG
gtcttgaactcctgacctta

SEQ ID NO: 174208 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtcttgaactc

SEQ ID NO: 174209 - DNA, 20 bp, Artificial Sequence
  Description of Artificial Sequence: Synthetic oligonucleotide
  Target: ATXN1; (-) strand; PAM type: YTN; PAM sequence: CTA
tgttggccaggctggtcttg

SEQ ID NO: 174210 - DNA, 20 bp, Artificial Sequence
  Description of Artificial Sequence: Synthetic oligonucleotide
  Target: ATXN1; (-) strand; PAM type: YTN; PAM sequence: TTC
actatgttggccaggctggt

SEQ ID NO: 174211 - DNA, 20 bp, Artificial Sequence
  Description of Artificial Sequence: Synthetic oligonucleotide
  Target: ATXN1; (-) strand; PAM type: YTN; PAM sequence: TTT
cactatgttggccaggctgg

SEQ ID NO: 174212 - DNA, 20 bp, Artificial Sequence
  Description of Artificial Sequence: Synthetic oligonucleotide
  Target: ATXN1; (-) strand; PAM type: YTN; PAM sequence: TTA
gtagagacagtgtttcacta

SEQ ID NO: 174213 - DNA, 20 bp, Artificial Sequence
  Description of Artificial Sequence: Synthetic oligonucleotide
  Target: ATXN1; (-) strand; PAM type: YTN; PAM sequence: TTT
agtagagacagtgtttcact

SEQ ID NO: 174214 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagtgtttcac

SEQ ID NO: 174215 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagtgtttca

SEQ ID NO: 174216 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacagtg

SEQ ID NO: 174217 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacagt

SEQ ID NO: 174218 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacag

SEQ ID NO: 174219 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagaca

SEQ ID NO: 174220 - DNA, 20 bp, Artificial Sequence
  Description of Artificial Sequence: Synthetic oligonucleotide
  Target: ATXN1; (-) strand; PAM type: YTN; PAM sequence: TTA
atttttgtatttttagtaga

SEQ ID NO: 174221 - DNA, 20 bp, Artificial Sequence
  Description of Artificial Sequence: Synthetic oligonucleotide
  Target: ATXN1; (-) strand; PAM type: YTN; PAM sequence: CTA
caggcgtgagccaccacgcc

SEQ ID NO: 174222 - DNA, 20 bp, Artificial Sequence
  Description of Artificial Sequence: Synthetic oligonucleotide
  Target: ATXN1; (-) strand; PAM type: YTN; PAM sequence: CTG
agactacaggcgtgagccac

SEQ ID NO: 174223 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgagactacag

SEQ ID NO: 174224 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctgaga

SEQ ID NO: 174225 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 174226 - DNA, 20 bp, Artificial Sequence
  Description of Artificial Sequence: Synthetic oligonucleotide
  Target: ATXN1; (-) strand; PAM type: YTN; PAM sequence: TTC
ccctgcctcagcctcccgag

SEQ ID NO: 174227 - DNA, 20 bp, Artificial Sequence
  Description of Artificial Sequence: Synthetic oligonucleotide
  Target: ATXN1; (-) strand; PAM type: YTN; PAM sequence: CTA
ttcccctgcctcagcctccc

SEQ ID NO: 174228 - DNA, 20 bp, Artificial Sequence
  Description of Artificial Sequence: Synthetic oligonucleotide
  Target: ATXN1; (-) strand; PAM type: YTN; PAM sequence: TTC
aagctattcccctgcctcag

SEQ ID NO: 174229 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagctattcccc

SEQ ID NO: 174230 - DNA, 20 bp, Artificial Sequence
  Description of Artificial Sequence: Synthetic oligonucleotide
  Target: ATXN1; (-) strand; PAM type: YTN; PAM sequence: CTC
cacctcccaggttcaagcta

SEQ ID NO: 174231 - DNA, 20 bp, Artificial Sequence
  Description of Artificial Sequence: Synthetic oligonucleotide
  Target: ATXN1; (-) strand; PAM type: YTN; PAM sequence: CTG
tagcctccacctcccaggtt

SEQ ID NO: 174232 - DNA, 20 bp, Artificial Sequence
  Description of Artificial Sequence: Synthetic oligonucleotide
  Target: ATXN1; (-) strand; PAM type: YTN; PAM sequence: CTC
actgtagcctccacctccca

SEQ ID NO: 174233 - DNA, 20 bp, Artificial Sequence
  Description of Artificial Sequence: Synthetic oligonucleotide
  Target: ATXN1; (-) strand; PAM type: YTN; PAM sequence: TTA
gctcactgtagcctccacct

SEQ ID NO: 174234 - DNA, 20 bp, Artificial Sequence
  Description of Artificial Sequence: Synthetic oligonucleotide
  Target: ATXN1; (-) strand; PAM type: YTN; PAM sequence: CTT
agctcactgtagcctccacc

SEQ ID NO: 174235 - DNA, 20 bp, Artificial Sequence
  Description of Artificial Sequence: Synthetic oligonucleotide
  Target: ATXN1; (-) strand; PAM type: YTN; PAM sequence: CTG
gaatgcagtggcacgatctt

SEQ ID NO: 174236 - DNA, 20 bp, Artificial Sequence
  Description of Artificial Sequence: Synthetic oligonucleotide
  Target: ATXN1; (-) strand; PAM type: YTN; PAM sequence: TTG
cccaggctggaatgcagtgg

SEQ ID NO: 174237 - DNA, 20 bp, Artificial Sequence
  Description of Artificial Sequence: Synthetic oligonucleotide
  Target: ATXN1; (-) strand; PAM type: YTN; PAM sequence: CTA
ttgcccaggctggaatgcag

SEQ ID NO: 174238 - DNA, 20 bp, Artificial Sequence
  Description of Artificial Sequence: Synthetic oligonucleotide
  Target: ATXN1; (-) strand; PAM type: YTN; PAM sequence: CTC
tattgcccaggctggaatgc

SEQ ID NO: 174239 - DNA, 20 bp, Artificial Sequence
  Description of Artificial Sequence: Synthetic oligonucleotide
  Target: ATXN1; (-) strand; PAM type: YTN; PAM sequence: TTA
ctctattgcccaggctggaa

SEQ ID NO: 174240 - DNA, 20 bp, Artificial Sequence
  Description of Artificial Sequence: Synthetic oligonucleotide
  Target: ATXN1; (-) strand; PAM type: YTN; PAM sequence: CTT
actctattgcccaggctgga

SEQ ID NO: 174241 - DNA, 20 bp, Artificial Sequence
  Description of Artificial Sequence: Synthetic oligonucleotide
  Target: ATXN1; (-) strand; PAM type: YTN; PAM sequence: CTA
gtcttactctattgcccagg

SEQ ID NO: 174242 - DNA, 20 bp, Artificial Sequence
  Description of Artificial Sequence: Synthetic oligonucleotide
  Target: ATXN1; (-) strand; PAM type: YTN; PAM sequence: TTG
agacctagtcttactctatt

SEQ ID NO: 174243 - DNA, 20 bp, Artificial Sequence
  Description of Artificial Sequence: Synthetic oligonucleotide
  Target: ATXN1; (-) strand; PAM type: YTN; PAM sequence: TTT
gagacctagtcttactctat

SEQ ID NO: 174244 - DNA, 20 bp, Artificial Sequence
  Description of Artificial Sequence: Synthetic oligonucleotide
  Target: ATXN1; (-) strand; PAM type: YTN; PAM sequence: TTT
tgagacctagtcttactcta

SEQ ID NO: 174245 - DNA, 20 bp, Artificial Sequence
  Description of Artificial Sequence: Synthetic oligonucleotide
  Target: ATXN1; (-) strand; PAM type: YTN; PAM sequence: TTT
ttgagacctagtcttactct

SEQ ID NO: 174246 - DNA, 20 bp, Artificial Sequence
  Description of Artificial Sequence: Synthetic oligonucleotide
  Target: ATXN1; (-) strand; PAM type: YTN; PAM sequence: TTT
tttgagacctagtcttactc

SEQ ID NO: 174247 - DNA, 20 bp, Artificial Sequence
  Description of Artificial Sequence: Synthetic oligonucleotide
  Target: ATXN1; (-) strand; PAM type: YTN; PAM sequence: TTT
ttttgagacctagtcttact

SEQ ID NO: 174248 - DNA, 20 bp, Artificial Sequence
  Description of Artificial Sequence: Synthetic oligonucleotide
  Target: ATXN1; (-) strand; PAM type: YTN; PAM sequence: TTT
tttttgagacctagtcttac

SEQ ID NO: 174249 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacctagtctta

SEQ ID NO: 174250 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacctagtctt

SEQ ID NO: 174251 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacctagtct

SEQ ID NO: 174252 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacctagtc

SEQ ID NO: 174253 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacctagt

SEQ ID NO: 174254 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacctag

SEQ ID NO: 174255 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagaccta

SEQ ID NO: 174256 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacct

SEQ ID NO: 174257 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagacc

SEQ ID NO: 174258 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgagac

SEQ ID NO: 174259 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttttgaga

SEQ ID NO: 174260 - DNA, 20 bp, Artificial Sequence
  Description of Artificial Sequence: Synthetic oligonucleotide
  Target: ATXN1; (-) strand; PAM type: YTN; PAM sequence: TTC
ttttttttttttttttttga

SEQ ID NO: 174261 - DNA, 20 bp, Artificial Sequence
  Description of Artificial Sequence: Synthetic oligonucleotide
  Target: ATXN1; (-) strand; PAM type: YTN; PAM sequence: TTG
cataaacggcaagtcgagtt

SEQ ID NO: 174262 - DNA, 20 bp, Artificial Sequence
  Description of Artificial Sequence: Synthetic oligonucleotide
  Target: ATXN1; (-) strand; PAM type: YTN; PAM sequence: TTG
aaattgcataaacggcaagt

SEQ ID NO: 174263 - DNA, 20 bp, Artificial Sequence
  Description of Artificial Sequence: Synthetic oligonucleotide
  Target: ATXN1; (-) strand; PAM type: YTN; PAM sequence: TTT
gaaattgcataaacggcaag

SEQ ID NO: 174264 - DNA, 20 bp, Artificial Sequence
  Description of Artificial Sequence: Synthetic oligonucleotide
  Target: ATXN1; (-) strand; PAM type: YTN; PAM sequence: TTT
tgaaattgcataaacggcaa

SEQ ID NO: 174265 - DNA, 20 bp, Artificial Sequence
  Description of Artificial Sequence: Synthetic oligonucleotide
  Target: ATXN1; (-) strand; PAM type: YTN; PAM sequence: CTT
ttgaaattgcataaacggca

SEQ ID NO: 174266 - DNA, 20 bp, Artificial Sequence
  Description of Artificial Sequence: Synthetic oligonucleotide
  Target: ATXN1; (-) strand; PAM type: YTN; PAM sequence: CTA
caaaagccagcttttgaaat

SEQ ID NO: 174267 - DNA, 20 bp, Artificial Sequence
  Description of Artificial Sequence: Synthetic oligonucleotide
  Target: ATXN1; (-) strand; PAM type: YTN; PAM sequence: TTA
gacctacaaaagccagcttt

SEQ ID NO: 174268 - DNA, 20 bp, Artificial Sequence
  Description of Artificial Sequence: Synthetic oligonucleotide
  Target: ATXN1; (-) strand; PAM type: YTN; PAM sequence: TTT
agacctacaaaagccagctt

SEQ ID NO: 174269 - DNA, 20 bp, Artificial Sequence
  Description of Artificial Sequence: Synthetic oligonucleotide
  Target: ATXN1; (-) strand; PAM type: YTN; PAM sequence: TTT
tagacctacaaaagccagct

SEQ ID NO: 174270 - DNA, 20 bp, Artificial Sequence
  Description of Artificial Sequence: Synthetic oligonucleotide
  Target: ATXN1; (-) strand; PAM type: YTN; PAM sequence: TTA
caacaattttagacctacaa

SEQ ID NO: 174271 - DNA, 20 bp, Artificial Sequence
  Description of Artificial Sequence: Synthetic oligonucleotide
  Target: ATXN1; (-) strand; PAM type: YTN; PAM sequence: CTT
acaacaattttagacctaca

SEQ ID NO: 174272 - DNA, 20 bp, Artificial Sequence
  Description of Artificial Sequence: Synthetic oligonucleotide
  Target: ATXN1; (-) strand; PAM type: YTN; PAM sequence: TTG
tcttacaacaattttagacc

SEQ ID NO: 174273 - DNA, 20 bp, Artificial Sequence
  Description of Artificial Sequence: Synthetic oligonucleotide
  Target: ATXN1; (-) strand; PAM type: YTN; PAM sequence: TTA
aaattgtcttacaacaattt

SEQ ID NO: 174274 - DNA, 20 bp, Artificial Sequence
  Description of Artificial Sequence: Synthetic oligonucleotide
  Target: ATXN1; (-) strand; PAM type: YTN; PAM sequence: TTT
aaaattgtcttacaacaatt

SEQ ID NO: 174275 - DNA, 20 bp, Artificial Sequence
  Description of Artificial Sequence: Synthetic oligonucleotide
  Target: ATXN1; (-) strand; PAM type: YTN; PAM sequence: TTT
taaaattgtcttacaacaat

SEQ ID NO: 174276 - DNA, 20 bp, Artificial Sequence
  Description of Artificial Sequence: Synthetic oligonucleotide
  Target: ATXN1; (-) strand; PAM type: YTN; PAM sequence: CTT
ttaaaattgtcttacaacaa

SEQ ID NO: 174277 - DNA, 20 bp, Artificial Sequence
  Description of Artificial Sequence: Synthetic oligonucleotide
  Target: ATXN1; (-) strand; PAM type: YTN; PAM sequence: CTG
gaagcttttaaaattgtctt

SEQ ID NO: 174278 - DNA, 20 bp, Artificial Sequence
  Description of Artificial Sequence: Synthetic oligonucleotide
  Target: ATXN1; (-) strand; PAM type: YTN; PAM sequence: CTG
cacgtctggaagcttttaaa

SEQ ID NO: 174279 - DNA, 20 bp, Artificial Sequence
  Description of Artificial Sequence: Synthetic oligonucleotide
  Target: ATXN1; (-) strand; PAM type: YTN; PAM sequence: TTC
tgcacgtctggaagctttta

SEQ ID NO: 174280 - DNA, 20 bp, Artificial Sequence
  Description of Artificial Sequence: Synthetic oligonucleotide
  Target: ATXN1; (-) strand; PAM type: YTN; PAM sequence: CTG
tggggtggggggcaaagaag

SEQ ID NO: 174281 - DNA, 20 bp, Artificial Sequence
  Description of Artificial Sequence: Synthetic oligonucleotide
  Target: ATXN1; (-) strand; PAM type: YTN; PAM sequence: TTA
aaagccgcaaaccaagacat

SEQ ID NO: 174282 - DNA, 20 bp, Artificial Sequence
  Description of Artificial Sequence: Synthetic oligonucleotide
  Target: ATXN1; (-) strand; PAM type: YTN; PAM sequence: TTT
aaaagccgcaaaccaagaca

SEQ ID NO: 174283 - DNA, 20 bp, Artificial Sequence
  Description of Artificial Sequence: Synthetic oligonucleotide
  Target: ATXN1; (-) strand; PAM type: YTN; PAM sequence: CTG
tttaaaagccgcaaaccaag

SEQ ID NO: 174284 - DNA, 20 bp, Artificial Sequence
  Description of Artificial Sequence: Synthetic oligonucleotide
  Target: ATXN1; (-) strand; PAM type: YTN; PAM sequence: CTC
gctgtttaaaagccgcaaac

SEQ ID NO: 174285 - DNA, 20 bp, Artificial Sequence
  Description of Artificial Sequence: Synthetic oligonucleotide
  Target: ATXN1; (-) strand; PAM type: YTN; PAM sequence: CTA
gaactcgctgtttaaaagcc

SEQ ID NO: 174286 - DNA, 20 bp, Artificial Sequence
  Description of Artificial Sequence: Synthetic oligonucleotide
  Target: ATXN1; (-) strand; PAM type: YTN; PAM sequence: CTC
tagaactcgctgtttaaaag

SEQ ID NO: 174287 - DNA, 20 bp, Artificial Sequence
  Description of Artificial Sequence: Synthetic oligonucleotide
  Target: ATXN1; (-) strand; PAM type: YTN; PAM sequence: TTC
tctagaactcgctgtttaaa

SEQ ID NO: 174288 - DNA, 20 bp, Artificial Sequence
  Description of Artificial Sequence: Synthetic oligonucleotide
  Target: ATXN1; (-) strand; PAM type: YTN; PAM sequence: CTT
ctctagaactcgctgtttaa

SEQ ID NO: 174289 - DNA, 20 bp, Artificial Sequence
  Description of Artificial Sequence: Synthetic oligonucleotide
  Target: ATXN1; (-) strand; PAM type: YTN; PAM sequence: TTG
tggaacttctctagaactcg

SEQ ID NO: 174290 - DNA, 20 bp, Artificial Sequence
  Description of Artificial Sequence: Synthetic oligonucleotide
  Target: ATXN1; (-) strand; PAM type: YTN; PAM sequence: TTT
gtggaacttctctagaactc

SEQ ID NO: 174291 - DNA, 20 bp, Artificial Sequence
  Description of Artificial Sequence: Synthetic oligonucleotide
  Target: ATXN1; (-) strand; PAM type: YTN; PAM sequence: TTT
tgtggaacttctctagaact

SEQ ID NO: 174292 - DNA, 20 bp, Artificial Sequence
  Description of Artificial Sequence: Synthetic oligonucleotide
  Target: ATXN1; (-) strand; PAM type: YTN; PAM sequence: TTC
cccagaaggccagcaggtgg

SEQ ID NO: 174293 - DNA, 20 bp, Artificial Sequence
  Description of Artificial Sequence: Synthetic oligonucleotide
  Target: ATXN1; (-) strand; PAM type: YTN; PAM sequence: CTT
ccccagaaggccagcaggtg

SEQ ID NO: 174294 - DNA, 20 bp, Artificial Sequence
  Description of Artificial Sequence: Synthetic oligonucleotide
  Target: ATXN1; (-) strand; PAM type: YTN; PAM sequence: CTC
aacccgcaaccagcatcatc

SEQ ID NO: 174295 - DNA, 20 bp, Artificial Sequence
  Description of Artificial Sequence: Synthetic oligonucleotide
  Target: ATXN1; (-) strand; PAM type: YTN; PAM sequence: TTC
gctcaacccgcaaccagcat

SEQ ID NO: 174296 - DNA, 20 bp, Artificial Sequence
  Description of Artificial Sequence: Synthetic oligonucleotide
  Target: ATXN1; (-) strand; PAM type: YTN; PAM sequence: TTT
cgctcaacccgcaaccagca

SEQ ID NO: 174297 - DNA, 20 bp, Artificial Sequence
  Description of Artificial Sequence: Synthetic oligonucleotide
  Target: ATXN1; (-) strand; PAM type: YTN; PAM sequence: TTT
tcgctcaacccgcaaccagc

SEQ ID NO: 174298 - DNA, 20 bp, Artificial Sequence
  Description of Artificial Sequence: Synthetic oligonucleotide
  Target: ATXN1; (-) strand; PAM type: YTN; PAM sequence: TTG
ttttcgctcaacccgcaacc

SEQ ID NO: 174299 - DNA, 20 bp, Artificial Sequence
  Description of Artificial Sequence: Synthetic oligonucleotide
  Target: ATXN1; (-) strand; PAM type: YTN; PAM sequence: CTT
gttttcgctcaacccgcaac

SEQ ID NO: 174300 - DNA, 20 bp, Artificial Sequence
  Description of Artificial Sequence: Synthetic oligonucleotide
  Target: ATXN1; (-) strand; PAM type: YTN; PAM sequence: TTC
cttgttttcgctcaacccgc

SEQ ID NO: 174301 - DNA, 20 bp, Artificial Sequence
  Description of Artificial Sequence: Synthetic oligonucleotide
  Target: ATXN1; (-) strand; PAM type: YTN; PAM sequence: CTG
ttccttgttttcgctcaacc

SEQ ID NO: 174302 - DNA, 20 bp, Artificial Sequence
  Description of Artificial Sequence: Synthetic oligonucleotide
  Target: ATXN1; (-) strand; PAM type: YTN; PAM sequence: CTC
aaatctgttccttgttttcg

SEQ ID NO: 174303 - DNA, 20 bp, Artificial Sequence
  Description of Artificial Sequence: Synthetic oligonucleotide
  Target: ATXN1; (-) strand; PAM type: YTN; PAM sequence: TTG
gacaaactcaaatctgttcc

SEQ ID NO: 174304 - DNA, 20 bp, Artificial Sequence
  Description of Artificial Sequence: Synthetic oligonucleotide
  Target: ATXN1; (-) strand; PAM type: YTN; PAM sequence: TTT
ggacaaactcaaatctgttc

SEQ ID NO: 174305 - DNA, 20 bp, Artificial Sequence
  Description of Artificial Sequence: Synthetic oligonucleotide
  Target: ATXN1; (-) strand; PAM type: YTN; PAM sequence: CTT
tggacaaactcaaatctgtt

SEQ ID NO: 174306 - DNA, 20 bp, Artificial Sequence
  Description of Artificial Sequence: Synthetic oligonucleotide
  Target: ATXN1; (-) strand; PAM type: YTN; PAM sequence: TTC
aagtaccaagcatgctttgg

SEQ ID NO: 174307 - DNA, 20 bp, Artificial Sequence
  Description of Artificial Sequence: Synthetic oligonucleotide
  Target: ATXN1; (-) strand; PAM type: YTN; PAM sequence: TTT
caagtaccaagcatgctttg

SEQ ID NO: 174308 - DNA, 20 bp, Artificial Sequence
  Description of Artificial Sequence: Synthetic oligonucleotide
  Target: ATXN1; (-) strand; PAM type: YTN; PAM sequence: TTT
tcaagtaccaagcatgcttt

SEQ ID NO: 174309 - DNA, 20 bp, Artificial Sequence
  Description of Artificial Sequence: Synthetic oligonucleotide
  Target: ATXN1; (-) strand; PAM type: YTN; PAM sequence: TTA
attttcaagtaccaagcatg

SEQ ID NO: 174310 - DNA, 20 bp, Artificial Sequence
  Description of Artificial Sequence: Synthetic oligonucleotide
  Target: ATXN1; (-) strand; PAM type: YTN; PAM sequence: TTG
aagggttaattttcaagtac

SEQ ID NO: 174311 - DNA, 20 bp, Artificial Sequence
  Description of Artificial Sequence: Synthetic oligonucleotide
  Target: ATXN1; (-) strand; PAM type: YTN; PAM sequence: CTT
gaagggttaattttcaagta

SEQ ID NO: 174312 - DNA, 20 bp, Artificial Sequence
  Description of Artificial Sequence: Synthetic oligonucleotide
  Target: ATXN1; (-) strand; PAM type: YTN; PAM sequence: CTG
gacacatgcccagtcttgaa

SEQ ID NO: 174313 - DNA, 20 bp, Artificial Sequence
  Description of Artificial Sequence: Synthetic oligonucleotide
  Target: ATXN1; (-) strand; PAM type: YTN; PAM sequence: TTC
agagcatcactggacacatg

SEQ ID NO: 174314 - DNA, 20 bp, Artificial Sequence
  Description of Artificial Sequence: Synthetic oligonucleotide
  Target: ATXN1; (-) strand; PAM type: YTN; PAM sequence: CTT
cagagcatcactggacacat

SEQ ID NO: 174315 - DNA, 20 bp, Artificial Sequence
  Description of Artificial Sequence: Synthetic oligonucleotide
  Target: ATXN1; (-) strand; PAM type: YTN; PAM sequence: TTG
ccagcttcagagcatcactg

SEQ ID NO: 174316 - DNA, 20 bp, Artificial Sequence
  Description of Artificial Sequence: Synthetic oligonucleotide
  Target: ATXN1; (-) strand; PAM type: YTN; PAM sequence: TTT
gccagcttcagagcatcact

SEQ ID NO: 174317 - DNA, 20 bp, Artificial Sequence
  Description of Artificial Sequence: Synthetic oligonucleotide
  Target: ATXN1; (-) strand; PAM type: YTN; PAM sequence: CTT
tgccagcttcagagcatcac

SEQ ID NO: 174318 - DNA, 20 bp, Artificial Sequence
  Description of Artificial Sequence: Synthetic oligonucleotide
  Target: ATXN1; (-) strand; PAM type: YTN; PAM sequence: CTC
atctttgccagcttcagagc

SEQ ID NO: 174319 - DNA, 20 bp, Artificial Sequence
  Description of Artificial Sequence: Synthetic oligonucleotide
  Target: ATXN1; (-) strand; PAM type: YTN; PAM sequence: TTG
atgctcatctttgccagctt

SEQ ID NO: 174320 - DNA, 20 bp, Artificial Sequence
  Description of Artificial Sequence: Synthetic oligonucleotide
  Target: ATXN1; (-) strand; PAM type: YTN; PAM sequence: TTT
gatgctcatctttgccagct

SEQ ID NO: 174321 - DNA, 20 bp, Artificial Sequence
  Description of Artificial Sequence: Synthetic oligonucleotide
  Target: ATXN1; (-) strand; PAM type: YTN; PAM sequence: CTG
gtgatttgatgctcatcttt

SEQ ID NO: 174322 - DNA, 20 bp, Artificial Sequence
  Description of Artificial Sequence: Synthetic oligonucleotide
  Target: ATXN1; (-) strand; PAM type: YTN; PAM sequence: CTC
catgcacgtctggtgatttg

SEQ ID NO: 174323 - DNA, 20 bp, Artificial Sequence
  Description of Artificial Sequence: Synthetic oligonucleotide
  Target: ATXN1; (-) strand; PAM type: YTN; PAM sequence: CTC
tccatgcacgtctggtgatt

SEQ ID NO: 174324 - DNA, 20 bp, Artificial Sequence
  Description of Artificial Sequence: Synthetic oligonucleotide
  Target: ATXN1; (-) strand; PAM type: YTN; PAM sequence: CTC
atgctctccatgcacgtctg

SEQ ID NO: 174325 - DNA, 20 bp, Artificial Sequence
  Description of Artificial Sequence: Synthetic oligonucleotide
  Target: ATXN1; (-) strand; PAM type: YTN; PAM sequence: TTC
agctcatgctctccatgcac

SEQ ID NO: 174326 - DNA, 20 bp, Artificial Sequence
  Description of Artificial Sequence: Synthetic oligonucleotide
  Target: ATXN1; (-) strand; PAM type: YTN; PAM sequence: CTA
tcacgacggtcgttcagctc

SEQ ID NO: 174327 - DNA, 20 bp, Artificial Sequence
  Description of Artificial Sequence: Synthetic oligonucleotide
  Target: ATXN1; (-) strand; PAM type: YTN; PAM sequence: CTG
ccaagcctatcacgacggtc

SEQ ID NO: 174328 - DNA, 20 bp, Artificial Sequence
  Description of Artificial Sequence: Synthetic oligonucleotide
  Target: ATXN1; (-) strand; PAM type: YTN; PAM sequence: CTC
tgccaagcctatcacgacgg

SEQ ID NO: 174329 - DNA, 20 bp, Artificial Sequence
  Description of Artificial Sequence: Synthetic oligonucleotide
  Target: ATXN1; (-) strand; PAM type: YTN; PAM sequence: TTC
atcctctgccaagcctatca

SEQ ID NO: 174330 - DNA, 20 bp, Artificial Sequence
  Description of Artificial Sequence: Synthetic oligonucleotide
  Target: ATXN1; (-) strand; PAM type: YTN; PAM sequence: CTT
catcctctgccaagcctatc

SEQ ID NO: 174331 - DNA, 20 bp, Artificial Sequence
  Description of Artificial Sequence: Synthetic oligonucleotide
  Target: ATXN1; (-) strand; PAM type: YTN; PAM sequence: CTG
cttcatcctctgccaagcct

SEQ ID NO: 174332 - DNA, 20 bp, Artificial Sequence
  Description of Artificial Sequence: Synthetic oligonucleotide
  Target: ATXN1; (-) strand; PAM type: YTN; PAM sequence: CTC
tgcttcatcctctgccaagc

SEQ ID NO: 174333 - DNA, 20 bp, Artificial Sequence
  Description of Artificial Sequence: Synthetic oligonucleotide
  Target: ATXN1; (-) strand; PAM type: YTN; PAM sequence: CTC
cggtgccaccctctgcttca

SEQ ID NO: 174334 - DNA, 20 bp, Artificial Sequence
  Description of Artificial Sequence: Synthetic oligonucleotide
  Target: ATXN1; (-) strand; PAM type: YTN; PAM sequence: TTC
acacggcgtcatagtaagca

SEQ ID NO: 174335 - DNA, 20 bp, Artificial Sequence
  Description of Artificial Sequence: Synthetic oligonucleotide
  Target: ATXN1; (-) strand; PAM type: YTN; PAM sequence: CTG
tgattcacacggcgtcatag

SEQ ID NO: 174336 - DNA, 20 bp, Artificial Sequence
  Description of Artificial Sequence: Synthetic oligonucleotide
  Target: ATXN1; (-) strand; PAM type: YTN; PAM sequence: CTA
gatgctgtgattcacacggc

SEQ ID NO: 174337 - DNA, 20 bp, Artificial Sequence
  Description of Artificial Sequence: Synthetic oligonucleotide
  Target: ATXN1; (-) strand; PAM type: YTN; PAM sequence: TTG
gaagtcatagtaagggggaa

SEQ ID NO: 174338 - DNA, 20 bp, Artificial Sequence
  Description of Artificial Sequence: Synthetic oligonucleotide
  Target: ATXN1; (-) strand; PAM type: YTN; PAM sequence: TTC
aaaattggaagtcatagtaa

SEQ ID NO: 174339 - DNA, 20 bp, Artificial Sequence
  Description of Artificial Sequence: Synthetic oligonucleotide
  Target: ATXN1; (-) strand; PAM type: YTN; PAM sequence: TTT
caaaattggaagtcatagta

SEQ ID NO: 174340 - DNA, 20 bp, Artificial Sequence
  Description of Artificial Sequence: Synthetic oligonucleotide
  Target: ATXN1; (-) strand; PAM type: YTN; PAM sequence: TTA
agtacacagcagagtcacag

SEQ ID NO: 174341 - DNA, 20 bp, Artificial Sequence
  Description of Artificial Sequence: Synthetic oligonucleotide
  Target: ATXN1; (-) strand; PAM type: YTN; PAM sequence: TTC
agaaagagatgtcaattaag

SEQ ID NO: 174342 - DNA, 20 bp, Artificial Sequence
  Description of Artificial Sequence: Synthetic oligonucleotide
  Target: ATXN1; (-) strand; PAM type: YTN; PAM sequence: CTT
cagaaagagatgtcaattaa

SEQ ID NO: 174343 - DNA, 20 bp, Artificial Sequence
  Description of Artificial Sequence: Synthetic oligonucleotide
  Target: ATXN1; (-) strand; PAM type: YTN; PAM sequence: TTC
cttcagaaagagatgtcaat

SEQ ID NO: 174344 - DNA, 20 bp, Artificial Sequence
  Description of Artificial Sequence: Synthetic oligonucleotide
  Target: ATXN1; (-) strand; PAM type: YTN; PAM sequence: TTG
taaattccttcagaaagaga

SEQ ID NO: 174345 - DNA, 20 bp, Artificial Sequence
  Description of Artificial Sequence: Synthetic oligonucleotide
  Target: ATXN1; (-) strand; PAM type: YTN; PAM sequence: CTG
gattgtaaattccttcagaa

SEQ ID NO: 174346 - DNA, 20 bp, Artificial Sequence
  Description of Artificial Sequence: Synthetic oligonucleotide
  Target: ATXN1; (-) strand; PAM type: YTN; PAM sequence: TTA
catcatcaactggattgtaa

SEQ ID NO: 174347 - DNA, 20 bp, Artificial Sequence
  Description of Artificial Sequence: Synthetic oligonucleotide
  Target: ATXN1; (-) strand; PAM type: YTN; PAM sequence: CTT
acatcatcaactggattgta

SEQ ID NO: 174348 - DNA, 20 bp, Artificial Sequence
  Description of Artificial Sequence: Synthetic oligonucleotide
  Target: ATXN1; (-) strand; PAM type: YTN; PAM sequence: TTA
tgatagtgggtcttacatca

SEQ ID NO: 174349 - DNA, 20 bp, Artificial Sequence
  Description of Artificial Sequence: Synthetic oligonucleotide
  Target: ATXN1; (-) strand; PAM type: YTN; PAM sequence: CTT
atgatagtgggtcttacatc

SEQ ID NO: 174350 - DNA, 20 bp, Artificial Sequence
  Description of Artificial Sequence: Synthetic oligonucleotide
  Target: ATXN1; (-) strand; PAM type: YTN; PAM sequence: TTG
gcttatgatagtgggtctta

SEQ ID NO: 174351 - DNA, 20 bp, Artificial Sequence
  Description of Artificial Sequence: Synthetic oligonucleotide
  Target: ATXN1; (-) strand; PAM type: YTN; PAM sequence: CTA
attggcttatgatagtgggt

SEQ ID NO: 174352 - DNA, 20 bp, Artificial Sequence
  Description of Artificial Sequence: Synthetic oligonucleotide
  Target: ATXN1; (-) strand; PAM type: YTN; PAM sequence: CTC
taattggcttatgatagtgg

SEQ ID NO: 174353 - DNA, 20 bp, Artificial Sequence
  Description of Artificial Sequence: Synthetic oligonucleotide
  Target: ATXN1; (-) strand; PAM type: YTN; PAM sequence: TTC
tctaattggcttatgatagt

SEQ ID NO: 174354 - DNA, 20 bp, Artificial Sequence
  Description of Artificial Sequence: Synthetic oligonucleotide
  Target: ATXN1; (-) strand; PAM type: YTN; PAM sequence: TTG
gttctctaattggcttatga

SEQ ID NO: 174355 - DNA, 20 bp, Artificial Sequence
  Description of Artificial Sequence: Synthetic oligonucleotide
  Target: ATXN1; (-) strand; PAM type: YTN; PAM sequence: TTT
ggttctctaattggcttatg

SEQ ID NO: 174356 - DNA, 20 bp, Artificial Sequence
  Description of Artificial Sequence: Synthetic oligonucleotide
  Target: ATXN1; (-) strand; PAM type: YTN; PAM sequence: TTG
tttggttctctaattggctt

SEQ ID NO: 174357 - DNA, 20 bp, Artificial Sequence
  Description of Artificial Sequence: Synthetic oligonucleotide
  Target: ATXN1; (-) strand; PAM type: YTN; PAM sequence: CTT
gtttggttctctaattggct

SEQ ID NO: 174358 - DNA, 20 bp, Artificial Sequence
  Description of Artificial Sequence: Synthetic oligonucleotide
  Target: ATXN1; (-) strand; PAM type: YTN; PAM sequence: TTC
agcacttgtttggttctcta

SEQ ID NO: 174359 - DNA, 20 bp, Artificial Sequence
  Description of Artificial Sequence: Synthetic oligonucleotide
  Target: ATXN1; (-) strand; PAM type: YTN; PAM sequence: CTT
cagcacttgtttggttctct

SEQ ID NO: 174360 - DNA, 20 bp, Artificial Sequence
  Description of Artificial Sequence: Synthetic oligonucleotide
  Target: ATXN1; (-) strand; PAM type: YTN; PAM sequence: CTC
cataggggtcccttcagcac

SEQ ID NO: 174361 - DNA, 20 bp, Artificial Sequence
  Description of Artificial Sequence: Synthetic oligonucleotide
  Target: ATXN1; (-) strand; PAM type: YTN; PAM sequence: CTG
cctccataggggtcccttca

SEQ ID NO: 174362 - DNA, 20 bp, Artificial Sequence
  Description of Artificial Sequence: Synthetic oligonucleotide
  Target: ATXN1; (-) strand; PAM type: YTN; PAM sequence: CTC
tgcctccataggggtccctt

SEQ ID NO: 174363 - DNA, 20 bp, Artificial Sequence
  Description of Artificial Sequence: Synthetic oligonucleotide
  Target: ATXN1; (-) strand; PAM type: YTN; PAM sequence: TTC
tctgcctccataggggtccc

SEQ ID NO: 174364 - DNA, 20 bp, Artificial Sequence
  Description of Artificial Sequence: Synthetic oligonucleotide
  Target: ATXN1; (-) strand; PAM type: YTN; PAM sequence: TTC
aggttctctgcctccatagg

SEQ ID NO: 174365 - DNA, 20 bp, Artificial Sequence
  Description of Artificial Sequence: Synthetic oligonucleotide
  Target: ATXN1; (-) strand; PAM type: YTN; PAM sequence: TTT
caggttctctgcctccatag

SEQ ID NO: 174366 - DNA, 20 bp, Artificial Sequence
  Description of Artificial Sequence: Synthetic oligonucleotide
  Target: ATXN1; (-) strand; PAM type: YTN; PAM sequence: TTC
atttcaggttctctgcctcc

SEQ ID NO: 174367 - DNA, 20 bp, Artificial Sequence
  Description of Artificial Sequence: Synthetic oligonucleotide
  Target: ATXN1; (-) strand; PAM type: YTN; PAM sequence: CTG
ttcatttcaggttctctgcc

SEQ ID NO: 174368 - DNA, 20 bp, Artificial Sequence
  Description of Artificial Sequence: Synthetic oligonucleotide
  Target: ATXN1; (-) strand; PAM type: YTN; PAM sequence: TTC
actgttcatttcaggttctc

SEQ ID NO: 174369 - DNA, 20 bp, Artificial Sequence
  Description of Artificial Sequence: Synthetic oligonucleotide
  Target: ATXN1; (-) strand; PAM type: YTN; PAM sequence: CTT
cactgttcatttcaggttct

SEQ ID NO: 174370 - DNA, 20 bp, Artificial Sequence
  Description of Artificial Sequence: Synthetic oligonucleotide
  Target: ATXN1; (-) strand; PAM type: YTN; PAM sequence: TTA
gtcttcactgttcatttcag

SEQ ID NO: 174371 - DNA, 20 bp, Artificial Sequence
  Description of Artificial Sequence: Synthetic oligonucleotide
  Target: ATXN1; (-) strand; PAM type: YTN; PAM sequence: TTT
agtcttcactgttcatttca

SEQ ID NO: 174372 - DNA, 20 bp, Artificial Sequence
  Description of Artificial Sequence: Synthetic oligonucleotide
  Target: ATXN1; (-) strand; PAM type: YTN; PAM sequence: TTG
taagtcagatttagtcttca

SEQ ID NO: 174373 - DNA, 20 bp, Artificial Sequence
  Description of Artificial Sequence: Synthetic oligonucleotide
  Target: ATXN1; (-) strand; PAM type: YTN; PAM sequence: TTT
gtaagtcagatttagtcttc

SEQ ID NO: 174374 - DNA, 20 bp, Artificial Sequence
  Description of Artificial Sequence: Synthetic oligonucleotide
  Target: ATXN1; (-) strand; PAM type: YTN; PAM sequence: CTT
tgtaagtcagatttagtctt

SEQ ID NO: 174375 - DNA, 20 bp, Artificial Sequence
  Description of Artificial Sequence: Synthetic oligonucleotide
  Target: ATXN1; (-) strand; PAM type: YTN; PAM sequence: CTC
acctttgtaagtcagattta

SEQ ID NO: 174376 - DNA, 20 bp, Artificial Sequence
  Description of Artificial Sequence: Synthetic oligonucleotide
  Target: ATXN1; (-) strand; PAM type: YTN; PAM sequence: CTC
ctcacctttgtaagtcagat

SEQ ID NO: 174377 - DNA, 20 bp, Artificial Sequence
  Description of Artificial Sequence: Synthetic oligonucleotide
  Target: ATXN1; (-) strand; PAM type: YTN; PAM sequence: CTG
ctcctcacctttgtaagtca

SEQ ID NO: 174378 - DNA, 20 bp, Artificial Sequence
  Description of Artificial Sequence: Synthetic oligonucleotide
  Target: ATXN1; (-) strand; PAM type: YTN; PAM sequence: CTC
cctgctcctcacctttgtaa

SEQ ID NO: 174379 - DNA, 20 bp, Artificial Sequence
  Description of Artificial Sequence: Synthetic oligonucleotide
  Target: ATXN1; (-) strand; PAM type: YTN; PAM sequence: TTA
ggaaagaaatgtactccctg

SEQ ID NO: 174380 - DNA, 20 bp, Artificial Sequence
  Description of Artificial Sequence: Synthetic oligonucleotide
  Target: ATXN1; (-) strand; PAM type: YTN; PAM sequence: TTC
gtcagaaatcccagtgcaag

SEQ ID NO: 174381 - DNA, 20 bp, Artificial Sequence
  Description of Artificial Sequence: Synthetic oligonucleotide
  Target: ATXN1; (-) strand; PAM type: YTN; PAM sequence: CTG
aggtattcgtcagaaatccc

SEQ ID NO: 174382 - DNA, 20 bp, Artificial Sequence
  Description of Artificial Sequence: Synthetic oligonucleotide
  Target: ATXN1; (-) strand; PAM type: YTN; PAM sequence: CTC
tgaggtattcgtcagaaatc

SEQ ID NO: 174383 - DNA, 20 bp, Artificial Sequence
  Description of Artificial Sequence: Synthetic oligonucleotide
  Target: ATXN1; (-) strand; PAM type: YTN; PAM sequence: CTA
catcagaaaaagcccaacat

SEQ ID NO: 174384 - DNA, 20 bp, Artificial Sequence
  Description of Artificial Sequence: Synthetic oligonucleotide
  Target: ATXN1; (-) strand; PAM type: YTN; PAM sequence: CTC
caaaatatcgctacatcaga

SEQ ID NO: 174385 - DNA, 20 bp, Artificial Sequence
  Description of Artificial Sequence: Synthetic oligonucleotide
  Target: ATXN1; (-) strand; PAM type: YTN; PAM sequence: TTG
aaccataatctccaaaatat

SEQ ID NO: 174386 - DNA, 20 bp, Artificial Sequence
  Description of Artificial Sequence: Synthetic oligonucleotide
  Target: ATXN1; (-) strand; PAM type: YTN; PAM sequence: CTG
gttgaaccataatctccaaa

SEQ ID NO: 174387 - DNA, 20 bp, Artificial Sequence
  Description of Artificial Sequence: Synthetic oligonucleotide
  Target: ATXN1; (-) strand; PAM type: YTN; PAM sequence: TTA
gacaaatcactggttgaacc

SEQ ID NO: 174388 - DNA, 20 bp, Artificial Sequence
  Description of Artificial Sequence: Synthetic oligonucleotide
  Target: ATXN1; (-) strand; PAM type: YTN; PAM sequence: TTT
agacaaatcactggttgaac

SEQ ID NO: 174389 - DNA, 20 bp, Artificial Sequence
  Description of Artificial Sequence: Synthetic oligonucleotide
  Target: ATXN1; (-) strand; PAM type: YTN; PAM sequence: CTC
aaacaggtttagacaaatca

SEQ ID NO: 174390 - DNA, 20 bp, Artificial Sequence
  Description of Artificial Sequence: Synthetic oligonucleotide
  Target: ATXN1; (-) strand; PAM type: YTN; PAM sequence: TTA
gaaagaatcctcaaacaggt

SEQ ID NO: 174391 - DNA, 20 bp, Artificial Sequence
  Description of Artificial Sequence: Synthetic oligonucleotide
  Target: ATXN1; (-) strand; PAM type: YTN; PAM sequence: TTA
tgtagggaagggaatgatat

SEQ ID NO: 174392 - DNA, 20 bp, Artificial Sequence
  Description of Artificial Sequence: Synthetic oligonucleotide
  Target: ATXN1; (-) strand; PAM type: YTN; PAM sequence: TTT
atgtagggaagggaatgata

SEQ ID NO: 174393 - DNA, 20 bp, Artificial Sequence
  Description of Artificial Sequence: Synthetic oligonucleotide
  Target: ATXN1; (-) strand; PAM type: YTN; PAM sequence: CTT
tatgtagggaagggaatgat

SEQ ID NO: 174394 - DNA, 20 bp, Artificial Sequence
  Description of Artificial Sequence: Synthetic oligonucleotide
  Target: ATXN1; (-) strand; PAM type: YTN; PAM sequence: TTA
tctttatgtagggaagggaa

SEQ ID NO: 174395 - DNA, 20 bp, Artificial Sequence
  Description of Artificial Sequence: Synthetic oligonucleotide
  Target: ATXN1; (-) strand; PAM type: YTN; PAM sequence: TTG
catattatctttatgtaggg

SEQ ID NO: 174396 - DNA, 20 bp, Artificial Sequence
  Description of Artificial Sequence: Synthetic oligonucleotide
  Target: ATXN1; (-) strand; PAM type: YTN; PAM sequence: TTT
gcatattatctttatgtagg

SEQ ID NO: 174397 - DNA, 20 bp, Artificial Sequence
  Description of Artificial Sequence: Synthetic oligonucleotide
  Target: ATXN1; (-) strand; PAM type: YTN; PAM sequence: TTT
tgcatattatctttatgtag

SEQ ID NO: 174398 - DNA, 20 bp, Artificial Sequence
  Description of Artificial Sequence: Synthetic oligonucleotide
  Target: ATXN1; (-) strand; PAM type: YTN; PAM sequence: TTT
ttgcatattatctttatgta

SEQ ID NO: 174399 - DNA, 20 bp, Artificial Sequence
  Description of Artificial Sequence: Synthetic oligonucleotide
  Target: ATXN1; (-) strand; PAM type: YTN; PAM sequence: TTT
tttgcatattatctttatgt

SEQ ID NO: 174400 - DNA, 20 bp, Artificial Sequence
  Description of Artificial Sequence: Synthetic oligonucleotide
  Target: ATXN1; (-) strand; PAM type: YTN; PAM sequence: TTG
gattttttgcatattatctt

SEQ ID NO: 174401 - DNA, 20 bp, Artificial Sequence
  Description of Artificial Sequence: Synthetic oligonucleotide
  Target: ATXN1; (-) strand; PAM type: YTN; PAM sequence: TTT
ggattttttgcatattatct

SEQ ID NO: 174402 - DNA, 20 bp, Artificial Sequence
  Description of Artificial Sequence: Synthetic oligonucleotide
  Target: ATXN1; (-) strand; PAM type: YTN; PAM sequence: TTT
tggattttttgcatattatc

SEQ ID NO: 174403 - DNA, 20 bp, Artificial Sequence
  Description of Artificial Sequence: Synthetic oligonucleotide
  Target: ATXN1; (-) strand; PAM type: YTN; PAM sequence: CTT
ttggattttttgcatattat

SEQ ID NO: 174404 - DNA, 20 bp, Artificial Sequence
  Description of Artificial Sequence: Synthetic oligonucleotide
  Target: ATXN1; (-) strand; PAM type: YTN; PAM sequence: TTG
cacccttttggattttttgc

SEQ ID NO: 174405 - DNA, 20 bp, Artificial Sequence
  Description of Artificial Sequence: Synthetic oligonucleotide
  Target: ATXN1; (-) strand; PAM type: YTN; PAM sequence: CTA
gtaaaacaaatgattgcacc

SEQ ID NO: 174406 - DNA, 20 bp, Artificial Sequence
  Description of Artificial Sequence: Synthetic oligonucleotide
  Target: ATXN1; (-) strand; PAM type: YTN; PAM sequence: TTC
tagtaaaacaaatgattgca

SEQ ID NO: 174407 - DNA, 20 bp, Artificial Sequence
  Description of Artificial Sequence: Synthetic oligonucleotide
  Target: ATXN1; (-) strand; PAM type: YTN; PAM sequence: TTA
gaacataaagaagattctag

SEQ ID NO: 174408 - DNA, 20 bp, Artificial Sequence
  Description of Artificial Sequence: Synthetic oligonucleotide
  Target: ATXN1; (-) strand; PAM type: YTN; PAM sequence: TTT
agaacataaagaagattcta

SEQ ID NO: 174409 - DNA, 20 bp, Artificial Sequence
  Description of Artificial Sequence: Synthetic oligonucleotide
  Target: ATXN1; (-) strand; PAM type: YTN; PAM sequence: CTT
tagaacataaagaagattct

SEQ ID NO: 174410 - DNA, 20 bp, Artificial Sequence
  Description of Artificial Sequence: Synthetic oligonucleotide
  Target: ATXN1; (-) strand; PAM type: YTN; PAM sequence: TTA
agactttagaacataaagaa

SEQ ID NO: 174411 - DNA, 20 bp, Artificial Sequence
  Description of Artificial Sequence: Synthetic oligonucleotide
  Target: ATXN1; (-) strand; PAM type: YTN; PAM sequence: TTG
aaagaaatgcatgattaaga

SEQ ID NO: 174412 - DNA, 20 bp, Artificial Sequence
  Description of Artificial Sequence: Synthetic oligonucleotide
  Target: ATXN1; (-) strand; PAM type: YTN; PAM sequence: TTT
gaaagaaatgcatgattaag

SEQ ID NO: 174413 - DNA, 20 bp, Artificial Sequence
  Description of Artificial Sequence: Synthetic oligonucleotide
  Target: ATXN1; (-) strand; PAM type: YTN; PAM sequence: CTC
acaatttgaaagaaatgcat

SEQ ID NO: 174414 - DNA, 20 bp, Artificial Sequence
  Description of Artificial Sequence: Synthetic oligonucleotide
  Target: ATXN1; (-) strand; PAM type: YTN; PAM sequence: TTG
gaggctcacaatttgaaaga

SEQ ID NO: 174415 - DNA, 20 bp, Artificial Sequence
  Description of Artificial Sequence: Synthetic oligonucleotide
  Target: ATXN1; (-) strand; PAM type: YTN; PAM sequence: TTC
attggaggctcacaatttga

SEQ ID NO: 174416 - DNA, 20 bp, Artificial Sequence
  Description of Artificial Sequence: Synthetic oligonucleotide
  Target: ATXN1; (-) strand; PAM type: YTN; PAM sequence: TTG
tagttcattggaggctcaca

SEQ ID NO: 174417 - DNA, 20 bp, Artificial Sequence
  Description of Artificial Sequence: Synthetic oligonucleotide
  Target: ATXN1; (-) strand; PAM type: YTN; PAM sequence: CTT
gtagttcattggaggctcac

SEQ ID NO: 174418 - DNA, 20 bp, Artificial Sequence
  Description of Artificial Sequence: Synthetic oligonucleotide
  Target: ATXN1; (-) strand; PAM type: YTN; PAM sequence: CTG
acaagcttgtagttcattgg

SEQ ID NO: 174419 - DNA, 20 bp, Artificial Sequence
  Description of Artificial Sequence: Synthetic oligonucleotide
  Target: ATXN1; (-) strand; PAM type: YTN; PAM sequence: TTC
tgacaagcttgtagttcatt

SEQ ID NO: 174420 - DNA, 20 bp, Artificial Sequence
  Description of Artificial Sequence: Synthetic oligonucleotide
  Target: ATXN1; (-) strand; PAM type: YTN; PAM sequence: CTG
aatagatgtaattctgacaa

SEQ ID NO: 174421 - DNA, 20 bp, Artificial Sequence
  Description of Artificial Sequence: Synthetic oligonucleotide
  Target: ATXN1; (-) strand; PAM type: YTN; PAM sequence: TTG
tatatgacctgaatagatgt

SEQ ID NO: 174422 - DNA, 20 bp, Artificial Sequence
  Description of Artificial Sequence: Synthetic oligonucleotide
  Target: ATXN1; (-) strand; PAM type: YTN; PAM sequence: CTC
cacggatgttgtatatgacc

SEQ ID NO: 174423 - DNA, 20 bp, Artificial Sequence
  Description of Artificial Sequence: Synthetic oligonucleotide
  Target: ATXN1; (-) strand; PAM type: YTN; PAM sequence: TTG
ctccacggatgttgtatatg

SEQ ID NO: 174424 - DNA, 20 bp, Artificial Sequence
  Description of Artificial Sequence: Synthetic oligonucleotide
  Target: ATXN1; (-) strand; PAM type: YTN; PAM sequence: TTT
gctccacggatgttgtatat

SEQ ID NO: 174425 - DNA, 20 bp, Artificial Sequence
  Description of Artificial Sequence: Synthetic oligonucleotide
  Target: ATXN1; (-) strand; PAM type: YTN; PAM sequence: CTT
tgctccacggatgttgtata

SEQ ID NO: 174426 - DNA, 20 bp, Artificial Sequence
  Description of Artificial Sequence: Synthetic oligonucleotide
  Target: ATXN1; (-) strand; PAM type: YTN; PAM sequence: TTC
actttgctccacggatgttg

SEQ ID NO: 174427 - DNA, 20 bp, Artificial Sequence
  Description of Artificial Sequence: Synthetic oligonucleotide
  Target: ATXN1; (-) strand; PAM type: YTN; PAM sequence: TTC
aaattcactttgctccacgg

SEQ ID NO: 174428 - DNA, 20 bp, Artificial Sequence
  Description of Artificial Sequence: Synthetic oligonucleotide
  Target: ATXN1; (-) strand; PAM type: YTN; PAM sequence: CTT
caaattcactttgctccacg

SEQ ID NO: 174429 - DNA, 20 bp, Artificial Sequence
  Description of Artificial Sequence: Synthetic oligonucleotide
  Target: ATXN1; (-) strand; PAM type: YTN; PAM sequence: TTA
acttcaaattcactttgctc

SEQ ID NO: 174430 - DNA, 20 bp, Artificial Sequence
  Description of Artificial Sequence: Synthetic oligonucleotide
  Target: ATXN1; (-) strand; PAM type: YTN; PAM sequence: CTT
aacttcaaattcactttgct

SEQ ID NO: 174431 - DNA, 20 bp, Artificial Sequence
  Description of Artificial Sequence: Synthetic oligonucleotide
  Target: ATXN1; (-) strand; PAM type: YTN; PAM sequence: CTA
agaggagacttaacttcaaa

SEQ ID NO: 174432 - DNA, 20 bp, Artificial Sequence
  Description of Artificial Sequence: Synthetic oligonucleotide
  Target: ATXN1; (-) strand; PAM type: YTN; PAM sequence: CTA
cactaagaggagacttaact

SEQ ID NO: 174433 - DNA, 20 bp, Artificial Sequence
  Description of Artificial Sequence: Synthetic oligonucleotide
  Target: ATXN1; (-) strand; PAM type: YTN; PAM sequence: CTG
ctacactaagaggagactta

SEQ ID NO: 174434 - DNA, 20 bp, Artificial Sequence
  Description of Artificial Sequence: Synthetic oligonucleotide
  Target: ATXN1; (-) strand; PAM type: YTN; PAM sequence: TTC
aaaatacgtactgctacact

SEQ ID NO: 174435 - DNA, 20 bp, Artificial Sequence
  Description of Artificial Sequence: Synthetic oligonucleotide
  Target: ATXN1; (-) strand; PAM type: YTN; PAM sequence: CTC
attcaaaatacgtactgcta

SEQ ID NO: 174436 - DNA, 20 bp, Artificial Sequence
  Description of Artificial Sequence: Synthetic oligonucleotide
  Target: ATXN1; (-) strand; PAM type: YTN; PAM sequence: TTC
tcattcaaaatacgtactgc

SEQ ID NO: 174437 - DNA, 20 bp, Artificial Sequence
  Description of Artificial Sequence: Synthetic oligonucleotide
  Target: ATXN1; (-) strand; PAM type: YTN; PAM sequence: CTG
gccgttctcattcaaaatac

SEQ ID NO: 174438 - DNA, 20 bp, Artificial Sequence
  Description of Artificial Sequence: Synthetic oligonucleotide
  Target: ATXN1; (-) strand; PAM type: YTN; PAM sequence: TTA
gcactggccgttctcattca

SEQ ID NO: 174439 - DNA, 20 bp, Artificial Sequence
  Description of Artificial Sequence: Synthetic oligonucleotide
  Target: ATXN1; (-) strand; PAM type: YTN; PAM sequence: TTT
agcactggccgttctcattc

SEQ ID NO: 174440 - DNA, 20 bp, Artificial Sequence
  Description of Artificial Sequence: Synthetic oligonucleotide
  Target: ATXN1; (-) strand; PAM type: YTN; PAM sequence: CTT
tagcactggccgttctcatt

SEQ ID NO: 174441 - DNA, 20 bp, Artificial Sequence
  Description of Artificial Sequence: Synthetic oligonucleotide
  Target: ATXN1; (-) strand; PAM type: YTN; PAM sequence: TTC
catctttagcactggccgtt

SEQ ID NO: 174442 - DNA, 20 bp, Artificial Sequence
  Description of Artificial Sequence: Synthetic oligonucleotide
  Target: ATXN1; (-) strand; PAM type: YTN; PAM sequence: TTT
ccatctttagcactggccgt

SEQ ID NO: 174443 - DNA, 20 bp, Artificial Sequence
  Description of Artificial Sequence: Synthetic oligonucleotide
  Target: ATXN1; (-) strand; PAM type: YTN; PAM sequence: TTT
tccatctttagcactggccg

SEQ ID NO: 174444 - DNA, 20 bp, Artificial Sequence
  Description of Artificial Sequence: Synthetic oligonucleotide
  Target: ATXN1; (-) strand; PAM type: YTN; PAM sequence: CTA
ttttccatctttagcactgg

SEQ ID NO: 174445 - DNA, 20 bp, Artificial Sequence
  Description of Artificial Sequence: Synthetic oligonucleotide
  Target: ATXN1; (-) strand; PAM type: YTN; PAM sequence: CTG
gccacccacctattttccat

SEQ ID NO: 174446 - DNA, 20 bp, Artificial Sequence
  Description of Artificial Sequence: Synthetic oligonucleotide
  Target: ATXN1; (-) strand; PAM type: YTN; PAM sequence: CTG
tgcctggccacccacctatt

SEQ ID NO: 174447 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccactgtgcc

SEQ ID NO: 174448 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 174449 - DNA, 20 bp, Artificial Sequence
  Description of Artificial Sequence: Synthetic oligonucleotide
  Target: ATXN1; (-) strand; PAM type: YTN; PAM sequence: CTC
ccaaagagctgggattacag

SEQ ID NO: 174450 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagagctgggat

SEQ ID NO: 174451 - DNA, 20 bp, Artificial Sequence
  Description of Artificial Sequence: Synthetic oligonucleotide
  Target: ATXN1; (-) strand; PAM type: YTN; PAM sequence: CTG
cattggcctcccaaagagct

SEQ ID NO: 174452 - DNA, 20 bp, Artificial Sequence
  Description of Artificial Sequence: Synthetic oligonucleotide
  Target: ATXN1; (-) strand; PAM type: YTN; PAM sequence: CTC
aagtgatccgcctgcattgg

SEQ ID NO: 174453 - DNA, 20 bp, Artificial Sequence
  Description of Artificial Sequence: Synthetic oligonucleotide
  Target: ATXN1; (-) strand; PAM type: YTN; PAM sequence: CTG
gcctcaagtgatccgcctgc

SEQ ID NO: 174454 - DNA, 20 bp, Artificial Sequence
  Description of Artificial Sequence: Synthetic oligonucleotide
  Target: ATXN1; (-) strand; PAM type: YTN; PAM sequence: CTC
ctggcctcaagtgatccgcc

SEQ ID NO: 174455 - DNA, 20 bp, Artificial Sequence
  Description of Artificial Sequence: Synthetic oligonucleotide
  Target: ATXN1; (-) strand; PAM type: YTN; PAM sequence: CTC
aaactcctggcctcaagtga

SEQ ID NO: 174456 - DNA, 20 bp, Artificial Sequence
  Description of Artificial Sequence: Synthetic oligonucleotide
  Target: ATXN1; (-) strand; PAM type: YTN; PAM sequence: TTG
gccaggatggtctcaaactc

SEQ ID NO: 174457 - DNA, 20 bp, Artificial Sequence
  Description of Artificial Sequence: Synthetic oligonucleotide
  Target: ATXN1; (-) strand; PAM type: YTN; PAM sequence: TTC
agcatgttggccaggatggt

SEQ ID NO: 174458 - DNA, 20 bp, Artificial Sequence
  Description of Artificial Sequence: Synthetic oligonucleotide
  Target: ATXN1; (-) strand; PAM type: YTN; PAM sequence: TTT
cagcatgttggccaggatgg

SEQ ID NO: 174459 - DNA, 20 bp, Artificial Sequence
  Description of Artificial Sequence: Synthetic oligonucleotide
  Target: ATXN1; (-) strand; PAM type: YTN; PAM sequence: TTG
gtagagacgtggtttcagca

SEQ ID NO: 174460 - DNA, 20 bp, Artificial Sequence
  Description of Artificial Sequence: Synthetic oligonucleotide
  Target: ATXN1; (-) strand; PAM type: YTN; PAM sequence: TTT
ggtagagacgtggtttcagc

SEQ ID NO: 174461 - DNA, 20 bp, Artificial Sequence
  Description of Artificial Sequence: Synthetic oligonucleotide
  Target: ATXN1; (-) strand; PAM type: YTN; PAM sequence: TTT
tggtagagacgtggtttcag

SEQ ID NO: 174462 - DNA, 20 bp, Artificial Sequence
  Description of Artificial Sequence: Synthetic oligonucleotide
  Target: ATXN1; (-) strand; PAM type: YTN; PAM sequence: TTT
ttggtagagacgtggtttca

SEQ ID NO: 174463 - DNA, 20 bp, Artificial Sequence
  Description of Artificial Sequence: Synthetic oligonucleotide
  Target: ATXN1; (-) strand; PAM type: YTN; PAM sequence: TTG
tatttttggtagagacgtgg

SEQ ID NO: 174464 - DNA, 20 bp, Artificial Sequence
  Description of Artificial Sequence: Synthetic oligonucleotide
  Target: ATXN1; (-) strand; PAM type: YTN; PAM sequence: TTT
gtatttttggtagagacgtg

SEQ ID NO: 174465 - DNA, 20 bp, Artificial Sequence
  Description of Artificial Sequence: Synthetic oligonucleotide
  Target: ATXN1; (-) strand; PAM type: YTN; PAM sequence: TTT
tgtatttttggtagagacgt

SEQ ID NO: 174466 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttggtagagacg

SEQ ID NO: 174467 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttggtaga

SEQ ID NO: 174468 - DNA, 20 bp, Artificial Sequence
  Description of Artificial Sequence: Synthetic oligonucleotide
  Target: ATXN1; (-) strand; PAM type: YTN; PAM sequence: CTA
cacacggctaatttttgtat

SEQ ID NO: 174469 - DNA, 20 bp, Artificial Sequence
  Description of Artificial Sequence: Synthetic oligonucleotide
  Target: ATXN1; (-) strand; PAM type: YTN; PAM sequence: CTA
ctacacacggctaatttttg

SEQ ID NO: 174470 - DNA, 20 bp, Artificial Sequence
  Description of Artificial Sequence: Synthetic oligonucleotide
  Target: ATXN1; (-) strand; PAM type: YTN; PAM sequence: CTA
caggcatgtgctactacaca

SEQ ID NO: 174471 - DNA, 20 bp, Artificial Sequence
  Description of Artificial Sequence: Synthetic oligonucleotide
  Target: ATXN1; (-) strand; PAM type: YTN; PAM sequence: CTG
aaactacaggcatgtgctac

SEQ ID NO: 174472 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgaaactacag

SEQ ID NO: 174473 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctgaaa

SEQ ID NO: 174474 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 174475 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccaagta

SEQ ID NO: 174476 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccaag

SEQ ID NO: 174477 - DNA, 20 bp, Artificial Sequence
  Description of Artificial Sequence: Synthetic oligonucleotide
  Target: ATXN1; (-) strand; PAM type: YTN; PAM sequence: TTC
aagcaattctcctgcctcag

SEQ ID NO: 174478 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagcaattctcc

SEQ ID NO: 174479 - DNA, 20 bp, Artificial Sequence
  Description of Artificial Sequence: Synthetic oligonucleotide
  Target: ATXN1; (-) strand; PAM type: YTN; PAM sequence: CTC
cgcctcccaggttcaagcaa

SEQ ID NO: 174480 - DNA, 20 bp, Artificial Sequence
  Description of Artificial Sequence: Synthetic oligonucleotide
  Target: ATXN1; (-) strand; PAM type: YTN; PAM sequence: CTG
caacctccgcctcccaggtt

SEQ ID NO: 174481 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccgcctccca

SEQ ID NO: 174482 - DNA, 20 bp, Artificial Sequence
  Description of Artificial Sequence: Synthetic oligonucleotide
  Target: ATXN1; (-) strand; PAM type: YTN; PAM sequence: CTC
agctcactgcaacctccgcc

SEQ ID NO: 174483 - DNA, 20 bp, Artificial Sequence
  Description of Artificial Sequence: Synthetic oligonucleotide
  Target: ATXN1; (-) strand; PAM type: YTN; PAM sequence: CTG
gagtgccgtggtgtgatctc

SEQ ID NO: 174484 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggagtgccg

SEQ ID NO: 174485 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctggagtgc

SEQ ID NO: 174486 - DNA, 20 bp, Artificial Sequence
  Description of Artificial Sequence: Synthetic oligonucleotide
  Target: ATXN1; (-) strand; PAM type: YTN; PAM sequence: CTC
actctgtcacccaggctgga

SEQ ID NO: 174487 - DNA, 20 bp, Artificial Sequence
  Description of Artificial Sequence: Synthetic oligonucleotide
  Target: ATXN1; (-) strand; PAM type: YTN; PAM sequence: TTG
acacagaggtctcactctgt

SEQ ID NO: 174488 - DNA, 20 bp, Artificial Sequence
  Description of Artificial Sequence: Synthetic oligonucleotide
  Target: ATXN1; (-) strand; PAM type: YTN; PAM sequence: TTT
gacacagaggtctcactctg

SEQ ID NO: 174489 - DNA, 20 bp, Artificial Sequence
  Description of Artificial Sequence: Synthetic oligonucleotide
  Target: ATXN1; (-) strand; PAM type: YTN; PAM sequence: TTT
tgacacagaggtctcactct

SEQ ID NO: 174490 - DNA, 20 bp, Artificial Sequence
  Description of Artificial Sequence: Synthetic oligonucleotide
  Target: ATXN1; (-) strand; PAM type: YTN; PAM sequence: TTT
ttgacacagaggtctcactc

SEQ ID NO: 174491 - DNA, 20 bp, Artificial Sequence
  Description of Artificial Sequence: Synthetic oligonucleotide
  Target: ATXN1; (-) strand; PAM type: YTN; PAM sequence: TTT
tttgacacagaggtctcact

SEQ ID NO: 174492 - DNA, 20 bp, Artificial Sequence
  Description of Artificial Sequence: Synthetic oligonucleotide
  Target: ATXN1; (-) strand; PAM type: YTN; PAM sequence: TTT
ttttgacacagaggtctcac

SEQ ID NO: 174493 - DNA, 20 bp, Artificial Sequence
  Description of Artificial Sequence: Synthetic oligonucleotide
  Target: ATXN1; (-) strand; PAM type: YTN; PAM sequence: TTT
tttttgacacagaggtctca

SEQ ID NO: 174494 - DNA, 20 bp, Artificial Sequence
  Description of Artificial Sequence: Synthetic oligonucleotide
  Target: ATXN1; (-) strand; PAM type: YTN; PAM sequence: TTT
ttttttgacacagaggtctc

SEQ ID NO: 174495 - DNA, 20 bp, Artificial Sequence
  Description of Artificial Sequence: Synthetic oligonucleotide
  Target: ATXN1; (-) strand; PAM type: YTN; PAM sequence: TTT
tttttttgacacagaggtct

SEQ ID NO: 174496 - DNA, 20 bp, Artificial Sequence
  Description of Artificial Sequence: Synthetic oligonucleotide
  Target: ATXN1; (-) strand; PAM type: YTN; PAM sequence: TTT
ttttttttgacacagaggtc

SEQ ID NO: 174497 - DNA, 20 bp, Artificial Sequence
  Description of Artificial Sequence: Synthetic oligonucleotide
  Target: ATXN1; (-) strand; PAM type: YTN; PAM sequence: TTT
tttttttttgacacagaggt

SEQ ID NO: 174498 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgacacagagg

SEQ ID NO: 174499 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgacacagag

SEQ ID NO: 174500 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgacacaga

SEQ ID NO: 174501 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgacacag

SEQ ID NO: 174502 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgacaca

SEQ ID NO: 174503 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgacac

SEQ ID NO: 174504 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgaca

SEQ ID NO: 174505 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgac

SEQ ID NO: 174506 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttttttga

SEQ ID NO: 174507 - DNA, 20 bp, Artificial Sequence
  Description of Artificial Sequence: Synthetic oligonucleotide
  Target: ATXN1; (-) strand; PAM type: YTN; PAM sequence: TTC
tttttttttttttttttttt

SEQ ID NO: 174508 - DNA, 20 bp, Artificial Sequence
  Description of Artificial Sequence: Synthetic oligonucleotide
  Target: ATXN1; (-) strand; PAM type: YTN; PAM sequence: TTT
cttttttttttttttttttt

SEQ ID NO: 174509 - DNA, 20 bp, Artificial Sequence
  Description of Artificial Sequence: Synthetic oligonucleotide
  Target: ATXN1; (-) strand; PAM type: YTN; PAM sequence: TTT
tctttttttttttttttttt

SEQ ID NO: 174510 - DNA, 20 bp, Artificial Sequence
  Description of Artificial Sequence: Synthetic oligonucleotide
  Target: ATXN1; (-) strand; PAM type: YTN; PAM sequence: CTT
ttcttttttttttttttttt

SEQ ID NO: 174511 - DNA, 20 bp, Artificial Sequence
  Description of Artificial Sequence: Synthetic oligonucleotide
  Target: ATXN1; (-) strand; PAM type: YTN; PAM sequence: TTC
ttttcttttttttttttttt

SEQ ID NO: 174512 - DNA, 20 bp, Artificial Sequence
  Description of Artificial Sequence: Synthetic oligonucleotide
  Target: ATXN1; (-) strand; PAM type: YTN; PAM sequence: TTT
cttttctttttttttttttt

SEQ ID NO: 174513 - DNA, 20 bp, Artificial Sequence
  Description of Artificial Sequence: Synthetic oligonucleotide
  Target: ATXN1; (-) strand; PAM type: YTN; PAM sequence: TTT
tcttttcttttttttttttt

SEQ ID NO: 174514 - DNA, 20 bp, Artificial Sequence
  Description of Artificial Sequence: Synthetic oligonucleotide
  Target: ATXN1; (-) strand; PAM type: YTN; PAM sequence: CTT
ttcttttctttttttttttt

SEQ ID NO: 174515 - DNA, 20 bp, Artificial Sequence
  Description of Artificial Sequence: Synthetic oligonucleotide
  Target: ATXN1; (-) strand; PAM type: YTN; PAM sequence: TTC
ttttcttttctttttttttt

SEQ ID NO: 174516 - DNA, 20 bp, Artificial Sequence
  Description of Artificial Sequence: Synthetic oligonucleotide
  Target: ATXN1; (-) strand; PAM type: YTN; PAM sequence: TTT
cttttcttttcttttttttt

SEQ ID NO: 174517 - DNA, 20 bp, Artificial Sequence
  Description of Artificial Sequence: Synthetic oligonucleotide
  Target: ATXN1; (-) strand; PAM type: YTN; PAM sequence: TTT
tcttttcttttctttttttt

SEQ ID NO: 174518 - DNA, 20 bp, Artificial Sequence
  Description of Artificial Sequence: Synthetic oligonucleotide
  Target: ATXN1; (-) strand; PAM type: YTN; PAM sequence: CTT
ttcttttcttttcttttttt

SEQ ID NO: 174519 - DNA, 20 bp, Artificial Sequence
  Description of Artificial Sequence: Synthetic oligonucleotide
  Target: ATXN1; (-) strand; PAM type: YTN; PAM sequence: TTC
ttttcttttcttttcttttt

SEQ ID NO: 174520 - DNA, 20 bp, Artificial Sequence
  Description of Artificial Sequence: Synthetic oligonucleotide
  Target: ATXN1; (-) strand; PAM type: YTN; PAM sequence: TTT
cttttcttttcttttctttt

SEQ ID NO: 174521 - DNA, 20 bp, Artificial Sequence
  Description of Artificial Sequence: Synthetic oligonucleotide
  Target: ATXN1; (-) strand; PAM type: YTN; PAM sequence: TTT
tcttttcttttcttttcttt

SEQ ID NO: 174522 - DNA, 20 bp, Artificial Sequence
  Description of Artificial Sequence: Synthetic oligonucleotide
  Target: ATXN1; (-) strand; PAM type: YTN; PAM sequence: TTT
ttcttttcttttcttttctt

SEQ ID NO: 174523 - DNA, 20 bp, Artificial Sequence
  Description of Artificial Sequence: Synthetic oligonucleotide
  Target: ATXN1; (-) strand; PAM type: YTN; PAM sequence: CTT
tttcttttcttttcttttct

SEQ ID NO: 174524 - DNA, 20 bp, Artificial Sequence
  Description of Artificial Sequence: Synthetic oligonucleotide
  Target: ATXN1; (-) strand; PAM type: YTN; PAM sequence: TTA
catctttttcttttcttttc

SEQ ID NO: 174525 - DNA, 20 bp, Artificial Sequence
  Description of Artificial Sequence: Synthetic oligonucleotide
  Target: ATXN1; (-) strand; PAM type: YTN; PAM sequence: TTT
acatctttttcttttctttt

SEQ ID NO: 174526 - DNA, 20 bp, Artificial Sequence
  Description of Artificial Sequence: Synthetic oligonucleotide
  Target: ATXN1; (-) strand; PAM type: YTN; PAM sequence: TTT
tacatctttttcttttcttt

SEQ ID NO: 174527 - DNA, 20 bp, Artificial Sequence
  Description of Artificial Sequence: Synthetic oligonucleotide
  Target: ATXN1; (-) strand; PAM type: YTN; PAM sequence: TTA
ttttacatctttttcttttc

SEQ ID NO: 174528 - DNA, 20 bp, Artificial Sequence
  Description of Artificial Sequence: Synthetic oligonucleotide
  Target: ATXN1; (-) strand; PAM type: YTN; PAM sequence: TTC
aaattattttacatcttttt

SEQ ID NO: 174529 - DNA, 20 bp, Artificial Sequence
  Description of Artificial Sequence: Synthetic oligonucleotide
  Target: ATXN1; (-) strand; PAM type: YTN; PAM sequence: TTT
caaattattttacatctttt

SEQ ID NO: 174530 - DNA, 20 bp, Artificial Sequence
  Description of Artificial Sequence: Synthetic oligonucleotide
  Target: ATXN1; (-) strand; PAM type: YTN; PAM sequence: TTT
tcaaattattttacatcttt

SEQ ID NO: 174531 - DNA, 20 bp, Artificial Sequence
  Description of Artificial Sequence: Synthetic oligonucleotide
  Target: ATXN1; (-) strand; PAM type: YTN; PAM sequence: TTG
ttttcaaattattttacatc

SEQ ID NO: 174532 - DNA, 20 bp, Artificial Sequence
  Description of Artificial Sequence: Synthetic oligonucleotide
  Target: ATXN1; (-) strand; PAM type: YTN; PAM sequence: TTT
gttttcaaattattttacat

SEQ ID NO: 174533 - DNA, 20 bp, Artificial Sequence
  Description of Artificial Sequence: Synthetic oligonucleotide
  Target: ATXN1; (-) strand; PAM type: YTN; PAM sequence: TTT
tgttttcaaattattttaca

SEQ ID NO: 174534 - DNA, 20 bp, Artificial Sequence
  Description of Artificial Sequence: Synthetic oligonucleotide
  Target: ATXN1; (-) strand; PAM type: YTN; PAM sequence: CTT
ttgttttcaaattattttac

SEQ ID NO: 174535 - DNA, 20 bp, Artificial Sequence
  Description of Artificial Sequence: Synthetic oligonucleotide
  Target: ATXN1; (-) strand; PAM type: YTN; PAM sequence: TTA
ggcttttgttttcaaattat

SEQ ID NO: 174536 - DNA, 20 bp, Artificial Sequence
  Description of Artificial Sequence: Synthetic oligonucleotide
  Target: ATXN1; (-) strand; PAM type: YTN; PAM sequence: TTT
aggcttttgttttcaaatta

SEQ ID NO: 174537 - DNA, 20 bp, Artificial Sequence
  Description of Artificial Sequence: Synthetic oligonucleotide
  Target: ATXN1; (-) strand; PAM type: YTN; PAM sequence: CTT
taggcttttgttttcaaatt

SEQ ID NO: 174538 - DNA, 20 bp, Artificial Sequence
  Description of Artificial Sequence: Synthetic oligonucleotide
  Target: ATXN1; (-) strand; PAM type: YTN; PAM sequence: TTC
agcaagcatctttaggcttt

SEQ ID NO: 174539 - DNA, 20 bp, Artificial Sequence
  Description of Artificial Sequence: Synthetic oligonucleotide
  Target: ATXN1; (-) strand; PAM type: YTN; PAM sequence: TTT
cagcaagcatctttaggctt

SEQ ID NO: 174540 - DNA, 20 bp, Artificial Sequence
  Description of Artificial Sequence: Synthetic oligonucleotide
  Target: ATXN1; (-) strand; PAM type: YTN; PAM sequence: CTG
atttcagcaagcatctttag

SEQ ID NO: 174541 - DNA, 20 bp, Artificial Sequence
  Description of Artificial Sequence: Synthetic oligonucleotide
  Target: ATXN1; (-) strand; PAM type: YTN; PAM sequence: CTA
atagctgatttcagcaagca

SEQ ID NO: 174542 - DNA, 20 bp, Artificial Sequence
  Description of Artificial Sequence: Synthetic oligonucleotide
  Target: ATXN1; (-) strand; PAM type: YTN; PAM sequence: CTG
aagagaacagactaatagct

SEQ ID NO: 174543 - DNA, 20 bp, Artificial Sequence
  Description of Artificial Sequence: Synthetic oligonucleotide
  Target: ATXN1; (-) strand; PAM type: YTN; PAM sequence: TTC
ctgaagagaacagactaata

SEQ ID NO: 174544 - DNA, 20 bp, Artificial Sequence
  Description of Artificial Sequence: Synthetic oligonucleotide
  Target: ATXN1; (-) strand; PAM type: YTN; PAM sequence: TTT
cctgaagagaacagactaat

SEQ ID NO: 174545 - DNA, 20 bp, Artificial Sequence
  Description of Artificial Sequence: Synthetic oligonucleotide
  Target: ATXN1; (-) strand; PAM type: YTN; PAM sequence: TTT
tcctgaagagaacagactaa

SEQ ID NO: 174546 - DNA, 20 bp, Artificial Sequence
  Description of Artificial Sequence: Synthetic oligonucleotide
  Target: ATXN1; (-) strand; PAM type: YTN; PAM sequence: TTA
tgcataatatgtcattttcc

SEQ ID NO: 174547 - DNA, 20 bp, Artificial Sequence
  Description of Artificial Sequence: Synthetic oligonucleotide
  Target: ATXN1; (-) strand; PAM type: YTN; PAM sequence: TTA
attatgcataatatgtcatt

SEQ ID NO: 174548 - DNA, 20 bp, Artificial Sequence
  Description of Artificial Sequence: Synthetic oligonucleotide
  Target: ATXN1; (-) strand; PAM type: YTN; PAM sequence: TTA
ttaattatgcataatatgtc

SEQ ID NO: 174549 - DNA, 20 bp, Artificial Sequence
  Description of Artificial Sequence: Synthetic oligonucleotide
  Target: ATXN1; (-) strand; PAM type: YTN; PAM sequence: TTA
ttattaattatgcataatat

SEQ ID NO: 174550 - DNA, 20 bp, Artificial Sequence
  Description of Artificial Sequence: Synthetic oligonucleotide
  Target: ATXN1; (-) strand; PAM type: YTN; PAM sequence: TTA
ttattattaattatgcataa

SEQ ID NO: 174551 - DNA, 20 bp, Artificial Sequence
  Description of Artificial Sequence: Synthetic oligonucleotide
  Target: ATXN1; (-) strand; PAM type: YTN; PAM sequence: TTA
ttattattattaattatgca

SEQ ID NO: 174552 - DNA, 20 bp, Artificial Sequence
  Description of Artificial Sequence: Synthetic oligonucleotide
  Target: ATXN1; (-) strand; PAM type: YTN; PAM sequence: TTA
tgttattattattattaatt

SEQ ID NO: 174553 - DNA, 20 bp, Artificial Sequence
  Description of Artificial Sequence: Synthetic oligonucleotide
  Target: ATXN1; (-) strand; PAM type: YTN; PAM sequence: TTA
gttatgttattattattatt

SEQ ID NO: 174554 - DNA, 20 bp, Artificial Sequence
  Description of Artificial Sequence: Synthetic oligonucleotide
  Target: ATXN1; (-) strand; PAM type: YTN; PAM sequence: TTA
gagtcaataagacataaaat

SEQ ID NO: 174555 - DNA, 20 bp, Artificial Sequence
  Description of Artificial Sequence: Synthetic oligonucleotide
  Target: ATXN1; (-) strand; PAM type: YTN; PAM sequence: CTT
agagtcaataagacataaaa

SEQ ID NO: 174556 - DNA, 20 bp, Artificial Sequence
  Description of Artificial Sequence: Synthetic oligonucleotide
  Target: ATXN1; (-) strand; PAM type: YTN; PAM sequence: TTA
aagtcatatgaggtagtagt

SEQ ID NO: 174557 - DNA, 20 bp, Artificial Sequence
  Description of Artificial Sequence: Synthetic oligonucleotide
  Target: ATXN1; (-) strand; PAM type: YTN; PAM sequence: TTC
aatatcaatattaaagtcat

SEQ ID NO: 174558 - DNA, 20 bp, Artificial Sequence
  Description of Artificial Sequence: Synthetic oligonucleotide
  Target: ATXN1; (-) strand; PAM type: YTN; PAM sequence: TTA
attcaatatcaatattaaag

SEQ ID NO: 174559 - DNA, 20 bp, Artificial Sequence
  Description of Artificial Sequence: Synthetic oligonucleotide
  Target: ATXN1; (-) strand; PAM type: YTN; PAM sequence: TTT
aattcaatatcaatattaaa

SEQ ID NO: 174560 - DNA, 20 bp, Artificial Sequence
  Description of Artificial Sequence: Synthetic oligonucleotide
  Target: ATXN1; (-) strand; PAM type: YTN; PAM sequence: CTT
taattcaatatcaatattaa

SEQ ID NO: 174561 - DNA, 20 bp, Artificial Sequence
  Description of Artificial Sequence: Synthetic oligonucleotide
  Target: ATXN1; (-) strand; PAM type: YTN; PAM sequence: CTG
actttaattcaatatcaata

SEQ ID NO: 174562 - DNA, 20 bp, Artificial Sequence
  Description of Artificial Sequence: Synthetic oligonucleotide
  Target: ATXN1; (-) strand; PAM type: YTN; PAM sequence: TTG
cactgactttaattcaatat

SEQ ID NO: 174563 - DNA, 20 bp, Artificial Sequence
  Description of Artificial Sequence: Synthetic oligonucleotide
  Target: ATXN1; (-) strand; PAM type: YTN; PAM sequence: CTT
gcactgactttaattcaata

SEQ ID NO: 174564 - DNA, 20 bp, Artificial Sequence
  Description of Artificial Sequence: Synthetic oligonucleotide
  Target: ATXN1; (-) strand; PAM type: YTN; PAM sequence: CTA
cagatcttgcactgacttta

SEQ ID NO: 174565 - DNA, 20 bp, Artificial Sequence
  Description of Artificial Sequence: Synthetic oligonucleotide
  Target: ATXN1; (-) strand; PAM type: YTN; PAM sequence: CTA
atgtactacagatcttgcac

SEQ ID NO: 174566 - DNA, 20 bp, Artificial Sequence
  Description of Artificial Sequence: Synthetic oligonucleotide
  Target: ATXN1; (-) strand; PAM type: YTN; PAM sequence: TTA
ctaatgtactacagatcttg

SEQ ID NO: 174567 - DNA, 20 bp, Artificial Sequence
  Description of Artificial Sequence: Synthetic oligonucleotide
  Target: ATXN1; (-) strand; PAM type: YTN; PAM sequence: CTT
actaatgtactacagatctt

SEQ ID NO: 174568 - DNA, 20 bp, Artificial Sequence
  Description of Artificial Sequence: Synthetic oligonucleotide
  Target: ATXN1; (-) strand; PAM type: YTN; PAM sequence: TTG
catacttactaatgtactac

SEQ ID NO: 174569 - DNA, 20 bp, Artificial Sequence
  Description of Artificial Sequence: Synthetic oligonucleotide
  Target: ATXN1; (-) strand; PAM type: YTN; PAM sequence: TTT
gcatacttactaatgtacta

SEQ ID NO: 174570 - DNA, 20 bp, Artificial Sequence
  Description of Artificial Sequence: Synthetic oligonucleotide
  Target: ATXN1; (-) strand; PAM type: YTN; PAM sequence: TTT
tgcatacttactaatgtact

SEQ ID NO: 174571 - DNA, 20 bp, Artificial Sequence
  Description of Artificial Sequence: Synthetic oligonucleotide
  Target: ATXN1; (-) strand; PAM type: YTN; PAM sequence: TTT
ttgcatacttactaatgtac

SEQ ID NO: 174572 - DNA, 20 bp, Artificial Sequence
  Description of Artificial Sequence: Synthetic oligonucleotide
  Target: ATXN1; (-) strand; PAM type: YTN; PAM sequence: TTC
ccatttttgcatacttacta

SEQ ID NO: 174573 - DNA, 20 bp, Artificial Sequence
  Description of Artificial Sequence: Synthetic oligonucleotide
  Target: ATXN1; (-) strand; PAM type: YTN; PAM sequence: TTT
cccatttttgcatacttact

SEQ ID NO: 174574 - DNA, 20 bp, Artificial Sequence
  Description of Artificial Sequence: Synthetic oligonucleotide
  Target: ATXN1; (-) strand; PAM type: YTN; PAM sequence: TTC
aatttcccatttttgcatac

SEQ ID NO: 174575 - DNA, 20 bp, Artificial Sequence
  Description of Artificial Sequence: Synthetic oligonucleotide
  Target: ATXN1; (-) strand; PAM type: YTN; PAM sequence: CTT
caatttcccatttttgcata

SEQ ID NO: 174576 - DNA, 20 bp, Artificial Sequence
  Description of Artificial Sequence: Synthetic oligonucleotide
  Target: ATXN1; (-) strand; PAM type: YTN; PAM sequence: CTA
taaacagggcttcaatttcc

SEQ ID NO: 174577 - DNA, 20 bp, Artificial Sequence
  Description of Artificial Sequence: Synthetic oligonucleotide
  Target: ATXN1; (-) strand; PAM type: YTN; PAM sequence: CTG
agtaccacctataaacaggg

SEQ ID NO: 174578 - DNA, 20 bp, Artificial Sequence
  Description of Artificial Sequence: Synthetic oligonucleotide
  Target: ATXN1; (-) strand; PAM type: YTN; PAM sequence: CTC
tgagtaccacctataaacag

SEQ ID NO: 174579 - DNA, 20 bp, Artificial Sequence
  Description of Artificial Sequence: Synthetic oligonucleotide
  Target: ATXN1; (-) strand; PAM type: YTN; PAM sequence: TTC
tctgagtaccacctataaac

SEQ ID NO: 174580 - DNA, 20 bp, Artificial Sequence
  Description of Artificial Sequence: Synthetic oligonucleotide
  Target: ATXN1; (-) strand; PAM type: YTN; PAM sequence: CTT
ctctgagtaccacctataaa

SEQ ID NO: 174581 - DNA, 20 bp, Artificial Sequence
  Description of Artificial Sequence: Synthetic oligonucleotide
  Target: ATXN1; (-) strand; PAM type: YTN; PAM sequence: CTG
ggccttctctgagtaccacc

SEQ ID NO: 174582 - DNA, 20 bp, Artificial Sequence
  Description of Artificial Sequence: Synthetic oligonucleotide
  Target: ATXN1; (-) strand; PAM type: YTN; PAM sequence: TTG
gcaccaacaaccctgggcct

SEQ ID NO: 174583 - DNA, 20 bp, Artificial Sequence
  Description of Artificial Sequence: Synthetic oligonucleotide
  Target: ATXN1; (-) strand; PAM type: YTN; PAM sequence: TTC
cagttggcaccaacaaccct

SEQ ID NO: 174584 - DNA, 20 bp, Artificial Sequence
  Description of Artificial Sequence: Synthetic oligonucleotide
  Target: ATXN1; (-) strand; PAM type: YTN; PAM sequence: TTT
ccagttggcaccaacaaccc

SEQ ID NO: 174585 - DNA, 20 bp, Artificial Sequence
  Description of Artificial Sequence: Synthetic oligonucleotide
  Target: ATXN1; (-) strand; PAM type: YTN; PAM sequence: TTT
tccagttggcaccaacaacc

SEQ ID NO: 174586 - DNA, 20 bp, Artificial Sequence
  Description of Artificial Sequence: Synthetic oligonucleotide
  Target: ATXN1; (-) strand; PAM type: YTN; PAM sequence: TTT
ttccagttggcaccaacaac

SEQ ID NO: 174587 - DNA, 20 bp, Artificial Sequence
  Description of Artificial Sequence: Synthetic oligonucleotide
  Target: ATXN1; (-) strand; PAM type: YTN; PAM sequence: CTT
tttccagttggcaccaacaa

SEQ ID NO: 174588 - DNA, 20 bp, Artificial Sequence
  Description of Artificial Sequence: Synthetic oligonucleotide
  Target: ATXN1; (-) strand; PAM type: YTN; PAM sequence: TTA
atataatcagatataaactt

SEQ ID NO: 174589 - DNA, 20 bp, Artificial Sequence
  Description of Artificial Sequence: Synthetic oligonucleotide
  Target: ATXN1; (-) strand; PAM type: YTN; PAM sequence: CTA
ttaatataatcagatataaa

SEQ ID NO: 174590 - DNA, 20 bp, Artificial Sequence
  Description of Artificial Sequence: Synthetic oligonucleotide
  Target: ATXN1; (-) strand; PAM type: YTN; PAM sequence: TTG
ctattaatataatcagatat

SEQ ID NO: 174591 - DNA, 20 bp, Artificial Sequence
  Description of Artificial Sequence: Synthetic oligonucleotide
  Target: ATXN1; (-) strand; PAM type: YTN; PAM sequence: CTA
tgccagggcaaaatgccaga

SEQ ID NO: 174592 - DNA, 20 bp, Artificial Sequence
  Description of Artificial Sequence: Synthetic oligonucleotide
  Target: ATXN1; (-) strand; PAM type: YTN; PAM sequence: TTC
aagaaggtaaaaaactatgc

SEQ ID NO: 174593 - DNA, 20 bp, Artificial Sequence
  Description of Artificial Sequence: Synthetic oligonucleotide
  Target: ATXN1; (-) strand; PAM type: YTN; PAM sequence: CTT
caagaaggtaaaaaactatg

SEQ ID NO: 174594 - DNA, 20 bp, Artificial Sequence
  Description of Artificial Sequence: Synthetic oligonucleotide
  Target: ATXN1; (-) strand; PAM type: YTN; PAM sequence: TTA
accttcaagaaggtaaaaaa

SEQ ID NO: 174595 - DNA, 20 bp, Artificial Sequence
  Description of Artificial Sequence: Synthetic oligonucleotide
  Target: ATXN1; (-) strand; PAM type: YTN; PAM sequence: TTT
aaccttcaagaaggtaaaaa

SEQ ID NO: 174596 - DNA, 20 bp, Artificial Sequence
  Description of Artificial Sequence: Synthetic oligonucleotide
  Target: ATXN1; (-) strand; PAM type: YTN; PAM sequence: TTT
taaccttcaagaaggtaaaa

SEQ ID NO: 174597 - DNA, 20 bp, Artificial Sequence
  Description of Artificial Sequence: Synthetic oligonucleotide
  Target: ATXN1; (-) strand; PAM type: YTN; PAM sequence: TTT
ttaaccttcaagaaggtaaa

SEQ ID NO: 174598 - DNA, 20 bp, Artificial Sequence
  Description of Artificial Sequence: Synthetic oligonucleotide
  Target: ATXN1; (-) strand; PAM type: YTN; PAM sequence: TTT
tttaaccttcaagaaggtaa

SEQ ID NO: 174599 - DNA, 20 bp, Artificial Sequence
  Description of Artificial Sequence: Synthetic oligonucleotide
  Target: ATXN1; (-) strand; PAM type: YTN; PAM sequence: TTT
ttttaaccttcaagaaggta

SEQ ID NO: 174600 - DNA, 20 bp, Artificial Sequence
  Description of Artificial Sequence: Synthetic oligonucleotide
  Target: ATXN1; (-) strand; PAM type: YTN; PAM sequence: TTT
tttttaaccttcaagaaggt

SEQ ID NO: 174601 - DNA, 20 bp, Artificial Sequence
  Description of Artificial Sequence: Synthetic oligonucleotide
  Target: ATXN1; (-) strand; PAM type: YTN; PAM sequence: TTT
ttttttaaccttcaagaagg

SEQ ID NO: 174602 - DNA, 20 bp, Artificial Sequence
  Description of Artificial Sequence: Synthetic oligonucleotide
  Target: ATXN1; (-) strand; PAM type: YTN; PAM sequence: TTT
tttttttaaccttcaagaag

SEQ ID NO: 174603 - DNA, 20 bp, Artificial Sequence
  Description of Artificial Sequence: Synthetic oligonucleotide
  Target: ATXN1; (-) strand; PAM type: YTN; PAM sequence: TTT
ttttttttaaccttcaagaa

SEQ ID NO: 174604 - DNA, 20 bp, Artificial Sequence
  Description of Artificial Sequence: Synthetic oligonucleotide
  Target: ATXN1; (-) strand; PAM type: YTN; PAM sequence: TTT
tttttttttaaccttcaaga

SEQ ID NO: 174605 - DNA, 20 bp, Artificial Sequence
  Description of Artificial Sequence: Synthetic oligonucleotide
  Target: ATXN1; (-) strand; PAM type: YTN; PAM sequence: CTG
atgcagccagggagattttt

SEQ ID NO: 174606 - DNA, 20 bp, Artificial Sequence
  Description of Artificial Sequence: Synthetic oligonucleotide
  Target: ATXN1; (-) strand; PAM type: YTN; PAM sequence: TTA
aatcctgatgcagccaggga

SEQ ID NO: 174607 - DNA, 20 bp, Artificial Sequence
  Description of Artificial Sequence: Synthetic oligonucleotide
  Target: ATXN1; (-) strand; PAM type: YTN; PAM sequence: CTT
aaatcctgatgcagccaggg

SEQ ID NO: 174608 - DNA, 20 bp, Artificial Sequence
  Description of Artificial Sequence: Synthetic oligonucleotide
  Target: ATXN1; (-) strand; PAM type: YTN; PAM sequence: CTC
cccaatgtcttaaatcctga

SEQ ID NO: 174609 - DNA, 20 bp, Artificial Sequence
  Description of Artificial Sequence: Synthetic oligonucleotide
  Target: ATXN1; (-) strand; PAM type: YTN; PAM sequence: TTC
tccccaatgtcttaaatcct

SEQ ID NO: 174610 - DNA, 20 bp, Artificial Sequence
  Description of Artificial Sequence: Synthetic oligonucleotide
  Target: ATXN1; (-) strand; PAM type: YTN; PAM sequence: TTT
ctccccaatgtcttaaatcc

SEQ ID NO: 174611 - DNA, 20 bp, Artificial Sequence
  Description of Artificial Sequence: Synthetic oligonucleotide
  Target: ATXN1; (-) strand; PAM type: YTN; PAM sequence: CTT
tctccccaatgtcttaaatc

SEQ ID NO: 174612 - DNA, 20 bp, Artificial Sequence
  Description of Artificial Sequence: Synthetic oligonucleotide
  Target: ATXN1; (-) strand; PAM type: YTN; PAM sequence: TTC
tttctccccaatgtcttaaa

SEQ ID NO: 174613 - DNA, 20 bp, Artificial Sequence
  Description of Artificial Sequence: Synthetic oligonucleotide
  Target: ATXN1; (-) strand; PAM type: YTN; PAM sequence: TTT
ctttctccccaatgtcttaa

SEQ ID NO: 174614 - DNA, 20 bp, Artificial Sequence
  Description of Artificial Sequence: Synthetic oligonucleotide
  Target: ATXN1; (-) strand; PAM type: YTN; PAM sequence: CTT
tctttctccccaatgtctta

SEQ ID NO: 174615 - DNA, 20 bp, Artificial Sequence
  Description of Artificial Sequence: Synthetic oligonucleotide
  Target: ATXN1; (-) strand; PAM type: YTN; PAM sequence: TTA
tcctttctttctccccaatg

SEQ ID NO: 174616 - DNA, 20 bp, Artificial Sequence
  Description of Artificial Sequence: Synthetic oligonucleotide
  Target: ATXN1; (-) strand; PAM type: YTN; PAM sequence: TTT
atcctttctttctccccaat

SEQ ID NO: 174617 - DNA, 20 bp, Artificial Sequence
  Description of Artificial Sequence: Synthetic oligonucleotide
  Target: ATXN1; (-) strand; PAM type: YTN; PAM sequence: CTT
tatcctttctttctccccaa

SEQ ID NO: 174618 - DNA, 20 bp, Artificial Sequence
  Description of Artificial Sequence: Synthetic oligonucleotide
  Target: ATXN1; (-) strand; PAM type: YTN; PAM sequence: CTC
tttatcctttctttctcccc

SEQ ID NO: 174619 - DNA, 20 bp, Artificial Sequence
  Description of Artificial Sequence: Synthetic oligonucleotide
  Target: ATXN1; (-) strand; PAM type: YTN; PAM sequence: TTC
cctctttatcctttctttct

SEQ ID NO: 174620 - DNA, 20 bp, Artificial Sequence
  Description of Artificial Sequence: Synthetic oligonucleotide
  Target: ATXN1; (-) strand; PAM type: YTN; PAM sequence: TTG
ttccctctttatcctttctt

SEQ ID NO: 174621 - DNA, 20 bp, Artificial Sequence
  Description of Artificial Sequence: Synthetic oligonucleotide
  Target: ATXN1; (-) strand; PAM type: YTN; PAM sequence: CTT
gttccctctttatcctttct

SEQ ID NO: 174622 - DNA, 20 bp, Artificial Sequence
  Description of Artificial Sequence: Synthetic oligonucleotide
  Target: ATXN1; (-) strand; PAM type: YTN; PAM sequence: TTG
cccttgttccctctttatcc

SEQ ID NO: 174623 - DNA, 20 bp, Artificial Sequence
  Description of Artificial Sequence: Synthetic oligonucleotide
  Target: ATXN1; (-) strand; PAM type: YTN; PAM sequence: TTT
gcccttgttccctctttatc

SEQ ID NO: 174624 - DNA, 20 bp, Artificial Sequence
  Description of Artificial Sequence: Synthetic oligonucleotide
  Target: ATXN1; (-) strand; PAM type: YTN; PAM sequence: CTT
tgcccttgttccctctttat

SEQ ID NO: 174625 - DNA, 20 bp, Artificial Sequence
  Description of Artificial Sequence: Synthetic oligonucleotide
  Target: ATXN1; (-) strand; PAM type: YTN; PAM sequence: CTC
atctttgcccttgttccctc

SEQ ID NO: 174626 - DNA, 20 bp, Artificial Sequence
  Description of Artificial Sequence: Synthetic oligonucleotide
  Target: ATXN1; (-) strand; PAM type: YTN; PAM sequence: TTC
aatgatcctcatctttgccc

SEQ ID NO: 174627 - DNA, 20 bp, Artificial Sequence
  Description of Artificial Sequence: Synthetic oligonucleotide
  Target: ATXN1; (-) strand; PAM type: YTN; PAM sequence: CTT
caatgatcctcatctttgcc

SEQ ID NO: 174628 - DNA, 20 bp, Artificial Sequence
  Description of Artificial Sequence: Synthetic oligonucleotide
  Target: ATXN1; (-) strand; PAM type: YTN; PAM sequence: TTG
aacgtcttcaatgatcctca

SEQ ID NO: 174629 - DNA, 20 bp, Artificial Sequence
  Description of Artificial Sequence: Synthetic oligonucleotide
  Target: ATXN1; (-) strand; PAM type: YTN; PAM sequence: CTT
gaacgtcttcaatgatcctc

SEQ ID NO: 174630 - DNA, 20 bp, Artificial Sequence
  Description of Artificial Sequence: Synthetic oligonucleotide
  Target: ATXN1; (-) strand; PAM type: YTN; PAM sequence: TTA
tccttgaacgtcttcaatga

SEQ ID NO: 174631 - DNA, 20 bp, Artificial Sequence
  Description of Artificial Sequence: Synthetic oligonucleotide
  Target: ATXN1; (-) strand; PAM type: YTN; PAM sequence: TTA
attatccttgaacgtcttca

SEQ ID NO: 174632 - DNA, 20 bp, Artificial Sequence
  Description of Artificial Sequence: Synthetic oligonucleotide
  Target: ATXN1; (-) strand; PAM type: YTN; PAM sequence: TTT
aattatccttgaacgtcttc

SEQ ID NO: 174633 - DNA, 20 bp, Artificial Sequence
  Description of Artificial Sequence: Synthetic oligonucleotide
  Target: ATXN1; (-) strand; PAM type: YTN; PAM sequence: CTA
tgggcagaagtttaattatc

SEQ ID NO: 174634 - DNA, 20 bp, Artificial Sequence
  Description of Artificial Sequence: Synthetic oligonucleotide
  Target: ATXN1; (-) strand; PAM type: YTN; PAM sequence: CTC
ccccaggccagctatgggca

SEQ ID NO: 174635 - DNA, 20 bp, Artificial Sequence
  Description of Artificial Sequence: Synthetic oligonucleotide
  Target: ATXN1; (-) strand; PAM type: YTN; PAM sequence: TTC
tcccccaggccagctatggg

SEQ ID NO: 174636 - DNA, 20 bp, Artificial Sequence
  Description of Artificial Sequence: Synthetic oligonucleotide
  Target: ATXN1; (-) strand; PAM type: YTN; PAM sequence: TTT
ctcccccaggccagctatgg

SEQ ID NO: 174637 - DNA, 20 bp, Artificial Sequence
  Description of Artificial Sequence: Synthetic oligonucleotide
  Target: ATXN1; (-) strand; PAM type: YTN; PAM sequence: TTC
atttctcccccaggccagct

SEQ ID NO: 174638 - DNA, 20 bp, Artificial Sequence
  Description of Artificial Sequence: Synthetic oligonucleotide
  Target: ATXN1; (-) strand; PAM type: YTN; PAM sequence: CTA
cggtgacattcatttctccc

SEQ ID NO: 174639 - DNA, 20 bp, Artificial Sequence
  Description of Artificial Sequence: Synthetic oligonucleotide
  Target: ATXN1; (-) strand; PAM type: YTN; PAM sequence: CTG
tgagccagccacatccatac

SEQ ID NO: 174640 - DNA, 20 bp, Artificial Sequence
  Description of Artificial Sequence: Synthetic oligonucleotide
  Target: ATXN1; (-) strand; PAM type: YTN; PAM sequence: TTC
acactgtgagccagccacat

SEQ ID NO: 174641 - DNA, 20 bp, Artificial Sequence
  Description of Artificial Sequence: Synthetic oligonucleotide
  Target: ATXN1; (-) strand; PAM type: YTN; PAM sequence: CTT
cacactgtgagccagccaca

SEQ ID NO: 174642 - DNA, 20 bp, Artificial Sequence
  Description of Artificial Sequence: Synthetic oligonucleotide
  Target: ATXN1; (-) strand; PAM type: YTN; PAM sequence: CTC
ttcacactgtgagccagcca

SEQ ID NO: 174643 - DNA, 20 bp, Artificial Sequence
  Description of Artificial Sequence: Synthetic oligonucleotide
  Target: ATXN1; (-) strand; PAM type: YTN; PAM sequence: CTC
tcttcacactgtgagccagc

SEQ ID NO: 174644 - DNA, 20 bp, Artificial Sequence
  Description of Artificial Sequence: Synthetic oligonucleotide
  Target: ATXN1; (-) strand; PAM type: YTN; PAM sequence: TTC
tctcttcacactgtgagcca

SEQ ID NO: 174645 - DNA, 20 bp, Artificial Sequence
  Description of Artificial Sequence: Synthetic oligonucleotide
  Target: ATXN1; (-) strand; PAM type: YTN; PAM sequence: CTT
ctctcttcacactgtgagcc

SEQ ID NO: 174646 - DNA, 20 bp, Artificial Sequence
  Description of Artificial Sequence: Synthetic oligonucleotide
  Target: ATXN1; (-) strand; PAM type: YTN; PAM sequence: CTG
gaaacaaggtcttctctctt

SEQ ID NO: 174647 - DNA, 20 bp, Artificial Sequence
  Description of Artificial Sequence: Synthetic oligonucleotide
  Target: ATXN1; (-) strand; PAM type: YTN; PAM sequence: CTG
tgaatgactggaaacaaggt

SEQ ID NO: 174648 - DNA, 20 bp, Artificial Sequence
  Description of Artificial Sequence: Synthetic oligonucleotide
  Target: ATXN1; (-) strand; PAM type: YTN; PAM sequence: CTC
aacagggctgtgaatgactg

SEQ ID NO: 174649 - DNA, 20 bp, Artificial Sequence
  Description of Artificial Sequence: Synthetic oligonucleotide
  Target: ATXN1; (-) strand; PAM type: YTN; PAM sequence: TTA
ggcatgaaggtatatctcaa

SEQ ID NO: 174650 - DNA, 20 bp, Artificial Sequence
  Description of Artificial Sequence: Synthetic oligonucleotide
  Target: ATXN1; (-) strand; PAM type: YTN; PAM sequence: TTC
agagggtgaaggaattaggc

SEQ ID NO: 174651 - DNA, 20 bp, Artificial Sequence
  Description of Artificial Sequence: Synthetic oligonucleotide
  Target: ATXN1; (-) strand; PAM type: YTN; PAM sequence: CTT
cagagggtgaaggaattagg

SEQ ID NO: 174652 - DNA, 20 bp, Artificial Sequence
  Description of Artificial Sequence: Synthetic oligonucleotide
  Target: ATXN1; (-) strand; PAM type: YTN; PAM sequence: TTG
gacttcagagggtgaaggaa

SEQ ID NO: 174653 - DNA, 20 bp, Artificial Sequence
  Description of Artificial Sequence: Synthetic oligonucleotide
  Target: ATXN1; (-) strand; PAM type: YTN; PAM sequence: TTA
aataatgttggacttcagag

SEQ ID NO: 174654 - DNA, 20 bp, Artificial Sequence
  Description of Artificial Sequence: Synthetic oligonucleotide
  Target: ATXN1; (-) strand; PAM type: YTN; PAM sequence: TTA
tcaattaaataatgttggac

SEQ ID NO: 174655 - DNA, 20 bp, Artificial Sequence
  Description of Artificial Sequence: Synthetic oligonucleotide
  Target: ATXN1; (-) strand; PAM type: YTN; PAM sequence: CTT
atcaattaaataatgttgga

SEQ ID NO: 174656 - DNA, 20 bp, Artificial Sequence
  Description of Artificial Sequence: Synthetic oligonucleotide
  Target: ATXN1; (-) strand; PAM type: YTN; PAM sequence: TTA
aacacaaaggacaagatgat

SEQ ID NO: 174657 - DNA, 20 bp, Artificial Sequence
  Description of Artificial Sequence: Synthetic oligonucleotide
  Target: ATXN1; (-) strand; PAM type: YTN; PAM sequence: CTT
aaacacaaaggacaagatga

SEQ ID NO: 174658 - DNA, 20 bp, Artificial Sequence
  Description of Artificial Sequence: Synthetic oligonucleotide
  Target: ATXN1; (-) strand; PAM type: YTN; PAM sequence: TTA
ataagaacaacttaaacaca

SEQ ID NO: 174659 - DNA, 20 bp, Artificial Sequence
  Description of Artificial Sequence: Synthetic oligonucleotide
  Target: ATXN1; (-) strand; PAM type: YTN; PAM sequence: CTA
agggagataagacatacata

SEQ ID NO: 174660 - DNA, 20 bp, Artificial Sequence
  Description of Artificial Sequence: Synthetic oligonucleotide
  Target: ATXN1; (-) strand; PAM type: YTN; PAM sequence: CTA
ctaagggagataagacatac

SEQ ID NO: 174661 - DNA, 20 bp, Artificial Sequence
  Description of Artificial Sequence: Synthetic oligonucleotide
  Target: ATXN1; (-) strand; PAM type: YTN; PAM sequence: CTG
acaatctactaagggagata

SEQ ID NO: 174662 - DNA, 20 bp, Artificial Sequence
  Description of Artificial Sequence: Synthetic oligonucleotide
  Target: ATXN1; (-) strand; PAM type: YTN; PAM sequence: CTC
aagaagctgacaatctacta

SEQ ID NO: 174663 - DNA, 20 bp, Artificial Sequence
  Description of Artificial Sequence: Synthetic oligonucleotide
  Target: ATXN1; (-) strand; PAM type: YTN; PAM sequence: TTC
aagataacctcaagaagctg

SEQ ID NO: 174664 - DNA, 20 bp, Artificial Sequence
  Description of Artificial Sequence: Synthetic oligonucleotide
  Target: ATXN1; (-) strand; PAM type: YTN; PAM sequence: TTA
aaacattcaagataacctca

SEQ ID NO: 174665 - DNA, 20 bp, Artificial Sequence
  Description of Artificial Sequence: Synthetic oligonucleotide
  Target: ATXN1; (-) strand; PAM type: YTN; PAM sequence: CTG
agttaaaacattcaagataa

SEQ ID NO: 174666 - DNA, 20 bp, Artificial Sequence
  Description of Artificial Sequence: Synthetic oligonucleotide
  Target: ATXN1; (-) strand; PAM type: YTN; PAM sequence: CTA
agcaagatagtgcgagagag

SEQ ID NO: 174667 - DNA, 20 bp, Artificial Sequence
  Description of Artificial Sequence: Synthetic oligonucleotide
  Target: ATXN1; (-) strand; PAM type: YTN; PAM sequence: TTC
cctaagcaagatagtgcgag

SEQ ID NO: 174668 - DNA, 20 bp, Artificial Sequence
  Description of Artificial Sequence: Synthetic oligonucleotide
  Target: ATXN1; (-) strand; PAM type: YTN; PAM sequence: CTT
ccctaagcaagatagtgcga

SEQ ID NO: 174669 - DNA, 20 bp, Artificial Sequence
  Description of Artificial Sequence: Synthetic oligonucleotide
  Target: ATXN1; (-) strand; PAM type: YTN; PAM sequence: TTG
ggtgtcttccctaagcaaga

SEQ ID NO: 174670 - DNA, 20 bp, Artificial Sequence
  Description of Artificial Sequence: Synthetic oligonucleotide
  Target: ATXN1; (-) strand; PAM type: YTN; PAM sequence: TTA
ttgggtgtcttccctaagca

SEQ ID NO: 174671 - DNA, 20 bp, Artificial Sequence
  Description of Artificial Sequence: Synthetic oligonucleotide
  Target: ATXN1; (-) strand; PAM type: YTN; PAM sequence: TTT
attgggtgtcttccctaagc

SEQ ID NO: 174672 - DNA, 20 bp, Artificial Sequence
  Description of Artificial Sequence: Synthetic oligonucleotide
  Target: ATXN1; (-) strand; PAM type: YTN; PAM sequence: CTA
atatttattgggtgtcttcc

SEQ ID NO: 174673 - DNA, 20 bp, Artificial Sequence
  Description of Artificial Sequence: Synthetic oligonucleotide
  Target: ATXN1; (-) strand; PAM type: YTN; PAM sequence: TTC
aactaatatttattgggtgt

SEQ ID NO: 174674 - DNA, 20 bp, Artificial Sequence
  Description of Artificial Sequence: Synthetic oligonucleotide
  Target: ATXN1; (-) strand; PAM type: YTN; PAM sequence: CTT
caactaatatttattgggtg

SEQ ID NO: 174675 - DNA, 20 bp, Artificial Sequence
  Description of Artificial Sequence: Synthetic oligonucleotide
  Target: ATXN1; (-) strand; PAM type: YTN; PAM sequence: TTG
gtcatgtcttcaactaatat

SEQ ID NO: 174676 - DNA, 20 bp, Artificial Sequence
  Description of Artificial Sequence: Synthetic oligonucleotide
  Target: ATXN1; (-) strand; PAM type: YTN; PAM sequence: CTT
ggtcatgtcttcaactaata

SEQ ID NO: 174677 - DNA, 20 bp, Artificial Sequence
  Description of Artificial Sequence: Synthetic oligonucleotide
  Target: ATXN1; (-) strand; PAM type: YTN; PAM sequence: TTC
atgcacttggtcatgtcttc

SEQ ID NO: 174678 - DNA, 20 bp, Artificial Sequence
  Description of Artificial Sequence: Synthetic oligonucleotide
  Target: ATXN1; (-) strand; PAM type: YTN; PAM sequence: CTT
catgcacttggtcatgtctt

SEQ ID NO: 174679 - DNA, 20 bp, Artificial Sequence
  Description of Artificial Sequence: Synthetic oligonucleotide
  Target: ATXN1; (-) strand; PAM type: YTN; PAM sequence: CTA
tacagtacttcatgcacttg

SEQ ID NO: 174680 - DNA, 20 bp, Artificial Sequence
  Description of Artificial Sequence: Synthetic oligonucleotide
  Target: ATXN1; (-) strand; PAM type: YTN; PAM sequence: TTA
gcaagcctatacagtacttc

SEQ ID NO: 174681 - DNA, 20 bp, Artificial Sequence
  Description of Artificial Sequence: Synthetic oligonucleotide
  Target: ATXN1; (-) strand; PAM type: YTN; PAM sequence: TTT
agcaagcctatacagtactt

SEQ ID NO: 174682 - DNA, 20 bp, Artificial Sequence
  Description of Artificial Sequence: Synthetic oligonucleotide
  Target: ATXN1; (-) strand; PAM type: YTN; PAM sequence: TTA
tttagcaagcctatacagta

SEQ ID NO: 174683 - DNA, 20 bp, Artificial Sequence
  Description of Artificial Sequence: Synthetic oligonucleotide
  Target: ATXN1; (-) strand; PAM type: YTN; PAM sequence: CTT
atttagcaagcctatacagt

SEQ ID NO: 174684 - DNA, 20 bp, Artificial Sequence
  Description of Artificial Sequence: Synthetic oligonucleotide
  Target: ATXN1; (-) strand; PAM type: YTN; PAM sequence: CTG
cccttatttagcaagcctat

SEQ ID NO: 174685 - DNA, 20 bp, Artificial Sequence
  Description of Artificial Sequence: Synthetic oligonucleotide
  Target: ATXN1; (-) strand; PAM type: YTN; PAM sequence: TTA
ctgcccttatttagcaagcc

SEQ ID NO: 174686 - DNA, 20 bp, Artificial Sequence
  Description of Artificial Sequence: Synthetic oligonucleotide
  Target: ATXN1; (-) strand; PAM type: YTN; PAM sequence: TTT
actgcccttatttagcaagc

SEQ ID NO: 174687 - DNA, 20 bp, Artificial Sequence
  Description of Artificial Sequence: Synthetic oligonucleotide
  Target: ATXN1; (-) strand; PAM type: YTN; PAM sequence: TTT
tactgcccttatttagcaag

SEQ ID NO: 174688 - DNA, 20 bp, Artificial Sequence
  Description of Artificial Sequence: Synthetic oligonucleotide
  Target: ATXN1; (-) strand; PAM type: YTN; PAM sequence: TTT
ttactgcccttatttagcaa

SEQ ID NO: 174689 - DNA, 20 bp, Artificial Sequence
  Description of Artificial Sequence: Synthetic oligonucleotide
  Target: ATXN1; (-) strand; PAM type: YTN; PAM sequence: CTA
caagatccaatggcattttt

SEQ ID NO: 174690 - DNA, 20 bp, Artificial Sequence
  Description of Artificial Sequence: Synthetic oligonucleotide
  Target: ATXN1; (-) strand; PAM type: YTN; PAM sequence: TTG
cctacaagatccaatggcat

SEQ ID NO: 174691 - DNA, 20 bp, Artificial Sequence
  Description of Artificial Sequence: Synthetic oligonucleotide
  Target: ATXN1; (-) strand; PAM type: YTN; PAM sequence: TTT
gcctacaagatccaatggca

SEQ ID NO: 174692 - DNA, 20 bp, Artificial Sequence
  Description of Artificial Sequence: Synthetic oligonucleotide
  Target: ATXN1; (-) strand; PAM type: YTN; PAM sequence: CTC
agaatttgcctacaagatcc

SEQ ID NO: 174693 - DNA, 20 bp, Artificial Sequence
  Description of Artificial Sequence: Synthetic oligonucleotide
  Target: ATXN1; (-) strand; PAM type: YTN; PAM sequence: TTA
caacctcagaatttgcctac

SEQ ID NO: 174694 - DNA, 20 bp, Artificial Sequence
  Description of Artificial Sequence: Synthetic oligonucleotide
  Target: ATXN1; (-) strand; PAM type: YTN; PAM sequence: TTC
atccgttacaacctcagaat

SEQ ID NO: 174695 - DNA, 20 bp, Artificial Sequence
  Description of Artificial Sequence: Synthetic oligonucleotide
  Target: ATXN1; (-) strand; PAM type: YTN; PAM sequence: TTT
catccgttacaacctcagaa

SEQ ID NO: 174696 - DNA, 20 bp, Artificial Sequence
  Description of Artificial Sequence: Synthetic oligonucleotide
  Target: ATXN1; (-) strand; PAM type: YTN; PAM sequence: TTA
atttcatccgttacaacctc

SEQ ID NO: 174697 - DNA, 20 bp, Artificial Sequence
  Description of Artificial Sequence: Synthetic oligonucleotide
  Target: ATXN1; (-) strand; PAM type: YTN; PAM sequence: TTA
tattaatttcatccgttaca

SEQ ID NO: 174698 - DNA, 20 bp, Artificial Sequence
  Description of Artificial Sequence: Synthetic oligonucleotide
  Target: ATXN1; (-) strand; PAM type: YTN; PAM sequence: TTT
atattaatttcatccgttac

SEQ ID NO: 174699 - DNA, 20 bp, Artificial Sequence
  Description of Artificial Sequence: Synthetic oligonucleotide
  Target: ATXN1; (-) strand; PAM type: YTN; PAM sequence: TTC
agtgaatcaacatttatatt

SEQ ID NO: 174700 - DNA, 20 bp, Artificial Sequence
  Description of Artificial Sequence: Synthetic oligonucleotide
  Target: ATXN1; (-) strand; PAM type: YTN; PAM sequence: TTC
acaattcagtgaatcaacat

SEQ ID NO: 174701 - DNA, 20 bp, Artificial Sequence
  Description of Artificial Sequence: Synthetic oligonucleotide
  Target: ATXN1; (-) strand; PAM type: YTN; PAM sequence: CTA
tagttcacaattcagtgaat

SEQ ID NO: 174702 - DNA, 20 bp, Artificial Sequence
  Description of Artificial Sequence: Synthetic oligonucleotide
  Target: ATXN1; (-) strand; PAM type: YTN; PAM sequence: TTC
tatagttcacaattcagtga

SEQ ID NO: 174703 - DNA, 20 bp, Artificial Sequence
  Description of Artificial Sequence: Synthetic oligonucleotide
  Target: ATXN1; (-) strand; PAM type: YTN; PAM sequence: TTC
atattctatagttcacaatt

SEQ ID NO: 174704 - DNA, 20 bp, Artificial Sequence
  Description of Artificial Sequence: Synthetic oligonucleotide
  Target: ATXN1; (-) strand; PAM type: YTN; PAM sequence: TTG
acagggttcatattctatag

SEQ ID NO: 174705 - DNA, 20 bp, Artificial Sequence
  Description of Artificial Sequence: Synthetic oligonucleotide
  Target: ATXN1; (-) strand; PAM type: YTN; PAM sequence: CTA
ttgacagggttcatattcta

SEQ ID NO: 174706 - DNA, 20 bp, Artificial Sequence
  Description of Artificial Sequence: Synthetic oligonucleotide
  Target: ATXN1; (-) strand; PAM type: YTN; PAM sequence: CTC
ctattgacagggttcatatt

SEQ ID NO: 174707 - DNA, 20 bp, Artificial Sequence
  Description of Artificial Sequence: Synthetic oligonucleotide
  Target: ATXN1; (-) strand; PAM type: YTN; PAM sequence: TTC
tcctattgacagggttcata

SEQ ID NO: 174708 - DNA, 20 bp, Artificial Sequence
  Description of Artificial Sequence: Synthetic oligonucleotide
  Target: ATXN1; (-) strand; PAM type: YTN; PAM sequence: TTT
ctcctattgacagggttcat

SEQ ID NO: 174709 - DNA, 20 bp, Artificial Sequence
  Description of Artificial Sequence: Synthetic oligonucleotide
  Target: ATXN1; (-) strand; PAM type: YTN; PAM sequence: TTA
gaaaggtttctcctattgac

SEQ ID NO: 174710 - DNA, 20 bp, Artificial Sequence
  Description of Artificial Sequence: Synthetic oligonucleotide
  Target: ATXN1; (-) strand; PAM type: YTN; PAM sequence: TTT
agaaaggtttctcctattga

SEQ ID NO: 174711 - DNA, 20 bp, Artificial Sequence
  Description of Artificial Sequence: Synthetic oligonucleotide
  Target: ATXN1; (-) strand; PAM type: YTN; PAM sequence: TTT
tagaaaggtttctcctattg

SEQ ID NO: 174712 - DNA, 20 bp, Artificial Sequence
  Description of Artificial Sequence: Synthetic oligonucleotide
  Target: ATXN1; (-) strand; PAM type: YTN; PAM sequence: CTT
ttagaaaggtttctcctatt

SEQ ID NO: 174713 - DNA, 20 bp, Artificial Sequence
  Description of Artificial Sequence: Synthetic oligonucleotide
  Target: ATXN1; (-) strand; PAM type: YTN; PAM sequence: CTA
aaaacatgcacaacaaagaa

SEQ ID NO: 174714 - DNA, 20 bp, Artificial Sequence
  Description of Artificial Sequence: Synthetic oligonucleotide
  Target: ATXN1; (-) strand; PAM type: YTN; PAM sequence: CTG
aatccctaaaaacatgcaca

SEQ ID NO: 174715 - DNA, 20 bp, Artificial Sequence
  Description of Artificial Sequence: Synthetic oligonucleotide
  Target: ATXN1; (-) strand; PAM type: YTN; PAM sequence: CTG
gactgaatccctaaaaacat

SEQ ID NO: 174716 - DNA, 20 bp, Artificial Sequence
  Description of Artificial Sequence: Synthetic oligonucleotide
  Target: ATXN1; (-) strand; PAM type: YTN; PAM sequence: TTC
tggactgaatccctaaaaac

SEQ ID NO: 174717 - DNA, 20 bp, Artificial Sequence
  Description of Artificial Sequence: Synthetic oligonucleotide
  Target: ATXN1; (-) strand; PAM type: YTN; PAM sequence: TTC
cgggtgaaagttctggactg

SEQ ID NO: 174718 - DNA, 20 bp, Artificial Sequence
  Description of Artificial Sequence: Synthetic oligonucleotide
  Target: ATXN1; (-) strand; PAM type: YTN; PAM sequence: TTT
ccgggtgaaagttctggact

SEQ ID NO: 174719 - DNA, 20 bp, Artificial Sequence
  Description of Artificial Sequence: Synthetic oligonucleotide
  Target: ATXN1; (-) strand; PAM type: YTN; PAM sequence: TTG
agtttccgggtgaaagttct

SEQ ID NO: 174720 - DNA, 20 bp, Artificial Sequence
  Description of Artificial Sequence: Synthetic oligonucleotide
  Target: ATXN1; (-) strand; PAM type: YTN; PAM sequence: TTT
gagtttccgggtgaaagttc

SEQ ID NO: 174721 - DNA, 20 bp, Artificial Sequence
  Description of Artificial Sequence: Synthetic oligonucleotide
  Target: ATXN1; (-) strand; PAM type: YTN; PAM sequence: TTT
tgagtttccgggtgaaagtt

SEQ ID NO: 174722 - DNA, 20 bp, Artificial Sequence
  Description of Artificial Sequence: Synthetic oligonucleotide
  Target: ATXN1; (-) strand; PAM type: YTN; PAM sequence: TTG
ttttgagtttccgggtgaaa

SEQ ID NO: 174723 - DNA, 20 bp, Artificial Sequence
  Description of Artificial Sequence: Synthetic oligonucleotide
  Target: ATXN1; (-) strand; PAM type: YTN; PAM sequence: CTT
gttttgagtttccgggtgaa

SEQ ID NO: 174724 - DNA, 20 bp, Artificial Sequence
  Description of Artificial Sequence: Synthetic oligonucleotide
  Target: ATXN1; (-) strand; PAM type: YTN; PAM sequence: TTC
ttgttttgagtttccgggtg

SEQ ID NO: 174725 - DNA, 20 bp, Artificial Sequence
  Description of Artificial Sequence: Synthetic oligonucleotide
  Target: ATXN1; (-) strand; PAM type: YTN; PAM sequence: TTT
cttgttttgagtttccgggt

SEQ ID NO: 174726 - DNA, 20 bp, Artificial Sequence
  Description of Artificial Sequence: Synthetic oligonucleotide
  Target: ATXN1; (-) strand; PAM type: YTN; PAM sequence: CTA
aatttcttgttttgagtttc

SEQ ID NO: 174727 - DNA, 20 bp, Artificial Sequence
  Description of Artificial Sequence: Synthetic oligonucleotide
  Target: ATXN1; (-) strand; PAM type: YTN; PAM sequence: TTC
aaactaaatttcttgttttg

SEQ ID NO: 174728 - DNA, 20 bp, Artificial Sequence
  Description of Artificial Sequence: Synthetic oligonucleotide
  Target: ATXN1; (-) strand; PAM type: YTN; PAM sequence: TTT
caaactaaatttcttgtttt

SEQ ID NO: 174729 - DNA, 20 bp, Artificial Sequence
  Description of Artificial Sequence: Synthetic oligonucleotide
  Target: ATXN1; (-) strand; PAM type: YTN; PAM sequence: TTA
tttcaaactaaatttcttgt

SEQ ID NO: 174730 - DNA, 20 bp, Artificial Sequence
  Description of Artificial Sequence: Synthetic oligonucleotide
  Target: ATXN1; (-) strand; PAM type: YTN; PAM sequence: TTT
atttcaaactaaatttcttg

SEQ ID NO: 174731 - DNA, 20 bp, Artificial Sequence
  Description of Artificial Sequence: Synthetic oligonucleotide
  Target: ATXN1; (-) strand; PAM type: YTN; PAM sequence: CTG
atttatttcaaactaaattt

SEQ ID NO: 174732 - DNA, 20 bp, Artificial Sequence
  Description of Artificial Sequence: Synthetic oligonucleotide
  Target: ATXN1; (-) strand; PAM type: YTN; PAM sequence: TTA
agacctgatttatttcaaac

SEQ ID NO: 174733 - DNA, 20 bp, Artificial Sequence
  Description of Artificial Sequence: Synthetic oligonucleotide
  Target: ATXN1; (-) strand; PAM type: YTN; PAM sequence: TTG
ttaagacctgatttatttca

SEQ ID NO: 174734 - DNA, 20 bp, Artificial Sequence
  Description of Artificial Sequence: Synthetic oligonucleotide
  Target: ATXN1; (-) strand; PAM type: YTN; PAM sequence: CTT
gttaagacctgatttatttc

SEQ ID NO: 174735 - DNA, 20 bp, Artificial Sequence
  Description of Artificial Sequence: Synthetic oligonucleotide
  Target: ATXN1; (-) strand; PAM type: YTN; PAM sequence: CTC
acttgttaagacctgattta

SEQ ID NO: 174736 - DNA, 20 bp, Artificial Sequence
  Description of Artificial Sequence: Synthetic oligonucleotide
  Target: ATXN1; (-) strand; PAM type: YTN; PAM sequence: CTC
tcacttgttaagacctgatt

SEQ ID NO: 174737 - DNA, 20 bp, Artificial Sequence
  Description of Artificial Sequence: Synthetic oligonucleotide
  Target: ATXN1; (-) strand; PAM type: YTN; PAM sequence: TTA
atagtctctcacttgttaag

SEQ ID NO: 174738 - DNA, 20 bp, Artificial Sequence
  Description of Artificial Sequence: Synthetic oligonucleotide
  Target: ATXN1; (-) strand; PAM type: YTN; PAM sequence: CTT
aatagtctctcacttgttaa

SEQ ID NO: 174739 - DNA, 20 bp, Artificial Sequence
  Description of Artificial Sequence: Synthetic oligonucleotide
  Target: ATXN1; (-) strand; PAM type: YTN; PAM sequence: TTA
atcttaatagtctctcactt

SEQ ID NO: 174740 - DNA, 20 bp, Artificial Sequence
  Description of Artificial Sequence: Synthetic oligonucleotide
  Target: ATXN1; (-) strand; PAM type: YTN; PAM sequence: CTG
ttaatcttaatagtctctca

SEQ ID NO: 174741 - DNA, 20 bp, Artificial Sequence
  Description of Artificial Sequence: Synthetic oligonucleotide
  Target: ATXN1; (-) strand; PAM type: YTN; PAM sequence: CTG
tccaagacagtctgttaatc

SEQ ID NO: 174742 - DNA, 20 bp, Artificial Sequence
  Description of Artificial Sequence: Synthetic oligonucleotide
  Target: ATXN1; (-) strand; PAM type: YTN; PAM sequence: TTA
gatgataagggacacgcagg

SEQ ID NO: 174743 - DNA, 20 bp, Artificial Sequence
  Description of Artificial Sequence: Synthetic oligonucleotide
  Target: ATXN1; (-) strand; PAM type: YTN; PAM sequence: TTT
agatgataagggacacgcag

SEQ ID NO: 174744 - DNA, 20 bp, Artificial Sequence
  Description of Artificial Sequence: Synthetic oligonucleotide
  Target: ATXN1; (-) strand; PAM type: YTN; PAM sequence: CTT
tagatgataagggacacgca

SEQ ID NO: 174745 - DNA, 20 bp, Artificial Sequence
  Description of Artificial Sequence: Synthetic oligonucleotide
  Target: ATXN1; (-) strand; PAM type: YTN; PAM sequence: CTA
gtagtaaccctttagatgat

SEQ ID NO: 174746 - DNA, 20 bp, Artificial Sequence
  Description of Artificial Sequence: Synthetic oligonucleotide
  Target: ATXN1; (-) strand; PAM type: YTN; PAM sequence: CTG
agataaagcagaaaaggatg

SEQ ID NO: 174747 - DNA, 20 bp, Artificial Sequence
  Description of Artificial Sequence: Synthetic oligonucleotide
  Target: ATXN1; (-) strand; PAM type: YTN; PAM sequence: CTC
tgagataaagcagaaaagga

SEQ ID NO: 174748 - DNA, 20 bp, Artificial Sequence
  Description of Artificial Sequence: Synthetic oligonucleotide
  Target: ATXN1; (-) strand; PAM type: YTN; PAM sequence: TTA
atgggcctctgagataaagc

SEQ ID NO: 174749 - DNA, 20 bp, Artificial Sequence
  Description of Artificial Sequence: Synthetic oligonucleotide
  Target: ATXN1; (-) strand; PAM type: YTN; PAM sequence: TTT
aatgggcctctgagataaag

SEQ ID NO: 174750 - DNA, 20 bp, Artificial Sequence
  Description of Artificial Sequence: Synthetic oligonucleotide
  Target: ATXN1; (-) strand; PAM type: YTN; PAM sequence: CTT
taatgggcctctgagataaa

SEQ ID NO: 174751 - DNA, 20 bp, Artificial Sequence
  Description of Artificial Sequence: Synthetic oligonucleotide
  Target: ATXN1; (-) strand; PAM type: YTN; PAM sequence: TTA
catgctttaatgggcctctg

SEQ ID NO: 174752 - DNA, 20 bp, Artificial Sequence
  Description of Artificial Sequence: Synthetic oligonucleotide
  Target: ATXN1; (-) strand; PAM type: YTN; PAM sequence: CTG
gttacatgctttaatgggcc
